United States Patent 9,518,277 (GENETICALLY ENGINEERED MICROBIAL STRAINS INCLUDING CHLORELLA PROTOTHECOIDES LIPID PATHWAY GENES) - sequence listing, part 10

SEQ ID NO: 36651 - DNA, 56920 bp, Chlorella protothecoides
  modified_base (647)..(656): a, c, t, g, unknown or other
  modified_base (724)..(736): a, c, t, g, unknown or other
  modified_base (1091)..(1100): a, c, t, g, unknown or other
  modified_base (1868)..(1877): a, c, t, g, unknown or other
  modified_base (2450)..(2459): a, c, t, g, unknown or other
  modified_base (2971)..(2980): a, c, t, g, unknown or other
  modified_base (3035)..(3044): a, c, t, g, unknown or other
  modified_base (3638)..(3647): a, c, t, g, unknown or other
  modified_base (4495)..(4504): a, c, t, g, unknown or other
  modified_base (4965)..(5072): a, c, t, g, unknown or other
  modified_base (5176)..(5185): a, c, t, g, unknown or other
  modified_base (6168)..(6177): a, c, t, g, unknown or other
  modified_base (6475)..(6484): a, c, t, g, unknown or other
  modified_base (7028)..(7053): a, c, t, g, unknown or other
  modified_base (7257)..(7266): a, c, t, g, unknown or other
  modified_base (8500)..(8509): a, c, t, g, unknown or other
  modified_base (8965)..(8974): a, c, t, g, unknown or other
  modified_base (10454)..(10463): a, c, t, g, unknown or other
  modified_base (12554)..(12563): a, c, t, g, unknown or other
  modified_base (13409)..(13418): a, c, t, g, unknown or other
  modified_base (13843)..(13852): a, c, t, g, unknown or other
  modified_base (14162)..(14218): a, c, t, g, unknown or other
  modified_base (17648)..(17657): a, c, t, g, unknown or other
  modified_base (18075)..(18084): a, c, t, g, unknown or other
  modified_base (18153)..(18162): a, c, t, g, unknown or other
  modified_base (18497)..(18506): a, c, t, g, unknown or other
  modified_base (18590)..(18681): a, c, t, g, unknown or other
  modified_base (19408)..(19417): a, c, t, g, unknown or other
  modified_base (20499)..(20508): a, c, t, g, unknown or other
  modified_base (22117)..(22126): a, c, t, g, unknown or other
  modified_base (22514)..(22523): a, c, t, g, unknown or other
  modified_base (23099)..(23108): a, c, t, g, unknown or other
  modified_base (23655)..(23742): a, c, t, g, unknown or other
  modified_base (23797)..(23806): a, c, t, g, unknown or other
  modified_base (25056)..(25065): a, c, t, g, unknown or other
  modified_base (25151)..(25160): a, c, t, g, unknown or other
  modified_base (25341)..(25350): a, c, t, g, unknown or other
  modified_base (25981)..(25990): a, c, t, g, unknown or other
  modified_base (27513)..(27522): a, c, t, g, unknown or other
  modified_base (28360)..(28369): a, c, t, g, unknown or other
  modified_base (30662)..(30671): a, c, t, g, unknown or other
  modified_base (31004)..(31013): a, c, t, g, unknown or other
  modified_base (31535)..(31544): a, c, t, g, unknown or other
  modified_base (31605)..(31614): a, c, t, g, unknown or other
  modified_base (34031)..(34040): a, c, t, g, unknown or other
  modified_base (34214)..(34223): a, c, t, g, unknown or other
  modified_base (35188)..(35197): a, c, t, g, unknown or other
  modified_base (35737)..(35746): a, c, t, g, unknown or other
  modified_base (36196)..(36205): a, c, t, g, unknown or other
  modified_base (38781)..(38790): a, c, t, g, unknown or other
  modified_base (39290)..(39299): a, c, t, g, unknown or other
  modified_base (39819)..(39828): a, c, t, g, unknown or other
  modified_base (39952)..(39961): a, c, t, g, unknown or other
  modified_base (40026)..(40035): a, c, t, g, unknown or other
  modified_base (40263)..(40272): a, c, t, g, unknown or other
  modified_base (40355)..(40364): a, c, t, g, unknown or other
  modified_base (41049)..(41058): a, c, t, g, unknown or other
  modified_base (45041)..(45050): a, c, t, g, unknown or other
  modified_base (46368)..(46377): a, c, t, g, unknown or other
  modified_base (48048)..(48057): a, c, t, g, unknown or other
  modified_base (50840)..(50849): a, c, t, g, unknown or other
  modified_base (51814)..(51823): a, c, t, g, unknown or other
  modified_base (52631)..(52640): a, c, t, g, unknown or other
  modified_base (55176)..(55185): a, c, t, g, unknown or other
  modified_base (56616)..(56625): a, c, t, g, unknown or other
  modified_base (56835)..(56844): a, c, t, g, unknown or other
ggggggggggatgtgtgcggcacagggaatgcggagcgctgttgcatgcgttcctaggaccgcgacgggcgacgatactcagccccttgcgcatcgccgcagggggagcggggctggagtggcgaccgactgcctcagctgcactcgtctgcatgcccctgctggctgcccgactaggctcccttcctgaccgtcgcccatacgatcacactcacctactctcatccacccccctcccgcctcccccgatgaacaaacccaactcctcctctcccaccgtccccccacctcgtccagcaggcgttccttgagcagctcaaaggcggcgatgtccacgccggcgtagggcaggatgccgatcatggagggcacgatgccgcggtagaaggcgcgcacgccctcctggcgcagcactttgccagcgcagtcgaagatgccgccgtaggtgccgctggggcagaccgccagccgggtgcgcaccaactccagggggtagatgagggcctgttgttggggagggttgcaagactttctattgtgggaggtggcgtggaggaggggtctggggttggtgcagggccaaggacactccgctccagctgaatagggccatcccatctcaccctggcccctcatccttctcctcnnnnnnnnnngctttttatcgtgggaggtggcgtggaggaggggtcgggggttggtgcagggccaaggacactccgcnnnnnnnnnnnnncaacgcccccgccagcatgcgctgagctggtgttatgtcgtcagggtcggacaccacagcatgcttaagcacatcgttcagcgtcagcttaatggccgtctccggcgcaatcttcaccacgttggtgccgttaccccggaagaaggccgacatggtgcctgggaatgcaggggaagaaatttccaatgagcatagtggagatcaggaacgtgcgcaatcaagagacacgcattgcagccccaagcggcgagggaggctccgctggccgtgccacagcccacaggcacacccgaccgcgctggaatgtgcccacttccccacaatgcacaccttcagccgccatctgcttgaagcnnnnnnnnnnacacaggcacacccgaccgcgctggaatgcgcccacctccccacaacgcacaccttcagccgccatctgcttgaagccctgccgcatggtcatgggtgttctgccctcctggatctgcagcagcatcttcagccggtctatcggggcagtggcggtcctgctcagtgccccggcaatgcctgcatggcatggggtggggtttggggccatgatatctagcaagcctggcagatgcagggcacacagagcgcaggcgctgcaggctggggctgcacttgtctgggcaacagcaccccagggcagcagcatgccagggccaatttgcatacaaatgtggctgccatcgagggaatgggggtctgcaagcagcgccccctccccacttctcccgcagaacctcactcctgtacacgcccacacggcatctccccgcacctccagacacgagcagcttggctgtgcgagccgggtcgaccacgtactcgtccacctcctcctcctgctcctccagcctccccccactgcgctcccaggccgcctgggaggccgcggcctccatggcggcctgggctgctatcagtgctgcaggctgcagggggaaggtgggggggtggggcccacgccaccccgccccccatggcacactccaggcgggggttgggcgcaggtgcagatgccgcccgctcgtggatgcctccgggggtggagaagtgcccgggggtgtcgtggcgtccgtactggaaccaggggtaccgaggcctggtgcannnnnnnnnntgtggatgcctccgggggtggggaagtgccggggggtgtcgtggcgtccgtgctggaaccaggggtaccgaggcctggtgcaggctcgattcgaggattagcgccccagattcataataaatgggatggcatgctggaggcagacggcacgcactttgctgtcttcgcgcttgttgcgacacgggaggtctgggcgctagaacctcacacaccgatgccaatcaaacaaaccagttcagacttgaaacaagtatgtgatagatggtcacattcagggtcgaggtttcgggctctaaaaagtatgggaccctgacattaccaacgttattttcgagcacctaacggagggagggtactgcagtccccagcagctctataccgcctaatgcaacctcatcagaattcacacttgcaatttcagggatgggacacatctttgcattagaatggttcttcacactgattttggctggagttgaatggtgtctggaagccaggatcatctgcactgattcttctgatttgtatgctgctgaatcacttgctggccaggggttgttgggagtacccaannnnnnnnnngtttcagagaagggacacatctttgcattagaatgtttcttcacactgattttggctggagttgaatagtgtctggaagccaggatcatctgcactaattcttctgatttgtatgctgctgtatcacatgctggccaggggttgttgggagtacccaagcagcttttcacatagtgttgtgaacgtactcagacttgtaaatatgagtgtcagcagcgcattgactatgatattgagtcgcctacttgctagattcactgactgcacccaacatcttgttgccacgtcggatgtcaaacatgtgttcaaaacaccataatatgaaaatggctcggcagactcgcgcgacggcgtccctgccgcatgctccagctcttcgggaccctcgatttgagtgattgacttggcctctgtggtctactggtattcctctggtgcccggggatgacgcacggcggaccatgacacggcacccccccccgacgctgctttcacttcgcgatgcttagggnnnnnnnnnnaaacgtactcggacatttaaacacgagtgtcagcagcgcattgactatgatattnnnnnnnnnnattggcctctgcggtctactgatattcctctggtgcccgtggacgacgcacggcgggccatgacacggcaccccccccggacgctgctttcacttcgcgatgcttaggggccaacggggttccgcatctccgctcctccctacgagagtcgatagcagggcgccaggacgcagagcgagagggagttcgatacgatggccggtccttctcatcgccctgtttggcctcgggctcctgggcctcaggcatcaagtgcgcgtcatgccgctcaaaacttcatataccagctgccttgtggccgacatgtctgtgactgcacggatcaaagggagtcagcaattctgggttggggagggtgggtgccatggttgacagcatgtattcatcgatctggcacccctcccatgcagagtcagctctcctcggcttcaggagggcattttgccacgagccaggtggggcaggatgtttgatcctgatgggatgagtcaccgtgctgcgctccgtccctcaccagtcccaccgacttacctgtgcgtccggagacgagcataatctgctcagtcaccctgccaaccccatttccacccacannnnnnnnnnccccaccgacttacctgtgcgtctggagacgagcgtgatctgctcggtcaccctgccaaccccatttccacccacacctcagcaagctgacactcaggcagctgttctcgagcagccctgccatggagcaggctgccctgagcctgtccagggggcccaagacacccctcccacccgacagctgattgccgcagtgcgggaggctgccggaatgctcctgcacccgccggctgtcccttcccccccgcccccccccaagcaccccacgcccatccatgcccccccctacaacgcgggtctggtggcgggggtggcagcgctgatcaacgaggccgatgccggtgcgcaacagggagttgctcgatctatcggcttcgtttggtccgtctggctccagcgcagaccaccatgtcccaaccctctcgcacagctgcgtggccggttctagcaattttgcttccctgcacaatcacggccctgcacttggaccgcgatgaccggaaccccccgtgtgccacccccttgcagtggtgcggcagcgggacatcgacaccgacattgacgccacggcgcggcgcctcgccgccgacgccgccgccctggacctcaccacctccgatcaggtgagcggggcgaggtgacacttccgccggcagccatcccagactcctgcagatgtgcgctgcggcagcgcggcgggcgatcttggtgctgccaagcatgccgcgcatcactcccattctgagaccttgccagtggcggtgctgcggacacagccgtcaaccccctcgacaaccccctccccatgcacgcgcttcaggaagaggcgctgggcgaggcagggcccnnnnnnnnnntcccttcgtcaacccccctccccatgcacgcgctccaggaagaggcgctgggcgaggcagggcccgggggcctccccctcgacccggtgtgcatctcccccgcggagtgcggcccgcacggcgcctgcgaggcggggcggtgccgctgtgtggtgctgtacaccggggtcgtgtgcgggcacgccctggtgctcagccccacgctgctcgcgccggggctgccccgcttcgtgcccgcctacgagggcgagctgatgctgcacgcgcagacgcggcacgccgacatccgcgtgctgcgccccggccccacgctcgagtgggacctgctggccgacgcggccgagacggcggcgctgaaccgcatcctcccgccctccgacctggtgttcaaggtgcaggggtgggtctgtgtggtggaggggttggggtggggggggaaacatgaggtggggagggtgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacttccgtatctccaatccccgaacaccctctgttcaatcaccaccgtctcatccccctttcccccccattcaaaaacaaactgcccatgtttgcagagcnnnnnnnnnngagacttccgtatctccaatccccgagcaccctctgttcagtcaccaccgtctcatcactctttcccccccactcaaaaacaaactgcccatgtttgcagagcaaggcgtacccgacctgcgcggtggtgggctcctctggctccctcctcctgcgccgcctgggccccgccatcgacgcccatgtgctggtcctgcgcctgggcgccacgcccagcgcagggcacgaggcctcgctggggtccaagaccaacctgcgcatgaccgacgagcgcgactgggcctggcgcgagcggccggaggacctggccctggtgcgcagcgccagccgcgccactgtcacgggcctgctggccaacgcggcctcgcccgcgccggccgccatcgtcgcgctcgacccggactttgagtcctggctggccgatgggctgggcttcgcggccgacctggagctggcggggacgctgctggcgctgcagacctgccgcgccgtgacgctgtacggcctggcgccgcaggggccggcgcagggcgtgccggaggcgtaccacgagccttgcaagccggcggtgggcacgacgggcgacccgccgggcggcgccgcggcgcgctgggcggcgctccaggccctggctcgcgtgggcctggtggcctggggcgagccctgcgtggaggagtgcatggccgcaccggccgcctgcgatacatgtcgagcggcgctgggcatcgtgccgaagcccgtcgacgcctggtgcgagtcggcgcgggcggcagggcgcccgccggcggaggaggcaccgggcggtggcgcggcgggggggggccgaggcaatggcaccgccgtggggaacgagagtgcagcggcagggtcgggacagggcgcagcggccaagacggagcacaacagcacggcggcggcgacgaccacccggcgatgacgtcgcggggagccggacgctggcggcggcgtttcgagtgtgcagnnnnnnnnnnagcgacgaccacccggcgatgacatcgcggggcgccagacgctggcggcggcgtttcgagtgtgcagccatggcgctgccttgttgagaacccggcatcgatgtgggcccagcaatgcatgcgtcgcatgagtctgcgtggcacgtgcaagccggagcccgagtgtgttcgccgcttgcgcttcaaggaccgcgagagcccgcctcagaaccttctaaaacccattcccaatcccctgtcgcacgctgtcgaagacagggccatacgaagggcaacggcccgggccacgcccaccgannnnnnnnnntgccgcttgcgcttcaaggaccgcgagagcacgcctcagaacctttccaaacccattcccaatcccctctcgcacgctgtcaaagacagtgccatgcaaagggcaacggcccgggccacgcccaccgagggtgtgtgcgacgttgttacagaagagtcagcaaagagaatctacagcgatttcaatgcagcgagcgtcctgcccgccgcccttcccacctccggtcgtcagaacaagttcagggcggtggccgccgcgaagacgaggaacaggatgccgctggtgtaccccaccgtcttctcgctgacgtggcgcgacagcagggcgccggcggtgaccgcgatcagcgtagccgccgcgtgccctgccaccgcgccgccggccacgccccagggagcctggaccgcgcccagagcgatggtggccagcatggacctgtcaccccactccgccacgaagatgaggctggccacctccaggatgccgcgccaggagccgcgcgcactgatcttgccggtctgcaccgccacgtccactgcgatgnnnnnnnnnnnnnnnnnnnnnnnnnngtcttttaaaacgcaggggggtgattcccggtgccgagaggttggcaccaggaggaatgcacaaggtctatagaccctccgcagccgtgcttgggccacaaactggaacccccccccctagtctccccaccgaatcacacgcacgcgacttctctgcatccttctcctcgtccgcccgcttctcctccgactgccaggcgtccnnnnnnnnnncagaccctccgcagccgtgcttgggtcacaaactggacaccccccccccccttaatctccccaccaaatcacacgcacgcgacttctctgcgtccttctcctcgtctgcccgcttctcctccgactgccaggcgtccagcagggtacggatgccaaagaaagcgaggagcgcagcgcccaaccattggcccaggaactccgtggtctcgatgctggcgggcacgcgcttcaccacatacccaatgcccacagaaatcgctgtcatcagggacagggccaggagggagcctgagggggggttggaggagcagggggttgggtattgggcggctggaggatgagcgtgcggtttttaaaggtgactataagatcccagggtgtatagagctggtcacgtgagcatgatgcagaaccagcagcatgcattaataccttggtgcgttgctatgtggcagacacaggcgccatctggggtggccagctcccccccccccacacacacacacaacactcacccacaaagctgatggccttgccgaggcgcatggccagcatggcggcaatgaaaaaggtcttgtctcccagctctgaggtgaagatgagactgaaggccgccaggaagccggagcgggcaaagcctgaccgagccagcgcagtacgcgtggcctccagccaggcgctccccacctccgactggaacagccatcggtaacccaccacgcccaatgcccccagcaccaggagagcaacgacgcccggcaggttgcgggtgggcagctcggcgtcgctcgcagagctcgagggcccagacccagacaaggtggctcgggtgtggatatgggtgccacgcggcgaggcccatgcgctgctcttcacgccctgggaggcagccttacgacttaaagatactgcaaaggtcagaaagggggcacaagacggtttcagaagggcagaagggggccattactccggtgtcaagtctttccacaaccctgcacagccccctccagagtggcaactcacccttgtccggcagcagcgctgctcttcggcaaaccacgaagctgcttcggaatggtagtcttatgagaggtgcgttacgttgtgtgagactatgcctcacgcatggtgtgctgtggaagaccgcgagcgccatggcccctagcagagcgatactgagtcagggccagtgatatgccgcaacgactcgtcctcgccagagcgacgtattctnnnnnnnnnnaagcagagcgatactgagtcagggccagtggtgtgccgcaccgactcgtcctcgccagagcgacgtattctcggtcaacttctctcctaagatcctttgtaacgccgctgtatggacccaccgacaactctgcgaaaactgcggtggctgagctcgagtacatgagaggccgtcgaggttttgaatggcagcttatccatgctcgaaacccttagcgctggaccgaccgcatcacatgctgccaagtggatttccggtatatatggcaaatgcaaactattcaacgatatataataaaactttgaatcgagtgattgagcacataggtttgcagcgaccctacgcaacttttcacttaataccgacggattaagacgggagcccacaagcctctttggtcgagttcccgcttttgccaatatactgcacattaaaatcctgtacatctgagcgcgnnnnnnnnnnaaataaaactttgaatcgagtgattgagcccagaggtttgcagcgaccctactcaacttttcacttaacaccgacggattaagacaggaacccacgagccttttgggtcgagtacccgcttttgccaatctaccgcacattaaaatcctgtacatctgagcgcgctctgtctatatagccacaccaggtatctcctcgccgagcacctcgtgaatggtcacagcctggcgctccaccctctccatcccaccatcgaatgtgttctgtgcgaaccactcgccacggtgcatacctggcaggtggatagaaagtgatcgtaaaaggtctcggccacgctggctcaagcctgcatgggatgtggctgctgcaagccctgggccgcctggcctgcaggctgcgcagcaggcacccgccatgcccccttcagcaacaacacatcatcccgcccccgccctgtccaatgatgcaagcctgctgcaaggctgcgagccggggccccggctcagggtcgctgccctgctgagtggcggcgtggacagcagcgtggccctggctctcgcccagcgagccggccatgaagtccacgccttctacctccagatatggttccaggaggactttaggaacacctgggcgtcctgcccctgggaggaggacctggagcagtgccgggaggtgggcagcggatggacacgtcgtgtgaagcttgggcggctgtgcttgctactcgggcagcccgggggggtgcaggtctgaggagtgccatgtgccccctggcacccggcccaatgttcccactgttccccctttcccaccacaggtgtgccgggccctgggcgacatcccgttgcatgtggtccccctcaccgccgagtattgggccctggtggtagaggagtgcatcgcaggggtcaggcgcgggcgcacgcccaatcccgacatgctctgcaactccagggtcaagtttggggcgttccacgcctggctggcacgccaggagcctgccttcgaccgcatcgcctcggggcactacgcacgagtggagcggggcggtgcaggcggtacgggcgaggccacaccgcacctggccacctcgcccgacgcggtgaaagaccagacctacttcctgtctcgcctgagcggcgagcagctggcacggtgcatgtttcccctgggccacctccagaagactcaggtgtgtgagtgtgtgtgtgtgtttgttgtcgggtctgcgcgggatcgttcgagtgaatggaggcttgacgcagctgcggcagcgctcagcgcaagaatgcatctgcatgtacgtgcctgtgcatctctgaacatgcggtggtccctctttgcgatgctcaccctctgcacccggcggctcctgctcctgtcgtcgcctcatcccactccgccaccctttccccccatgcacgccaggtgcgccagctggcggctgagctggagctgccgaacgcggcgcgacgcnnnnnnnnnntaagaatgcatctgcgcgtacgtgcccgcgcatccctgaagctgcgtcggtccctcttttgcgatgctcaccctccgcacccggcggctcctgctcctgtcagcggcccatcccactccgccaccctttcccccatgcacaccaggtgcgccagctggcggcagagctggagctgccgaacgcggcgcgacgcgagtcccagggcctctgcttcctgggccacgtccggttcgacgagttcatccgcgagcatctgggcgactggcctgggcccattgtggaggaggaaagtgacacggtgctgggctaccatcgcggcttttggttccacaccctgggtcagcggaaaggcgtgccactgcatggcggaccctggtgagctccgttgtgtgggcatgcggggtgtttgctgattggggctgcaaatgtgccctgtgcttggtaaatgtcttgagcttcttggtcaggatacagatgatgtctccccaaccttcatccaccacccaccaggtatgtcacccgcaaggacatcgagctgaacattgtgtatgtatcgcgggcataccacgaggcccccaggccggatcgatctaccttccgtgtgtcccagctgcaatggcaccggcggcccgaggccgccggccccgacgctgcgctgcagctgaggtgcaaggcccggcacggcccggacagcgtggcgtgcactctggagatggccgatgctgactcagcatcgggcgtcgtcaccctggccacgcccgatcagggcctggccccagggcagtttgccgtgttctacaaggatgacatctgctgtgggtcgggggtcatagagggcggattgtagtgggaaagtgccttgatcgtgtaaaatgaatcttcagccaaggtgtgcaagtccacggtgctggcgataggatcgcattcaaccccatagggcagccctctttgatgactgcgatgtctggacacagcgatggattttggccgtttggcatagaaatctctttgccgtcccgtatttaccaatccctggccatcgccgaggcatgtcctgtgcccgggtggcagcaagtcgactgcccgtatcccacttggtgtcactccagagtggctgtagatacagcttgcacactcgcacccgtcgggatgctcgtagtacaggccgaaattgcagtgtgatgtgcgctctcatcgaggatcagggccctggaaatcagggtgagacacctcccgcaactcctacccttgccccgtcgaggctgcggacccaccagctcgcaggaaccgcggctggatacagggagcaggctgttgcccacggcatacccagcaggaagcatgggctgtttgcggacgacgatgccctgctgcttgagctctgcgcctccccggacatggcggcattcgagaagcacctgccgggggaggcgggtccctatcagccccttccacgcggcggctgggtgacgggagacgaggctgctgcgcggggcatcgacctacgcatgttctataggactccagccccgggggaggagcacggatctctggagggcgtggtacgtctcggggatggcgccagcatcggcatcgggttctgggtgtcggcccatggcggcgcggtcgagtccgtgttggacgaggccaccgctgagctggccaagtgcgaattcacccccgtgctggccaccgtcgaggcgaacttccggatcaaaaaggcggtgcccctccacacgacgctgagggtggagtgcaggtggggattgtgtgcaggtgcttgttggttgcctgacacagcatcgatcgcttccccacttcaattcttcccctctgtccccgctccaatccatcctgcagggtggtaaagatgcgtggcattcgatgctgggtggatggccgcctgacctctccagatcgcagcgtggtgtatgccgagtgtgccgcccagctcgtcaacataagcagctggctctgatggcatctcctgtgcatcctgctgcatcttgccgtttgtgcagtgttacattccgccatgtccttgccggccttcatgaccacgcatcagttggcagcagccatgagcttgannnnnnnnnnctgtgcagtgttacattccgccatgtccctgccggcctccatgaccgcgcatcagttggcagcagccatgagcttgagggagcgggcgtgcagcaagtccactgcccgcccgatgttctcaaaggccgccagggcaggggggaagacctcgtccttggtgccctcctcccacacctccagcaggccggccccctgatccagcgtgcctggcgaggggtgaaaaggaggtggtcgtgggagatcggtcgagcctctgcgcagagggcgtgccctcccctgggccccggccttcgtgccagggcctgatcctgcatgttcttcaggtcaccctgattcctatcccacccaccacatacactcatcttgaccccaccccacccacttccttcaagccaacccgccctgaaccccaccaccaacctgcgagctgcttgtccagaatcatctgggaaagcttggcctcgacggtgggcaggggcaggtcaatgagcctggcgatgtgggccacctccacgcgcgagaagggctcgatcaggcggagcaggttcttctccagcagcgtgctgtacagctgggcaaggtgggtggatacgttcacatcctccgtcagctgctccgggtactcctgcacgggcgtgttcaggatggggaatgagcttgttggtttgtgggcctcggtgccaacgcgggtctcatgactgaagatgcaggcacacagcatccaccaccatcaaggaaccggcggctcctcggaaagccctccttccccccccttttcctgtaggacaagtccctctcccatgcccagccaccctgtgctcacctcgaggaccgcctggaagtcgnnnnnnnnnnccatccaccaccatcaaggatccggcggctcctcggacccctcccccccccccttcctgtagggcaagtcctctcccatgcccagccacccggtgctcacctcgaggaccgcctggaagtcgtgcaggctgcgggaatcgtaagcctcagccacggcgcgcatggaggccacctcgcgactctccgtcgatgtggcgccggtcttgctgttgatgatggccggcacctccgcgacgtctcccttcatgatctgcggcgatgtgggaggaggatgggttgtggggaggagggcggggtgtggggaggcgggggaaggatggtgctggggagtgagaacacactcagggccagggcctgcaaggggtcggggctgacaaatagagcccctccttctagtcagcagcatgcctccgcctctctgtccnnnnnnnnnngggaaggatggtgccgggaagtgagaacacactcagtgccagggtctgcaaggggtcggggttgacaaaaagagccgctccttccagtcagcagcatgcctccgcctctctgtccaggcaggcaagaagggtaccaacggtccccctctcccatgaccatgcacgcatcagtaccttcgccaggagcatgagcttgagcaggggcagggcgcgtggggaggaaagggccgcgtactgctcgtacgcctcatagtagtagctgtaggcggtggtgaagtcgccctcctctgtgaaaggaagaggggggggnnnnnnnnnnnnnnnnnnnnnnnnnnnnnnnnnnnnnnnnnnnnnnnnnnnnnnnnnctgacggttggatggctttcgcttcctctgcacaacgcgaatgccctcgaccagcgagcgaccaacttcccctgcccttgctgcgagcaaggcgctccaccaaccgcctgatgcacccacatccccacattgccacacgcagtccatgggcccttactccatggatgcatgcatgcactaccgtacacgccctgcaaacacacactccatcctcaccagagtgcaggaggccgctctgcgtgtcgaggttggcttgcgtggaggggggcacgtagatggcgttggccgcagcccggccagccgtcagggacgcccggctcttgggcaggttcttcagcgcatggtgggcctattgccatggtggaaaggaggtaatggggggagaggtgttgctggactcgtcgagtgcaatggggcccagagatcacgcaccagctgtgccagcgtgtgagaagcatgcacactcgctgttcatcacaggatcatcgtcattgaacccatgtacagacccccagcatcaacacgcatgcatgcatgcaagcgtgttggtacctggctttccaggaggtagatgtccaccagcaggagtttatcatccagcttcttcacctccgacaagagcttgctcagcagggacagggcagcggggtagtccttgatctccagcagcaagcctgccagcctgcatcattaatgggggaggaatcagtgacacgtgcctcatgattaacccatcagagcctcatggcctagagacacacacactcactcacacacaccagccaatgcccggccccggccacccgctcgccaagccgcggacctggtctccagcctctgccgcaggaaggatcgcttctcagccgcagcccactccacctgggctctacacacctccagctgcataagtggaggatcaggggagacacagctgtcgggcgcaccccgctacgccgcaaagttgcacagggagctttgccacatcctcagactcaccaggcgctgcgtcgagttgggcactcgggagatggcatcgatgactgtgcgaatgatcttggcggtcttggccttggggatgacagcgaacagcgggcgcaagtccaggagcagactgctgagagcatctgcatctttcgaggagaccaagacctcgcacaggcgggtaagggcgctctccttgacctttacactctctccatcgttgggaccttcgcccgtcaacagcgcccgcagctgctgcgctgcatcactggaggcaccatcgatagcctccagcctagtctgcagggcagaagccattggagcagtagtttggattgccaaggcagcaggagtcgcaagtttcacggccgaggtggaccctccagggcaagaagactgatccggcactctgcgatgatccactcaaagcctgagcagcgaaggaatgatcgcctgaaaggaggatgacgattcactctggagcagcgatgacgcatgccgtgtctggagcaccacccagcccggatcgagatcctcgggccaggcagcacattcaccgaattccttcccagcgtgtgtcgtgatcgccacccagcctcctgtacacttctctgtagtccttgttttctttgccaatccatcgagtgcacggcgcgatacgtgagtgactcctttttcccttgagcactggttccgacaacgctggcaggcggttgaaaagccggacacactggtatcccgactccctccccaggcttgagttcccaggttatcaagtgagttgtgagagtgtgtgagcagcctgctggcaactgcatgcgaggcgcgcctcccctcaacctgctgccggcccaccgcagtggggggctgtgcctccgctgagcgtggagctgctgccgacggggcggagcaggtggccagcaaaccagggcatcagagattagaggttcccgtgccctccccggcctctcccaaccccgtcccgagcaaggtcgcgagcttccctgccgctcgacttgacggccaggccgcggcttccccccacaacggggatgtggctctgcacaaggtgcccagccacgattttttccaccggaagtcccaggtgagcgtcgcccggggatgggaggcggtttatgctggaggcagggatcacagtgctgatggtatggcgctgcagcgtgcctgctgctccgccatcatgcccaccgcatgtcggccaggctggacgccctctgccacccccttgccgcgcccctcgtcgaatccatgccgggccgcctgggccagcatctaaccctgtgcctgccggtcccctcaccggccccgtccccgccggttccccccaaaccaaaatccaggagctgagcatggcgcacctggtgcgtcacccccgcatccacgcctttgacaacgtggagggccgatttgggttggagtccgggtatgaggcagtgcgcctgctgggccgtggcggcacgggccagacctggctctgtcggcggcgcgggacgggggaggaggtggcactcaagctgcagcagcgccccctgcccaagcacaccctggacctgacctacaacgaggtggtgatccaggcggaggtgggttggggctcgccccacatgtgcacgctgcaggaggtgatgctgaccccctcccacctcgccatggtcctggactacgaggcgggcgggtcctgcgccgagtacgtggcggcccagatccccaaggtcgcccgcctggagctgtgcgtggacgaggagcgagcgcgctacatgttccggcagctcatcgcaggcgtggagtacctgcactccctccacgtcgcccaccgcgacatcaagctggacaacagcctgatggacggcgccgaccccgcgcgcgtcaagctctgcgacttccagttcgccaagtactggggcaagcccgagtacgcgcgcatgaccacccacctcgggtgtgtgttaagggggggatgacgagggaagggatccacattgaggaggctccggagcggagggggtggtcgctgggctgcacagcctgtgcgacgtatcggaatggggttcttgaaggcagcaggccagtgctgatcagcaggggacgtacgtgcctgatccttgctgatgcatcatcccctgccaaccaccccaccgcaccccaggaccgccgtgtatatggcgcccgaggtcatcaccaaccggcaaaaccacaagtcatacaaccctggtgaggcggcaggggggcggtcaggggtagagaggggggatgcgactcctgggctgcagccgagcgacggccgaggttgtcttggacctgcgggacgtcggggaatccggtgtcgagcatggaccatttggtcgtcccgggccgcaggtctcccgacgatgcacccctcaatcattgcaccacccctccctgcgcgcagtggaggccgacgtctggnnnnnnnnnntggtgtcagcatggaccactcggtcgtcccgggccgcaggtctcccgacgatgcatccgtcaatcattgccccacccttccctgcgcgcagtggaggccgacgtctgggcctgcggcatctggctggtggcgctgctggtgggggccttcccgtttgacaaccggcccggcgtggacgaccgcaccgccgagatgcagatcctgtgaggagacgggaggaggaggccggctcacttcttccagtagggtttcagatgcctggatgctgagcccagggctggtgccgagaggatgtggccgtgtgctgtgcagatcccacttctcacccacacacaaccacctcgacctgtgcactcacacagcgtaccaagctccggcccgcccgcaccaaccatctgcccccccccccccccccccnnnnnnnnnnaccaggaaatgagcgcgccgtggcacgactccaagttcgtgcgcccctacatcggcaagctctcccctnnnnnnnnnntccttccgcaggcaccaggaaatgagcgcgtcgtggcacgactccaagtttgtgcgcccctacatcggcaagctctcccctggatgcatggacctgctggaccgcacgttggcggtggacccacggcgccgcatctcgctgggcgagatctcggcccacccctggctggcggccccgctggccgagccctacgcgggcgcgtgggaggcttgcgtggccgcgcagcgcgcggcccgcgagcgcatggcgcgtctgccccacgaccccgaggcggtcatggcgcgcaatggccgcgtgtttgcgctggtgcaggaggccgggcgcggcggcgacgnnnnnnnnnncctgccccacgatcccgaggcggtcatggcgcgcaacggccgcgtgtttgcgttggtgcaggaggccgggcgcggcggcgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctgccggcgctgcccatggtggacgcggcctccatgccccacgtcgtgcgcgtcgacatgcgccccgaggccgtacgtgcacgcgcggcctccgcccgcgtgcgcagcctgctggacgtagaccccgacggcgagggcgccgaggggggcgagcccgccgccgcgcccgcgccgccgcccaggaagttccgggacaccgcgccgggggtggcgaccaagacgccgccgtccaccccgctggcgggggcagaggatggagggagtggggccgcgaagccgtcgccctttgccaccacgggcggggccgagggggcgcatgcggtgtgaccctctggtgcgccctggaaacctgcttcggcattcgcagccggagtccctggcgccgtccaggaggctggcgtccccttggcgccgtacgtctgcacggggccgctggtaccatgcgtccaccctgcctccctcgctgcggccatctctgcggctcgtggacctggcccctcgtgacgcaggtgggactggccggcatcgcaccccttttccccgcgcccggaagccactgacccggtttccacccaagcacatccaaaggaaaccagggccagcaacgcacccctcacccgtccggcggtggaatgtactgccccgcttcgtcaaccacgaaccttcccctgataccaattgcatctggggcgacccactccctccctcgctctgcatttgcttnnnnnnnnnngggcggtggaatgtactgccccgattcgtcaaccacaaaccttcccctggtaccaattgcatctggggcgccccactccctccctcgctctgcatttgcttgctgttgagagccgtgtggatcacagcagggcacatgctgtgcggcgggggcattcttcagtggatgcagatgggcgcatcgggcaggctgcaggctgcgacaaggtgccctggctcaggcatcccgctccgctgatgagtggttgaaggcagcttccctcttggccaggacctctgcaggggtgatggaatccagaggacaactcagtcactatagaatgggccctctggcaagtgcagtaatcacaccgccaccagggttgcaggaggtgacctcccagggatcccaccccttgccgcgcaaccctttcctacccttgagctccagtgccgtcctctcctcaaagtcgaccagccagttgccaaaggctgcgccagcgccgatgaagaggacgtgctcccaggggttgcgcatcaagggcagcttgcgcacggcgttgcagtagagttgcacgccgaggcccagcaggcccccgataatggtggctggagccattctatgtgtcaggtatcgggagggggaccgccagagggtgctccaaaggggtttgcaccgcctgcgtacagcgtcgcgggggtggcgaaccccgtgttcttccgggatgggcgactgtcgatgtctgcccctctgaccacagcctcgatatttgactgtacaactgcgacctcttggtgtgggcccgggagagacgtctcccctcggggtggtgctgttccgctgctgctgcgcgcgtttccaatcgccatggcgaagcacgatctggagtcgtcatcccccgctgcttggtggaatcctctaggccttcaaccattcaagcatgtctgcataccagggaaagcacccagcatcgtcacacgctccacgcacaaccgccagctagcccctgggccgtcagcggtgggggttgctggggtcgtcaggggccaggcgcgccgccaggcgctgcgcttcggagtggtcgcccatgcggtacgccagcnnnnnnnnnngcaaccgccagccagcccctgggcccgtcagcggtgggggttgctggggtcgtcgggggccaggcgcgccgccaggcgctgcgcctcggagtggtcgcccatgcggtacgccagcgtcatctgcgcgcgcatcagctcctgctcccgcatcgccttggccttgtcggtggtgtgcagctcgccgtaggccgccttcagccgctcgcgctgctcctccgcccgctgcgccgccagctgggccttcagctccgcctcgtcctcgaatgcggtcctctccttgggctgcagggtggcagggatggggctctaggtgcggagcaaggtgcaggaagtggtgcatgccttgaggggcgcctttgctgtgcaagccccgcattggtaacgaggtcctccacgatttcatctcaggatgactgggaacgccacacgtcactcacagcgttgaaagagtggtctggatgaaacataagcacggacacacacatgcggctgattgttgatgccaggaagccggccctggcacccccacccccctatcactcccgcccactccgtctgcctcaccccattctttgcagcgcgcttggcggccttggctgcccgctgcctctcgtacagctcagtgtcataatatttttggtgtggcagggtggcggtgttgtagtcctccatgtactctctgcacagctcacagggcgagggcaggagtgatcttccattatacagagcttccagtcaccgtacatgccactactgcgcttcaatgttcatcactagttcaatgaacacccctaggtccacagcttccatcaccgggcagacactgtgtacccaaacacaccatttcccactcacctgaacagctccttctcctcaaacttgggcatgatctccacatcaatcttttttacctgcgcacaggaggtgcggagttcgagcatgggccgctttcaataggagtgttgcaaagctactcctaattgcaagggggggaatgaaggcaagtgcatgtcaatcctaccactccatcgcctaatcactcacctcgatggcccatagcataaactctgggcgcttggcatacatgtctgtctctcgaatgatgccatgctttccatactctgaccccacagcgccctggacgaggagaagggagaccgcttggtgaggcaggggttgactggcatgacacagcaatcaagggtggtgcaggttggctgctgaccatcctcagaggagcagcgataggcagcgggcagccaccaaagcagcgcctgagagccgcagagttacagcgaacagggcagccatcactctacgttccactcacctttggtggtctgtcttcactccccgacctcgacctcttgtgtttatgcttcttcttggactttgagctgctgtgtcgcttgccatccctcttcttgctgctcttcccatgcttcttactccgccgattatcatcatctgcaggcgggagatgcggtggccttattgacctcaagtcacaggtatgtgaccccccgcacacccgctgtggccatggtgcgtctccgcaaggagccgttctggagcctaagcagtccattgatccgcacggcaagtcgcnnnnnnnnnngttgaccttaagtcacaggtatgtgaccccctgcacacccgctgtagccatggtgcgtctccgcaaggagccgctctggagcctgagcagtccattgatccgcacggcaagtcgctgcctgcttcctccctgcctttcctcgccaccccaaccacccactcaggcttaccactctcgtcggaattgctctcagacccatctccactccttccagcagcaatgcgagctgccatctgagtctccgcatgacgtgtcctctcctggaaccagggcaggggttgcgaggtactagggcagaagtccaagcacttccagtcccataatgcccatttggaagagactacaagtcacccaaaatctgccgctccgacctgacttgactaccttnnnnnnnnnncttaaagaaaccacaagtcacccaaaatctctgccgctccgacctgacttgactaccttttggatcgtgctgagctcctgggcattggagagggcaaacttgcgcaacagggccagggcacgctcagtgtcccacccacattcctggagggccatctcccgagcaaccgggcctatgtgaggcatcaaggccttcagcttggccaccgcggcatcctccttgttcttttgcagcttgtccaagtgcttggccacctgtgcaaaggaggggaggacagtcctgatatgcatgctgcatagctcgcctggggctgccagggaacaggatcgaatcaaaccatcccctcaccatgctctggcccctgttgtctgccatgtcgggccctcctcgagtgaagagctcggttgtcgctgccattttgccggtgtagctggtggagtcccagggtctgaccgatgatcagcacgaaaatcagtggttcaattgaaaggctcacaaggggctctagtcagaggcaaggacagcttgaagggaagacaatccagtaatacatctaattccacactcacgagacgnnnnnnnnnntaattgaaaggctcacaaggggttctagtcagaggcaaggacagcttagagggaagacaatccaataatacatctaattccacactcacgagacgatcaccgagtcctgagcgcgcgtcgcgctcgcgggaagattgctgccgcctcactcttcatcgccgcaggaggaactactatgcagcttaaaccatgcatcattgaatggaccaccaatattcaagatttatggtggaagggtagggatgggtcaggttgatccttccgtcaagttgttactcgatgcctaccccgccgtcctcacactgaaggacgatggccgggtggagtgcatactcaacgggcatacaatgcccgggcgtcctgacgtcgtaaaggcttttgtcgagtgagttgtacactggattgtagtacgtctcgcctgctacaccaagaagggaactggcctagacggcggactctctcggcttcactgttcactggcctccctttactcgaccttccaggggcaaaaagtttcagaagctcatctccaaacacaaggttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtgcagaaattcgcaggccaagcatcgcagtgctggtgcaggactttgaccnnnnnnnnnncacgcctcgcatgctacaccgggaagggaactggcctagacggcggactctcccggcttcactgctcactggcctcccttcattcgaccttccaggggcaaaaagttccagaagctcatctccaaacacaaggttgagcgaaccttgaaacaatacgagccgttcctgacgccatccatcaacttcccgtgagtttcggctctcaagaggaggatccatgtgcaggaatccgcaggccaggcatcgcagtgctggtgcaggactttgaccggttgtctaatctgtacatccgcgcagtgggaagctgttctgtgctctgaccaaccacctcatcgaggcagacgtggatgccgtgaaggtgcacctgcatggcaagcgcttcacgcgggcaaagggtgagggcacgggggggttaagggaggaaaggaggtcacaagtgcgtctggatgattgaagcaagttaaccatctttcggagcatacatgcgcactcgatgcgctctgctgataccctacactgcagatgacagacatgcacccaaccagtttctggctgtttgtgatgaaaccctacccctggggctcctgcactcatgagtcatccatccttccacatgcagaccttttccaagctgacaagctggagctttttgaggaaccagactttgctgcaagtcctcctgagagcgacgaggtgagaaaccctgaggaccttgagcaaatgcctcttgctgctgcgcgggggggtgggtgggtgggtggggggggcaaaaaggtatccagctcacccctgcccactgcatgtcccttcgcttgctctccatcacaggatgctgctgggagcggctcagaggccgaaggcaaggcttcctcagacgtggattccgacggtggcggcagtgcctcatcctctggcctgccacatgacatggacatagtgctgggggagtctgaggaggagggaggaggcccccaagtcaagggtgacactcttgtcgaggatgtgtctgtggagaccggcacgatttcaaggaaaaggaggaagtctggagctgtgcaacagaaacctggaaggaggagagttgcaataacctaaccttgtgtgcatgacttgtacctaagcattggtgtatttctgagacgcatgtactcccgccggcgacctgtgttgccctagcctctgagaaactcctcaaatttatgtgatactgtgtaaggtgttcttctctagacgttttggaccaagccctnnnnnnnnnngtaacctaaccttgtgtggatgacttgtacctaagcattggtgtacttctgagaagcatgtactcccgccggcgacctgtgttgcnnnnnnnnnnatcatacgatacaaaggagagacgcaccaccctttccatcatgttgctgctgcgagtcgttgatccccacgatcaaatgagggacggccacgtaatattgacgttcccgagatgaggccattgccactcccatcacgttcatgcatggtaactgcaagtacccattattgtacaggcttcnnnnnnnnnntccatgcgatacaaaggagagatgcaccatactttccatcatgttgcagctgcgagttgttgatccccacgatcaattgagggacggccacgtaatattgacgttcccgagaagaggccatcgacactcccatcaccttcatgcatggttactgcaagtacccattattgtacaggcttctgtggtagcgcaccatgccttgagaacgggccacgatggcgttgagcaacggggtcctggcgcccacccctcccgtgacagtgcccaaggctaacaagggcgatcgtcccggcgacttgccatggcaggaagacactgactttgggggcattaaaaagcagtacgacgtcacgcaggaggtggtcctgaacctagagttcgtctccgatggctgggccagggtgcggtgggaggagggagtgcctttggaggaggaagaccaaactgcggagacagactctggctgtgaaactatgtgccgcaaatggtgggtgcgttcccatgccaaaaggtcagcaaatcgtaagggctcaggaaagggtccaagggtttccatctaaccaaggcaatcaagggcgcccttcgcctccatgcacccaatttcctcgcagctgtctaaagctttggtaannnnnnnnnncaccagactgcggagacagactctggctgtgcaactatgtgccgcaaatggtgggtgcgtttccatgccaaaaggtcagcaaatcgtaagggcacaggaaagggtccaagggtttccctctaaccaaggcaatcatgggcgcccttccctccatgcacccactttcctcgcagctgtctaaagctttggtaatgatcgccaagtgcgtgtccgtcgccatcttcatcttgctcctgtataaaaagagtagtcaggtgcgctgaggtgcccctttcctgcctagatggttggtggtgctcgatgggtgtgcatcacccatcgagcacctcgggattttcgcatgctgggtgcatgtctggcctgccgctgcttggccctcctcctgttcccgcttccctgtccgcgactcccccttcctgcctccctccattcctcttccaccccccccccaccacaccaccacacacttccctgcctcttccctgtcaccagggcattggtggtctcgtggatgacaacttcctggccatcctgaacgtcaccgtgggggccatctgcttggtcaccctcctgtttgccctctggctcctgctctggcgcatccaccgagccatgctctccggtcgcacctggacccgtccccgccgcttcctcgtcaacctcgcgctctgggagctggggctgcaggtggtgaacctcaccttcttcctggcgcccaacgccgcatggttggcagacccctgcacccccttccgcggcatcgtccacggcgccgtctttgtccagttctcatgctggctgggtctcttcaccatctttgtcatcagcgtccagggctttatgcccatcacgccagggacagccagcgtgcggggcctgcccctctacagctggtggctgcggcgcaatggggagacggtgccggccgatgccacctcggtcctggatctacctacttgggtccatgcagacctggtacgtggcagcgggggtgccttggatgggtggaggtggggccgggattgcagcaggccatccgacatgcagggacgcgacgatgtgaatttgttgctcctggcacagcggttcttgttgagggggaggactgggggattggagggttgtgctctgcagacggcatctgaggagctgccttggcaggttttggctcgagtatgctgggtggaccagcagcaagagtctcgacgttggcttctcttgccctgatccatctcccttgcgctcccgtccttggcaatcagttgaccgagtaccaatcccccacacaacaccccttcccgtgccagctcctctttgtgtggctccctgggcagctcctcctgctcttccaactcctctgggccaccggttgcctgggtgggtggggtctatgcgctgctggcagagcagaggcgggggggtccggacgaaggtcgatgtagctgccctgcatgggtgcagctgatccgagcttgccgggctgcttgcatggaggagggccacgtgagaacctgaagccgtcnnnnnnnnnnacggacgagggtcgatgaagctgccctgcatgggtgcagccgatccaagcttgccgggctgcttgcatgcaggagggccacgtgagaacctgaagccgtctcactgttccctacctctcagcatcccccccctacaaactcccatgcgcaggagcggccccgatctgcggccaggcctctgcgacagtcccctgcgacgagctgcgccccgcccctggccagtcctgcgccgcctggatgcaggacgacctgggcgaccgatgcgtctccgtccacgtcaccactgtgctcgtgctgtccagcatcggctttgcctgggtgctggccgtcatgctcctgggggttctggccatgctgatcagctacagggagctgcgccgcttccggtaccagcagtatcgcgccgccaacattgccgtgcgggtgctgaacaagaagcgggcgaccatgcaggccatctttgtggcatgcgtggtcgccttctggtttgtggacctgcgggcctgtaccaactaccttctcaccttctacggccttacacccctccaggtgagtccacatgcgtggggtgggtggcgggcaatgcctgctgtgtgtgcttgcttgggggccctgaccgcctggaatgccccacccggcccttcccctcgagcccgcactcgatcgacgagcgcccacccctgttgtgagcctccactcagaaggcgcttgctccctcgagtccgcactcgatcgacgagggctcaccccgcccccctcgcaaatccctcactcacatgccagatgctcggaagcatccaggtctttaccacgacgatggccatcatgcccatgcccnnnnnnnnnnctacgccctcgctcgacgaccgctcaccccgccccccccgcaaacccctcactcacatgccagatgctcgggagcatccaggtcttcaccacgacgatggccatcatgcccatgcccccgcgggcacagcagcttgccctccacgtctggctgcagaactttgtctggaatgaggtgggcggggagaggaggctcatcgggcaacctgggatggagcgctgggcacgggcatcgctgcatgcagtcgcaaacgctgcgcggcatcccgaacccccccccccctcccggcaattgcgcaggaggagcaggaggcggctctggcagagcgcccccccatctatgccaaggagcccttgttctgtttcgagacggccgtgaaggccctctactactccatgctggtctactactacaaaggcagcgacgagctaggaccggtgggttgggaatctgagtgtgattgccgcgcacgatgcgtgcactcacggaagtcatggatcaccgttctgcagggcaaggctgcccagcacccactccatccggccaccgcccctgtccgcacctgcccacccacaccagtgcctcacagcccccgcccccaagacacaccctccaccaacacatgaaacacaggccgttcccgggaagggttcgccgcacccggcgctgacgctggacctggccctggagctgtacggccttgaccaccacgaggcgatcgtggaggcgcagcaggacctgacctgcatgctgggctggagcgctgccaggcggactgtggtgctggccttccgcggcacctcctccatggccaacgtgtggctggacctgcaggtctggcgcaggccgcacccgctgggcatggggcggtggtgggacagcacccggcccctggtgcactccggcttccacgcctgctggctggagcgcggattcggccagcgcgtgctcgcccgtctgcgcgccatcgtcgccggcgagggggccgcggagggggccgcggaggaggggggcggcgtgggagcaagggggcctgacggcgcgccctggcgcgtgctctgcatcgggcactcgctggggggggcgctggcctgcatggccgcctgcgacgtcgtggatctgtcgcgtgccctggagcgggagcgggcggaggcgagggaggggcggggcgaggcagccgccccggcggcgagtggatcaccgccagccgccggccccatcctcgtggccagctcatatacctacggctgcccacgcatcggcaaccacgcctttgccaagcactacgctgatgtggtacctgacagctgggatgtggtgcacaccaacgacgccgtggccaggaacggaaagtgagtttggattccttcttattggggcggcatgggagaaggagaaaggggggggctgaaggatgttgggacatgccctccaggtcccccaggacagcgtcaggcatatcccgttgcatcccgagcaagtgatgcagccctgtgcgggcactgcgcgagcatggcgctcaagctgccgtgagcctggctaggaacccaccgcccctcctttctaccacgaggtaacaccccttacccctgccttccctctcccatgacgcaaaaggttcatccggctgtacaagcgcgccggcaagcgcgtcatcgtctcccccgcaggggacctgattgtgcggcccagcctggccgaggccactgtgctgcggggccactcctccatccaggcccacctgctgcgcacctacgcgcgcagcatggccgcggtggtcaggacgcaggcagggatcgtgggcggggagggggcccgcacctccctggccgtcctggccgccaagccctatgtcggccgcctgctgcacctgcggaaaggcagggggggggagccctccttcctgggcctcataacacaggcccaggacgagcacgtcgccacgggcgcggcactggacggcgaagggcgggaggaaaagacggatgaggagggcgtagaggaggaggacagctgccctgaccccgacgcagagctggagagagcccggccggggctgtttgcgggggcctaccacatgatccaggacacagcgagggatatgctgtcgtgatacagcccgtgacctcggcgagaggtcctggggcaaccagaccccctccttctgtgcttgagcgactgtacccaccttctgcagcttgcttactcatccaaagcgtgtgcctgacatgttgctgcactacttttgaccttctgaaatagtatcccactctgcatacaaactcttaccccnnnnnnnnnnccctgacatgctgctgcagtacttttgaccttctgaaatactatcccactctgcatacaaactcttaccccttgcctgccagggcccttgccaccttgcagtaaaactgccatcgcacattgttcaccattgctgcccctgctgcgccttgagtcgagcttacagaggcatgtgagagggggctgatcccgacagagacacagcactccactgcaaccacattcaagccttctggggggcctggccggcctgtccagcgggcctgcaggggggaaagaaagggaggaaaggggttagggtttagtggcatgattgatcgagggtcagcacagnnnnnnnnnngcagcactccactgcgaccacatcaagccttctggggggcctggccggcctgaccagcgggcctgcaggggggaagaaagggagaaaagggggtagggttcagtggcatgattgatcgagggtcagcacagtgtgccaagaaaggggcatccaagactcaaccagcacctcttatcacatcatcgcgcttgaatgtgcaacatatgttttgacacatcaacccgccctccctacaacctccgccacatatcgctcgtgctcaccgctcggggcgggggccgaagccgggacgctttgggggctcgcggttgcggcggttcttcacggaccgcacgcgcacgatcttggagtggatggccgcagagatgcagtagtacactttcctgcatggtggcagggcagggaaggggcgaatgagcaccacggaatcataacacagtatacagcaaactcgagccctgtccgcctgcctgcccaaacacccgaacgaatgcacacctgtagatcttggggagagcgtannnnnnnnnncgaatgtgcaagaaatgtttttacacacccacccgccctccctacaacctccgccacatannnnnnnnnntataacacagcatacagcaaactcaagccccgtcggcctgcctgccccaacacccgaacgactgcacacctgtagatcttggggagagcgtagtctgcagatagagtgtagggaaggaggggtacggggagtgagtctcagcatgcgaggtgtgcggcagcaaagcaggggtcggcgaactcgctccttgccgagctggtgctctccagcgccgggcgccagcaacacccttcccgtatcccagatactcactgtcgatggtgcaggcctcctgcagatcgcggatggcggacgcatccaccatgttcctcacgatgaagcgcttgatggccttgtccttgggcaccagcacgccggacgactcgcagcgcacgcgcttgacctgcagagcaaggagcggaatctttagacatgggacccactgcgcgtccggtggacaggagtctgcacacagcggaagtgctcccagccctcctcgtcgaaggcccacgtacatggccgcggccgtgcttgttgcggcctccgttcctcctcttcttggtcatggttgctgctgtcggattccaaaggcgtccaaagagaccgtgccaggcgggaccagggcgattgagggcggcctactgggacagggtcgaaggcggcaggcctccctttctactgaagacacgacagcgacaggcatgcccgggcgctactggcgactttttcaagctggcgaacagccaataggctgcagttgactcttctgatttttctagcagaaagaaatggcattcgaagctccttgagtaccgtcccactcttagtcagatcgaacacccacaccccctcggaaaccttcagagaaggcctaccggcactggcaaacatgcacccccaggacctcgatgctttgtaacacagtgcaatcattggagcactcctagaggacgcttccacaaccaggcctggaccatggtcctccaacaagtggctttgagcgcaggccacgggtgcctgtttcaagcaaagtggggcactgaagtgtcaagttgactcgaaacaataatctaccgtgccaagggtgcgaattatcgcctgttacaaccagaggaagtgtctgagcaaggtggaacctacaaacctgccaggtttgtaggtgctcacatctggcacactctctgccaccacattctagtcactccagcagactctcaccaatcaaacagcacatatcgaaggcatctttttatcactcagatcttgagcttcttgttggagtaatcagaccctgattgcatccagcttctggccaatgctcagacgagcagtctgagatcacgtccagctgggaacagacacgcaccattgaaaagcagttcgtcacacgacgccccccgtctcagctttgcatgcatgctgtgagctcatgctctcataatttactcgttccagcacccaggcaggcgacacatgccttctgcgagctgtccgtggtccatgtttctccctcatgattcaatgatgatgtcccggcctcacggtgcggcccctcgcgctgcatcctccgccccgcacagccatgcctgccatgctcgcgtgaaggtacagcgttctcgtagtcgccggatgtcggccatgcccggccgtgccaccgcgacggatgatcacgtgtgcgtcatcggggctggaccggccggcctggcggtggcggctgccctgcaccaggtgggcatccccgtggtcgtgctggagcgaggcacaggacccccttcctccggcaccgcactgggcctttggaccaacgcatggcgggccctggacgccctgcacgccgcagaggagctcagggcccagtaccgcgaagtcagcctgtgcgtgcaaaggccctgggttggggtgatggcggcaggaacggggcgcgaggagttgcagggactctcctttgcctcacatagttcccacacatgttttgcagcggcgcctgtccggccgaccccagcagtccccccttccttccccaatctcgccagagtgcagctgtgccgcgagggcgggcgcctgctgaaggactttgacctgcactcctgcgacggcggcccgcacgagttcaggggtgtgcggcgttcgtccctggtggcagccctggctgcccgtctcccgccggagaccatccgctatggccacgcggtgagcgccgtcgccggcgaagatcagggggccggcgtggctctgactgtcgagggcgaggggtccggggggcagatgcggttcgccggggtggtgggcgccgacggcagcgccagcgtggcggcgcgtgctgcgggaaggaagcccgcccgctcggtgggccagacggcggtgcggggcgtggcgacctttccctcggcacgagacatgccgtgcgactccatccgccaggtctggtctgtcggtcnnnnnnnnnnaaagcccgctcgctcggtgggccagacggcggtgcggggtgtggcgagctttccctcggcgcgagacatgccgtgcaactccatccgccaggtctggtctgtcggtccgcgggccgggatgtacccgctgacaggtgagtgcaggaaaggaagggggggggggggggggggggnnnnnnnnnngtgagagggtcacaggttgcaggaggccacaggatgtctgggagcgcaatgacagtttcccacaaggcgggttctctgaccctgcggccagagcgttttgctgtcgcctgcaccgtggaagcccaccctgccatgccgggagggagcagcaagactcactccacagccccactttctcctcctcccctgccctcccgccaatcaagacacggagctgtactggtttgtgtgctacgacaccccttccacaaaggcatctgcccgggcttctgcccgggagcaggcgctgcgggtggtgacggggtggggctggggcgtggaagccgccgtgcacgcgactccggacactgacctggcccgcaacgctctgggcgacaggtgggacatctggcccggggccgtcgccggcgccggcctggccttgaccctggcgggggatgcgctgcaccccatgacccccaacctgggtcaaggggcctgcaccgcgctggaggacggcgttgagctggcgcggggcctggtgcgggccggcttccgcgacgccggctccggggtggaaagggcggcgcgcttccgcgaggcggcgcgggagtacgaggcgcagcgcaggcggcggaccctgcccctcacgctgcgctccaacctgtttggcaagatcctgcaggcgccggtgggggtggtggccgccgccagggacgcgttcgtgagccgtgccttccagcccgcgcacttcctgtcccatgccaactatgactgtggacgcctggaatgacatggggttttgtgatctgagggtggaggggtaacacgtagccgactgaaggcagggagccgaggaagcacctcaggcaacatcgacctctgcggatccgcccagcaagccggggccggtcgccagaaatctctcgcatacgccccaaggggacaccggcaagacaggaatgtgtccagggaatctatgtgcnnnnnnnnnntgccagaaatctctcgcatgcgccccaaggggacaccggcacgacaggaatgtgtccagggaatctatgtgcattaccgggctccgtaacccattacagcgatcaaaagttttgaatatcagtgcaccctggtatcggcccgccgcactcgtcggaggagctcctggtacgtctgcagtctagccgcagaccatgcaggtgatccagagccatgccagccgaacaggctctggcaacagcgcaaagtgcggacttgccgtccatcgctcctcccaagtacggcccgcaccaggtgtgttgatggggattactgaaaccttgtcccccatggaccaagccacaaacccatcaatacacaatgcatggcacgtcctttgcccatgcttctcaacttcacccattcttctaccccacagatcccttgcactgtggtgcaagactggggctggtgtctcagctcccacacagacggtcgaggggcccaaggcttcacacccgccgacagctcagcaggaccacccttgcagcggcagccacgannnnnnnnnntggcgcaaggcctcacacccgccgacagctcggcaggaccacccttgcagcggcagccacgactgtgagcgtgcgcattggcgtgcagcgcgacgtggggtacggcagatcggtgcgcctggtgggcgctggtccccgactgggtgactggaacccgagacagggtgtggagctggcatggacggatggcaatgtgtggacgactgatctggatctagaacctgggacggccctggagttcaaggtgatgaaacttggtggcttgagggagtgagaatggatgagcaaatggagggtagaaggtggtaaaggacacatggcacccagacttgccatgtcttggggtgtgtggactgggcggtccttcacgctttcttgagatggtgtatctccctgcgtcattgccaagcaggtgcgtggattgcctgcgttgagttcccttctgacgcnnnnnnnnnntcttgccatgtcttggggcgtgtggactgggcggtccttcacactatcttgagatggtgtatctcccttcgtcattgccaagcaggtgcgttgattgcctgcgttgagttcccttctgacgctcgcaggccgctgcctcacgacagccctccctcaatcaagcacacagtttgtcagcatctccggctccaatgtggaatgggagtcggggtccaaccacgtcgtccctgcccccgaggccgacgctgccgtgtccttgaactggggagcagccgaggctgtcgtgaagaaggcagaggccggtagccccttcgccagcagccccggtcctgatccaggcacacagggccccgccagcgacgattcgccggttcgtgctcgctggagtggaaaggagccggtcttcatgcaggggaacgagcacagccgggagcggcagggccggtgggagacggagggcctggagggggcgacgctggagatcgtgaatggcgatcgggacgcgggcagctggctgcagaagctggcagtcgcagagaagctgctggtccaatctgcgccgcgcctgaggccgaggctggacgcggtggccgccgcctatgtgtacctccaggtgagacgtttgtgggtgcttggatgggggggtctgggctcctggatatcaagtatatgaaggagggggccgccaagtgggcgtgcccatccttgcatgctggcacgaggagggtggagtcatcagggcaagcagggttgtctgacacaagacgccacacccaaaagtcccctccctggctggaatcgcaagcaacaaccatcgaattgagaactgattgcgttctcttcacaataatcgctccccttaaacccctcctcccccccttcaactcatgcagtgggttggcaacgggactctggcctgcgcggagagcgggggccatcaccggcccaaccgccatgctgagctggcgcgcagcatgttccggtccctggagtgggtgcttgccgagggagggaaggacggcgaggcccaggccctggccctcctggcccgccggctgcaggcctacctgccctccttcgacgccgcctacaccgcctccacccccctcacgcgcatcagggacattgcgcacaggtataggattggggggaaatgtgctgctcagagggcgtgccggcagcgaatggatgctaggatcgtaatcaacaccacctccctatccctccctcctcccttacgccgcaggaacgacatcccccacgagctcaagcaggagatcaagcacaccatccaaaacaagctgcaccggaatgcggggccggaggacctggtggccactgaggccatgctgcggcgaatcacccgccaccccggcgaataccccgacgcctttgtgggcgagttccggaggttccacgcggagctgagtgattttttcagcgctgggtcgctgacggacagcctggccgccctgaggcccagcctaggggacgacccctccgatatacaggtggctttttggtgggcggggggttctaggtgggaagtcgccgctgtttggtgctgacaggaggaaacatgaggtcagaagttgcagccaatgctcccccgccccacctggccctccctcgccgccgcccatgccccaccactccccaactacccagatcgtggagcgtttcctggaagccaagcggaagctggaggcagcaggcagcagcgccgacatgaacgacgtggtcgacacgttgcacacgctgggcacgctgcgcgcgctgctctgttcccgcctctcctcaggcctgcgcaacgacgtgggcgacggcgtgctcgccgggcgtcagaggcgagttcatgcacacgtggttcggggggctgagcatgccgggagccggcatgctggcatgcaggcctggcgttccttgccgtcacggagcgcccgctggtgcatggtgtcgcagacacagccccctgccccgtctccatgcccaggtggcggcaggccgagatccaggcggaggactatgcattcgtcctgctttctcgcttcagcaacctcctcgaaagccaggtggggtgggtgcggtggggcagggcaggacctggagggtcaggcttgtgggcggggacctttcccgccgtcaagaaaaccccaacctcttcgcagcggcttgaggagtccgcaatggcagagtagttcatattgttgttctccacgtgtctgttgcagcatgctctgcctgctgttgttcgaatctgacaaaagcccccctccccacacaatgcgaaagggcggtgccgaatcactcgtccaaggaaaggacggcggctgggcgctgccccttggctccctggtcctcggcctccgccaggtgggcctgggcgccgggccggggctggcgcgcgagtgcgctgccctggagcaggagctcgccacctggcagcggctaggcgggtttggcgagcgcgacaatgccctcaggtgtgtgcttgggaaggggggggagtggggggccggcgaggctttggtgggaggtgcatgtgagaccttgggagtatactgcctgagtgccannnnnnnnnnggagcgcgacaatgccctcaggtgggtgcttgggaggggggggttgggggccggtgaggctttggtgggaggtgcacgtaagaccttgggagtatactgcctgagtgccaggaatgtttggagctgtttggggctgaccctacggcccgcatttcccgcaagcgtgcatgagcatgcataccgccagcttccatgctccgtcactctcccctcaggctcaaggcttccctgcagcgcctgcgccggctgacgcatgacttcagccagatcctgatggactcgctgtcggagcgcgcgcagaagctgggggatgcgctgggggtgtcgggcgacatcagctcaggtgcaggggggtggggtggggtccgacaaaacggtgcagagaatctctgggcctgaggaggaggtgacgggccaaagttggccgtgagcacatgcagcgttaaggatccttgccatgataccttgttgcaattcccaaccttgatgccatggatcannnnnnnnnncaggcctgaggaggaggggacgggccgaagttggccgtgagcacatgcagcgttagggttccttgccatgataccttgctgcaattcccaaccttgatgccatggatcattttgcacagcttcctgcacaccctttgtctgcctatgcacaccatagccctcatccccactacccgcagtgttcacggaggctgagatccgtgccagtgtggttttccagctctctaagctggcggcgacgttgctcaagggcaccgagctggtggctggcggctcgccctttgacgtggtggtgggcggggaagcttctgggaagctgcaggaggtggatgccctgcagcccggctgcgccggtgtcgaggtgggtgctgcgatcgtttagggtcaaggctacgggcccagcttgattgccaaaccaccacacaccctggatcctgggcctcgcagccctcatcaacggggagggaatcaggcaagcacaatgaccaaccattactcctctgcgcatctcaccgggccnnnnnnnnnnacagtgttcacggaggccgagatccgtgccagtgtggttttccagctgtctaagctggcggcgacgctgctcaagggcaccgagctggtggccggcggctcgccctttgacgtggtggtgggcnnnnnnnnnngcctcccaccacaggcctgcgtgctggtggtgaaatctgccaccggggacgaagaggtgggcgcnnnnnnnnnntcctcccatcacaggcctgcgtgctggtggtcagatctgccaccggggacgaagaggtgggcgccctgggtccaaacctccgcggcatcatcctgcgccacgacatcccgcacctctcccacctaggtgtgcatgtgtgtgcttggggcgtgatgtcccctttggaggggacgaggccttctattaattcaaccagccgcctgtgtgacataaggagagtgtggcttnnnnnnnnnnaggaatctaccatcagaacatcaaacctctgcaccatccccatggccccccgttgtcacactcatcaggggtgcgggctcgcnnnnnnnnnngggaatttaccatcagaacatcaaacctctgcaccgtccccatggcccccccttgtcacactcatcaggggtgcgggctcgccaggagcaggtgccctttgtgctggtggaggacgacgctttctttgaggaaagcatcgcgccgctgctgggcaagcacgtgacactgagctcggtgccggacgccaccactctgacgtctggcgcggctgacgcgcccggtcttacaggcaaggcttccaggggacgccccgaagccggcgcggaagattggaagggggaggccccacgccgcatctccaagctctccgcctcggcagccgttgttcccctggctgaggtggaggcaggaagctgcggctccaaggccgctgcctgcagccggctctcgcgcctggccgtcgactccaaaggaaacagcggcagcgagtttgcggcgcccccgggtgtcgtcctgccctttggcacgatggagctcgccctcgaggtaaggtatcaggagggtggtgctggcagggaagctctggcggtgtatagtggcggacaggtcaggaatggcactgatgcatttggcgagcaagggcttctgaccaaaaacccatgagacccgtctatatgtactgggcaatgcatgccatatcgcccagcaacgactggagacctgcagctgagctgacgggatgtnnnnnnnnnncatgtactgggcaacgcatgccataccgcccagcaacgaatggagacctgcagctgagctgacgggatgttccctctcacccctcactcatcaggctggcggccaggcatcggctttccgagacctcctcggccagttggatgatatgctgcgggagcccgaggacgaccctcgcaatgcccggctggcgcggctctgtgaggaggtccagggcctgatcctgaacagcagcaagctgccggatgaggtgcggaggtcggtgggaaggagaagagtgggtgagtatcggtgcctggctctctgccaccttgaagatgcgacaccaggctcattcctccgccctctctgctctgcaggtcatcaaggcactgcaggactccctgcctgcagactcacctgtcattgcccggtcctctgcaaacgtggaagacttggcaggcctctcaggttgctggtggagggtgcaggaggaagcactcccctggctcaacatactgcagcattggaggtgtcaaacacagtgttaatgcgagctgcccacttcagccacacctcaccatccaactctttccccctctccactcctccaggtgccggcctctacgactccatccccgggattgacccgagcagtgccacgtcgctgcagcgtagcatagccctggtctgggcctccctgttcagcaggagggcggtgctcagccgcggcgctgggggtgagtggctctgtgtgctccgccggcacagcctcggccaccctggagctctgtctgcatgctgctcattgacaatttgggaagcgcagggactgtgctgggtcgcccacgcctccaacgccgtttgccaaagcaaggccttccaatgccccacaacccccttcacccgcctgcgcaggcatcccctcccaggccgcagcgatggcggtcctgctccagccccagctctgccccgacctctcctttgtgctgcacaccgcccatccggtcacccgcgacgccggggtcatgtgggccgaggtggccccgggccagggcgagatcctggccacggggtcacgcggcgcagcctggcgcatggaaatcgacaaggccggcgacacgctgcgcatgctttctttcgccaacttcagcaccgcgtggctggtggcgcggggcacgggaaagggtggcgtggccaccctcactcccatcactgtcgactacagctcgcaggccctgtcaggtgcgggtgacagctgtgtacaggtgccggcctccagggagaggaatgtatgggagggttgtgatgcactcccctgaccgatggtgtgttacagcacgacagccgtgagcacggaaggacatgctcatttgcaggctccgaggaggcccgggcgcagctctcccggcggctgctgggcgtgggcgccgccttggaggcggagatgggcggtgcacaggatgtggagggctgcatcgcagccgggcagctctacatcgtccagacccggccccagccatgatggtgaatgcctggaggccggtgcaggagcaaagctgtgcgatttcaacaggcccatcaactggaacgtcggatgtgcagcgcacccggttgccatcaagttgctctgtgagaatcgacgccgctaccaacatgctgctttgtgtatgccattcctgcttggcttgtgctcctgtcctgtgatcgcaggagcctcttcactccgctgcagctgccgtggcgctggccttgaccaccctccccacaatggggtacttggaatagaactgggcctgccaatcccgcagggtgtccagctccgagagcgtgcagtccgccagttcatcattgcagtctgcaagcaggagagggcgaagaaaaggatgatcaatcgatgaatggaggttgggacagcggcagaggccgagaaccctcgccctcggcgatccagaggttcatgaggtcacttgcatcagccaacttccatctgggcacagccagtgctagtgtcctcaccatcaatctctgttgagaactttgccagcgcccgtgcacattcccggcccccaaaggggtaagccccgtcagggccatagaactgactccctgtcggagcagggggaacaggggattgtggggatgggcaggaatggattgttgggcaagcgcacgctcagctggcccatgggggtgcaagtgacttgaggcactcacagccatcgttggccacctcaacagcatacctctagtgacatcaaagatgacacccttgatggcaaggtaaatgggagcagggtttgtctccccgtcatatgcagccagctgctctagtgtcagactcaaatcggggacgacctgggtgaggatgcgagaaatgtggagtaattggtcagtgaccttgcctgccatctggccaaggtacaaagcgagggtgcaccgccctgctcccctgccgcgccatgcatgatgcccgtctcacagagacagctcctctcctattgattattcccggcctgatcaaactgctcccaaactccaatgttgagctcggaccccacaaactccaccatacctttcccacgacttcatatttttggtcaaacttgtcaacccattcctgcagcgtcttctcctccttctcggtgaagtctgaggtgtcagcgctgcaatggtctgctgtaatctgcatcttccctaaagccctcgccacttcccgccctgcaaacacactgtagccgccgcctgtgcatggcaggtgtgttgggcatgaatttgtgagcaggaaccgccagttgacggctcagtgatcccattggagagaatatatgccttttcatcctgccgtgaggcctgttgagtctgcttcgatgatgacagatgcacctccaactcccccaggccccaactcaggccagccggaacaacaaggctctcgacaaacacgctggcgccctccaggctcacctggtccgtagaagttggccttggcggacacatcgtagatccggcctcgcaccgccaggaggatggggaggtagggatcctggcccgagtacttgctcagctcctccagcgtgacgtcgcccacttggaaggagcgcttcaccgcgaccagcttgcgagggaagaagaactggaacacgaccctcaggattgtgaatatcatccaggagaatatcgccacgaaggctatggcacatatggacgagaatatcgtgaaaaccattgtggccgctgcgctccaccagcaattcgggaaaagggagctgggggaaccaggtagacagaggacatgcactggaagcagacaggaagagatcaacgacttgcttgtctgggcgatgccgtttcacctcgaggtgcccacacgggaataagcccgtgcatccgtgcactggttttgggcgcttcagactccccgcccacgcgatttaaaatgggatctggggcgttgagatatctgcccagatacagcatcggctctctgcacctccttgggacctcccaagaataagtaattatgcatacagtatgtaatcaggtcatgcattctcattgtcatcctcatccaagaccggcgggtccctccgctgtgatgcgttctgcacgagctgatccctgagggctgcatcgatttcttcgcatgcgcccatcgccagctcaacagcatctcttagctcgtccttggaccacaccccgtgcgatgtcagcgatgtgatctgcagaatggagggaactcgtcgcttgcgccagaccttttgcaaggcagtgggaaccacggcaaaccttcgctgtgccgcacccgcccacctgattgaggcagggcatgaaagacagcaccagccctgcttcttcccggtactcctcctccgccgttggatccagcaattggatgccctgcaccctgctctgcaacgtgtgcgtttgagaggaaggaggctcaggggggtggcttgcagaacaccaccgacacgggcacggacagggtctccaaccaggcccannnnnnnnnngggaggctcagggggttggcttgcagaacaccaccggggcacggacagggtctccaaccaggcccaatgccaactgtccacgatgagcggcgtcttttgagcctcctcaccacggacgcagcagaaaccagatctctcagctctatgctggcatccgcgagggccagggtggctgcggcgatgacggccgcgaggacggagccgccggcctccagcaccaggcattgcacatccaggactgcctttgggaaggtgtgcaggaggacggaggcagacagggccgtttccagctgggcagacagctccttctccagctgggtctggatggggcgccctctctgccgcgtcgcaaaggtcgcgagccgcacgtcgcagtccagggaaccctgctcgctgtacttcatccaccgatcggactggcgcgggccgtacacgcccaccatcacttttgtgctgcccagctccacgtaggacgatccagacgcctggctgatggtcccgcagtttaagactgtgatggaccgtgaatgtggagggtgagaccatcacacgcactctcaaacaatggcatggtctgccacggcacctctcaggtcacaattacccctgtaaaaagcttacatagtgtccgaaactcctcattgtcgcgcccatccaatcgctttccatcagcgataacctccgccggccggtcatgtctgaagaatggcacgctgctattcgtgaaggccatgatgcatgggctgatactatgctccaatgaacgacaagaataatatcatgactcgccgaagcgtgggttttgtgaccagacttgtgccttgcagcgatggcgtatttcgaccttgctcgtctgcaacccacccgcatgcgtgcgggccatgctgagagatagccccccgtgggaggacagggcaaaaggcgtggttctgattccttgaggccgaatgattagtacttcgattgtaggagggcatgctgatgtgaacggaagcctcttcatctcttaagacaccgagatcctcacacaactggggttgggatgggcatttgcaatctcccagacaagcatccacatctggccgtggaattttcgataatgaatgatcttatcagcaaagtgatagctctgtcgctagctgtctgtaagcgacggctctgttatttctgcatggcatgcattgcagagtcccctggtggcccacggcatttcataacaaaattcgaacagggtccgacatacaaacctaattgagaattaacaacctataaaaattccagttttacgaaaagcgcggcaatgaaagcggtgcacgtnnnnnnnnnncttctgcatggcatgcgttgcagagtcccctggtggcacacggcatttcacaacaaaattcgaacagggtccgacatacaaaccaaattgagaatcaacaacctataaaaattccacttttatgaaaagcgcggcaatgaaagcggtgcacgtttggaggttgggcaatcgatcaggatctcctgcgactctccgggactgtccgagatccaacgaaaccgcgtcccatgcccgcctcgaaacccacacatcatctgccgggcagtgaatgtctctaccacgttctacttatacccccttgcatccgagaccaagcaatactgtgcccaacaaatcgactgagcctcccgtaccctcagctgccgcaagtttgaagggtacaacttccatggctcggactcgggcggcatgggccagcaagacgctgtctttcatgcttgcaatggctgcagcgacccactttgcagctgctggtaatcatgggtctcatgcagtacaaatcggcttcccttcgtagtgtcccagcccctgtgtgtttatctcctgaccgagatcctccatgctccggccgtgcagatgagtgtgtgccttacaagctccccgatggctacaccagttttcaaaagtactgccagtaccttcagaccatcgatgacgagtgagtgtcagggatgaggtagaggagctggttgggtccgtcccgtgtcggccaccgaggatgctgaatatcgagaagccagagcaggtttggatatgctacgagctcccgacctggtatattacaaacaaacaatgtgccattgtaaatccgttcccatgcttgcagtcaggtgatcgagcaatatgcaagtgccccggatccgaagtcaggggatgccttccccctgcatggcgcggttctgggctgcattgcgggagcctcaggtgccaacagagccaactccctgggcttggggcgctggtcgggcaaagatttcgggtgagtggattgtaccgagtgtgaacgacgtgtttgtccctggctgcttgcaggtggacgtatctccttgacataggagtcccaagcctctgccatcattacaaatgccaaaatacacttggtgccttcctcctccacactcaggaccctggacacctccactggcctcattccagtccaaaacatcgtggataattccgtgggactgggcggctctgttgtgaacgccggcgtctgggccaatggactgtccaccgaggatcagttcccaggcaccattggtgttggacaggcttggtgcgttgaggaagcgtattgaaggggagcgggagtagttcgtctggtctcagagccccttcacgtgaagcagaatcatccaaatgtctctgtctctccgatctctgacccagctgtttatcagtttctcatgcccatcttacctagtcatccccatgtcagccagaggcctcgacccatcccccctgcaggagcgaccgcgatcgtgaggcatggatcctgaactacaactcggtccagacgggagcaggaatcctgaatgggctcatcgccaacacccgcgatgagctccgccaggtgatgatgacactccctgcgcagtttcactccatcaaattgacatcaggcaacaattgcagtccgtttcactgccagtcctttactctgcttcattnnnnnnnnnntaatgggctcatcgccaacacccgcgacgagctccgccaggtgatgatgacacgccctgcgcagtttcattccatcaaactgacatcaggcaacaattgcagtccgcttcactgccagtcctttactctgcttcattcattcagctccattctgtgaccccaaaccctcgcaggtcggccctggggtcatgatcgggaggacctacgccaaacccttttccagcgccaaccccctgccagtccctgtgaacgagggggcggcgttctacctgttccaggtgtggtagcgtgtgcttgtgttggcagagaatagcccttataacctcatcaagccagttttcagacgctgctaccacctcctgtcctcccctacaggtgtgcgatgccagcggcggctaccccgccaaccccaacgaccgcgccttgtcctgacccaacacctggttgattgagactctcctgctcacatcctgatgctgatgtgcatgtgacaaccagccatcggccgcatgcacctccccacgctccccccgtcgatcaattgtaatcgctggactggccctcagggctacgctccagggtccagaggaacacggccccgtcggcccccgcgctgaccaggccctccgggcaccccgccaggccgctaaccgccgcccgccgccgggatcgcgcgccgtgtgcccgctcctccctcagcaccagcggcgtggacggcaggccgggatcaaacatgcgcaggtcgccatccgcgtacccggccgccacccagccgccggccaggcgcgtcagcgccgtcaccgccccggccttcttgtgcgccgcctgccacagcagcgcgggcggtgcccccggccccacagccgccggctgagccccgccgccgctcagccgccgtaggtccagggccactaccgcgccgcccaccgtgcccgccgccaggctccagagccccgcactcgggcccagcaggcgcgtgacaccgtcgccgggggtggtcgggtggaggcgcgccacggcgctgcaggcacgcgaatcccacagcaccaggtttccggacgcatcctccccgcccaccgccaggacggcctcgtcgatgtatgtcaccgcccgccccttccgggccaggcactgcaggttgttgtggggttgggtggggagaggcagggtcggtgacgtgcagggctttggtgaggatcccgggaaacctgggagcgaaggaagagctgaacattggagactttgtcctccacgcacttctacatctctgtcctcgtggcagtctgccagcaatcatgtccctttcctgaaccactcgagcatcagatgacagcagcgaaataagcctcctctcctgcacacagcactcattatccaccctcccttcctgcccacctcccaccccctacacccctcttctcctcacctggtgccaccactcggcgcaggcgtggccgtcggcatccacacccttgggccggcccacgcgccaggtggcgaccacgccgccctcacccaccgcggcaaaggcgtcggcggcgggggaccatgccaggtcctggcagcagccccagccccccagctggctggtcagcgagccggagaagaggcgggagcccatggagaggagggaaccagaaccccaggaggccaggtcgggcggggggaggggggtgaaagaggccaaggcctcgcgctcgccaaactgccagaggtgcacgaagccgtgcccatccgcgctcaagaagctggcaggaagaggggtttgtggggttgagggggtgggttggactggaacgtgaggacgtctactgattcaaggctgcaaaaggagggtgcatttgtgttgaggtgcatgcacctccaccataccctcacggcacttcccagcgaacgctccgcgaggcgcaccccacagggcccctgaaacccaggacctgattcccacgctcgatcccaggcactcacaactggcgggtggggtgggcgcagagggcgctggcgtgcatgctgcccagctccggcaggccgtcgacgtggccgcgggccggtggcgtgtgggggctggtgggccccccgacgaagcccccaaacccaagatcggactcggccatcgtgctggatccccacttctcgctctcctcccagctgtgaaggaagttggggggagggttggctttggaggttgacacctgcaggtgtaggccatgcagctggctgccaagggaggttgcacctcgaggcggcatgcagcggtggtttcaccaccgcaagtcacaccatacatgagagagtgcacgcagaaggcatgatgcaacttcactcgttgcaaggcgatgcatcaaggtcgatccatctttgaccagcatcgcgctgcctcccccccctctcctccagcaccccccacctggcctggtcgaagatgtgggagatgatgcgcgaaaagatgccgccctgcgccgctggcgcctgaaagccgccgacgtcgggggtggagaccggggtctccggcctggacccggcctcggccgcgcccctgtgcgccgcgctttccaggggaatgacgtcactggccacgagaccgtggcggtgggtggacaccacgagagccctgccccccaactcgtcgggggaggtcagcgagcacagcgccagcgccccgcaccggtcgccgtccacacagacaatgggctgcctgcgatggcggagggtgaggaagtggtgagcaacacgtgcttcaacttcttgaataggggaagggtggtgattctgacagtcaagtnnnnnnnnnntgtccacgcagacaatgggctgcctgcggtggcggagggtgaggaagtggtgagcaccacatgcttcaactgcttgaatgggggaagggtggtgattctgacagtcaagtcgaggcgtgccaggtgagggcaaccaggaagagattggggaagccggggcccaagtcaggggcctctcggtaaggggttgctgatgccatcagactcggcactgtccgcaccctcacataccagaccctgtgcaacacagagcgctccatggccttcaaaactggcccctacgacttccatttcaccccccctcctcccactccaaaataaaacacccacacctcacctccccagcacccacctcttcagctcccaggccgccgctgccgcgccctcccccccgccccgcgaggaggagctgactctggaaagcgcgcccagccccagcgtgctgcagctgctgtcccgctccgaccccagccgctcgggcagggcctccggcgcaaacgccatctcctcggcatccagtgccgcgcacatcccggcggcggcggccgcgacggcccccgcgtccagcggccaccttgcctccgccgcggcggccagggcgcactcagcaaacgccgctgaggcgtcactactcgaagggaccacggcctcatcggaccgtgtgaggcccaccagggcgctggcggccaggcgggcgagaaacggcgtgagagggtcaagtgttttacttagtccagtctcttcgccctccttcgcggccgggccgatcgcgatggccgcggcggcggagcccagtgccaacagcggcaaccgcgccgcgtccagacttgtggcggccgcggtcagcgccccacgcagttgctgggccaggagggtcgcgtggtcggcatcatcgatggcatcgccatcacgttcacgtttgacatcatacacagcagcctccacacccacaatgtgcgggagcnnnnnnnnnnctggcatcgccatcatggtcacgtttgacatcaaacacggcagcctccacacccacaatgtgcgggagcagggcggcggcgagggcggggagctgcgcggcagccagggcgccgcccctctcccagcgcacacgccagcacagcgcgcaaagcagaccggcatcgtcgcccagcagcgccgcgcgggctgccgccccccagccccagtcttccaggtgatgcggggctgcgggcgcattgggtccactcgcgtggtcctgggaatggtgctcgggttggtgcaggctcatgtggcggtccaggaggcgggatgggccgggcggcggccgcccggcgggagcggcgccatcgctgccagctccgaggctgcgccccttcaccacgccgccgcccttccctcccatcaccagcacgacgatgcgccgtatgaagagcgccagttgcaggtcgcccagctcgcgcacgcacacgtccagcgcatcactcacgtggccgcccaggaggaagaaggccgccgccagggagaagcggtgctggcccagcaggacgaatgcgttcttggcggcggactgcgcgttggcgggcaggccaaagtcccggcccaggaaatcggcctgcttgcgcgcgttggtggtgcggtacaggccctgttttgcggtgtgtggggagggttggggatggggagggctcgctgagactgcgttcttgcaggcaggagcgaactccaagaattaaaagggactcgagaagcacagctgcatcgcatggggctgactgagagacccacaccccacgcacaggtgccgcnnnnnnnnnnggaactccaagaattaacagggactcgagaagcaaagctgcatcgcatggggctgactcagagacccacaccccacgcacaggtgccgcacctgcagcgtcgccttcttgcccagggcgacgtacagcagggcgcacgcgtccggcttccgcgccgcggcgaactgggccttggccagcttctcgccgacttccagcaccagccccgggtcgcgcagccagaagccggccccggcagccctcagggcctcccaggtcggcggctgggcatgcccggcgtcggccctcgttcccaagaagctcggggcggcgctggggccggattcggacgctgctgtgctgccatcgactgctgcagccaggcttggcagcgcctcctccagcagcacctcctgggtacctgtggtgtgagtggagtttgaatttgagctcctcttgcccagccaccttgcacccactgacctgtgtgcaagtcacaggctgccaggccagggcagggtttgaacatagaaaaagcacacgctacagacaccccgtgctcgaacagtcacctcagcacccacctgacatgagtgcccagaccaccgcctccagacccaggccggagtgaagctgcagggaagctgccagcccgccctgtggcatgccgtggtggcccgccgcacgtgctaggtccaggaaggccctgcccgccgggttgaggcgggcatgccctgcggaatcgctggcagccaggaccctcgccaaagccccgccgccactgctatccaggcgacaaatcgctgcggtcacccgctcggggtccggcagggctgggtctgcctcagaccgagtggacgctatcgaggttcctccttgggcccgactgcaccgcagctgtccctcctcctcgacaggctccagggctgggacagtgtgtggctcttttgcaagggggcctccttggtgagatgcctcggcgtgcaaggtgcccatatctcccattccaaaggccgcaaggtccagcatgccagtgtcctgggctgcacgagcgacacttgccggggacaaggccgctgcaccccatggggcctctgcagtgtgctggggtccaatatctcctgcaccctgcccaccgtttcgttctcgctcccagccatgagcacgcggcgctgtcgactccctgaggccggccaggagggcaggaaggcgcagcgcgacgctccacgccgcccacagcgccgccagcgctcgctgcagcgcggcttcggcctcgccacctggcgcaccgccctccagcgcagcagctcgagcgatcaggaggtggaccgccaccccacgcgccccacaggcaagcagcgctgccagcgtcgtggtgccgtgcgccggcaggggcccatgcctggccgctatcgtcctggagtgattgcaaggatgaggggagcagggtcggtccaccaatagacggcccaagcagatgacaaggccggccagtcatgttttgcgcttcaactccccccgcaagactaccctcttcttcacctcgccaagccgtggaaccccaaatcagggcctgccgcgtccaggagaacgacagaggacccgacggcggcggccagggcgccggggcccgccggggtcaggcatgccagcgcgcctccctgctggcccaggtccaggcgcgctgagggtgcccaccttccgccaggctgctggcaatacagcagcgcatcggcacccagcaccactgccagggccggtgccacggcatgcggcacccaggccaaggaggccgatgtggctactccgtctcgcgcaaggggcggcagcgtctggacggcggcgtgcctgccgcgccagacgtgcagcagcaacgtgggggggtcggcagctttctttccagcagaggcctccgcgagcggtgcagagtctgccagcacgggaccgcccgtgagggccgccaccaggccacaggcccccgccgccgccgccatcacggttgcttcgtcggggagcgcatacagccccgccggcaccagttccgccccgctctcgccgtcgcgctcgaccgcgcgccaggcgcgcagcgctccccgctcggcgctcagcagcagatccgaacctgcgcccagcactcgcacatgctccgccccgccccaggccccttcagcgcagcccgtcagcgagcgctctttcccccagcgcagcgtccaggccaggcgtgggccggcccgatcctgcgccgcggtttccagcagcaggagcgccgccccacggtccccgcccgccaccgcaatcgcgtgcagggccacagcccgcgttccgggcggcagggcctccacgagcgcgtccccggtcccgcccacgaccaccaggtcgcccgtcgtcgccagcgccagcgcggcgtcctgcgtccgccagcggcgccgcaagggccgagaacgcgtgtcgccatcggaggcggggcctcggtaggagcgcacccccgcgtcggcgccgggtgccgcgcccgccgcccgcccggcagcctccccgttgcgccgtccatggtgcccgannnnnnnnnngcccccgcgtctgcgccgggtgccgcgcccgccgcccgcccgacaccctccccgttgcgccgtccatggtgcccgagactcaccagtgacatcgccagcactgtcacgcctggcggcacgaggctggcgctgcccggggctggaaacaggcggcgcgccgcccccgcgccccgcctgccggcttcccatagcaggaggcctccgccggagtccaggctgcccagctggccgccgtaggggctccctgcgatgtctatgactggagtcgcatgccccgtggcggcgccgcgccaggcgctcagcagggtcagagcgggcggaagccctgcggtgcggggggtgggcctaggccggaagaaggtgccgggctcctggacggcggccgggaccgtggcgaagcggctgcagtcaatcctgacctggcagtagagggggggaaagcggaggttcaggcctggctctggagggactcggcgagcccgggcacaagcagaggccaggaggtctcaacttgtaacagcaaacctgccagaggccgactccttccaggtgcacacccaaccaccccgaatcccagcccttgcctctggccgcggcacggcaggtggggcggctgctgccgactccagcaccaggatcgtgctggacccctcccgcgcctccaggcggcaggtcagacttggagggctgtccatgtggtgcgcccccctcggcctccgctgctccagctggccccagagcaccgcctgcgcggaggtgacggcgcccgggccggcactgctgggcccctcctcggcgcgccaggaagaaaccacgaccgcctgcagcgcgcgcacgacgtgcacccgcgtcagcgtggatatgtggggtgcgggtccagccggctccatcccgggcgggccctcagctacgcggcagcgggacaccagccacagcaggtcgtcgtcgggcggggcgcggcgcggcgtcaggtcgccggcgtcgtgcgtcgcgcctgggcccgatcctttgtcaccctcctcttcctcacgctcctcctcagcccagacggcgcgcaggctgccggggtaaaagccctgggcggggccctggatgaccatggccatgcagaagaaggagtccaactgcggctgctgggtcgggtcagcggcaggctgcaccagcgccatctccacccacagccgcacatccccgtctgtgtggagaggacagggtgcagtggcgtggtaggcaagggagcatcgtggcacgggcaaagactgagtgggcaggatccttaccgtgcgaatgcatgatgatccagagcaggtttcagtgcccccacacattcgcccctgggtctgcactgacccagcacaggaacgagcccctcctccggtactccaccgcccagcgacaaaacaccatcacacctgcgccgacggtgagcannnnnnnnnntccctcctccagtacttcaccgcccagcgacaacacaccatcacacctgcgccgacggtgagcagggccgggtggtccttcagcgcgccgggccccccgccggccaggcccgtggctgcgggcttccgcagcacgcgccggctccaggccaggcccaggacggggcaggggtggcgcagcttctcgcgccgcgcgcccgagccctgcgcnnnnnnnnnntgggtggtccttcagggcgccgggcccaccaccggccaggcccgcagctgcgggcttccgcagcacgcgccggctc

SEQ ID NO: 36652 - DNA, 77 bp, Chlorella protothecoides
gggggagagatggtttttcttgttgagggggttctcgcgggtccacatcgtgctttgccaaaagcgcgaggagcctg

SEQ ID NO: 36653 - DNA, 153 bp, Chlorella protothecoides
aggagactgcatgccgcagcacgagaagagtccggcgggcgggggatggggcgccgctgcgcggggacagccatcctggaaaccctgttgctcccgcacgggctacccacagcgccaacgactaggactggcatgctcgcctgtgcatcgagt

SEQ ID NO: 36654 - DNA, 77 bp, Chlorella protothecoides
gctgtagcaacgtacctccacaatgcagtcagcgggcaaatgccatttgcacgccagtcgctgggtaccatatgatg

SEQ ID NO: 36655 - DNA, 75 bp, Chlorella protothecoides
caatcagatactcgaaatctaaatatgcttgtattcgtatctctgtcacttgtgtttgcagctccagctgcggat

SEQ ID NO: 36656 - DNA, 62 bp, Chlorella protothecoides
gagggaggtcaatggtggtgtcacctccccatcgcatggcctgtgtccacagtaccggtctc

SEQ ID NO: 36657 - DNA, 656 bp, Chlorella protothecoides
  modified_base (98)..(333): a, c, t, g, unknown or other
  modified_base (392)..(603): a, c, t, g, unknown or other
cgcctacctgtccgagagtatctagacaaggaaagataattgttgcacactctctctccaaaggtagccggcgcgctaggtgacgcagtacacgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgccagtttcaatcgttggtcagccgatcaaagcattaacaagcatagcattgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccggggtatggtggacgggccacattgcgcacagcgtacggcatactctg

SEQ ID NO: 36658 - DNA, 62 bp, Chlorella protothecoides
cccgccgagccagcgacccagctgatcgcatttggaactggctctctcccatgctcctgacc

SEQ ID NO: 36659 - DNA, 61 bp, Chlorella protothecoides
ctcgtcagccacttgggctttatgggaccaggggcgcacctgaagcactcgactgacaacc

SEQ ID NO: 36660 - DNA, 66 bp, Chlorella protothecoides
gagcggtggctgcccttgcacaggtgtgccacgacctccgtcgacgggggcgcagcgcctgcctgg

SEQ ID NO: 36661 - DNA, 85 bp, Chlorella protothecoides
atcgtggggtccgtcatggggtccgtcatgagggccatcatgagggccatcatgaggtccatcgtggggccctttgtggggtccg

SEQ ID NO: 36662 - DNA, 106 bp, Chlorella protothecoides
ctggccttgcgatgccaggtgggccgccagggccccctttggaggaaagcggggagcaatgaacatgtcgcacggggcgctgcgcggatcatgactctgtcgcgtg

SEQ ID NO: 36663 - DNA, 76 bp, Chlorella protothecoides
cacttgatccgccgtgcgcacctgcgtgccgccatctccctctgggggcacagtgcatgcccatggccgccaaggc

SEQ ID NO: 36664 - DNA, 14255 bp, Chlorella protothecoides
  modified_base (872)..(881): a, c, t, g, unknown or other
  modified_base (2139)..(2148): a, c, t, g, unknown or other
  modified_base (2357)..(2366): a, c, t, g, unknown or other
  modified_base (2587)..(2596): a, c, t, g, unknown or other
  modified_base (3172)..(3181): a, c, t, g, unknown or other
  modified_base (3955)..(3964): a, c, t, g, unknown or other
  modified_base (4346)..(4355): a, c, t, g, unknown or other
  modified_base (5834)..(5843): a, c, t, g, unknown or other
  modified_base (6158)..(6167): a, c, t, g, unknown or other
  modified_base (7689)..(7698): a, c, t, g, unknown or other
  modified_base (9587)..(9596): a, c, t, g, unknown or other
  modified_base (10143)..(10152): a, c, t, g, unknown or other
  modified_base (10493)..(10502): a, c, t, g, unknown or other
  modified_base (10700)..(10709): a, c, t, g, unknown or other
  modified_base (11295)..(11375): a, c, t, g, unknown or other
  modified_base (11967)..(11976): a, c, t, g, unknown or other
  modified_base (12576)..(12585): a, c, t, g, unknown or other
  modified_base (13236)..(13245): a, c, t, g, unknown or other
  modified_base (13382)..(13391): a, c, t, g, unknown or other
  modified_base (13461)..(13472): a, c, t, g, unknown or other
  modified_base (13558)..(13567): a, c, t, g, unknown or other
  modified_base (13799)..(13808): a, c, t, g, unknown or other
gggcggggcaggcgcatgtgcggctgcccgtcgccctgcgcccgccccgtccctcacccccgcccccaaacccacctttcccctcgagcattcgaagccgtcggctccccagccccctcccatgccgccaccactccagtgccagccgccacagggtaaattttagaccagactgtgatgccctgctgcctttcgtccctttcgctctcccgctttccctctcgctccgtctccttccttcccacacccgacgggcgccgcgcccgccggcccgcgcccagccgtcccgtcgcgcctgcgcatggcttgtacaccccgccgggggcatcgtgcgaccgacagctccccctttcttgccccttgtacccggccacgccggctgcccgctgtgttccgggctgtgtccatcccccccatacgctttcccccctcaacccccccccctgtcctgcgtgtgggggcctggggcggctgccgggggcagacggccgaccccgcccgcccctggaacccacgcgtcgaattgtccacctgtgcacccccaccctgtccccacctgggcgttcccccccaccgatcggtccagcaccccattaccttctcgacgctggcatctggtggcgtgaggcgggcgccgcccatctgccgtcttcctctgaccgcgtcgctgcgccgacgtggcgcagctcgccgcacctgcgctccccaaaccttctcgtggccgcggctcatctgccgagctgcccttccttggggctgggcccactccccaccctctgctgctgctagtctgctaccgggagcgggggtcggcaaccctcccactccccgaacgctgccatccacagcgcggcgtgacacccccttgcctnnnnnnnnnnaaccgggagcggggttcggcaaccctcccactccccgaacgccgccctccacagcgcggcgtgacacccccttgcctcctctgccggccgttgcatcgcggcaggctcctggaggctgcacctggtgtggagccgtgggaatgctggcgcctgccatctcagcgtcattcccagggctttgccacgcaacccgccgcgtgcatggcaatcccacatccgaccaactctggactgcacacggcagtccgagactctcgacctgcaccctaaccctgcagtgtcccacccttcccattcgatctctggcagcagggttgatgtccttaccctcgacccgacaccagaatggcacgtttccatgggcaccgaagcatgcacatccatgctggcaattaatgtgcctctagtggcttgcttgtgtgtaaggaacacgtgttctcaggcgtctgcacttgacgagcaggtggcccactacatggaaatctgtgcctgagaatctgtccggtggaaaatcgcggagggaagcgacggattcgcccatcccttgggcgtgcgtgggtgagaccaggcacaaaagtccttcccttgatagctactgttgtatcttacctcatcatctagacaacatcgccgccttcgaagcatgttgcagtctgtccgcctctccaggccattcgtgtccccggcaagcacccggacgtcgctgacctgcacagctagacgtccagaccggccgtcacgcacgaatgcacgtctccagcccaggggaacagcgggagtgggtgagtgacggaggtctccgaggcgttgacagcgccccccactgctgacgagagttaggctcacagggttccccgacctcccccaatcttcgcagccccaacagttaaggcagcccccccgcctccagcaatcaagctgaccgacaaagctctgtctcacttacaacgactgcgggccgacaagggcagacagtcggtgatcctgcgcatgggcgtgcggtcggggggctgctccggcatgacatagtaagcccagtgagaggggagcctggtgctttggtgagctcaggtgtctgacatgccatggaaggagcattgttcatcgcaaagtgcttccgtagatgggagaccgggctgggatggcctctatcttgctaggtgcaggtgcagtgcatgcgtacctgtacattactgccaggagcacatcacgatttcctcgttcctcgaccctcccagcttcatggacttcgaggacnnnnnnnnnngcctgcacatcactgccaagagcatatcatgacttcctcgttccttgaccctcccagcttcatggacttcgaggacgaggacaaggtgctgcccagcgatgctgtcatggagtatgaagagggtttcaagcttgtctgcgactcaaaatcgctcctgtacctctttggcatgtccctggactactcagatgagctcataggcggcgggnnnnnnnnnnaacaaccccaatgctgagagctcctgtggctgcggcaagtcctttggagcctgaccgtggcagtgctgtgacgcgtaccccttttcccatgctgccctgacgggtggacgtcctgtatcatttaaaaccccaggcctggctgtaatgggcgtacaacaatatatgggaccgtcatggagccccaacgaccgcctgaggggtgtgggattatgccagcacannnnnnnnnncaaccccaggcctagctgtaatgggcgtacaacgatatattggaccgtcatggagccccaacgactgcctgaggggtgtgggattatgccagcacaacaggcttgccaggctggaaagcaggggtggggacatagttacacagtcgggcatgcccagatcaggcatccggcaggaggccggagaggtcggtgatggggacgcgggactggtcaatctcaaccaccagtgtgtggccctttcttgctgtggtggggccgtccttgtacaggctgggcaggtacagacggtaggccggcatgtaacagctcacaaagtcggccacctgatggacgaaagtggggggggtctttgggatgaggaagtgtgtgagaaccttttcagacaaaggcttgcgggcgtgggctgtggacaaggcgcaggtcccatctgaggggagcaaggcgcatgtgctgcagcccctacgccccatgccaactcagacgtgccagcgctttccccatcccagcaaccctcattcctttcccccccaacgagaaccaagcattgccctcgcctgcgcatcggtcatggcgggnnnnnnnnnngggcgcatgtgcttcagcccctacgccccatgccaactcagaagtgccagcgctttccccatcccatcaaccctcattccttccccccccacgagaactatgcattgccctcgcctgcgcgtcggtcatggcgggtttaccggaccggcgctgcttctgctcagcttccaaacgccaagcggcggcgtacccagcatctgccacctggatgacgatccaggagtgcacatacatatcccatgcatccttgtacctgttcatggcgaggtgaaaaggtctgacaacaatccaggggtgcattgatcacaccctgggctccatgactgtagcagctgcagtatcccgacttctgcaggttaagttgtgcagtccaacagcattcactgggcggccgcacgagaatgtgtgccgttcaactccccgcatcccctgcggccatgccctatcgcccatccgccccccccaaaaaacaaatcctccacctgcgtagggcgcgattgatgggcacgaggtctgggtctatcgcagccgcagcctcctcatcggtggcctgaaaccccagcatccagccttcgaagaggaccaggtcgaccgggccctctaccgccgcccactggtcctcggggaagcggtcgccgcgcccggcgtgcgcggacttgtcgtagcgcggcacgcgcgtccgagcatcgcttccagcagcagagctcagcgcacgcagcgtggcggtccccagctccaggtcatgcgtcagcgcattgcctcgcttctccagcnnnnnnnnnnccttccagcagcagagctcagcgcgcgtagcgtggcggtccccagctccaggtcgtgcgtcagcgcattgcctcgcttctccagcagcctgttgcccgggtgctcgccgctcactgcaggggacgtaaggagtgaggggtgttgcagtggccccaggtgttgtacaagtagagagtaggagtgcagggtgtgaccggtggggcagcaggcggcggtaagccaaggggcaggcatcttgccagccggtgttgcagtcaccgggccatttggcactcaatggctctgacgactcccggtgcagttgcagagtggcgagccaggtttctaaaccccccatgaggccgctccaactgttacatgtccccagcgtcaaaaggccccnnnnnnnnnncttctaaacctcccatgacgccgctccaattgttacatgtccccagcgtcaaaaggcccccctcctccccagcccctcgacacttacctctctgcagctcggtgtgggtgaggtaaaagtcgtcgatggagacacccacggccttcagtccctgctcctcaaaggcagcgtgtagctcctcgcagagcgtagacttgccgcagccctggggagcagagatgcccacgaccagtgggcccctctcccctgcgtccctgtgctgcttgagctggtcctggatccaggcatacaccgggaggtagtagtgggacaccctggccctgtggtggcgggagtaagatcaaggatgggtcgttcgtaaaaggaggtggtgcacctgcagtggagcagggcacaccctgccaggcagcatggccctgggggtaccttgcttcgggaggcactgtgtcccaagatcctccatgccccaggtgtgcgagcatgaatttggccaccccatccagagggcttggagcaggaggggatagcctgcttccccctgcatgggccatggcaggcagagcgtagcagcgtccgaccggagcggcagcacgataaggctggatgaaacagtgaccaggtctcgcaacaatgctcacatgcatgggtgaactgttatataagagacaggtatggatcagagcccaagaacggcatgatccagtactggctgagtactgatcgatcgtcatggcgggggtccacggggcagctcagtgtcggaatgcttagtgagggaaagggtttcctggaagtgcttttctctcacacgtcgtcctgaaaacatgatggcttccccttcaactccatcaaacataatggacatttacatgcctcgttcatgcccactctggccctaagggaagaggtttgatttggtaccctgctggtgactctgaggatgtcgagtccagccaagagtcgcaagcgagtgcgcttctcagaccaacctcagattcgggaattcgaacctgctttgtttcctgcggctgagtcgacggatctgcaggatctagagggtgagctgctgcctttgctctcgtgacacccctgcctgcagactcacaggcaaagacgccttttcatgcatgagcccacaggtggcatcgatgcggtgcacctgaccaccgtggatcccgcgagggcggcatctgatcgtgcaaagcggcgcagggatgccctgatgatgagctttgaggagggcatggaaggggacgagcttgccgcagaggccgagtataatgacatccctgtctccagcaggtggtgtttgctcctcatgccttgcaatgacaggaggtcatgtgccccaagttgacatgagcacagcaatctagatgccaaccacgggccctaaaccctgcaggcttgagcattcggcccggttggagcctttccacatgaagcgagagagggagctgggttactttgacgccgaannnnnnnnnngaagttgacatgagcacatcaatctagatgccaaccacggaccctaaaccctgcaggcttgagcatgcggcccggttggagcccttccacatgaagcgggagagggagctgggttactttgacgccgaaacaggggactatgtcgagtacgcatctcggagggacgtccctgacgcgtgggccgatgcactcccaggtcaggagcaggtatctgcatgaagctatcgggtagctactcggcctgccctgccaaggagccccttgcatcctgggggtcccggatgtgtcgctgctgcgagatgatgcaatcggcannnnnnnnnnagtagctactcggcctgccctgccaaggggccccgtgcatcctgggggtcccggatatgtcgctgctgcgagatgatgcaatcggcacatccaatagttgttactcctttctctcccacacccacagtcaccgagtccatggaggatgaggacgacagcgagtcagctgaggaggctgagattgagatgggcgcagacaagggcggcgatcctgcattgctgaggaaaacgtgggtgctgcaagctgtgcttcgatggagagggtggatatgggcagaggcaaggagtggcagcaaggactgacgatcctcccagcaacacttggctcacgctgggctgctttggtcgtcgctgcgttgccgggagtggaaaggattttcatttttcaaacaaagctttcctccgctcccccatgttcactcagcccatgctcccctcttcctcttgccacagcatcgtgcacgccctgcgtgagggcgagaccgtgctgagcgcgctccgccgcatcgcccgggagcgggaggtggcgacgggcggcggtgctgcggccgccccgcttcggcgagcggtgggtcgcggtgtggggggactgaggggggagttgcctgcgcctcgctgacggtctcctgtgacctgcaggctggtagtcatgtcagaattcaggcgcctgggttacagcatcaaagacccgccccaaaaaaaccatcacgaacagtccatgctcccggccgcggcggcagccttcgaggagctcacggatgcggcggcgcagctcatgcgcagcgtgggagactttgggctgtacagcaagacgagggagcagattgcggccgggggtgccgcggcgctgggcccggccgcagcgggcggtctgacggccacgcccgggccaagcctcacgctcatggctggccggggggcctcaaacggcgatgcaggggcggctacattccacaacccgcccccgcctgctgatgcggagctgaacatatatggcgaggagggcgggggggggcgggccgagaccccggcgtcggagcggcctctgtcccccgccgatgcggaggcccgcgcggcgggcgagggcgactcgaaggggccacagcgcctcccttccccgctggcgcaggcccagcccctcccttcctcgccggagcccaaggtggaaggccctgcacccagcccagttccctccggcgtgggaagcgacccgctggacgggttccaattagaccccggatccgggcagtgggtgaaccactccctgggctgcacctttgaccccgcgacccagttgtacggggacgtggaaagcggcgcgtggtaccgctggcaggacgggcagtatcacccggtcgtcacaggctcctcctgagcgcgccccggcccctaggctcccccggccaggccactcagttccaatctcgtggcacggtacaagttcccaaaatgacaccatgtgtggcctgcactccttcgtgctgcaagcctccccttcatgctgcaggccaccccttcgtgnnnnnnnnnntggcccctaggctcccctggccaggccacccagttctggtctcatggcatggtacaagttcccaaaatgacaccatgcgtggcctgcacctcttcatgctgcaggccaccccttcatgctgcaggccaccccttcgtgctgctggccttttcaaaacttgaatgactaccctcgcaaacctgcactttgctccgctgaatccccctgcaactatgctgaacccgccttgattgcagcgcatgcggccccgtgcgccagtgggcacactgaaaaacctcggcccccaccagaccactgtgctccttgtcatcgcatgccttgcactctagtttgacccaggcatccccagcgcgcttcgcacactgcagcactggccgtgtcaacgcccgactcttttatccgcatcatccagtgcatgacatcgtgcgcagcatggcaggggtcagggggcatgccaaggcttcattgggtgaccaaggggggggcccccctctttaagagacaccccctaccccatacctttcctcaagggtgcttgcctccgccgctggccaggcaggcctcccagtgctcgccgtcgatgtctgtgtggtctggtccctcccagggcagcgcctgcggcgtcagcgtggggaagtgggtggcgatggcctcccgcacccagttccccaccagcgtctggccggccgacgagaagtgcaggccgtcgcacagcagctctgtctcccaccccggccgctggctgaacccggtccacaggtttatgctgggcagggagagggagcgggcgacctccgcggccgccgcagcgtaggcgcccgaggctgcggcagtccgctccgcgctttccagggccagaccccgggtctgcagggcgtgcgtcaggcgggtgggttcgtggacggggcccggcgtcagcaccaggatgttggccacgcccagcctgcgggcgtgctgcacgatggcggccaggttggctttgaactcctccagcggcacgtgctgcttggccctggcttgtgatggggaggggaggccaggagagggagtctcaggagcagggctgaggctggcgtggagagggagctgcaacccttgcacaggtgcggcaggccgttggccgggcacgtggggcctaggccaggcgcaaggcccaaaggtgcagtggggaggaaaggccacaagggtcaagcccgactgatggccaccaaacctctattggaagcccgcgccccactcacgatgagcgatcgggcaggcaggcgtcgttggcgcccaggcagaggatgaggagctggggtggggggcccggcctgtccaaggggagaatggtggggagcaaccccagcacccagcgggagttgtacccgctgtaaccccggcactgcacgtcgatggaccgggagtaggcattcacgagactcgcaccccaccccgagggctcgaagctacgctgggtcagactgtccccaagcaagacccagacgggccgcatggtgcagggctcgcggaagggcaaggcagtacggcaggttcccttcccgcttggaagctccccggccggatcggatgtttaacaatctcccagtggggaattgtggcttcattgccgtgcatgccagcgtcaatcaccctcgacaccggcagatcgaggggtatctctggccggtgtccggggtactgacggagcggtgaacacgtttccgtagggctgcatgttttgcagcacccctcacggtcccctcctctttcccttgcctccatactccttgctcatccagcctgggatatcgtcgctgcacagcatggcacatacaatcgtactagcacataagagcataacatacatcattcgcatctgcctgggaaaagtctacaggggggggggnnnnnnnnnntcaccccctacggcccatctccttccctatctcccaaggccagccccagccccaacatctcaccttcaagccttccacctccgcccaccccctacactccatctccatcggcctcccccaccccaatccccagccctacagtctctccttccattactccccctccctcgccgtacaggtctaccatcagttcccctcctcctagctttccaaccagcccctccccctctccttacaactccaagacccccgggaaacttcaagctagacgctttcacaggctggcccagtgatagcactggtgtgacttcatgatgatctagtcttcctctccaacaagcttgcacattcttcttgattcttgatctgttcaaatttctgcagctgattcatagatagcggctgcatttctcctctgctcgcggccaattgtaatacacgcgtcacaccttcggtcacataagagaagtgaagatatatctggtcttggggtggatttcatatggcaacaacttgggtagtgggtgtaagtgtgcttaccgccttnnnnnnnnnncttctgcggttgattcataaatagcggctgcatttttcctctgctctcggttaattgtaatatacccgtcaaaccttgttcacataagagaagtgaaggcatatctggtctcggggtggatttcatatggcaacaaccttggtagtgggtgtaagtgtgcttaccgccttagactgtcgcatcctgtcatgaacagacaacgagacccgaatgttcggatcccctaagttcgacagaacggctcaccagcgtcaaaaatacctcaaaaatcgttcctagtgcttggatcgtggcttgtgtacctccccttgacatcactgcgggtatttgaacctttgacnnnnnnnnnngaacctcaaaaatcgttcttagtgcttggcttgtggcttgtgtaccttccctggacatcactgcgggtatttgaacctttgacgcccctgctgcctgctgtaaccggagtggatccggagggcgcaaggtcagctgcgccagagggacaaggggggtccggagtaggagtcggagcagagggatgagctaccgaatannnnnnnnnnggagggacaaggaggtcccggagtagaagtcggagcagagggatgagctaccgaataggttccagacctaccataactctccccagtggcttcttggaactgagactgcccgaaggattccgtgctcaattgccggtggttttccagattcgaccaggggttgcggtccatagctgccgacatggcacgtcttctgctctcgcttctgtgcgtcactgtgctcctaacatcctaccaggtaatgtgcagcttgtttgaccaaatccgggagtgtaccgagtcaatcgatcgacccaagggtttcggcaacccgttgtgtgaggcggcccacgacccccctccatgcaggtgtctagcgctccggtcatatgcaacgccaacgacctccgcaacttcaaccctagcctgaacagtggggatgactcccctgccctgaagcgagcggtgcgcgtgacctcctgccctgtcccggatccacagaccctgcctgctccccagctcctgcatgctccccaggtgccacgcttccctctccccgccatcgcaggacgcctccccctccactacctacatctatgccgacaannnnnnnnnnnnnnnnnnnnnnnnnnnnnnnnnnnnnnnnnnnnnnnnnnnnnnnnnnnnnnnnnnnnnnnnnnnnnnnnnagcccctggtgacgggccgcttcctcagcgtcaagttggcggccggggcggtgctgacgctgtcggcccagccccgcttcccccgcggccgcgtcatctctggcgagggacgggtggtcttttctggccccggacccttctgggtcctccccgattggtggatgggcccgtcctccaacaccgacgccagcgtggcgctggcagccgcccgcgccgcctgcgcctccacgctctgccacatcatcgtcacagggcagacccggttgtcctcccccctcaccctcacccccagcttcctgatctggggctccgcccgctccttcctgaccggtaccacctccgccccctcccccgacggcctcatcctcgcccccggtacctacgccaccccgctcaccctgccctacctcaccggcttcagcggcagcgccctcaccctgcgcggcgtacgcggcctgcgcgcttacgtccccatgctcagctccagcgcggtggggctgcagctggccaccagcgccgccgcgcccgccatcgccgacaaccagttggaggccttcctcaccaccggcctggggcacgccgtctgggtcannnnnnnnnnacctgccatcgtcgacaaccagttggaggccttctttgccaccggcctggggcacgccgtctgggtcaatgctcgggcgggggacaccatctctgccacctccgtctactccaacttcctcttgcgggccaagtccggcgcctcctccggcgtctacttctccggtggcactcctgccctctccaacttcaaggtcagcttctccgccgtagacgccgccaacacaggctccacctttgccctcgtgcgcagcggcgtcgccgctgcggtgtccaacgtcgtggctgaggtcacggcctgggccggcgggttcactgcgggggcgagccttgtgagcggtgagcctgctgcgtggtggtgggcgggaggggtgggatgtggaggagggttgactcggtaaggtgggctcagaagggtgccgggcatcttcccgagtggggcctgcaccctcaacaacaaacagctgggcaaccgcccacctggctcccataccccatgcccagcacctgttgcccgtccctgggtcatcacccacctccaacccatcacccttcccaacccttaacactccccccaccctggcaggggccttcaacaacnnnnnnnnnncgtggtggaggattgactcggtgaggtgggctcagaagggtgccgggcatcttaccgagtggggcctgcgcccccaacaacaaacagctggggcaaccgcccccctggctcccataccccatgcccagcacctgctgcccgtccctgggtaatcacccacctccaacccatcacctttcccaaccccaaacacccccccaccctggcaggggccttcaacaacctgaacctggtcatgaaactgtcggggcccatcagcagcaaggtgctggccttcaccggcgcgggctccaagatcaactgggatgcctcgtggaaccgcgacagcgccatggccctggttgccacgcgcaccaagaacccgcccatcggcgacatgatcagcaccaactttgcggtggtcaagctccccgccgccctcatcaccgggacctggcccaaaggtgggaccagcggctttgttttgtttgtccctgaggggggaaaggggttggacgggccgaggctgcggtctggagtgtccacgtgggcagccgaccaggacggaccgtcccaaggcgaccagcgcacatcactctgaggcgtcctggagccacgcatgtctcggccgccggctggttgggctcctgaaaggccgggccacactttctnnnnnnnnnncggaaggtccacgtggggagccgcccagaacgggccgtccaaggcgaccagcgcacatcactctgaggcctcccggagccacgcacgtctcgaccgccggctggccgggctcctgaaaggccgggccacactttctnnnnnnnnnncaacaatctcccagtggggaattttggcttcatagccgcgcatgccagcgtcaatcaccctcgacaccgnnnnnnnnnnnncttggcagcacccctgacggtcccctcctatttcccttgcctccatactccttgttcatccagcctgggatatcgtcgctgcacannnnnnnnnngggggcaggcacttgctgggacccccacccacccaccagggggaatcgctgctgcccaccacttttcatcccttcactctgccaagtcactggtgcattgtccacagactgtgcaagctggcccctgcattccaggatccgctgtgctccatcgcattctgatagcatgaagacctcacccgctctcccacacactcctcttccctggaacaggcaccacccggaccttctnnnnnnnnnncgttgcctgttcggtcagcgggagggaaatccctggatcggtgtttcgcgcgcctggcgctcctgatgtcaggagatgcccccgaccccgaccatgaggttgaagtacagatcgtacgtcttgccagttggcagcgtcacgtcggccttggtgatggaacggcccagggtgttcttcagcgtgacagccaggttgtaggaccccaagtcctggaccccagccaccacgaggccggggttgacgatgaagctggcggcgggctgcaggcggccgggtcccatcaggatgcgcttcatgccgccgttggccatgaggtggttgatgtagaaggtccgggtggtgcctgttccagggacgaggagtgtgtgggagagtgggtgaggtcttcatgcaatcagaatgcgatggggcacagcagatcctggaatgcaggggccagcttgcaca

SEQ ID NO: 36665 - DNA, 162 bp, Chlorella protothecoides
agtgcgacccgtcctgggtttcaggatagatctgcacaccaccaggagccctgctcctatggattcccgcctcgctgcgctcactcgagcgagcatctcccggcctgcccccatcctgcttccatttcaaaacaagtcacggcatgcacgttcccagggagg

SEQ ID NO: 36666 - DNA, 71 bp, Chlorella protothecoides
tgtgccctgtgcggtaggaaagaggggggggagggatttatttatcaagtgtgcaagtcagtccagggcat

SEQ ID NO: 36667 - DNA, 62 bp, Chlorella protothecoides
accaggttcttcacaatcctgggcatgatatgagaggagcaaggattttggagggaggagag

SEQ ID NO: 36668 - DNA, 78 bp, Chlorella protothecoides
gtgtggtcacacccattggctctacaaaacttccccttatccccaaaacgcaggtgacggaggtgtcgctcacggcca

SEQ ID NO: 36669 - DNA, 97 bp, Chlorella protothecoides
cagcgactccgtgctgtccacctcgtcgaatgaggctgcaggagggtgtatgtcgggcagggggagtttgatgacacgggatggcaggttggtatgg

SEQ ID NO: 36670 - DNA, 116 bp, Chlorella protothecoides
ttcttgccccggcaccatgtctgcaagggtcagcaaggaagttgctggaaagaagccgacaactgggcattgatctggaatccccatttgggccacctgccccgacctggcctcca

SEQ ID NO: 36671 - DNA, 20905 bp, Chlorella protothecoides
  modified_base (543)..(552): a, c, t, g, unknown or other
  modified_base (1322)..(1331): a, c, t, g, unknown or other
  modified_base (1966)..(1975): a, c, t, g, unknown or other
  modified_base (3372)..(3381): a, c, t, g, unknown or other
  modified_base (4458)..(4467): a, c, t, g, unknown or other
  modified_base (5264)..(5273): a, c, t, g, unknown or other
  modified_base (5513)..(5522): a, c, t, g, unknown or other
  modified_base (5810)..(5819): a, c, t, g, unknown or other
  modified_base (8938)..(8947): a, c, t, g, unknown or other
  modified_base (9506)..(9568): a, c, t, g, unknown or other
  modified_base (11719)..(11728): a, c, t, g, unknown or other
  modified_base (14265)..(14274): a, c, t, g, unknown or other
  modified_base (14602)..(14611): a, c, t, g, unknown or other
  modified_base (15020)..(15029): a, c, t, g, unknown or other
  modified_base (15340)..(15349): a, c, t, g, unknown or other
  modified_base (15868)..(15877): a, c, t, g, unknown or other
  modified_base (16118)..(16127): a, c, t, g, unknown or other
  modified_base (16745)..(16754): a, c, t, g, unknown or other
  modified_base (17424)..(17433): a, c, t, g, unknown or other
  modified_base (18411)..(18420): a, c, t, g, unknown or other
  modified_base (18552)..(18561): a, c, t, g, unknown or other
  modified_base (19434)..(19443): a, c, t, g, unknown or other
  modified_base (19551)..(19560): a, c, t, g, unknown or other
  modified_base (20027)..(20036): a, c, t, g, unknown or other
  modified_base (20716)..(20725): a, c, t, g, unknown or other
cggcgggcatcgccacgggcgcgaccggcgcggcgcgcggcgcgccggcggccggcaggctgctgctctcctcccccacctcgtcgccctccagctcctcccgagtccagccgctgcccgaggtcaggcacacgggccccggctcggcggccatggcgcgcagcgccaccgcggccagctccgcctcgtagctctgcagcgggaagttggtcagcgcgtcggcgccgttcagctccaggcaggccacgtcgtagcggcgcgcggctgaggcctcgtcccggaagctgcccagcagctggaagcggctgccgttccacagctccgccagccaggcctggtgcgcatcagaccagctgacgccgcggaagccggaggcgccgatggcggcgccgccctggaagtcgtggtcgcccgggacggggaaggcgccgtactgggagcgcgggaagttggtaggggcgtcgggacccctggtagttgtgggggagggggcggggttggcaaggggataagggtgagggcgcagtcttgatcattgcatannnnnnnnnngggggcgtcgggacccctggtggtgggggagggggcggggttgagaaggggatggggtgagggcgcagtcttgatcattgcatagaatctcgaactcaaccgacagcttcccacacacatgctctcagctttacatatcgcgaacagcgccagcacacacctgatgcgcaggacagcctcgtcgtaggcgcgggcagcgtcttcctcgccctcaaagtatcccaggtggtgcacttcgctgcccttccacacctgcgcccgccacttggcgcagttggagttccagctcacccccctgaagcgggaggtgcccttcacgggctgcacccgcgacttgcccgccttgcgcggggagggcggggggcgggccagggggctcgccgcgcgcgggccaggggcggtgtggcgcacggggggcgtgccggggtcgtggtagacctctgcccctgacgcgtagagctccgggaagttgagcttctgcaggttgccatgcaggcggactgcagcggcgatggtgggagggagggaggagatttagatttgagcaggacaggctggcttggagtgaggaacattgtcaatagacatgctggaaggattgtggaaaactgcatggctctacacctgggcagccattgtcatgaagcaagagaaaagcaccaaatctctgcacctctctacgcatgagaccactggactgcaggcaatgtgcacagggcctgtcgcaatcccatacccctccaacataccggcatatgtgtcgtacgcannnnnnnnnngtttggatttgagcaggacaggctggcttggagtggggtacattgtcaattgacatgccggaacaattgtgcaaaactgcatggctctacacctgggcagccattgtcttgaaagcaagagaaaagcaccagatctctgcacctccctacgcatgagaccactggactgcaggcaaagtgcacagggcctgccgcaatcccatacccttccaacataccggcatatgtgtcgtacgcatgggcagcagcttcctcgctggtgtagtagcccagaaacttctgcttgccaccctcgtagatgcgagcctcccacttggaattggacttgtgccagaccacgccgcgatatttggaaggtcctccacgtacgccaagaccctgacggggtcggcgggccggggcagacgaaggcgtggtgcgagggctgcaagtggttgggggggcagaatcacgtgagaagctgctagaggggcagcagtgcgaacgcccaccacagaaactgtcacgacaaaacatgcactgctggcacagaaatgctgcattgtatactccaggccatgtaacaactgtcacacaggcttactttcccctttcaagcaggaggcgccattctgtacctgaactctgggtcggtnnnnnnnnnnccacgtgagaagctgctagaggggcagcactgcgaatgcccaccacagatattgtcacgacaaatcatgcactgctgtcacagaaatgctgcattgtacactccaggccatgtaacaacagtcacacaggctcactttcccctttcaagcaagagccgccattctgtacctgaactctgggtcggtgtcgtcccctccatcatccatggccacatactttggagtgtgcagggtggacggtcttctagatcttttggctggtggatcatcctcgttcgtctctgtcgacgtctggaagagggccggggcaggccggtccacgagcttcatgtgtggtcgcacgcctgtcaaggtgggctcatcggtcctgtaaaagtacggcgatggggacatgagtgagggaaaggtgaaggataccatagagtttggccgtgcaatttcgaccttgtagaaggaatacataagcgtatcggaatgagagaaggatgggaaggggaggcaggacaaaagtcccacgacacgcggaaggtggtgtgttcggggatgacgttacctgccccccacattcccgaagatattgcctcatcgatcgccatggggctctccgctccacccccggaatcggaaacaaagcataaaaaataacacggtggggaaggggagcacggccgacgggttggccagaagtctgggactccgcaaagtctggaagccccaccagcggaggaaaatcttggggaggagagcacttgtgccgggccctccgagaaaaccacacgcagcgccgaagaaacatagtgccaaggtccattagaacgaaaccacaatactgctgcgcacctgtgccagggcgctgtcatgtcgagggcgagtggtgtgtgctggctcggcgtcatatcggaggccagtcggtcacgcgtgtccagtgtttgcggagccggatggtccagataggttgtgggcgcgcgtggctggcaataaatttagccggaagatgtctttggaggggtcgagaagcgggctgagcactagtattctgaggtgagaatgttgagaacctggccggaagtacctcggaagaaagtttacgtcataattactatgctctgtgctgaccattggcgcgttaatatcggcgattccatactcgacgccattggcgcacggttgaagaatgtatccgcgcaaccctcacagagaacgatgaaaccggtgcaagacacgacgaataaatcattcgcccaacctcagtcaggacctggtcagggtatcgcccctgctgctgttagcagccctccagcttagactgacaactgcctcaacaggacacgttggggatgaagcatgcgtcaagatctctattctaaggctgcgttcgacctatgcagcttgtctgnnnnnnnnnntgggtatcgccctggctgctgttagcagccctccagcttagacaggcaactgcgtcaacaggacacgttagggatgaggcatacatcaagatctctgttcttaggctgcgttcgacctatgcagcttgtctgcttcccagtgcttgaacactgtattgttgcaggtccagggtattggggtttacatgtccggagaaactggttccaaaagggtcttggattggcacaccatttgcacagcagagttgccaaatatggattttcttcaagatctgggtctgctgcggtcttgcacgactccacgcaatcaccagcatgtagcctcggcagggcgcgagatccaaaaatcaaacttgcgcgcgacgactgttcgccaggcagcaacagaattcccaccccaaggtcgtcgattccccgatggctgtgctgcctgaaccttctatgtcactaacgtcctattttgacgctgcacgggacggggcttgctgagatcgttcccagatcccggccccgtggactgccgggatgggcacgggcgactacccggccgagctcctggccgggtgctccggcaccagcctgcatctatggagggtgaataatgtgaactccagccctcccgtgcccaacagtcaccctggtcagcagcccctggaggtcgtggcgtggaaccggaacaacaaggtggtcgcgggggcacgggccgatggcagcgtctccctgtcgtacagcaatggcgaggccatgagcgtgctgaaccgtcctgccggctccagtgcgatcgtcactcccaccgccctggcgtgggccagcgggtccaaacgactggcagtggcagacaggaacggcgccattggcgtgcacgacatgaccaacaaggtaggcgacaggatcgcctgtcattcgctcgtagatgcttgctgtggatggcacatcgggtggagcgtgggctgttggcgccgcacacccaccggtgctcactggggtgacgccgcgccagccgtgccttccaagacccggcccgtccccttcccaccacccgtccgcccacccttcccgtccctgcaggcatgcacnnnnnnnnnngacgcctgtcattcgctcgttgattatttctttcttcggatggcacatcaggtggaccgtgggctgttggcgcccgcacacccgccggtgctcactggggtgacgccgcgtcagccgtgccttccaagacccagcccgtccccttcccaccacccgtccacccacccttcccgtccctgcaggcatgcaccacagtgcatctcccggagcccatagcggctctgcagtaccaccctgctgaccgcttcctggcagtctgcaggtgagagatgggggtcggtcagcctggggaccaacgcgggggggttcagcctcctccgcctcctgcacaccccaacgcaagcctttgctgatacggaaacactccccgcctcgactctcgactcccagtggagcctcggccacgctgttggacagggacctgcggcctgttggacaactgaccccggaacctggcatggcgcccgccacatgcatgcacctggactccagctcggcttgcctgaccctgggccacgccgatggcagcctgaacgtgtgggacctgccctcccggcggactgttgccgcctcccaagcgctgggccgaggggggatctgcagcgtgtcctctccagccggcgacccgagctccgtgtacgctgccgccaaggatggcagcgtgtggtgcctggtgagcgtgggtgaagggtacgtggcggggaaagtaagcagagacaccctcccctggcgcagcaagtgtctcatgcttcttcttattggcaacttacaatggctccagataggccatgcggctnnnnnnnnnnctcgaggcggggaaagcaagcagagacaccatcccctggcgcagcaagtgtcttatgcttcttcttactggcaagttacaatggctccagataggccatgcggctgccgtgtttgcagcaccacagtgcaccctcccggcccggcacgtgcgctgcaggatcgccggactccaggttccaagcctgctgccctagtcagactgggcacgccgctcaccgcttttgacttgaaggaggacnnnnnnnnnnttgcacccttccggcccggcacgtgcgctgcaggatcgacggactccaggttcaaagcctgctgccctagtcagactgggcaccccgctcaccgcttttgacttgaaggaggaccactccatctttgcggctggcaccgcaggtttgttggtgggtccttgtgagtgtccttgggggaggcaatggcagtggacctcaatgcgttcccctgggcacgcatcgcgtggccaggcaggcgatgaggacataggtggcgcgggtgtgggcgctcccctgcccagcctcatnnnnnnnnnncggtgggtccttgtgagtgtcctcgggggaggcaacggcagtggacctcaatgcgttcccctggccacgcatcgcgcggccaggcaggcgatgaggacatgggtggcgtgggtgtgggcgctcccctgcccagcctcatgccctacctggcgccgtactccctctccgatgcactcgagactacccttcatccacgaaagtcctaccatctccgcactcacagaaggcatcgtgtatctgtatgacccccgcgcccctgctgggcccctggccgcgctttcctcgggctcacgccggcccatcaccggcctgcactggcagcactgctaccacagccctccctcccgggctggcaatgacgggagggctggccaggaaacccgctctgcccggcccagcgacatcgcatccagcggcaaagcgccgacaagtactgctggccagtctggcactgcccttggcccctcgtctcggagaccagacgcgctgcctggcctgccggctgacagcgttgccgctgccggggtctgtacgtcgcacagcacacttgccaacctcggtggggcggggcatgtgggaggacagccgacggggccctccgaccatgctgccacatctggcaccgaggccagcagagcgatggacgcggctcggtgtcgtgaggcggcgggggcccgggcggcaagcggggcggctgcggccgggctcgcccatccggaaagcctgaacgtgacgccctttgtggggttcaggcatggcgtgggcccagcaggcagcacggcgccgagcgcaggggcagctgcactcgaggacattcgcaggcggctgccgttggcgatcgggtcgcggtggggcaccgaggccggccaggaccgggcggctttcacgcctgcgccccaggtcacggcgagggagtggagcgaggggcccaggtgggaggcagccagggagggcggcgacgctgggtcggcgggcggcgcgcagggtccgcgcccgcacgcctccgagccgacgtcgagcacggccagcgcaaatgccaacccagcactgcagcgcgcgccctcaggcgcgcgcctgtcgtcccccgccaagtcatcgcccgggacggactctgggaagaagggggcggacatggcgcaggagggctggcggatacctgctgtggcccgcgactcgccgccgcgcagcttccgaccggggcgagaggcggccgagggcccgggctcgcccgacggcagcaacgagtcggtgcggcccatggaggaggactccctccttgggactgcaccggcacagggcgccgcagcagggtcgccgctgcgcaggcagccgcccccctcgctggccagcgtgtctcgggatgacctcctggccctgcacctcgacatgctcaaccagttccaggtggggtggacagctgggctaaagggggaggtgttcgaggcggtcccataagggagcttcgctttgttaatgccgcccgcgtccactccccctcacccatacccctctgcacgatcctttcccaggcccagcgcattcacatggaggagctggtgaaggagatggggagccgtcaggaccagctgtcggccgagctttccagcctgcgccagcaactgggctcgctgctcacgcagaggaacgatttgcgctggctgtgaagctgtgcctctgatgacacaggctgtaaggctgagcccttgatggcgctggtgctagtcagcattgaacagaagcatgcttgatgtccgagtccccacaagaacctcctgggacgaaggcgccgcgctgtgaatccctagaactgcaccgtacttgccccggtatttgtcccaggcttgttacacaccaaaagcagcaggccaggtctagcgcacgaggcatgcttgagcacacagggcaactattctggagcgagaatttatggccagtgcctgcaagcctcgtggcaacatgcgccctcaaggtgttaagctcactcctccaccttgtcgatctccgcaaacgagaagggcgcaaacttgtacccatcgcctgaggcattggagggaaggagagggaatttgctaaaacatgcttgtcatgatctctccatgtctcgcatgccaagcaccgaggcatgccatgcggcgggaaaagggccccagactgcagaaggaaagcacgccacatcatgaaacagccatgccaatgcacacattcccccccccaccctaacaatccctcatcttccatatctactcaccaaagtagtgcttgctctggaactccacccagtgcagacgaagggcatgcaagaaggcggacagcgactccatcagcatcagcacggagatggtggccaccaagaagacatagaaccctgtgggaatgggtgcgtgcatcatcagggtgcggtcctgccagatccctggaaaggatgactgcgcatgccccgggcgctgccctgaccaatgcagatcctagacctcctgaaatcacccacccaccccacttcccacccacaacgcaacgaaaactccccgcaccaatcacgatggcaatggggttgccgctcttgatggcggccatgagcacgcggtcgtagaagacggcggagagctgggagtgcgccagcgacagcgcccacaggcgcaggtaggatgccgtgttggagacggagcccagcacgaactcgatggcgtggatggcctggtgcaccatgacctccccaaagtcaaactcctcggagccatgggaggcgccgtgcccagcgggcacagcatgcccgccctgctgctgccccgcctccaggcccagctctgcgccgccggcgaccgaggggtcgtcgtcggagaagcgggcatagctgaagtcattgtcttcgggggccagcaggccgtaggatgcatcctgtgggtggtttggtgtttcgtgggtgtaaaggaactggcaggaagagcagcggggcgggagtgctaggccctttggcacctaggatgcctaccgcatatccccaaaactgacagcccctttgatgcccagatcaggcaaactctccggcaaggaggacccacatctcccattccgatgccctttgctcagggacatacatccccggagggtcagtgacctcnnnnnnnnnncctggcaggaagagcagcggggctggaatgccaggccctttggcacctaggacgactaccgcgtatccccaagactgacagccactttgatgcccagatcaggcacactctatggcaaggaggacccacatctcccattccaatgccctttgctcagagacatacatccccggagggtcagtgacctcaaactccctcccctccccctcatgcccacgacgcaccctggactgccggcgctggctgcgcttgcgcaggatcaggggcttgggcaggagcatccagggcactgcgatgagtgccgccagcaccaggacgacctgaacaaaggcctggccgcggtacatgtggttttcggggcactgcccgctgcagtccacgttgccgggctgcaggaacatgtagatcatgacatggtacaggtcggtggtcacacccgaggcccatttggccaggatgaggaccaccaggtacccaaacaggctgttcaggaagatgacctggggcacaaactcgcacctggcgggattcggggggaggagggggggggggggcttgnnnnnnnnnnnnnnnnnnnnnnnnnnnnnnnnnnnnnnnnnnnnnnnnnnnnnnnnnnnnnnngtgcaaggaaacctggaggccagcatccagcctaccaacgggcacctagtccctgggcagggatctctcgacgcgacacacagggcagacagcaccagacagagagacaatggagcaggagtcgacgctcgtccccttgtgggtgcagcaatcccttccaatcccatcagcccctgcggcatgctgcccacagcaccgccccaccgcatgcgaccccaccagacacaaatccttaccaggtggagagggagtcggagaagtagcgctggttgaggaaggagagcaggatgccgccattcatctgcgcaatgcccagcacgatggacatcttcatcttcagcgagttgaggtagggcagctcggtgcgggtgccgtgccaggcggggtccacgcccaccgggtagggcgcgcccgggcgcggcatggccaggcccgagttgaaggcggaggggcagagcgtgtggtccatctgcatggccaccgggtcggtgatggcggcgttctccgcgcaggcccagcggctggcgccgaagagggtggtgaccatggagaagaactcgttgtagagcaggccggtgtagatggagaaggcggccatggccaggatgatgtagcggccctggaagaacatggccaggatctcgttcaggggctgggcccccaggcggcgctcggaggccaccagccagacggcaaaggccagcatgaggaggccgtgccccacgtcgccaaacatgacggcgaagaggaaggggaaggtgacgatggtgaagacggcagggttggcctcgcggtagcgcgcgatgccatacgcgtccaccagctcctggaaggcggcggtgatcttggaggtgcggaagaaggtggggggtgggtcgtaggtcaccaccggctggaagacggtgcccacgggcgagtgcgcggcggtcgccgcggcgcgcagcgcatcgtgcacgcgtgggcgcgaggccacggggacccaggcctcggccaccagcaccttgcgcgtgacgtccaccgacagcttgttcagcgtgtggtacacgcccttctcgcgccggacctgcacgccccaggcgtccaggcgctgggcgagggaggagagcaccgcgccacgcgcgcgcgtgcccgcctccagcgtggcgtgcagctcgcgcaggcgcgcgccgacctcggcggccatggcgcggcgccgcgccgtgtcctcggggaaggggtagcggttggccgagaaggcctcgcagatcttggcgatcttggaccgcgcacgctcgccggcgaagaagacggtgaacaccgacttctcctgcccctcgccggagaccgggtcggccacggtgcccacctccccgtgcttcaggtacatgttgccgcgcgtggcgcggaagagcaggcgctcaaaggcggccagcttctccagctggatggtcccggccaggaagccgagctggatgcccgccggctcggtgaaggacgcgctttccagcagcggcgcgcccatgtccagctggccgcctttggagtggtcgacgggtggggggagggggtgtaggatgggatgcggggcggggatgcttgtgcgcatcatatgatccgttggcattgtacgcatgcgatgccacgcgcctgcaggcacgcaggtaggtggatacaggcaggcagagcgaagtcccatgcttctataccagggagaagcatctggcccgtccttgccacagcttgtcacccaaacaactcccctggaactcccaacagctgttgaaccactcaccttccgcggtcagggcatgctcatcgcggacttgcagggcgttggagtgcgcgtcctcgaagaaggtgcccgcggtctccagcaccagctgcagttcctgcagctcgttgtacgagcggtctagacgatctgtgttggcgttcagctgcgtcagctccgtctccagccccgccagctgcgactccagcgcatccaggtcgggggtgggagggtcggcgccgcgccgcgcgacggggatctcccgcttctccagctcggactgaaagaagcgaatctggcgggccatttcgtcacagcgcttgatctgtgcagtgggagaataggaaggagtgcttagtgagtgggtgccacatgacaggagcgggatgttggaaaggagnnnnnnnnnncgcagtgggagaatgggaaggagtgctcagtgagtgggtgctacatgacaggagcgggatgttggaaaggagacagaagaagtaagcgaaacgtagacatccaaaacgcacgcacatacttgaatgcaatacgaatcctacgcagattcatcccgttgtagagtgcccatactatcccgaacaagaaggtccttgtgattcacctggccagcataggtccgctggaaagctggcttctccgggttcaggtctttgaactgcagcatgcccacctcacccaaggccacgatggtgtcatgggcgacttcggagggtatcatcagctgcggggggagggaagggaggggtcgtcgccctcgctggcacaggcgatccccagcgcgaccatactcggtgacactccactgagccagcagagccatactcttggtaccacgatctttcacctgcattaaatggacctcttcgctgcggaaaaggtccatggtggctggtgcagggcttcaagggtgtccagcgacaggttggcaaccctacagccgagatgtacagcaccccgtccaagcgttatcaagagtggtatccgaaagaggggcgagggtcgcagctgctctgcagcagacttgtctgggttgggcctgcctccactgtatatgctggagggtatcatcagggtgaggggaggtcccgccaaacctagcgcgcgctcggaatgcttgcttgcccgacactgacactcgacgtcagggctgtggactgcagcgcaagaaaggctcatcggataaaatgcagtggtgcgcaagtccgcgatcgtctgaattgtaagctaccgttagtcgtctttggggctcctctgccgacagccgtctggactctcagctgcactgaccctcttacgaggcagtcagcaggcacaggcacgctgcgcagcattgatctacaacaatgagcctcgaaagtcgtttcttgtcaatctgagcgacctgaggtcctttgtaagactttggagccacagattcctacgcaggcagagagccgtcctagaccatgaatcctctgacgcagatcaaaaatacccagaagatcagcaaggatgagattgagctgggtctcagcgacaagtcttcctggcactccaggttcaagcactctgcctacatctttgctggcgggctgcccctgaacctgacagagggggacctcctcgccatctttgcgcagtatggcgagatcgtcgacctgagtctcagccgggacaggaagacaggcaagttgttcattgtgggaacacgagtggacgtccagattcggtggcgcaccatttggtggcttcggcagggctggtgtttggccctgcaatcaagtcctcgtcctcctgcacggcagtcgctgtggcaatcacttacattgccttgcacctgtcatgcaaatgatgactgtctattctcatcgctctgctcacaggaaagccaaagggctttgcctttctggcttacgaggatcagcggtccactgtagtagcggtcgacaacctctcgggcgccaaggtctctggtcgcacgctccgagtggaacatgtggacaactaccggaggaagcgcgccgaggtgagagtgtgtcagaggctgaggagacagctggagtgcggggaccagacgtcactgactagtgatggtggatccgtggaaatgtgcagcatagcataggaattgcaccataagtttgacaagcattccctcgtttgtcgtattcatctctagatggaaggcgagcctgatcctgggagtggtgcggaggacaccgcgaggccagacccagtacggagtcggtcagaagctggggcccctgacgcccctgcacgacagccacctgtgccagcagacgagccctgggcagctggaagcagcgtgttcagtatgttgaacgctccgctgccgccaaacctactgcggccggctgcggtcagcggcgcgaacagcgacaagcccaagaaatccaaaaaggtaagctccagcagtctgataccagatagttttgtacgcatgaaggaacctggtacatcccaactctgcatgctgcaccacaggagaagaaggagaagaaggagaagaaggagaagcgacgggggctgtcgcctgcaccaccttcgccgctacccagagactcgcccgatgatgaggaaggggcgtacatgggtgcacagacatcaagaggcccctcaaatcaaccagtgcaagaccaaaggcccacaggcagggccgagtcaccaccccggcggcgccggctccgcagccccttgccagacagggatgcccgccgtcccaggcggagtcgatcaagggaggcacggcggcgcagctactcgcctgcaccgcgcagggtccgggactcccgctcgcccgtgaggtatcggcgatgacagtgagtgcgtgtgtccgtgttgaggctcagcttttcgaagtgagggagccattggcacccacttgtcaccccgtgtactgtcctggctcacccaaggcatgtcagtgccctacatnnnnnnnnnngtttcgaagtgagggagccatcagcacccacttgtcaccccctgtactgtcctagctcacccaaggcatgtcagtgccctacatgctgccctgtcaagaccagggcattgtaaaaggactgagaatccagtccagatggcagagggtctcagggggtgtggtgtaggcctgaatcatgaggtcgaagcaccttggagatgcagattgtatggcgaaggctctgaagaatgaagaatgccaagggaacggtacaacagcgtgcgccccagcatcgactggcgcgacacgcttggtgcagctcaggtgtccctcctcaggtcatgccggnnnnnnnnnngacagcgtgcgccccagcatcgaccggcgcgacgcgcttggtgcggctcaggtgtccctcctcaggtcatgccggcggccacgctgcgcctcctcaggtcggcggcgctgcacaggaactggtgccccaggcggccgggctcccgaccgtgccagggcttctggttggtgaagtgcagtaccacgggagccacgccgcctaccgtgaggttgcccaccaggctctgcgccgtctgcgtgcgtcggagggtgaggtgatcgtacagggttgggttatggagaagggggtggataccacgggggcctcggtggcaggagggggggaggtcaggcgcggcagtggtcccaaacctcccttgaaatccctcggcgtgcaccaccgcttgtcccacagatgaagccgcggtcgnnnnnnnnnncgaggtgatcgtgcagggttgggtcatggaggagggggtggataccacgggggactcggtggcaggaggggggaaggtcagtcgcggcagtggtcccaaacctccattaaatccctcggcgtgcaccgccgcttgtcccacagatgaagccgcggtcgacccaccgtcccgctctgacaccaacaccccgcgccccagccatcctcgcgatgagtgggcatcaccctctcaaacaaaaaaacacacctgcacgttgtactccaggggcagtacggtccccgtgtaccggaagtaccagtccaggaagtccnnnnnnnnnntgccatcctcgcgctgagtgggcatcaccctcccaaacaaaaaaaacacacctgcacattgtactccaggggcagtacggtccctgtgtaccggaagtaccagtccaggaagtcctgctccgcggcgcggtgggtgaagcgcagcttggggtggctctccaggatgcccgccatgtgggcggcgacggcggggcaggggcgcaggagcagcacgccgccgttgaggccgcgcaggccggtgcggtgccggcccagccagcggtactggtcccacaccgcggcaaagggggtgggcagggaccagaggggtgccacgtcgcccacgatcacggtgtcggcgtccaccatgagcaccgcgtcgtactgggtcaggttgaaggccttcagcttcacgaagttcttgccgtacctgacggtgaaagagtcggtggatgggtcgttgggaggagtgttgagcatgggctgtattgtgtagagacaatctggccatgattcagcgaattccaaggcaaccgtgcnnnnnnnnnnatgttgaacaggggctgtattgtgtagagataatctggctatgattcagcgaattccaaggcaaccgtgcacaacagccccaaggacgtccccttccagctcccaactccccagtgccagcctgtggtcccccggatctcctcataaaccttcacacccacccaccaacctgggttcgtaggtgttggggtattccagggggtacgtctgcaccagggtgacccccagcttgcgcagcagnnnnnnnnnnagatctcctcataaaccttcacacccaccaaccaacctgggttcgtaggtgttggggtactccaggggggacgtcttcaccagggtgacccccagcttgcgcagcaggcgctcgctggacttgggcagtaggcccggctccagcagcaccgccagctccaggcccgggttggacatgcgtagcgtgcactccagctgcaggaagagcggcaggtaggcgggggaggagagcgtgctcagaaccaccacacgaccgccgcccttgggcacgcagctctggcccgtgcagcagacgggggaggggaaggcggcgtggctgcgccccatcatggccgggtcggacttgtagtacaccgcggcaaaggcgtcctgggcatggcgcaagagggacctgcggttgtaggccaccagcaccaggaggcagagggcgacgaagggcgcggcccggcgccagaaggcgctgtaggtggagcggcgggggttctggggcctggggacggcggtgggggtagggcttgactttgggttatgaggagcggtaagagcagacttgactaagccagcatccgatggaccaggtacgcatgtggaaaggccttcgcaccaggaaaagggggcnnnnnnnnnnagggggtagggcttgactttgggttgtaaggagcggtaagagcagacttgactacgccagcatccgatggaccaggtacgcatgaggaaaggccttcgcaccaggaaaagggggctgcctgcagctctacatcggcgctgcccatgggcttgccccggagcgcgcaacgagcccaggcgggcaagccccgccaggggcccccgcaggagcgactgcgaggctggctcgcatcgaccatgtacgcatggggtggactcaacaccacatcacggtgggagggaaaacagtacacacctgttgaccgagctgggcttccacaatcgcacagatatgtcgaggctaggtctcgatcagcacacaagtcccttgtgtcaagccgcgcccagtctacccggtgacgaggagaaacataccgtggctgtcccagtgcaacgcgcgatcttgctgcacacggcttccgtgggcatggcgcaggcttccaccctccttcgcccgaccccgctctcgcgccctgatccgccaccggcacccgctctcaatgtgaccgagcggtcgtctcgtggggccaccggctctctggtgtccatgcatcttacaatacataagtggctcatcttccccaaccatggccttgaaagtagatgagaggcatgcaggggtccgtggacannnnnnnnnngtcatcttcccaaaccatggcctgaaaagcagatgagaggcatgcaggggtccgtggacatgaggtcatctcaaggcaccagcggagtggctgcagcttggccaggcgaggcctgagagctgtccctcgccagcatccagctctccccagcccgccctcactgcagcttgagggtggccagcttccccgccaccgccagtgcctcgtccagcttgcccacctccgggcccatgccctgggcgaaggtgggcttgcctccgcccttgccgccgatggcgcccagcgccgccttgagccactcgccggcaggaaagccgggggccagttccttgggcaccccggcgaagaccagggccttgtcctcccccgccgaggccaggaggacggggagggaggggtgggccttggcgatggcgttccacgcctcctgcaccgccttggcgtccaagcccacgtccagccgcgtgacgaggaagcgggagcccaccgccgccgcggcgtcggcggccgtgacggccgccgccacggcacggtccttgttcgccgccgcctcgcgcttctgctcgtccagcaccctctgtacttgtgtgcaaggggcgagggagggtgatgcgcgtgtatgcgtatgctcagggaggcagatgcggtccccaggcgagggagcgggatcctgggaaaggcaataccggttggactcgtgcccatgcctcgcatgccaaacacccacccaccccccaggcaagccatgcttgccttgagctgggtctgcagctcgccccgcagctcggccttggccaccgtggagatggggctggagtcgacggtctgcgaagaaagcatggaatggatcgtgtgggcaacggctgggcagggctggacgccgagatggagatgacatcgtgtggcaggcaggcttcttcccatgcatatactccccttttcacatctgccaccacacacctaccccccccccccccnnnnnnnnnncggaatggatcgtgtgggcaacagctgggcagggctggacgccgacatggagatcacatcgtgtggcaggcaggcttcttcccatacatgtactccccttttcacatctgccaccatacacctacccccccnnnnnnnnnntcaacaagccaagcgcccaaactctcaaactcaccacggtcagggtcttgatcttggcggcaaggtcgtccagggacgaaaggccctggagcccccggatctcggcggccagcgcctcggccgtctctgcggcctcctcagcctcgctccctgtcacggccacgatgcgccgcacgcccttggcaatgccctcctcgctgagcagcgcaaaggcgcgcgcgccggcggtggaggccaggtgcgtgccgccacagaactcgaccgagtacgcgcggttgccctccgcgcccgggtcggccagcagctcctccacgctgcgcccgatggacacgacgcgcaccgggtcggggtaggcctcgccgaacatggcgcgcaggccgtggatgcccttggcctgggccaggggcacctcctgggcatacacgcgctcgtcacgcgcgatgtaggaccgcgtggtggcctcgatggcggccagagcctcgggggccaccgggccgttgttggagaagtcgaagcgcaggcggtcgggctgcacgatggaccccttctggtccacgtggtcgcccaggtgctgtgtaggggaagaaaggggggcggggtctcagggagggaggagtgagtatgactccatgtgtgtctggggatgggacgtgctcggccaatctaggtgtcgaggggtgccgcatgcaggagccggcaagcctttctttcttcgttcgaaaccccgctgactcacctcgcgcagcgcccagttcaatacgtgggtgtaggtgtggttgggcatgatgcgccggcgacgctccacgtcgatgctgtgtgatttgcagagcattgaggttggagttgggacacaaaggggtgccagggcgctcnnnnnnnnnnaggggggtggggtgtcagggaaggaggagtgagtatgactctatgtgtgtctggggatggggcgtgctcagccaatataggtgtcgaggggtgccgcatgcaggagcnnnnnnnnnncgtgatttgcagagcactgaggttgggacacaaaggggtgccagggcgctccgtaaaaaggtgctgagagcaccgcacctgggagcttctctgatgatacatcatccaatttggacatcaaatgctgaaccaccccacccctcccgcctggcagcacctggcggtgacggcatcgccgaccttgatctccccggactcgaggtcgcccaaatgcagcacataccctgccgccacctgcacagggagtgggggcagggagggggaatttctccgtggggcttcaagattgagaaaatcagccgaggtgaaatgggcgcagcgcttgaataaagggctagttggagcacgggacgcactgtcaccagcgacagcaaactcgaacgatcacatgaatccatcagggggcaaggtggcagtcagcattgaaccctggacccccaccaatctcccaacccccatctccttcnnnnnnnnnnaagggggaatttctccgtggggtttcaagattgagaaaatcagctgaggtgaaatgggcacagcgcttgagaaaagggctagttggagcaagggacgcactgtcaccagcgacagcaaattcgaacgatcacatgaaaccatcagggggcaaggtggcattcagcattgaaccctggacgcccaccaatctcccaacccccatctccttcccttctccatcttcacctgggcgctcgaaacggcaaatctggcgccgccggccgtgatcacaccggtgtctgccacctggccgccctgctccgcgtagaagccggttgagcccagcaccaggcccagcgggccctcctccacccctgcgctgctctccacgaagccctgcttggtcaggatggccagcacccaggtgtccacgggctcctcggagtacttggcgccgtccagcgtggtgcggacctcgttcttctgcaggtagccggtggcctccgcctcgaagcgcaggccctcccgcgcacccttcttggatgctggagcgggtttgaggaaagggtggaagaggtggggtctgtgaagggtccatgcgcacggggatggaggcggccaagggatgttgtgagggatgggtacagggtgtggaaccctacactgcgcatcctaggttggggactgatgctggggcctnnnnnnnnnnacacggggatggaggcggccaagggatattgtgagggatgggtaaagggtgtggaatcctacattgcgtatcctaggttggggactgatgctggggcctgccacggcccgccatgtgagtcttacaacagctctcttcatatccagaagatctcaaccaacaccccaccccccccctccc

SEQ ID NO: 36672 - DNA, 61 bp, Chlorella protothecoides
gcagggggaaagagtatgtgtcacggctggaggggacctgggcttgtgatcaccaattttc

SEQ ID NO: 36673 - DNA, 88 bp, Chlorella protothecoides
ccagccatgccttgagttcccagaccaccgttcgaaacaaggaaccacccccttcagttaccttgaagatggcaaaggcgaggggcac

SEQ ID NO: 36674 - DNA, 198 bp, Chlorella protothecoides
cagctgctcctgttgctccaccagacgcttgacgagactcaactccttcaacctttggggttcggcctggggtacctgcaatcgtcctgcctgtccaacccggtccctcagctgcttgtgtccgaatgttttggcttgcagctttcccacctgaggatgcatggcgtgcacgacacaagatgagcgacaacaggccgc

SEQ ID NO: 36675 - DNA, 75 bp, Chlorella protothecoides
ttgaggggggcgtaaactatcctcccgatcctcccccccccccctgcggcacagcttaacacctcgcccagatca

SEQ ID NO: 36676 - DNA, 103 bp, Chlorella protothecoides
gctcctgcacgcgggggaaggagaggggggcgagctctcgcacggcgccaatgcgggatgtggtcccgggggatgcaggtgccctgaaaacagggcgacccga

SEQ ID NO: 36677 - DNA, 183 bp, Chlorella protothecoides
tgtgtgtgtgtgtgcgagtgtgtgtgtgtgcgtgtgcgcgcgagaatgtccacatggagtgaccctctggagagctgagcttcacggggactctcacacccctgcaccatggtgagcatgatgcacccctgcctgtccaacccaccagcgccaagcaggacggcggggagggcacccacccag

SEQ ID NO: 36678 - DNA, 144 bp, Chlorella protothecoides
taggcttggacgcacggtgatgtcagagtctccgctgaacgagaggttgtgccaatgcggggagccttgcactgttactccccttgtcttgagaaagtgtgctcccctgtgtccccatcgccagaactccatcatgtgctccct

SEQ ID NO: 36679 - DNA, 3790 bp, Chlorella protothecoides
  modified_base (369)..(378): a, c, t, g, unknown or other
  modified_base (477)..(620): a, c, t, g, unknown or other
  modified_base (719)..(728): a, c, t, g, unknown or other
  modified_base (816)..(864): a, c, t, g, unknown or other
  modified_base (1044)..(1053): a, c, t, g, unknown or other
  modified_base (1111)..(1120): a, c, t, g, unknown or other
  modified_base (1339)..(1348): a, c, t, g, unknown or other
  modified_base (1609)..(1618): a, c, t, g, unknown or other
  modified_base (1955)..(1964): a, c, t, g, unknown or other
  modified_base (2445)..(2454): a, c, t, g, unknown or other
  modified_base (2621)..(2630): a, c, t, g, unknown or other
  modified_base (2763)..(2772): a, c, t, g, unknown or other
  modified_base (2833)..(2842): a, c, t, g, unknown or other
tgtaaaccgaacgtggcgaagcgaccagtctgcttggcaaggccaggcggagagtgggctggcaggggtagagcacagagaaggaggaaacgcatggcacggggcgggggccggcaaggagctgtcctgggggctgcctgcctcgagtcacgacggctttcactgagaaccgctccagggtcggagcttactgcgctgggtctccgtgcgaccaggagggcagcactgccgcctggccaaatgccgtgcctgcgtcggatggtggaggagctcggctgcacgtccacaatcaccattgctagtagggagggcaatgaaaatcaggggtggcagtgttcccccatccccaaacaatgaagtcccccgccnnnnnnnnnnggccggtgaacagtttccacaacaccacacggcctctcttgtggcacttagcgctacatagaaccaatcaaggacacactgaaattccagctcacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcaacgggtggactcagtacatggccctgcgactgtgcaaggctatggaaatcgcggctagatcacttccctcccgactactgcaggcgaggggcnnnnnnnnnnggggtgagtgtgtaggtcgaggggcggaccaccttcccgtcatgcagtggcctgagggctcgcagctttgcagctgcactcatcatannnnnnnnnnnnnnnnnnnnnnnnnnnnnnnnnnnnnnnnnnnnnnnnnagggtgagtgtgtaggtcgaggggcgggccaccttcccgtcacgcagtggcctgagtgctcgcagctttgcagctgcactcatcataggggcctccagacggtccctgaaagtccttcaacggggcctccgtccgccaaaccaccctgcccaaaagttacctcgccgtctggcgctgcgnnnnnnnnnnccagggtggtttggcggtcggaggcttcgttgaaggactttcagggaccgtctggagnnnnnnnnnngtttcaacgggtggactcagtgcatggccctgcgactgtgcgaggctatgggaatcgctgctggatcccttccctcccgactactgcaggcgaggggccgagcccctctttgtgtatggcaatgccgcagcgctggagctcttcgagacagactgggagggcctccagggggtgccctccacccgctccgcagcgccagacggcgaggtaacttttggnnnnnnnnnnctagcagtaccctggaagcctcacgtgtcgtggcacagtagcgcaaagggagcataccacagccactctgctgttgcgggggtgtctattccgtcagggaccagcgatctgtgggtgggagggaggacaggttgtgtgagctggaatttcagtgtgtccttgcttggttctatgtagcgctaagtgccacgagagaggccgtgtggtgttgtggaatctgttcaccggcatgcacgctcatgtatccggtacaagcacccnnnnnnnnnnacctccctccacggaaacaccactccagatccagtcagagaggcagactgcgctggcgcgggcgctggagaaggggtatgtcgagaactacagcggcgatcgggtggggttcaggggcgcacgcttccgcatcgagggcgcgaccctcttcagcgtcacctccccgacaggtggtgctgggcagctggacaggggaagggcacgcggcatgcatgcgcggcgggggacttcattgtttggggatggggaaacactgccacccctgattttcattgccatccatactagcaatggtgattgtggacatgcagccgagctcctccaccatccgacgcannnnnnnnnncaacctcaacacatgcatccccccagagcatggcaggtccagagggtactcccaccaatcctagcgcacttcttcagcaggcgcttgtagctctctgccattaagagggagtgtgccaccacagaagcctgcttgtaggggggggtactgctcctatacaagtgggccttggacctggcgcgctggcttgcagtgagtggcctggaaccggatggacgtgttgagggtggtgcacctgtctcaagggggttgaaggttggacggagttccttcatcacttgcgtataattcccaacccgatggctctgatgttgaacgagcacatttacgacgccccatctcaagctggaattcgagccacgtacactcttactcctaccatgctgggcatgaacgctgagtgaggacatcgccaacgtccgtagcttggagatattcgagacggcaccctcacttcgtgagcgaagcatgcaccgatcannnnnnnnnngttaagcgcatttacgagggggcatctcaagctggaattcgagccacgtacacccttattcctaccatgctgggcatgtacgttgagtgaggacatcgccattgtccgcagcttggagatattcgagacggcaccttcacttcgtgagcgaagcatgcaccgatcannnnnnnnnnacccaggacggctccttgccggcccctgccccgtgccatgcgtttcctcgttctctgtgctctgcccctgccagcccgctctccgcctggccttgccaagcggactggtcgcttcgccacgttcggtttacannnnnnnnnnatggagccctgcggccacgacaagtgcgtcggaaaattgtcgccgcgtggcattgccgctnnnnnnnnnntggcccacgatgagcatgtgcacgtcagtgcctcgtgtgcaatgctgcagttctaggggagggggctgggcagaggggggcccaggcacgagacaggtgccctcctttcgtgaagccctgcggccatgacaagtgcgttggaaaattgtcgccgcgtggcattgccgctgtctgagaacatcggcgcccggcctgggtgggcgccactggggtcgccgccagcgtgcctgtcgccaccaggctcgtcgtccatccgatcaccactcctggactcaggaccgctgactggggggcggcttcccagcccctcccggcgacgacccctcgcctcgtgcagcggctgcttgcccccctcctcgttccccccggccccgccccccggtgctcagccgcctcaggcccagatggcgagcacggacatgaggccgtaccccgtcgccagcgcggccagcttcaggagggtgtgcgccttgtcgtccagctccttggggatgacctccatgaaggcgacgtagaggaaggtgccggcggccatggaggaaatggaggcggcccccgtccccgccgccaggtccgacaccacataccccacgaagatgcccagcggggaggccagggtgaagggtcccaccacgctccagaagcgggcgggggagacgtcggagtcgaccacgctggagcccagcgcgtaggcggccaggcccttgtgcgacaccacggcgatgaagatgtgcatggaggcgctgacggtggcctgcgcgcccatggccgcgccctccagcacgctgtggaagcacagcgcgacgcccagcaggatggccgtcgcaaaggtcacgctgtgcccgccgcgtcgcttgggcgcggcgggcaggaccgacgagcccgcgccgtcggggccggccgcgtgcgacagcagcggcgccgcctcgtgcgcggcgggctcgccat

SEQ ID NO: 36680 - DNA, 73 bp, Chlorella protothecoides
ccccaggcggggtgggggcggggacccggcctcggaccgcgaccggaagaagaaggaccagcacaaggcggcg

SEQ ID NO: 36681 - DNA, 79 bp, Chlorella protothecoides
caatggtctgagcgtttgactcatccccccccctcctcccccatgctcgcctgggtccccaggaaattttgagtacacc

SEQ ID NO: 36682 - DNA, 61 bp, Chlorella protothecoides
agtgtatcaggaaccgccctttcacggcggtgccggcacgccccacccaccggcatgcctc

SEQ ID NO: 36683 - DNA, 420 bp, Chlorella protothecoides
  modified_base (147)..(268): a, c, t, g, unknown or other
atgggctcacttgcaaatgaacaaaggaattcaaaggtgcagcagcatccttaagataagttcttcctttcatctgcgcatggaattgaatgcagttgagtaagacctactcatacatctccatgtgaggatacatgctgcccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagacgtctcaggggctgattaggacgtcaaggatttgcaccttcccctggcttccctccgaggggagataggagcctcctggccgtcgtcattcagccgatccgcatcccggtcacgacgtgatgccggggggctcctgtagaatatccc

SEQ ID NO: 36684 - DNA, 76 bp, Chlorella protothecoides
cgacgtggtgaccaccaccacccacaagagcctgcgcgggccgcgcggggccatgatcttctaccgcaagggcgtg

SEQ ID NO: 36685 - DNA, 69 bp, Chlorella protothecoides
cgccctggagctgggctggggatcggaggacgcgtcggggagtgcgcctggcggggcaaggtgcgccgc

SEQ ID NO: 36686 - DNA, 103 bp, Chlorella protothecoides
tgtgcaaagccctgcccagccggccctgctcaaacagcccggttgcccttcccctgaaccccaacccccacccagcacacctggggcagtaggcgcccagcgg

SEQ ID NO: 36687 - DNA, 76 bp, Chlorella protothecoides
cacgtcgattccatggcaagtcattgccacccctcggtcgtgccaaaactagcttttcttctatcaatctgccatt

SEQ ID NO: 36688 - DNA, 71 bp, Chlorella protothecoides
tccacgcactggtgtcgggtgcccgccttcccgggacccgcaatggagtcctggacacagcgtgacacagg

SEQ ID NO: 36689 - DNA, 66 bp, Chlorella protothecoides
agggcaagaacaactttggcaccaagaacatcgggaatgataacattggtgagcagggggtggggt

SEQ ID NO: 36690 - DNA, 61 bp, Chlorella protothecoides
tcgtgcacagacggatgcaaggcatccccctccccccccctcttccccaccacacacagcg

SEQ ID NO: 36691 - DNA, 65 bp, Chlorella protothecoides
ccccccccctcttccccaccacacacagcgcacgagtcacccttgtcacagattccagctggctg

SEQ ID NO: 36692 - DNA, 92 bp, Chlorella protothecoides
caggaccttgtctgtcttggagatttggaggactgtggaaggtatcacttggccccatccaggccatgcatgccccttgcccgggctgcccc

SEQ ID NO: 36693 - DNA, 123 bp, Chlorella protothecoides
aggtgtgctttggtttgtgtaggagggggaatgcagcgcatgtaaggcggtgaagaggggagcgatgtgttgggcagaggtccactgcctcaggccggacaggccgacacggcgaggctggcc

SEQ ID NO: 36694 - DNA, 65 bp, Chlorella protothecoides
tcacgcaggcggagaataaaagagggagggtggggctttgcgggagacacttggcgatgggccgg

SEQ ID NO: 36695 - DNA, 97 bp, Chlorella protothecoides
cgtaacctacagactgtcaagaataaggccattacaaagtcagtcgtggtgtattaacacccgagggaggggcaagtgtcctgtggtccaaggttgt

SEQ ID NO: 36696 - DNA, 61 bp, Chlorella protothecoides
acgcgaaagaaactcatgaatcggcaggggggatggagtagaaaccttgacacaggtatga

SEQ ID NO: 36697 - DNA, 74 bp, Chlorella protothecoides
gggcggcggcggtggggacgccttcttgggtggcggtggcggcgacgccttcttcttgggtggcggcggcgacg

SEQ ID NO: 36698 - DNA, 720 bp, Chlorella protothecoides
  modified_base (165)..(310): a, c, t, g, unknown or other
  modified_base (410)..(614): a, c, t, g, unknown or other
gagatgcgccccattcttccatgcttgtgccctccccctcgccagtaatttcaatgcgatgggcatgcatggcgcttgcacggacccccttgcactgcatgcacaataagcatcaggatgtgcctgccatccacccctctacacacctggagactgtccagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggcacatgtgcgagtcgttcggtcgtgtccgtggacatcagcgcccgatggagcgtcccttctcgccaggctggccccagcgccacacgctgtcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtggcccatggggtgtgggggaggtccagttgggtgctgtgaaggtcaaacccgaatggtcgccgctgtggttcatgggacacccaactgccacacctcctcg

SEQ ID NO: 36699 - DNA, 446 bp, Chlorella protothecoides
  modified_base (155)..(374): a, c, t, g, unknown or other
acgctgtgagggcagcccggcccgccccgagaaggtggcgctgtagaagatgagctgtcgggggagctgcatggccgccaggcgctgtgctggctggaagggcggagcgcggacttgctgcgcctgctgtggccgggagcctgcgaagccaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtactgtcctgggaggcggccatcgtctgttggggcgctggtgcttgttgaggcgctggcgcttgttgggg

SEQ ID NO: 36700 - DNA, 70 bp, Chlorella protothecoides
acttggcccgggcatgccatgtcgaggcggcgcagcaccccccacagcgtcgtgagggtcacggtcacat

SEQ ID NO: 36701 - DNA, 69 bp, Chlorella protothecoides
gcccgacactggcctcgaggcaatgggctggcttgcgcgccctgccagttagcaaggcatgcagcccgt

SEQ ID NO: 36702 - DNA, 74 bp, Chlorella protothecoides
aatcccattcccttcctactgaaacctgtgtgcccccccccttaaaatcaagattccgtgcgggtcttccatcc

SEQ ID NO: 36703 - DNA, 61 bp, Chlorella protothecoides
tggggctgacggcggtgacggcggcggggggggaggactctcccgccatggcggcggggat

SEQ ID NO: 36704 - DNA, 519 bp, Chlorella protothecoides
cttcccccttttccttgaaggcctcctcccgcctccccctccctgcccccctcatccctcactccctccacaccccgcagggactcgcacgtgcagctggcgcggcaggcgcgcgtctcccacgactcctgcatcggcgcgggcagcatcatctccgacggcgcgctggtggaggccagcgtggtcggcgccaactgcgtggtgggcccgggttgcgtcctgcgcggcgcctacctgctggacgacgtgcggctggaagcgggcgtgtgcgtggaggccgccctgctctgcgacagggtggtggtgcgcgagggcgcggcggtgcgccgcggcgccgtgctttcctttgacgtcgtggtcgggccggggcacgaggtgcccgagggcgcgcgcgtctcgctgtaccgccagctccgcgcgccgggccactcctcggacgacgacgtggaggtgcccgcgcgcgaggccaccagcaccggtgcgtccctggtggggtgggaaggggagggggggggaggg

SEQ ID NO: 36705 - DNA, 61 bp, Chlorella protothecoides
ttccgtctagccgcttctgccgacacccccacccccccccgatcgaccccacagcctgcat

SEQ ID NO: 36706 - DNA, 78 bp, Chlorella protothecoides
gtctgacaatcgaatgtgacaaaatttgctctgaggaatcggggtggctgctgccgcgcatgtcatgtgccccctggg

SEQ ID NO: 36707 - DNA, 86 bp, Chlorella protothecoides
tgcaagtgagtgctgtttactgacggggcacgaggtcttcatgcgaggcagaaggtggtgccctcggcgccgccattcgcagtggg

SEQ ID NO: 36708 - DNA, 115 bp, Chlorella protothecoides
cagttggggggtttggatgagggagggagggtggggggctcatggggaagaggataagggtgctatatttgctggtgcactggaggggggtgcatgcaaggaagagccataggac

SEQ ID NO: 36709 - DNA, 78 bp, Chlorella protothecoides
tgcctcaccctgacaacaatacccactgaacgcggacactctgaatgatcatgctcccctccctctcctcccccactc

SEQ ID NO: 36710 - DNA, 71 bp, Chlorella protothecoides
caacaccgcccgacgacacctcggcgccaatttcccttgccccacctcaccgttgagaaggtccagcagtg

SEQ ID NO: 36711 - DNA, 3130 bp, Chlorella protothecoides
  modified_base (275)..(284): a, c, t, g, unknown or other
  modified_base (1078)..(1087): a, c, t, g, unknown or other
  modified_base (2168)..(2177): a, c, t, g, unknown or other
  modified_base (2380)..(2423): a, c, t, g, unknown or other
  modified_base (2591)..(2600): a, c, t, g, unknown or other
ggcccgccgccaggcccggcgcgcggccgcgcacggccccgcccagccaggcgcgggcgtcggcggcgcaggcctcatccctcaggtccagggtgaagagcacggagtcgaggcgggggcggtggcccaggcgcatgaagccgcgggggcggccggtggccttgtcgatgcgggccatagacctggggaagggggggcgggggagaatgcattgtgattgtacacttgggagatggggagggtcggtgcagggggtggatggaggcgggggaggnnnnnnnnnngatgcattgtgattgtacgtttgggggatggggagggtaggtgcagggggtggatggaggcgggggaggaggaaaaggagcaggaggaggagtgcgctggcagtggctgcgagtcagtggggggcccaggcgagctccctggctgtgggtggtgccgggtgccccaagcgagcacaaccctgcagcagcccgcccagcgaccgcaccggtagagcatgggcagggggacccagtgcggcgggtacttgaaccgcgcggtgtccaggatgaggaccaggtcctccgcctcggagtaggcccccacggggctatggtgcccgtcccccgtctggccaaagtcggcgcggcagtaggccacgatgatgtgctcggtgccgctggcgcaggcgtcgcggaccatgtcgcggaaggtgcccaggctgacgcagccggaaggatagacctccaccgccgcgccgttgcagtgcgccaggcaggcggcctggtccagggtgacgccctcctcccgcacccgggcaagcgggtggcagcagtccagcatctcctcgtggaaccagcgccaggggcccttccatgcgcggcgcgggtcgatggccaggctgttgagcaccatggccaccgaggccaggccgcagaaggcgggctcgtcctgcgtgcggaactgctcgatcagcttgaagaaggtgttggcgccgccagcggccagcgcgccggcgaagatgcgcttgcctgtaggcagcgggcaggaaatggggtggggtgaaatggccgggcagcaggatggaggaggggannnnnnnnnntgcttgcctgtgggcagcgggcggaaaatggggtggggtggaatggccgggcagcaggatggaggaggggagcctggatgcaatttcatgctggtgtgtccaaaggccagggtcataccaggggggagggatgtaccctttgacccaccccaggcccaccctccgcgatccccagccggcaacctgcgagcaatcctcgaccaactcaaatccaagcccaccttgctcggaggaaaactcgatggcgggggggcagggcagctggcgcttgtaaaacgtccgggacacgccggggggagacaagggggccgacaagcgggcaggggggctgcttggcatgtcggtgtccatggtgtccgctagaaatacagtgtgtctcacacagcttgactctgtagccgacgtccttggcaggcgggaaagggcccgggtgaaactcccgcacacagtgctcgctgtacggcccacgcccattggcgcatggcccgtcccactggccaagaccgtgcaaagggtcaatctggatgcgtgagatttgattgtaatactagaacattgtataccgtgcgagacgtcgcctagaagctttccggctgggtattcgaaaacgccgaaggcgcgacggggcgcgtttgggaagaccggttcaagcatcactcagtggcaggcccttcgctgccggtgccattgtgccgcacgatccgcgcattcccctggccatgatcacgctatgtgagcaccagcgacacaagccagggcacgacagtagggcaccggggcgcatgcccaccggcctcgacccccacctaccgtgacagagggacatggccagcgagcgatatgccatcctggtgagcccacaggcagggcaatcatggacatgagtcatggtggaggtggaatgaatcgctgattggacctgatcacgcgcgacaccgccagggggggagacgtacacggtctcggaccggtcattcccggggaggccgtctcgggctcccggacgtcgatgccgtcccccgccccacagtcgctaccttcacgccccgccccccgccggtctttcaggaaggacgggtgnnnnnnnnnngccggggaggccgtctcgggctcccggacgtggatgccgtcccccgccccacagttgctaccttcacgccccccctcccccgccggtctttcaggaaggacgggtggtgggcgaggaggagctgctggacagcctccagatcagcctgccccgcccgctggaggaggtgctcactgctctgcgcaaggtgtgcaagcggacannnnnnnnnnnnnnnnnnnnnnnnnnnnnnnnnnnnnnnnnnnngtgtaggtggccagcagtcatgctgcgtatgaacggccccgccctgcacttctccgcccgatggcccccgcccatcaccccattgcccatcgccccatcgcccatcaccccatcgcccatcacccccaaatcacacctccccctctgcaaccaaaccagggcaccctnnnnnnnnnnttgtaggtggccagcagtcatgctgcgtatgtacggccccgccctgcacttctccgcccatcaccccatcgcccatcgcccccatagcccatccccctcccgcccatcgcccccaaatcacccttccccctctgcaaccaaaccagggcaccctgctgctcaagcacggccgccatggccgccccaaggtgcactacttccgcctgatgggcggcgacacgctgctgcgctggcgctcggcctcggggtccatcaagacggtgccgctgcgtgccgtgggttccctcacccccggccaggccagcgaggtgttccggcgccacccgctgccctccggcgcggcggcgggggcgctgtgctggagcctggcctacgccgacgagggcggcacgcggcgcacgctggacctgacggcgcccagcgccgaggaggcgcggctctgggtctccggcctgcgcctcatcctggcctggctggcgcgcggtccccagccgcggcgcgccggcgggcaggccccggcgccgccctgg

SEQ ID NO: 36712 - DNA, 71 bp, Chlorella protothecoides
acaggcccagccgcacctccggcaggcccaggcgggcgtcgtgggcggccacgcgcgcggtgcaggccagc

SEQ ID NO: 36713 - DNA, 6151 bp, Chlorella protothecoides
  modified_base (388)..(397): a, c, t, g, unknown or other
  modified_base (565)..(574): a, c, t, g, unknown or other
  modified_base (995)..(1004): a, c, t, g, unknown or other
  modified_base (1440)..(1449): a, c, t, g, unknown or other
  modified_base (2175)..(2184): a, c, t, g, unknown or other
  modified_base (2422)..(2431): a, c, t, g, unknown or other
  modified_base (2630)..(2639): a, c, t, g, unknown or other
  modified_base (4240)..(4249): a, c, t, g, unknown or other
gccgaggccacgcccgcggcgcagcgcagcgccgagtccaggctctgcgcggcgcgggcggcggcccgcggcaagggccccgccggcaccgcccgcggggcgcagaaggggttgcgcagctcccgcgccagcgcgctgctgcgcgaagaaagctgggagtggaggtgcacgaggagcggggtcagcctggcgccggccgaagccccgctggggtcctgccgaggaggaaagggattggagggcggcgggggcggatgaggggagtgaggcaagatgtccacaatacaaaggcgcgaggaaaacgttcaccgccctgcggctctgcgatcgggaagctggaacgaccccggcacatgcaaggacgcacaaacggaccgccagcactccnnnnnnnnnnatcctcggtggcatgccgggggatcgcagacttggccagagcctgcaggagttggaaagggttccgtgacggcaatcgcagtgtccagggctagaggccagagtgtaaaggggacgggactcgacgccgcacgtcacggcatgcttgccggaacatcaggagggtccnnnnnnnnnncccctccatgcagggtagccaccagcgagcgcaggagcaccaggatggcctgcaccccgtcctcggtggcatgtcgggggatcgcagacttggccagtgcctgcaggagtcggaaagggttccgtgacggcaatggcagtatccagggctagaggccagagtgtacaggggacgggactcaacaccgcacgtcaaggcatgcttgccggaacatcaggagggtcccagccagattacagcacgattcgcatccccacccttcctcccgatgcgctccctcctcaccaggccgaggctgatgctgggctgcgcttggacgctcagccagacgctcctctgggtctctgtccgggtccagtccgaggcctgttggtagtgaagaaaggactggggtgggcttgaaacctcccagacagcgctnnnnnnnnnnttctgtccgggtccagtccgaggcctgctggtagtggagaaaggactagggtgggcttgaaacctcccagacagcgctctgtaccgcgcaatgaacccctcctggccgcgtgcctggccaaaggtgttggcgaatgtggccagcccttgcaggaggcctacagcccacagcagatccgtggggtccggcacgctgggatacacggccagcagcttctcgagctccgtggattctcgtgcccctcgccgggcgtcataaacgaaaaactggatgtcgccaaggcgggcgcgaaccatgggtgaggaagtgatctagtcgggcccacgctggggccttgtggaggccagcgcgccgatgggttggagagtgtagaattgctaggaggagtgtttgtttctgttacaacatgggcgagtgcatcaaggatgcataggcnnnnnnnnnnaagtgtagagctgctaggaggagtgtttgtttctgttacatcatgggcgagtgcatcaaggatgcataggcgcctcggagtctagattgcgcatcagtattgccgttctggcgccctatgacttggcttggggaatgcatggtgcccgccacaagcgagcatgtcaccggcatacaaatcagattgcatacatcggacatcttgcatcacacttcaggtgccggacctgccaagcggctggagcgatagtatctcaccctgcacttggtcaccatggtagcagagggcgggctcacagagaaggaagcggctgtgtatgatcgacagctgcgtgtatggggtgtggagacacagaaaaggtacgagtgttcgatctgagctggtctagatcggatggacggcatcttcgagaccggcagtgcgccaccacggcatcacatcctcctcgcaggctgagctccgccaaggtcctcatcgtcgggtgcacgggccttggagccgaggtgagacttgaagtggccgctggggtggacctggaggacacgatgtcttccatgtggcgaggtgtccctggtgccagcaccccacgcagtgtccaccctcccgtcctccccatgtcccaggtggccaagaacattgtgctggccggtgtggggtcggtgaccctcgtggacgacacgccatgcgcgcagcgcgacccaggcaacttcctcgtcctggcagacnnnnnnnnnncggtgtccctggtgccagcaccccatggagtgtccaccctcccatcctccccatgtctcaggtggccaagaacattgtgctggccggtgtggggtcggtgaccctcgtggatgacacaccatgcgcacagcgtgacccaggcaacttcctcgtcctggcagacgctgacggcagccagacgtgagggttacgctggggttggaggggaggaaagggtccccccccatctcactggctnnnnnnnnnntgcagccggacgtgagggttacatggggtttggagggaaggaaagggtccccccccatctcactggcttccttcccagcaacccgctcctgttcactttgaggtcggcaaggaccccgccccctgcgattctcgagtcccgtgcaacccccctctctcccgtctcccacccggtgcagggtggcgcaggcatgtgcggnnnnnnnnnntcccgccccctgcgactctcgagtcccgtgcaaccccactctctcccgtctcccaccccggtgcagggtggcgcaggcatgtgcggccacgctccgggagatgaatcccctggtggatgtgcaagcccaggccggcccgccggcggggtctgggctagaaagggaggcgcacggcctggtgctggacctgacgggggacccggccagcgtgtcggcctccagcgtagcgtgccgggcggcaggcctccctttcttcgcggggggcagccgcggcacgatcggctgggcctttgccgacctgggcgagcaccggtttgtggtcgagcggcggggcccgggccccgacggcgccacgcaggcggaggcgtgcagcaccagctacccctcctgggctcgcgccatggctgcggacgtgggtggccgcagcatgaagcgcgtgcaccccgtctacctcatgctcagaggtaaggccactgagtgtaggagaggaggggtcgtggaggggcgatgcaggcccgggggggtgggcaggggatggcgcaggctcgcaggcatgcctgccggccgtctgactcgggctcctgacccgccctgcctgcagcccaggcgctcagcccgagcggggctggcgagggagcaggcgccgccgctgccgacgccatcgcgcgactggacgaggagctggggaggcccagcggcctgcaggccgaggccctggaaagcatgacctgcaccgcgcatggcctgcccgcggtgtccgccgtagtgggcggcatcctggcgaacgacgtgctcaaggccgtctcggggcggggcaggcccatggacaacttcttcctgtactccatcgccgacggcgcgggggtcgtggaccgatggggggatgcctgacctgctgtaacgtgtgtagccctgctggttgagaggtaacagccgatgagtaaggcaccacccgggaactagaaaggatcgccccgcaatgccagtcttagtcccgctcgaacccgcgccgagttcgcactgtagaccgctcctcagcagcgacaacatcgaattgcttgccccgcgggcccggcatctcaggaaggtaagcgcaccaacgccccctcgtgggcatgggcgagtgccgggagcctgcggagtcaagggcggggtgcatggccgcaatctgctgcacctttgccagtaatactcacccgttcattatcccacgctttatcgcagaggcagccatggggaagatcccggtcaagttcagggaggtggtctacaccctgtccccgtacgagcagaacgtcatgggtgggctgtggagggacatccctcacaaggtctctcactactccaccaaggtatgggacgtgaggggtcccatcatcacatcggcatcggaggcctcgggctgggtggttcctatctttagggccctttcacacttacagccaaaggctcctcccccatcctgaccttatcgattctgccgctgcaggttcgggacgccgtgatcttcgctgtgcttcccctctggggcattggctggtacgttgggcatgggtagggtgtgggtgtttgtgggtggtggatctgagagggcgctgggnnnnnnnnnntgttgggcatgggtagggtgtgggggtatgtgggtggtggatctgagagggcgctgggcagggtgggtggggctccaactgtggtccgcagatcacattcactccagagtctcaatagcgctgggccatccaaagctcaagcttcggcaccttgctgttccaggtactgcaatgacttcaaggagaaggagaagcaccatcaccgcttctgagccacatgcgaactgtcctcaaaacagcactgtgtgtctgtcctcccgctgtacgcttccttactgtaacccagccaaacgagtgtgtcgcagagtgtaccaggcttcacacgagatcccttatcggtccctgcatcctgccagtcctgctaaggcgaggtgtgctgtcaccttccccctcgggtagattcaaaaggtttccggcacattctcttacagatgaagcaaatacgtagcagtggacggggttcagcgccgcgtgatgagctctcactgaccttacatctccatttacacgttaacgcaccttgaaggtgccaggcaggctggcgacgtgggatgcaaaccggtttgcggcacttcgacggtgtgggtgccgacccggcgccgtcgactccctcggacacgatcgagcaccaactggcagcatgcgtgcgtgaatacctaggcaattacctgtacgacaccgcgacattcctctgcgagcgtctggtcgctgaaacgccatccacggtgtgttggcatgctggtggtgggcccctgacgatggtcccatcttccggtttcaaccctcacagcctcggcctgcccgttccacaggcacacacgctccttctggcacgatgttactacctctcgaatcaaccataccgcacctaccatctgctgaaaggtggagaaggagttgcgcccccacccatctgcatgtcagctggccctgggtgcttgtctgcctccgagtgagcgtgcactgcctgaccccatctcctcccctcccatgctcctcagatagcagcgaccctgcctcgcgctatctgtttgccacggcatgcctttccctgaaccggctgaccgaggctgaggatgccatgctcccaggccccgccgcccatggggtaggcacacgtgcagggtggggccgctcactgcgatgtggctgaggagggtgcaggcactgatttgtgcacccggcccagcccccgcattccatcgcctcaggcttcgcctccctcacagggcgtggcccacggcgcggcgggtcacttcctgctggccaaggtccacacgctcatgaaccggcacgacagcgcggcctcccaccaccgcgcggccctgtccctggaccccatgctgtggggggccttcgaggggctgtgcaccctgggcgccgagaccgaggcccaggcctacctggagggcagcgggtgggcggcgcagcatggccatgcgcccggtgggggccgagcggaggcttgcacctcggagcagacacctggtgccagccccagtcaggaggccgacgtgggccccacgcccgggtcatcgcaggtgggccccccccccacagactcaatcgccgaccaggccttctccttccccagccccgcacccatggccgacggcggggcgctgctcggcgtgaccccgggctctggaggtgggccggggtactccggcatgcagtcctacgtcaccccttccccaaccgggctcctggcaggtgcgtggtggggtgctcagaggatgcgagcgtgtcattcccgggctgacggatggacatcactgcatgctcgggtgcaatctgcgcaacaggggtccttgctgcggatgcgatccgggcacattccctgcgggccacccttcggcaccccagcaagcacccccaccatgcaccgcgcagcccccccgc

SEQ ID NO: 36714 - DNA, 77 bp, Chlorella protothecoides
agggtgatgtggagcagccagggggattcagcaagtcgaaccaacccactcctgcccatgcccgagggatgggaata

SEQ ID NO: 36715 - DNA, 61 bp, Chlorella protothecoides
gaagctggagtgggacgtgtaccgccgccagcacgtcttcccctcccgccactttgacctg

SEQ ID NO: 36716 - DNA, 93 bp, Chlorella protothecoides
tccaccactgcctgcatcccccatgaccagcccggggggggtccaacgtcgcaaatgctgcgcccctcccgacactctcacgtccatcccacg

SEQ ID NO: 36717 - DNA, 77 bp, Chlorella protothecoides
cagaactgcactgtgagacgctgacaccacaaaacccaacacaatggcacagccagcagacattggcactgcccgaa

SEQ ID NO: 36718 - DNA, 119 bp, Chlorella protothecoides
ggccatctgggcttccaccacgcatactgctcggtggaggtgagatgacgcctgcggaggcggggtcgagggacctgcattgccctccaccagctcatcacatgcacccgatgctcccc

SEQ ID NO: 36719 - DNA, 61 bp, Chlorella protothecoides
gattgccgccgcgcatcctccgcacgatgctggtggcctgccgagtactagcagattgagc

SEQ ID NO: 36720 - DNA, 151 bp, Chlorella protothecoides
gacgtttgggtggagagggggagcgccagaggggctcgcatctgggggtttgggccgaggatgggaaagggggcctgcgacgagccgagcgccatcattttcatcggggcagaatgccattgctcgatgcatccctgcttgccagcccgac

SEQ ID NO: 36721 - DNA, 61 bp, Chlorella protothecoides
gtggtgtgcatgtgtgatgtgttgccggggacccccccccagccaacgcctcacactcccc

SEQ ID NO: 36722 - DNA, 65 bp, Chlorella protothecoides
cctgccgctccgcggccgcctccccgtcggccacggccgcagcctcctcctcctccagcgtggcc

SEQ ID NO: 36723 - DNA, 362 bp, Chlorella protothecoides
  modified_base (87)..(306): a, c, t, g, unknown or other
tggttcaggctacggtgagttcgattccaggtgcaggcctgtcgcgtcgagtcacgctgcgcttctccaaccagtgcgctgtctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttgtgaacggactgcggcagtattgcagttggaggacctgcatgtttcaagt

SEQ ID NO: 36724 - DNA, 128 bp, Chlorella protothecoides
cctgtccaaagtcgaagcctgggcaggggtttgggggagggggtcggcggggtgggtttcggaaggcagggatgatgccccaggcagctggcggcggggccggcaggtctcgcgcggtggcgtggccc

SEQ ID NO: 36725 - DNA, 71 bp, Chlorella protothecoides
ctctcctcctcgagtaccccaaggtgtgtctctcaaggggggttggcatccctgcatggccatccttgctc

SEQ ID NO: 36726 - DNA, 75 bp, Chlorella protothecoides
agcgacgaccactcaaagttgacaaacatgcctctaatgaaactctcacaatggactgtgttgctgtcatactac

SEQ ID NO: 36727 - DNA, 94 bp, Chlorella protothecoides
gttgggtggggcttggtatgagtaagctcctgtaatgattgcgactggcagaccgcattattttgtaaaagcatcccctcccgctccgcccctt

SEQ ID NO: 36728 - DNA, 85 bp, Chlorella protothecoides
tggtctccttcctggcggccgcggcggccgtctccgcctcctgggctcgggccagggcctcgcgcctctcctcctctgccctcag

SEQ ID NO: 36729 - DNA, 70 bp, Chlorella protothecoides
gtcttagcatcagctcgtcccattgccccagtccccccccaacccatctccaccctccctctccttcaac

SEQ ID NO: 36730 - DNA, 61 bp, Chlorella protothecoides
acaggtgcacttgaggggcatactcggctcacgtatggtgggcctcaagaaccgatgggga

SEQ ID NO: 36731 - DNA, 61 bp, Chlorella protothecoides
gctctggtcaggtgttctgatccctccccaaaacctgcatcctcacttggagtacttccgt

SEQ ID NO: 36732 - DNA, 175 bp, Chlorella protothecoides
acccctcccctggcctctcgccggggtgccgaggctgggccgtgcgggccggcgctctgtctgtttgtgggctgaaggacccctcacactgctcgatcccccctcccacgcttccctgccaccgacacaatcccccctcccctcaaaaacacacccctccaaaacacacacacac

SEQ ID NO: 36733 - DNA, 61 bp, Chlorella protothecoides
gccggtgccacccaccaccagcagggtgttttttccgactgtcgagccactggacgcagcg

SEQ ID NO: 36734 - DNA, 182 bp, Chlorella protothecoides
cgcacccggggcgcccagaggtgcgtggtgcttctgggcctcgctggggaagtggttgtgtgtgtctacaggagaaaatatgagctgccctgcgaccgcaccgtgactgcgcagaggcgggctagggtttgggtgaactcgccgaaggagcgcagccattcagcaagcctgcccagcgcatg

SEQ ID NO: 36735 - DNA, 411 bp, Chlorella protothecoides
  modified_base (129)..(309): a, c, t, g, unknown or other
cctcaccacgcacctgcggaagtagatggggatgcgtgggacggcgggtgtggggccctccgtgcctttccaactgccctgcaacaggggagccgccgtcctttccagccaggtagtagccacgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatgcctgccacccaccagtccaagattccttgcccttgcagccctctgcttcgtctcaccttgccgggctgcgcaaccgccgcattggcgatggagtag

SEQ ID NO: 36736 - DNA, 103 bp, Chlorella protothecoides
ctttgggaggcgcaagcacagcacttcagctcccaaaccggaggagaatgctgagttggcaccagcacacggtgcgcgtcccggatcgcacgtccaggtgcac

SEQ ID NO: 36737 - DNA, 66 bp, Chlorella protothecoides
cccccgccgtgaacctggcgactctgggaacctgctccgccccctcgtgccaggcactggtggccg

SEQ ID NO: 36738 - DNA, 77 bp, Chlorella protothecoides
gatggccgcctgacggggtgcgggctgcgtgtcgaaccggaacctggcagggcctgggagggtggcttgctcgcact

SEQ ID NO: 36739 - DNA, 67 bp, Chlorella protothecoides
aatgcgttctgggtcctccacatgattgtgtgtggcgtcctcccttcccagatccttggcaggcatg

SEQ ID NO: 36740 - DNA, 70 bp, Chlorella protothecoides
atgccttgggatgcctcctggggctcctggttgatggccaagggagcagggcggtcgcctggaggggtct

SEQ ID NO: 36741 - DNA, 108 bp, Chlorella protothecoides
gagtgtggcgcggaggccaggcgctccaggctcacaagggcgcctggctcaccgctgggtcccaggtcctgtgagtcgtgggttgggggtacattgcagggcgtgtga

SEQ ID NO: 36742 - DNA, 61 bp, Chlorella protothecoides
ccacgacgcggtctacaccactgccgggcctgtgctggtggctgtgaaccccttcaagccc

SEQ ID NO: 36743 - DNA, 79 bp, Chlorella protothecoides
gagcgggcgctccaagacgggaggggaggacacaggggcgccatggaatccagcaatcggcccgatgcgctccgcctga

SEQ ID NO: 36744 - DNA, 62 bp, Chlorella protothecoides
gagagtgtggcaggagatacagccaccacacctgaccaggaaaatgcaactgcaggttgaca

SEQ ID NO: 36745 - DNA, 61 bp, Chlorella protothecoides
tggtgccgccgttgcattggctggcctcgcccccagtggacccagcggaagcctggcttgc

SEQ ID NO: 36746 - DNA, 197 bp, Chlorella protothecoides
gggcgaggtgatgccgcccatcccgggcctgcccctggagctgcacccctcccctcactgccatgcggctaactgtgcatgggaagggatgccttgtctgaacgggaaaggacttactcgccctgatggcatgcagccacaaacccccacgccagggcatgcacgctgaccatgcacagcaggaaggttccccgccg

SEQ ID NO: 36747 - DNA, 93 bp, Chlorella protothecoides
ttccctgcacaatcacggccctgcacttgggccgcaatgaaggaacccccccgtgtgcatccgcccttgcagtggtgcggcagcgggacatcg

SEQ ID NO: 36748 - DNA, 61 bp, Chlorella protothecoides
cacgaggaggtccgggctgctgtgccctccacccgggggtgggactgctgctcgcctgttc

SEQ ID NO: 36749 - DNA, 97 bp, Chlorella protothecoides
caacggaatgaatgggctgaggtggtgaagcatcaggaatgcactgggagtctttggacccatgacacccaatcaccctgctgatggggtccaccag

SEQ ID NO: 36750 - DNA, 61 bp, Chlorella protothecoides
gcgatgtcgcttgtttgggctggtgaggagtcttggcatggctgtgatcgtggggtgcgcg

SEQ ID NO: 36751 - DNA, 77 bp, Chlorella protothecoides
catgccagccaaacaaggtgtcaccgctccctcacaacatctcctcccacaccctgcggagccaccacaccaccgag

SEQ ID NO: 36752 - DNA, 61 bp, Chlorella protothecoides
cgggccccgccacccctctgcacgctcctcacaggcccaacttcagcagacggtggcccgc

SEQ ID NO: 36753 - DNA, 61 bp, Chlorella protothecoides
cccacctctctcgctgaagcctagcacccacggtggctggacccatgagcaacagccctcc

SEQ ID NO: 36754 - DNA, 76 bp, Chlorella protothecoides
gtgcggagctgaagcaaaccctcgcattgaatccctgaatgttgctcatccggtcacccaccaagagacagcggct

SEQ ID NO: 36755 - DNA, 113 bp, Chlorella protothecoides
gaggggcagcgtgccgagtgatgagactgtgcacgctgtgcaggaagaaagtatgaccaggagtgtggaagttcatgtgcacttggcaaaaaagtcgacgccctgtctgagct

SEQ ID NO: 36756 - DNA, 250 bp, Chlorella protothecoides
ctgacgaagggtccgaggtgtacgtgtttggcgggcgagggcagcaggtctcccaggacaagagcacacaagttcactgccgacctgcctcatatggtgaatgaccccggcacacaagtcgatgcggcacccgccgcacaccgcgtgcatcccctccatcaaccaccacgcatgcgccgtggaccggaggatgtcccccacaaagcccctggcctcctggcacgcaccatcctccgcagcagggtggact

SEQ ID NO: 36757 - DNA, 112 bp, Chlorella protothecoides
gtacaagagtcatgatgcaaaagggaccggtaatgttctccatgcacgcgacatcccagtgccaacgggcacactgcctttctcagtaccccaaagccaggggcgtaatcaa

SEQ ID NO: 36758 - DNA, 61 bp, Chlorella protothecoides
ggctcggagagggtgactcctcagggctcgaagagggtgactcctcggggctggggctggg

SEQ ID NO: 36759 - DNA, 79 bp, Chlorella protothecoides
attcttgtgaggtcacctggagctcctggaaggatactcgccccgggcgggtgtcaccagcatctggcttggtaacagc

SEQ ID NO: 36760 - DNA, 105 bp, Chlorella protothecoides
agggggggtggggaggggagggcaacgtgtatgatgacaagacgcagtacagaggatggccccaaagcgtcgcagctcgtcctgccaggcactcagttcccacaa

SEQ ID NO: 36761 - DNA, 73 bp, Chlorella protothecoides
ccatacacgccccaagctctggacccttttcacccctgttacggaacccaccccttgacaacacccacccgcg

SEQ ID NO: 36762 - DNA, 11689 bp, Chlorella protothecoides
  modified_base (1834)..(1843): a, c, t, g, unknown or other
  modified_base (2364)..(2373): a, c, t, g, unknown or other
  modified_base (2548)..(2557): a, c, t, g, unknown or other
  modified_base (3739)..(3748): a, c, t, g, unknown or other
  modified_base (4215)..(4224): a, c, t, g, unknown or other
  modified_base (4909)..(4951): a, c, t, g, unknown or other
  modified_base (5527)..(5536): a, c, t, g, unknown or other
  modified_base (5657)..(5666): a, c, t, g, unknown or other
  modified_base (7602)..(7611): a, c, t, g, unknown or other
  modified_base (8118)..(8127): a, c, t, g, unknown or other
  modified_base (9148)..(9157): a, c, t, g, unknown or other
  modified_base (10176)..(10185): a, c, t, g, unknown or other
cccccccacctcacccaatcttcaacaggctacgcccagatggctgtgctggtctgccagtggctggccgccgtgcaacatggggcagctgagaatgaccctggaaccccacgggccgccagccagccccctctggacgaggcctcctgtctcagagtgggtgggcttgatgtcagcgctaggccctgcagctgggtcctggtgaggaatccaagactgtgatcggaggtattcaccaacctcccccctcacatcgcatgcaggagctggtgaaggagaggtttgaccccaagagcttccatgggatcttctccaggggcggggcgggcgcccccccatggctgcactccctgattgccgatgcaggtgagcaatgagggcaggggtgattgatgcccgggagggaaccctgcctgcagagatcaatgtcaaagcccttcctcatcagtacgataacagaggacgcccgcagacctagatcaggcttgccctggagagtgccacaccatgcatgtgctcccgatgcccagcttggatacgcagtggctggctctccatcctcccgtcctccaccccctgcgccgacagacgggcgccagctcatctacgacctgtctggccgctacgccaactcgctgctgctgaactttgcgatccagaagatcctgcagcagcccgggcgcgaagcggaggtcgcggcggtcgggccgcgcctgggctcctactttggcgtcttccaccggctcatggtcacgcgcctcagtgctgccctggcctccaccagcgagcgggagctggacaagctgtctgcggagatacaggcacgcggagggggagggcctggaggtagtgtgcctgcttgcctgcgtcgatttcgggaggaaggatgtcgggatgttgggtccaggcctacttttgctggccccgggtatgcagagagggtggtgcaggtggctggcttgctcctgctgtgacgcagcagtggcatgccggcaatgatcgatcgagctttcctcttcctgcatgttgagtttggtgagcccccccaacagtcccccatcccctctcaccccttctgcccatcacacagcaaaacgccagccagagccagcacacctacattcacgtccagtcggtgttacagagcctgggcgcacacccccagggggcccgctttcgccggctggccgctgacctggcagggcatgccgcccagacccagggcgccgtggtgtggcgcctgagcccactgttctggggcgagccggggtctggggccgtgggtcccctgctcgccgacctcatggccagcgtggagggcggcccgctgcccagcctggaggtcatcaggctgtgcgccctctacggcgccgagccggccgaggcgcggcccagcctggacctcctgcgccaccctcgagtcttcagggtcctgctggcggccctgtttggccccgggcaggggctggcgggccaggccctcgccgccgcggtcgagctgctggcgcgagccgcggcgggcgggcccgagcgcgaggcggcggtggaggccacgcgcgccgcgctgatgggggcggtgacgctgacgcgcaaggcgctgcacgacgccaagctcagcgcggaagagctggagggaacgggcgaggtgcttacggtgcccatctgcgcagcaggtttggtttttggttttgctggagaggggttgaagggtgtgggggtgatggagagctgtgcatgggctgcgagtctgatgcccgcgtccaggaatttatcctgggggcaggtgacgctttgtgcagggaaggatgttaccaagaacatttcattgggcagnnnnnnnnnnggtttttggttttgctgcagaggagatgaagggtgtggggtgatggagagcggtgcatgggctgcgagtctgatgcctgcgtccaggaatttatcctggaggcaggtgacgctttgtgcagggatgttaccaagaacatttcattgggcaggaatggcagaactatcagaagaagggctgccgccctcctcccttccctgccgtgggcccagacctgattcggcctcgccatcgacgcagggctgctgtgcggcatggaactgcgcttggccaagccggcctactggagcacgaccttccacggtctgcgcctgcctcccttcctcgccctcctccgcagggtcataccgctgcagccccagctccacgatgaggtgccttgcttggtggtgccttgcatgacccgtgatggtgtgggatgcagcagtggtgggagcccttttgctgggtgccggagccctctgcactgatcctcttagaagataagtcccctcctgaccggcaagccgttctcccctggnnnnnnnnnncctgctgggtgccggagccctctgcactgctcctctcagaagataggcctcctcctgaccggcaagccgttctcccctggtactcaggatgccccctgattccgacggttgagctacttttttgccctcagcatatcgcaacacgacctatccttctcaccccctcccactcctnnnnnnnnnnatgattccgacggttgagctagttttttgccctcagcatatcacaacgagacctatccttctcaccccctcccactcctctagatcctgcgcctcatcggcagcatcctggaggccatgggcaacagcaaccacgacgtggcccgcgccctgctggactgcgcggtacagctgctggcggcgggccgggtactgcaggtactagagtgggcggccgaataccgtgcgcgcgccgacccctccctcctgcgccacctggcctacggcgtgcttgaggcggccctgcccccctactcccccgcctttgcctcggccctgctgcgacttatgatgcatgccggggtcaagcagccgcgcgcccccggcagggacgcgggcctgcgcgcgctgctagatgagttcgccgcggggtgcagcgccctggagttccggccgcccctgtcctcgcgcgagtccgccttcctcctgggcctgtgcgatccgcgctgagagcgctgagaaggggtccccggcagggcagtggcccaggtcgccttgtgcgccagagtccagtagccgatgctctcctgaccctcgaggggggtggcgtcggcaccgagaccagtcacaatgccgtttgcactgccgtcgctgccagaccctgggcatcgtgcaggcgcctgctgtgcatggcattgccaatgccatgccctttgcttgcgcatcggtccctccacaacagccctctccatgcttcctctccatctcagacacacgctcggcttgacactgcccgctgtgggcggggtggcgtgcggggacgcaccacgggctctgcaacagtttaagcacacaaacaaaacggcactccccgacacaaaatcgttcgctagggtgtgtgggggaggtgggatgagagggcggccacgtcgcatggctcacggccgcacagcacgcgaaggctgcgccaggccaggccctgtcgctgatggcagggacgggcctgcccacgcaagtactgaaaatgttggcatgggtagcaggggctaagacagcatggcaaggggtagtggggtgtggggagtttagagagcaaggcaagggagcagcgggtgtctggggtagtggctgaggcaaggggcggccagaacactgagtgtgctctccccccttccctcccctcctcgatgtcggggcaatcagnnnnnnnnnncggcatgggtagcaggggctaagacggcatggcaaggggtactggggtgtggggagttaagaaagcaaggcaagggagcagcgggtgtgtggggtggtggctgaggcaaggggcggccagaagactgggtgtgctctcccccctcccctcccctcctcgatgtcggggcaatcagcggcgcagcgtattgtagagggcgtcgatctccttctggtacttggcctgcagctgggggcgcttcagcttgaaggtgggggtcatcagctcgttctccacggagaagggctccgactccaggatgacgccgcgcacttgctcgaagccctgcggtgtttttggtgtggggagacaatggggacatgggcatgtggggtcgagtgcgaggtgctccccaaccagtcagcagccggcatgcagtcgcccagccggggtgggggggtttggtgcctcacaggccacccacagcnnnnnnnnnntgaggtgcttcccaaccagtcagcagcctgcatgcagtcgcccagccggggtgggtgggtttggtgcctcacaggccacccacagcccatcctccgcctccccccccccccccaccccttgaccacattcccaccttgagcccgccctccttggcggccgccgccagctccttcaggatggccttcttgagctccgggtcagcgcacttggcggccacgtcacctgcgccgccgtgcgcgtccaggcgcccctgagtgggcacggccacggccaccagcacgctctccaggctgttaccgtacacccagatctgctccacgctggggcagagcttgtaggcgttctccaccttctccaccgccacgtactccccctgggacagcttgaagatgttcttcttgcggtcgatgaccttgaggccgcccgtggggctcagctccccgatgtcgcccgtgtagaaccagccgtcgcgcgtcagcacctcgtccgtcttctcctggtccttgtagtagcccttgaacagggaggcgccgcggatgcacacctcgccgcggggcgggtcggcgctgggactgtacttcatctcagggacaccctccaggcggaaggagatggcgggctggggggggcccaccgtgcccatgtggtcctgttgtgtgtgtgtgtggggggggggggttttgnnnnnnnnnnnnnnnnnnnnnnnnnnnnnnnnnnnnnnnnnnntgggggaggaaaggaggaaagaggggaatggatgccgcgtctggcgggccatcaacgagcccaggtggagcccggggccgggcaccagcagggtctgacgacgccacggcgctcttccggccaaccctgtgccgcattctgtggatgtccttcgcggtccccgcctccccctccccctccacgacgcccgcgcaccggttcggaggggtaggcgatgaaggaggcggcacaggtctccgtcaggccatacccctggaccaccagcgcgcccatgcagacgcgcaggaactcttcggcgtgcagcgacaggggcgcgccgccagacaccagcacgcggcagcgcccgcccagcgcggccttgatcttcttgaacacgatcttgtcccagatgggggcggcctgaaggcacgtggaagagtgtggcggcgtgcgagtggggcagggagcaccagggagccaggggaaggcactgaactggtggggggtgcgggcgaggcacgcgatcagcccatacaccgccctgcaagcccctgcgccccacagtatttgacaacgcaccttgtcctgggccacgcnnnnnnnnnnagatgagcggagcagggctgggactcaagcgtggcggagaggatgagggttgcaccatcaggaccctccccattcaccccccctcccaatcacctgccccgtgacggtggagtagatgcgnnnnnnnnnngaggcgcgtggaagagtgtggcggcgtgagggtggggcagggagcacccagggagccagggggaggcactgaactggtgggggggggcgggcgaggcacgcgatcagccaatacaccgccccgcaagcccctgcgccccgcagtgtttgacaacgcaccttgtcctgggccacgcccctcttcaggcgggccagcttggtgttgaaggcagtgtggaacaggaacttcttcaccgccccgccgctggcgatctggggtgtgatgtgggagagggagggtgcgggggggtgggcggagcagggctgggactcgagcgtggcggtgaggatgagggctgcaccgtcaggaccctccccattcacccccccctcccaagcacctgccccgtgacggtggagtagatgcggtcgaagacgcgtggcacggagcagaatagggtgggccgcagcgccttgacatccggcagcagctccttcacgttccccgcccagtagccgatggagccgccgacgtagaggatgagctcctccgcggcgcggtcgaagatgtgggccaggggcaggaaggagaggagcgaatcctcggtgcccatgcgcaccccagcatcggtcaggaaggcgtccaggctgagcacggtggacaccacggcgcggtgggagagcatgacgcccttggggtcgcccgtcgtgccggaggtgtacatgatggtgcacaggtcgtcagcctgcacggtggcggcggcggcgggcgaggcctcccccagcgcgacgaactcgtggaaagcgtgcacggcgatgcccaggtcggcgacgcggcgcagcgtggccgcgtcggcctcgtcccagtagaccacggtgcgcacgcggtcgcgcagcgcgggcaggctggcggccagggcgccgagcttggagcccagcaccgccactgccgtcacctcggcgtgcttgacgatgtactccaccgcggactcgcccagggtgtcgtacagggggacgcagtagaagccctggcggttgcaggcctgcatggtgatcatccactcgggggcgttggggccgtaaacgcccacgcgcccgccgggggccagccccgccgacaccagagcggagcccaccgccgccacctcacgcgcggtctgggagtaggtgcgccaggaatacccctccttcgtgcgcttgcccaggcagttcttgtcgccgaagcgggagactgagtggctgaacaggtcggacagggtgttgatgtccttgacggtgggggggccgtccttggccacgcgaaccctgcggtggcgaggagtggggagcaagggtgagccggataggagtccccagagtggccccaggccatgacgagcgtcatcagggactcccgcccatgatgagtactccgaaatcgccactgcgcccccttcagccccgccgcgacgcaccgatactcgggtccagtttcgggacggccatccgcggcgggggagggggggcccacctcggcgaggtaggcaaactttttaccgggcatactggcggagatgggcttccgaaggtgaacaaaaaggcagcgctaggtcccctggtcagtacgtctagaaacagtatgagaattttgagctaccaatggggtgcattgggtaccagggcctttatcacatcaaccgcgacgaggttcccggcttcaaggagccgttcccatgatggattggaaagggggccgcgtgcttggctgtcacgcttccgacaggcacccgctaacctgccgagccatggcggagctggagtggaagttttaccctgtgcaaattctcgatccatcggaagatgatgtgttttcatgaggccgtcatgcctggaacagcaggcgggcgctgcatgaaccacgatcggtcggtggggaagtcgacaccatctcatgccctcttcttctgaccattcgcctnnnnnnnnnnccggtcggtcggtcgggaagtcgacaccagctcatgccctcttcttctgaccattcgcctctgccccccccgctccttccggcgcatccttcctcttttttaggccctgcgtgttatcgtggttgtaaaggagacatgagctcgcaatacgcctcggacataatgaggaatgcgcgttgtgcgcaggccagcaccggagggaagcctcgcccaccttggacttgtgcagcgctatggtgtcgatgttttggggaggcatgtagatgcgtcccacccgaccctccagcgcatctgtcgccacattcttctccttggtcctcgtcagcttgggctgcttcatggcctccttttccaggtcggccgcaggctccctggtccgcctcacctctagatcgagactgggacccatgatctcaagctcaacgcgcggcaccttggtccctgtttgtgtgagttggagtgagacgatcctgccccagtgaggtgtgtaggtcaggcaagtatcannnnnnnnnntggcaccttggtccctggttgtgtgagttggagtgagacgattctgcctcagtgaggtgtgtaggtcaggcaagtatcagaggacctgtgtgcaggactgagttctgcagaccccactgtgagcctggagaagtctctcagcccaggcccatacaataaacagtgaatcctgccccatcctcgtgcagctcccagccataacatgcacgttggccacaacctcacccgaccgtttgagcttgacactgtactgacggaacactatggtctttgaccctgggagacaggtcacgaagaccaccctgtccaggcccttcaggttgagcgcatccacctgcctgccgcggaagaagtccaagaacatgctcttgacccgccgcaggacggcatcgctctcaaatccatcgccagcaaagacaaacgcgggctgcgatgagagggcagaggttgggacactggtatcgttgtgtcacggtttatccccaatgcaggaactgagtcacacagcaagcatgctgaccacatgtagccatcaacctctccttccatctttgggtggccttgctccagaccgccacatcagggatcccctctcagccattgaggcagaggcgggctgtggggctggcagtcccctaccacccaaactcgctgaccttgtttcccagctgggaagagcgtgcgcctgagaaagcctggatgggggcaaaccccttcaccccaaactcgatcatgtcatacattcgaaagtcgtacagccgccccagcaccaggttgttgggccgcttcttggagtgtgtgcccacggcaaagaggctgcagttggccctggagccgtgcgactccagccacacgtcgccccctgcctcaaagggaagcacgtcgttcttgcgtgacatgcgcagggagtccacctgagagagaaagagggggaaaaaggaataggtgcagggatgatttaaaactctgtcaaaggcaaggtgtatgacatcagactgtaatgaagagcaagtgatctcgnnnnnnnnnnggagagaaagaggggggaaaagcaacaggtgcagggatgatgtaaaactctgtcaaaggcaaggtgtatgacgtcagactgtaatgaagagcaagtgatctcgtaccaatgtcaacttcctttgattgacagccctcagccccaatggcaaactctccacgagaagcatgtctcggcacccagactcaattctcctttgctgttcccaacctatgctcctgcagcagcaggataccactcacccctttcagcttgtgaaggtcggtgagcacatccttaatcgtttggttgaccttgtggccactgatgatcatcgacctccgggtgtcctcaatctgcgggatggtaagcggtgagtggaatgccatgcaagacaaccggtgaagacgctcagccacccagagtacctgtcaacgtgaacacaccccttggaagaactaccctcaacgcaccagtttgggggctcggctctccagcaggcgcctgccacgccgagtcttgggctggatgattccagttgccgacattgcgcaggttcctaccgcgcagacggtatcaagtatacggctgcttcacacgcagtatgtttattctacgaggtttcggagatacttcctaattgctgaaagatttcgcacaaagacgctcagaggtcgtctcagcgcagcatgcggtacagggggaagcctaccgccacaggtaatcttcagtacagtagttccaaatgatttagcacatataaaacggcaatctctatgatgctagagctaccctgtctcgtgccggcctttgcagcacaccctgatggtgctcgacgtggcaccctcactggaagggtgttctttcttcccgggttcaagttcgcattgcgacaggctgcacccatgtcctcgtagcagcaagttctcggcaggatcatcccattatcttggctacaaaggtcatgcacatcattatagtgggattaaggcattgccagaggtccggtcggagccagggcacgcccatgaagcgccctnnnnnnnnnngagttctcggcaggatcatcccattattttggcaacaaaggccatgcacagcattatagtcggattaaggcattgccagaggtccggccggagccagggcacgcccatgaagcgccctgcgatttaaaaggcccgctcccatcagcaccggtcgaacctcattcccgctccgctagagcatcaagttgtttcaactgggcggtgaagctacgaaggaggcacgaaccctcatccatccccgtcctgaacctcttaacccgcgccacactcgcgcatcaggccggggtcggtcttcatggcgcagagctatcgggccctggtgaggggccccccgggtgttgctcctcgccatgcagtctctccacgatgccgagcgatccaccccgccccttccccacccccatcgcacccaggtggccacgctcaccgcccatattcgggaggaggtgctcgcgggggctggggcagccctgctgcaggtctgggcctgccgcgacctggaggagggcatcgtgttgtccacacagggcctgccctacttcctgctcggcgacggcgacgagctcgccctgttccggtacatgagcaccaagcactgcttccctctgggggaggcattgggccagggcaccccagcctccgtcttccacaatcggcaggtgaataagcgccccccctaagggagggggggagattgctgcaccagcaaaatgggctcacgccttggccatgggtctgctcccatttacatttgccagtgtcagcaaagttaacctcatcatttacgcaccgcagggctgcgctatcgttgacctggcggccctggacgccgccgactgcccgcgcgccgactgtgccggggcctgcgctgcgcacagtgtcctgctcctgcccctgctggaccgcatgatgggcatgaagagcgagccgctggcaggtgggcgctgtttgggaaggtgttggagccacaggcatgagggctgccactgcttgcaaagtctcaaggatggacttgggtggcatgagaatccgatcctgatggggcatcgaacagccagctgcgaagtccagccccctctttgtcctcgcttcccttgccctcgccattccccctcttgacccccctccctcccctctcctccaaccctgcctcacagtgctagaggtggtcttgtcccgtcgcgaccccggcatgctgtgcacgctgcacgccctgctgcaggcgggcgcgctcagcgccggctatgccttcccaggcctgggcgagggcgcggccggcgcgccgagcccgcgcagcgtcgccggcccccagcagccgccacctgccgcgctgcgcgcgctgctctcccgccccgtgcagggcctgggcgggctgggggggcccgggacgatcgtccccggccacgatgacgacggcatgatggaggaggacgagcccagcgggggctcgggcggggctcgggacgcgcgcggcgcgcccggccacagctccggtcggccgcca

SEQ ID NO: 36763 - DNA, 61 bp, Chlorella protothecoides
tgtggtccaccatcctggatactctcgatgtcgctgggatgccccaggggcctgccttccc

SEQ ID NO: 36764 - DNA, 376 bp, Chlorella protothecoides
  modified_base (95)..(319): a, c, t, g, unknown or other
ggctggaatgctgaaaggatacttcctccaaaacaccacaccccaggtggacccggcggaccttgacctggcgagcctggccttcctggcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtgcctgtgcgggagaggggatgcccctgcttgccgggcatgcctggtggcagg

SEQ ID NO: 36765 - DNA, 114 bp, Chlorella protothecoides
gccaccatgtgtgggccttgggacattcacagtatccagctgcatcgagggcccgaagggtggctgcatggtcccccatcaagtccaggatcaaagccattgctcgttgatctg

SEQ ID NO: 36766 - DNA, 61 bp, Chlorella protothecoides
tggtcctggtagggtctgtgatcaaggctccgcagtgcacagggcaagtgcgtgctgtggc

SEQ ID NO: 36767 - DNA, 14541 bp, Chlorella protothecoides
  modified_base (1346)..(1355): a, c, t, g, unknown or other
  modified_base (2865)..(2874): a, c, t, g, unknown or other
  modified_base (3064)..(3073): a, c, t, g, unknown or other
  modified_base (3261)..(3270): a, c, t, g, unknown or other
  modified_base (3675)..(3684): a, c, t, g, unknown or other
  modified_base (4088)..(4097): a, c, t, g, unknown or other
  modified_base (5088)..(5097): a, c, t, g, unknown or other
  modified_base (5194)..(5203): a, c, t, g, unknown or other
  modified_base (5258)..(5452): a, c, t, g, unknown or other
  modified_base (5923)..(5932): a, c, t, g, unknown or other
  modified_base (6333)..(6342): a, c, t, g, unknown or other
  modified_base (6834)..(6843): a, c, t, g, unknown or other
  modified_base (7369)..(7417): a, c, t, g, unknown or other
  modified_base (7727)..(7736): a, c, t, g, unknown or other
  modified_base (8167)..(8176): a, c, t, g, unknown or other
  modified_base (8367)..(8376): a, c, t, g, unknown or other
  modified_base (8825)..(8834): a, c, t, g, unknown or other
  modified_base (9803)..(9812): a, c, t, g, unknown or other
  modified_base (10272)..(10281): a, c, t, g, unknown or other
  modified_base (10460)..(10469): a, c, t, g, unknown or other
  modified_base (11001)..(11050): a, c, t, g, unknown or other
  modified_base (11291)..(11300): a, c, t, g, unknown or other
  modified_base (11419)..(11558): a, c, t, g, unknown or other
  modified_base (12418)..(12427): a, c, t, g, unknown or other
  modified_base (13213)..(13222): a, c, t, g, unknown or other
cccccccccccccccccccccccccctcatgtcaatacgaattgacttgagctcacgactcaggctgattgaaggatttcctggattgccacgtccaatcttcaatctcgatcatttcgcatgggagataatgttgagagtgagcactggccccatcgagtaggccatgtagtcgggtagaccatgcgccatgggcttgtgtggctgcttcacctcctcccgcagcaggaatgctgaccctgaatcgaaacaaacagccgacgatgaggattacgccggtcagttagcccggctgatgagctgtcagctggagggcgagcccgtcgtgacggtccggcaactctcgaatgcccgcgtgaatgtcagcgctgtggagtcatcggagccccaaaaggagttcatgccgcacacggcccgcctgcgcagcatggacttctcggctcatgcccaaggttctccgtgctggtggggggccgcagtccattccatctgtccattatcaactcatgaccatgtcctccctctccatgtcgccaccccgcagaggttcgtgagcagatggactggactgccagccggtgggacctggacagtgccctcaagtcagagcaggaggcggcgggcaagcgggcggtgtgggagactggcctgctcctggcggaggacacgctgcgggcgcggctgaggaagctcagcctggatctgcacataatggagggggacggcaactgccagtttcgctccgtggctcactcggtctacggtgggtgcaggggagctacgcggaggcacagcagcggggcggcgggggcgtcccttggttctgtgcatggccctgccatgcatcatcgcctgcatgtgagcttgggtactgtaacccagccgccggccacaggcgccctgcagggtgcacacccaacagaacgcctcactgcaggaaggctcgaggtgtgcaggaaggacagcctcaccaggtcccttacttcccatgcctcacattcgccacaggctcccaagagcagcacatgcgggtccgccgggcggcgatcatgcacatgcgacgctgccccgacgagttccgtgctttcctgggctccgattttgacgcctacctggcatcaatgagcgagtctggcgtctggggcgacgaactgaccctggtgcgcggaaaagggggggggaaggagccttgggtggctcgagacatctagtggggggaaacccgagtctgccctgaccttgagggcgccaggaggaggaagcctgcctcattactccggctaagcacatattctctggtgttccatctcatgagagtgctgccgtgtccaggtgggtgtgaaacnnnnnnnnnngttttctggtgttccacctcatgacagtgctgccgtgtccaggtgggtgtgaaactctttgtgccaaacattccgaaccgccaccccgcgtcatgcagagggccatcagcgacgccctctgcatcaccatctcggtggtcatcggcgcaactcagatggtacggtacatcccaaccgactacaggcaggggaagacggtgaggcgcatgtgggtgggcaggacagatgcgtggacaggcaatcgtgcaggactggtttgggtaggggtggctgccccgagctcctgcgctgaggccaggatgcagggccatgtactgacagcaagtaacagttgccactgattgtaaacatccccaacctcctccctgccctgcttgcagcaagaaattttcctgacatacatatcacctgtgcactacaatgccattcagaggatccgatcggcgccccactccggatcagttgaccggctcaggcgcggatctcagattgcgttagcgatggattcgttccagcaccgaaatacatccatgttgcagccctcagctcattgattttgctgggtttcacgcttgacgggtgcgttacatgcgtttttcagcaccattgtttgatagtcgggtccacactccacacagctgggtggaagaaaggacgcctcggtctactcatcaattaagcaatagggtcctttcgcggaatacttcacgccggcaagtaagcgatctcaccacttatataacaccagccaatttttccgactccatacaactggcgttggcatggtagctccgtcactgtgacctggtcataggatgggggacacgaactccgacagtcccactgcctccccggaggctgccttcgaagcacctcccacagcaaccgtgtcgctgagagaagatcagctgcagaatgctgtttccttcctctcccaccccaaggtagggccttcacttgcgtggacttggcccttgcccgacctgggaccgctccttggaggactgtaccttgcacaggtccggacctcactccgtcccatcggcctttccaggtccggtcgtcggctgtggagcagaagcggcagttcctgcagcgcaagggcctgaccgacgcggagattgaggaggcattcaggcgggtcccggaagcccctgctgcggcctatgtacctgccccatctccacactccgtggtggccgtgccagcggggaccgtggcgccggctgggtacgtccccgtgcagcagcagcagcagcagctggtgtctgcacagccccaacctgtgcgatggggacaggtgagcatgaggagacggtcttggtaggggacatgggaggaatcatcatgctcgaagaactgctctaggcccctgttgtttcactgggccgctgttgtttggaggggatgcccacctcatacattgtcgttgcccaaaacatccaccacccccaactccgacaggccatgctgggcgcggcctttgtcgccgcgggcgtctacgccctcnnnnnnnnnnctggtaagggacacgggaggaagcatcatgctcaaagatctgctctaggcccctattgtttcattgggccgctgttgtttggagaggatgcccatctcatacattgtcgttgcccaagacatccaccaaccccaactccgacaggccatgctgggcgcagcctttgtcgccgcgggcgtctacgccctcnnnnnnnnnnctttgctgttccaacaatccgtatcccagcctgctcagctcatgggccaccctgccctgcccgctccctgcaggcccagacgtccgagctgcggaatacggtggagctgctgcagaagctgaccgtgagcctggagtcgagcgttgcagagtccaaacgcgccgcccaggattcgctcagcttggccnnnnnnnnnnttttgctgttccaacaatccgcatcccagcctgctcagctcatggggcacccctgccctgccctctccctgcaggcccagacctccgagctgcggaacacggtggagctgctgcagaagttgaccgtgagcctggaggcgagcgttgcagagtccaagcgcgccgcccaggattcgctcagcttggccgacctgagggctgaactgcgcactctggccggcaccatccgagagtgagcgcggtggttttcccagggtgggtcggggggtgtcgtgagggtttgcctcccgatgcaccggcgccattcacccgcaagtgcccccgtgcgatgccgctgcagcgtgccgagtccctccactcctcccaccctctccactgcaggcagcggcccgcggcagcgccgcnnnnnnnnnntgcctcccgatgcaccggcgccattcccccgcaagtgcccccgttcgaaaccgctgcagcgtgccgagtccccccaatcctcccaccctctctactgcaggcagcggcccgcggcagcgccgccggcgcccagcgtggacgtcggccgggagctggcatccatcaagcagctgctggccaatggggtcggtacgtgagagaggatccgctgcatggcctggtgcctggcagtgtatgccgatcgcctcgcctgcgcagtatcttgaggtgttgcggtgtcctgtaatcgctctgcactccacccatctcggcaaactgggcgtcggggctctcggacaggggcctcagacagtggccggggtttctgcgcaatttgctgaggtgcgccatccaccccccacacnnnnnnnnnngatctcggcaaactgggcgtcgggctctcggacaggggcctcagacaggggccggggtttctgcgcaacttgctgaggtgcgccatccaccccccacacccgcagagggtagcgggccgggcgccgcgcacatgcctggcgctgaggcggccgcggacgcggctggcgtcgccgccgtgaagccgaccccgcaccccgcctccgcggccgaggaggctctggcgacgcccttccgccccgccgacgagtcgccgacgcctgctgccccggccctctcagggcctgcccaccccgcctcctacatggaggtcctggagatgttggaaaagggtcagaagccgccgggcatcagggtgagaggattttgtgtgtgggagggggggagacaggtgcacgtgagtgcaggtggtggcacaaggagagaagggataggggggtccactgtgtggactactgctgcaacagccctcactgccgcattgcagctggtccaaccccgcccctcccaccacctgggcccctgctctccacagacggacatcaacgacaaggcgcccaacccgacccagagcgtgcccagcccccgcctggcaccgcggcgcaagccgtgggagaggagcgtggaggggccctcccccgcctccagcgcggtgagcgagccgcggcagggggttggcgaggcgtgggccccgaggcgcgaggcggccgctcaggacggcgagacggccgacacgccgccgccccgcggcccaccgtccacctccagcagcaccggccgccccagctccgagcagtcgcccggccggagcagggctgccgccacctccatctacgaggccggtgaggatcagggggcaatcgtgcatggaggtcggtcatcgcctgggcgccaggggggggtgggcatggtgtctggcgggcgcaacatgtgcgcgactcagagccccctccctttatggactcttcacaaccttcccgctcccctcctctnnnnnnnnnngagctcaccaatgggccgattcctgagtagcgtcaccctcttgaacctattaatcgggattggcttacaatgtctaccgctgttgacagccttgacnnnnnnnnnnccggcgaggcgcgggccccgaggggcgaggcggccgctcaggacggcgagacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgagagccccctccctttgtggcctcttcacaaccttcccgctcccctcctctgtttcaacagcgtccctgccctcctcgcaccaaggcggcgtcatcgccgggcggctggggagcggcagcaccgcctctccctccgcgcgcagcgtggagcccaaggcaccgtcgtacgcggctgttgttcgagacagcccggacacctccgacattcgaggctggcaaccacctcccatgcctcagcccagcatcagcttgtgagccagctcaccaatgggccgattcctgagcagcgtcaccctctcgaacctattaatctggattggctcacaatgtctaccgctgttgacagccttgacgttggtatacgtggcatcaaggcacaacaggattcacagagccaatggatacggcgccctgggtgacgaatttcattaatgacgacgacagaaccgatccagggaatgcgcgcnnnnnnnnnnagaatacgccctgggtgatgaattccattaatgacgacagaaccgatccagggaatgcgcgcgcgcaaatctgtcgcttccccaccgataataaatagagatagacaagctatcagacagtcccgaagtctaaacctctacttgggtcttattgaaaccagtttcgacgtcgctcaaggagaaggagcgcaccaagcttccgaaagaggctcaatacaatgcccctcacattttcacttgtggcgagcgggcgcatttgcccgaccagcacatcgtacggacccagcagcacttctcttcaggcacatggtgccttcttcggtccctcgagagtagcccctaagcagaggaaggcccggcgctccatcttggcttcgcgtcaaccccggcgaggtgcgcgnnnnnnnnnnaagagtagcccctaggcagaggaaggcccggcgctccacctcggcttcgcgtcaaccccggcgaggtgcgcgtcatccaacggcacatgcgccggccgaatcacctccgtgcgtaccctccgtgctcaaactcacgcgtaattctcctgtgcccgagcagtgcgattaaatgcggtggcagcagcgtctgaccaggccctggagttgacagaggccaatgtggagaaggtcctggacgagatccggccatacctcatggctgatggcggcaacgtggagttcgtagagatcgatggacccgtggtctacctcaggtcaggaagcacatgtgcctcccactggagggccaggggccctgtgtcatagccgccctgcattgccttgcagcagtgaagtactaccgcatctcaggagctccccgcacttgaccttgcctcccgtcgtgtcttcaccttcccactcatgcctcgccccaggttgcaaggcgcctgnnnnnnnnnnctagccgccctgcgttgccttgcagcagtgatgtactaccgcatctcaggtgctccccgcacttgaccttgcttcccgtcgtgtcttcaccttcccacccatgcctcgccccaggttgcaaggcgcctgcgggtcctgcccttcctcgctgaccaccatgaccatggggatcaagcggcgcctcatggagtctatcccggtacggcatgagaccgacctcacaggctgctgctctcggatgtgtggggagatgggctccgcacaactttgctgtcctgcaggctcaattgtgtccagcattctttcctggcctcctgatattcaggagatctcagatgtggagcagatggagcccgaggacatgggtggtctggacctcacgccagagaatgtggacaccgtgctggatgagatcaggtgggatgcttggatgcagtcctggcattggcatgcatctccttgttccttcctgtacccagaagtgaggacaatgcgcttgagtgggtgcagccttgtatcccccccnnnnnnnnnnnnnnnnnnnnnnnnnnnnnnnnnnnnnnnnnnnnnnnnnacctcatcggcacggggggcgggggcctggacctggtggagatcgacggcccaattgccaaagtaaggatcacgggcccggcggcctcggtcatgacggtccgagtggcagtcacccagaagctgcgggagcgcatccccggcatcgcggcggtgcagctcgtcaactgagggagggggccacgaggggccccaggccctgcccggctctgcggctctcccagcgcgcatgtgcacttgtgtgtgccccagcgggccatgatcttcccatgatggtccacccctgacctcatcctggctgctccccagcnnnnnnnnnnacgagggaccccaggccctgccccgctcagcggctctccctgcgtgcatgtgcacttgtgtgtgcaccagcgggacatgatctttccatgatggtccccccctgacctcatcctggctgctccccagcatgcgatgcccctctctgtgtctgacaatccctgccgtggaccctgacatgctcgctattacaaagggaagtgcacgcagcgatttgaggtgtggtataggagggatggcatgcatgcctggggcctgcagaaaaagaacagcagtgtatcatgaggaccagagtatcacatggcagctcctgcacacagtaacaagaaaatgctggtggtggtggggggggggtaagtgctgcccaacctggtgtactatcgtcatggcgggtctttcttgctcgtgccgtcgcccacatgggcgcgaccgnnnnnnnnnngcctggtgtactatcatcatggcgggtccttcttcctcgtgccgtcgcccacatgggcgcgaccgacgtcagtagggtgcaacagccaggggaccgggcatgcgccctgggcacttggctctgagatcagatcgaggctcacgcgccctggtcctccgcatcccccaggcgctcgcccgcccagcgcttgnnnnnnnnnncagggtgcaacagccagggggccgggcacgcgccctgggcacttggctctgagatcggatcaaggctcacgcgccctggtcctccgcctcccccaggcgctcgcccgcccagcgcttgagggccgtgtgcacaaaggcgtactgggccagagtctgcacgcaccccgcacgctgggcacgacacgcggccaccaggccgcgcaggtcggccaggtcctccgcgctggcggggcgcgcgccgctcagcgcggcctccgcccggcgcacggccaccagcagcaccgcaaacacgccagaccgcccgatgccggctgaggattttgggggggtgggcggggagaggacggtgaggagccctagggaggggaaaccacggccaaccacccgctccggcatgggtaaccagccgcataggcagcgccgcgctcacccgacccctcctccacagnnnnnnnnnngtttggggggtggggcggggagaggacggtgaggagccctggggaggggagaccacggccagccacccgctccgacatgggtcaccagccgcacaggcaacgccgcgctcacccgacccctcctccacagaaccaacccccctcggaaccccccccccaccagagcagtgggcgaggatgggggtctgcacaggagccagctcgcccaccagccgcagcagcgcctccggcgacgccggcacgccgtggtcgggccaggcagcgtagtgccagtgccagacggggcggggcggggggccgcccccgccgcgcaggctgaggcgccgcagccagagcttggcgtgcgcctcgctgacgccctcggtcttcaccgccatgccgccgaagcggcgcttccaccccgcctcctccgccaggtaggtggaggacttgattacgccgttctccactgcacgagggtggtgaccggttgaacgttcatgtgagcttgcatgctggttggaggatggaagcacatgaccgtgtcaatgaggctggcaaggagtagcagtgtcaggcacggcgcccaagacttgggggcggagagagaggtgggagcggggcaggaggtgccacggtacaggcacgggaccaccacatgtttagcccacaactccgccgcacctgggttggtcagcgagacgacgtgggtgtgctggcactcgaacaccatctgccagaaatgctcgcgggtactccgcagcggcgcctgggggtaggaggaggatagcactctcagcgggacagaggggtggcccagaggggcgagacgggcgggcccaataccaatcctccgtgagaccattcatacccccaatgttacatggaaggcaggcctggtcgccatcggggtcctgttcccctgcacgctcctggatcaatcaggtcccattccccggatcaggccccggtgctgaacggcctcgtcannnnnnnnnnacaggcctggtcgccatctgggtcctgttcccctgcacgctcctgaatcaatcagatcccattccccgaatcaggccccggtgctgaacggcctcgtcaggtaaaccccgcacctgggccagggtgaggtgccaggggacgtcccccggcgccccctccagcggcgaggcattgatgtacagcgggtccgagacggtccccgcgtcgccagggctgggctcccgccgcaggcggatgcggtggtcgtcaaagggcaggacgtcggagtagcgattgcgctccatgcagccggtagccgccgagaagccgcccgcagcagcggccgccgcgacggcggccgcgtcctcctgcccaagcgccaggaactcggcttccagcagcttggggctcagctttgcggcaaggcgtgccaccagcgcctgtggcattgcagggtcgcaagcgtgagtgccttgggtgnnnnnnnnnncgcggcaaggcgtgccaccagggcctgtggcgtcgcagggtcgcaagcgtgagtgccttgggtgcgctcggggtggggcggggcgacatgcatcgcatggcttcagtactctgagcgacccctgccccgagttgacagaccaccagcgagcgctgccccgctccagacccagagggccnnnnnnnnnnctggcttcagtactctaagcaactcgtgccccgaggtgacagaccatcagcaagcgctgccccgctccagacccagagggccggcccttcacctgcaggagggccctcccctccgcatcgagggcctgcctggtcacgggggaccgagacatggggcccctcaagacaggaccagcgcggacagtgcgtgggatcagcgtggcgccgcagccccgtgccgcggcctcgctgtggtttgcgcgctgccgccggtgcgctcagtgcaggacggagggcgggttggtggtgagcagcatgcgcttgacgacgtccaggctgaagacggagcccccctcgcccgagatggtaatgtcaaagggaaaggtgacggcggcgctggagactacgggagggatggcgtcgcgtcggtcgttcacggtgcgcaggatggagtggatgcactcctcgagagaggcctgcagctggcgctgctggacagagtctgtgtggaatgggtcaaggggaggagtgaggcggtgggtcgagaaagggnnnnnnnnnnnnnnnnnnnnnnnnnnnnnnnnnnnnnnnnnnnnnnnnnnatgcaccttgctcagaaagggaggcagactccttggtgctgaggttgatgtacctgtgtgggtgcgggcaccgcgcataggaacaatcagcagtcggtagggtcgtgtctttcaccccaatacccccatggtgagcacttcacgactgcgcgacaaaacattcactcagcaggtcagggacccaaagcccctaggctgagcaggagagctaccggcagcgcatgctgaggtccaccatcannnnnnnnnnctgggggtctgtatgcgtgatgggcagacatgctggggactggcaatctgagtatgcttgaggggtgagcagggccagtgtccaaatcccgcagaccctttgcataaaggatagccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtcgtgtctttcaccccattgcccccatggtgagcacttcataactgcgcgacaaaacattcactcagcaggccagggacccaaagcccctaggccgagtaggagagccaccggcagcgcatgctgaggtccaccatcacacgtctcccgcacagggcgcctgccactgcctctcaccactgctcccagtacaggcgctgttcctgggacccaaaccaagccgccttctgacgcttctcgtagaaggacaagcaaacctgggaaggaaagatgcacgaagaggctgaagcagggtgatggcgtgcaaagggtgaggacgcgggacgatgcaggctgcatggtgattcgcaaggcggccatggggtggtcacccaccctgcccatgccattcccacctggccgcgcttgctggggttcttctcgacccaggccgtgaattgggctatcttgtcctcgatcctgcgctcgacgctcggatccccacactggacctgcggatggcggggtgatcctgttgggtgggcctacggcttgaatgggcggaggaccagcaggggcccccgttgtacaacttacccaggtgagatcaaagagctgggagtctacctcctggggcctcacgagtccgagtgccctgtggaagatgatggtgtgcaacagggcgcgcaggacctccggaatctgatgtgcaaacacgtcgagagtgccacgggccgggagctggacgacttcgcagctgctcatggcgcaacgcagaggatgatcagatgcctcatagcattaatcgatgtgctgattcttgggctggagtgtcgaccgagctggcgggccgggttcaacgcgacagatttgacggnnnnnnnnnngtgatctgatgcctcatagcattaatctatgtgctgattcttgggctgggatgtcgaccgagcttgtgggccgggttcaacgcgacagatttgacggagtggcccaggcccagggtgattgggagagccggaaggaaagtgggaaaccgactttaggttgtgtgggtgaagactaccaatccagggccttcccccgacatcttcccccaccattgcaactgtcttgttacatcgtttcgtgccccgcgggtgactcggtctgcgccgggaggacttttgggaccctcggcggttgaggtccgtcagccccatccctcagcgtaaacgcctatggagtcgcagcaccagacccaatctccgtcctcggtcccggacaccaagctctgcagcaacaattgcggctttttcgggtaagattgggagcgcgcggtcggtgcgctcgatgtgcgcgtcagtctcggagcttcctgaaggggtaagcttcggacctccatgtctcgtcctgaatctcacctccccgccctggaccgccatcaaataggaatgcggccacagagggcatgtgcagcaagtgctggcgggacaccgaggtccagcggcagaagctgacccggcctcccgggctggtcaccccgggccccctccccatcgagccagcggcggtgccattgcccacagcgccctcctcccgcgcggaggagcaggctgcagtccaagccccccctcgggccccagtgccagccgcccagccatccgttccagccatcgaggctgcagcagatgccnnnnnnnnnntgagccagcggcggtgccattgcctacagcgccctcctcccgcgcgaaggagcaggctgcagtccaagctccccctcgggccccagtgctagccgcccagccctctgttccagccatcgaggctgcagcagatgcccctgcccgccccgtgcaggcccagcgcaatcgctgcttcggctgcaacaagaaagtgggcctgctggggttcgagtgccggtgcggcttcgtgttctgctcctcgcaccgccatgccgcggaccatgcctgcacctttgactatgtgggcatggacagggcccgcctggcagcccagaaccccctggtcgcagcctccaagcttgacaaactctgagtaatcaggcctgcttctcgtaaactctcgcatacctgtacactcagcccccagggcgctccttggcgcccccttgctccccttctgctgtcccgcccctccccctctgtacaaccatcccagcagggcctttgcttgcactttattgcctgatccagtatcatgaatgtttgtgtcatcagtcgtactcagtacaagcgctgggaaatgggttactatagggcacagccgccacggtggctgtgttgtggcctggcagcaaaagtggtggggaaagggggggcgcccagcccttcccgttacgacgcagcagcgcatccttctgaacagcagcatgcttgcacggccatgcccgcctcgcgtctcaagacaccaggctgcagtatttgcctgggatgttgcgaccggggccgggtcacgcatctgcatggcgacgcacttcgcccgcaaagactgctgccgagttcctggtgtttccctgagacccaggtgcccggctgctggccaccacctgaggaggcccgcccaggccacgctccagcctcaggagacgacagcgacgagggcggtgatgtcgtcggccttccccccgcggtagatcatgtcaaaggcctcggtggcaccgcggctgtagggcgtgtcgcgcgcccggtcctgcgaagcctcgaaggcggcgtaggccagccgtcgcgccacggcgctgaccgttccccccgcgtccagctcatggttgaccagcgccacgatggcctcgtcatccaggttgtcgaacaggccatcggagccgaggacgagggagcagccggggcccacgggcagcgaggtcagcatcgcgtcctcgggcgagtcggcgctgggctgcgcgcccagctggaaggggtagccaaaggaatgctcctgctggggcgagcgcgcgcgcagcgcgcgtgggcggcgccgcgcgccggggcccccgccgccgccgccg

SEQ ID NO: 36768 - DNA, 61 bp, Chlorella protothecoides
aaagcaatatcacgcaatgaggcggctcattccgagacacacgctaccctatccaggttct

SEQ ID NO: 36769 - DNA, 127 bp, Chlorella protothecoides
gcgcgcggccacggcgtccagccgcgccagccccaggccgcggccagacagcgcggcgtagggatcgcgacgcagcgcggcctcgaccccggagcccagctcctcggccagggcctgcgcgaccagc

SEQ ID NO: 36770 - DNA, 70 bp, Chlorella protothecoides
gcctcaccctcctgggaagcagacgaatggacgattgattgatgtacaacattgtggggcgctcagtgtg

SEQ ID NO: 36771 - DNA, 128 bp, Chlorella protothecoides
gccttgcgcatgctggctgttccttttcatttgcaaatgggcacattgctacacttgaggtccttctctgcgtgagccaatcctctcagcctccatgtcacccgctcacccccactccacggtgagat

SEQ ID NO: 36772 - DNA, 7771 bp, Chlorella protothecoides
  modified_base (801)..(976): a, c, t, g, unknown or other
  modified_base (1197)..(1206): a, c, t, g, unknown or other
  modified_base (1511)..(1574): a, c, t, g, unknown or other
  modified_base (1692)..(1701): a, c, t, g, unknown or other
  modified_base (2975)..(3046): a, c, t, g, unknown or other
  modified_base (3419)..(3428): a, c, t, g, unknown or other
  modified_base (3609)..(3618): a, c, t, g, unknown or other
  modified_base (3717)..(3726): a, c, t, g, unknown or other
  modified_base (4133)..(4142): a, c, t, g, unknown or other
  modified_base (4429)..(4438): a, c, t, g, unknown or other
  modified_base (4761)..(4770): a, c, t, g, unknown or other
  modified_base (4841)..(4936): a, c, t, g, unknown or other
  modified_base (5431)..(5440): a, c, t, g, unknown or other
  modified_base (7240)..(7311): a, c, t, g, unknown or other
catgcagtggcggcgacagggcgccgagagtatgctcatattctcggcctcccagcccttccccccaaagtctctctttctcgcctcccacctcaatcacgtggctggccaccttgtcctgcatcatctgctgcagctggtctggggtcacgttgagcatcgtgccgcccagcagacagctgactagctgcgtggtggcttccctgcggaggcaggcgggcggggggagggtggcccgttgacaaggaatggtttgtcgcttgaggcgcggggcttgcatttgctttaaagacaacgagtggagcggtcgtctctgtgactgtccttgtcttgctgcaagacggtgcaccggtcccaacgcctgttccccggtccctacaacctccacacatggcgccaacacggggagggtaaatatgtacccccgagcacccacgcccaaacccataccccaagcagacgcactcgttgtccttgcaggcccagagcagggactggagaaaaggtgcggcaaaagtgttgcggcacagggcggccgcctccacggcaaagtcgtcggtgagcagggaggccagcaggccctgcagcgcctctgggtgatcgacctcccccgccgaggccgcggccgaggtgtcgctccccctctccagcttgctcgccaggcccccgaccgtcttgcgccgcttgggcgccgcctcctcacccttctcctcctcgacctctggcgccgccgcgtcggacccacccccggctactgacggacctggcgatgccttggctgaggggccggaggtcacgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagggttggtgttctaaaagccacttcctagagtgacgtcgtccaactggtgctggatctgaatcagcaaggcccctttgtgccattgccttcagggatcaggctccttgcacatgcacccctcagtatccagcccaccctcggcctcgagcgctcacctgctcgatctgttctggggcttccccggcgcgagcccggctctgtagcaggatcaggatnnnnnnnnnntgacccccccccggctactgagggacctggcgctgccttggctgaggggccggaggtcacgtcccgccccacgagcacgctgaggaggcggcgggaaaggaaggagccgtgccgcgtcgtgatgaccgcctgcaggtcgccgcacactgactccgtcgtgctgtacagggcctggaaacggaaaggaaggtacaggaagtggtgctggggagtgttgccggcagggttgtgtttttaaagccagttcccagagtgacgtcgtccaactgatgccggatctgaatcagcaaggcccctttgtgccnnnnnnnnnnnnnnnnnnnnnnnnnnnnnnnnnnnnnnnnnnnnnnnnnnnnnnnnnnnnnnnntttctcggccacgtgggaggggaagggtgccctgccgcaagacatggtcagatggatctttcagcacgcagagcactgaaagcagtgagatggcggaccatgaaccccaattggtccnnnnnnnnnncttctcggccacatgggaggggaagggtgccctgccgcaagacgtggtcagatggatctttcagcacgcaaagcactgaaagcagtaagatggcggaccatgaaccccaattggcccaggaccacatccccagcacctccgactgcccatcctcgttgcatgcaagtcacacggcggacccacccgtcgcattctcaagccccccacatcaacccaaacgcacccagtgcagacggcaacgaggttctctccggatgtaagggccgtcagcatgtcgatgagggcctgggtgctggcgtggggcatgagcttctcaagcactctgctcaccacgccatctcccgtcgcctctatcatctgagtgccggcctgctcgaaggcgttgtcagccagcagcctctgctcctccccatcctccagttgggagagctgcttgtcgatctcctcgtagtactggacctcatccttgggcagtcggccggagaaaccggcctctccctcccggccatccctggccctggactctccctgagaccgcgatggaggccccattctacgtccaggagttcttacatatactgtaaggttctaaatgcgcttgcgtattaggcttctgtccgctcgaccatccctattgcacatgcatgtcccagtcccgcgcctgcgcctcggtgagccgacctgccatcagtgtcccgacgtcaaggcacccagtattgtgcactgaaaggtttcccagacgcaacaatatcacattcaagaatagaaatatatcaaagagaagcaaagctggccagaatggtgctatcagactgcagtagtgagtgcgctgaaccgatcacgtggcttgacccacactccagagattggcgtccttcacgaggcccagctgcgaagggaaggggactttccgacgaccacccatctgaatcaccaatgtgaatttcgtcatgttgcgtcggaaagcgcgtggaccagaaacaatcgacttgacgcaagaatctccgacaggtgcgcctgctgttcaggccagcgcgagcgctgacaccgttctaccgtccgccgaggagttggccgacagtaccaagccacgcatacgacgaagtcgacgggtgaagaaggagaaggagagcttcgaggagccggatggccctagcagcggcttctgcgatgtttcgacggtggtgacggaacccgcttccacctcagccgcaagcacatccaaggagatcaaaccagccaagcgtcagaggaagaatgacgcgaagaaggannnnnnnnnnnnnnnnnnnnnnnnnnnnnnnnnnnnnnnnnnnnnnnnnnnnnnnnnnnnnnnnnnnnnnnnacggttcgtttctgtgcatcacccagcatcaaggtcaaggagcggatggccagggccagcgagtcctcgggccaccgccttttcctcatcgagcgcaagcgggtggatgctggcgggagtggtgttccagagatggggccttcctcccgcgctgatccggccgtgaaagcagaggagcaggatgaagggaaagcttcccttgccgaggagtttgctgtgctgggcgccacgggaaatggtgggtcctcgtcctgcgctgcatgtagttggggggctgggtggggtcgaagacagatgttctgtacctaatgctaagagtctgctgccttgggtctagtgctgtgcctgcacccttaccggaggttatgatccnnnnnnnnnnggcatgtacttgggggcctgggtgggtttgacgacagatgttctgtacctattgctaagagtctgctgccttgggtcaaatgctatgcctgcacccttaccggaggttatgatcctccacaggaactcaccgacagactcccattccacagtgtactctgtgaccatctgccggcagcctnnnnnnnnnnatggtgttccagaggtggggccttcctcacgcgctgatccggccgcggaggagcaggatgaagggaatgcttcccttgccgaggagtttgctgtgctgnnnnnnnnnnatctatgcaagcacatcctgtttgtgatgttgagagttctgggtctcaagagttctgatccccttgtgtggcagcgagccctgctcacagatgaggtgaggcttgcgacgctgaaggggaggcgagtgagggatttcaggctggcggaaagtgaggaaattctttgttgtcacagccattacgagtgtcctgacaggtagtatggatttacttctggagtgaagctctcagtccttgatgctttgaacacttttgcacataccattgttgtctaatgggagtaaccatcggctctatgtttgttaccaccctgtaggtcaaggccgtcctcagctccgcaccctgctgtaccgctgcaccaatggcgaatgcggctgtacaggcctccttccgtgccatgtcgggannnnnnnnnngaaggccgtcctcagctccgcacccagctgtaccgctgcaccgatggcgaatgcggcagtacaggcctccttccgtgccatgtcgggaagccagggcccagctgaggtcagccaagagagtggactggccccaggccagaggccagtggagggagactgccccatctgcatggaagcaatggccttgggtgctggaggcgcggctgatcaggtaactaagtgagacagtagttggggtcatcactatcttctgatgggtcgtggagatgtcaaagacctggacagcnnnnnnnnnncgagccacggctgatcaggtgatttaagtgagacagtggttggggtcatcactaccttctgatggtcgtggagatgtcaaagacctggacagccttcggaaatgttagaagcaggaccaagagaaggtatgtgctcgaaacatgtaacatctcacatatatcttcctcaatctcaccgccccatgcacctgcatcccccgcagctgacattctgtggagtgtgtggcaacaatgtgcaccgtgggtgcatcaaactttggcagaagcatcggcgacaagccggcagcggcgtctcttgcccgtattgtcgcgggaggtgggtnnnnnnnnnnaaaacatgcgacatctcacatatatcttcctcaatctcatcgccccatgcacctgcatcccccgcagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcgacaagccggcagcggcgcctcttgcccgtattgtcgcgggaggtgggtggacggcctcttcccagctacatctcaggcagacaagggcaagggaaagtatgtcaacttgacggacctgagttcgggccatcaaggagttgacacctcctatgaagcgctgtatggcgatcgggcggtctgggtgtatgcaaatcagggactggggagcaggcgggaggcggcgcggatgtggaggagtctcgggcactgagtggatctgctcacacggtgtcacctgtggttcaaggccagtcctgctttgtcagcaccatgccattgatgcattggtgtcctggctgttgccatgcttccttgatgctaggtggtttctctgagtcgacactggctgagagtggggagcactaggataccccattcccggggaggtggtgtggaggaattgcttcgaggacgtccatctaagaaggaaatcacgccgagcattgccgnnnnnnnnnncaggatgccccattcccgggaggtggtgtggaggaacagcttcgaggacatccacctaagaaggaaatcacgccgagcattgccggcatctccccaagggccggtgatccctgcgcgtgatcgatcgctcatcagctcgcatggcagggtatgctttgccagacgatcagccgccctgcaactaataagatcgtgtacgggtcgtcgactgggggcagcgcgctgtacctaccagcacgtgccggaagtgagggcgcggctgctgcacctgggggcccaggcagcccactgctgggtgctctcacccaccctgtacatacgacctctcacgcatgcctccaagcatcccctgatctggtggtgacccggcgcgtctgatcccacggggaggtcccgcccgcgcgcactgtcggacgcgatggccagggttccgatagccgtgcttgcggcctgcatgctcttcacaggtgggccatggtctcggtggcgcctgtgaacacgcatggcgatgcatgtggatgtacacccactggccctgcatttgatgtcggcatgctcggcccatgtcgtggtgtgtgggtaggggagggggaggcggtccccatccgcatgcatcccatccgtcgcgctcccctttcttcaccaccccaaccctgtcctcctccccccctccccatcaaaccaggctccctgttcaccatcgtgctgaagctgcaagacacggaggtggtgggccaccgccccgacggcacccccatcaccttccgccaccccgcgctgcagaccgcctgcatgtttgccggcgaggccctgtgcctcatccctcacttcatctggcgctggtcgcgccgcggggtgcgcacccccacggatcgcgcggcctccgacgcccgccaccgcgccgcggcctgggcctttggcctccccgccctctgcgacgcgggcggcaccaccatgctcaacctgggcctgtactacacctccgcctccgcctgccagatgctgcgtggcacgctggtcgtcttcgccggcctgctcaccatcaccgtgctcaagcgcaagctctacgcccaccactgggcgggcatcacgctcatctgcgcgggggcggcgctggtgggcgcctcctccatcctgtacgccgacggccgggcgccggcgcggcaggggtcgccgggcctggccgcgcgggccggcgggaagctcctcgccctgctcgaggtcggtggagggttgggattcgttctggtggggcaagggtcatgccgagtcgccggcagtcctgaccgccgtgaagggcctggtgctcgtgacgccccacaacaggacgcccccacctgccgccgcgacccacactccccgactccccctcgaccccgctcgccccatcgcgcgcaggcggtgggcgtgggccaccacaacacgtcggcgcccaatcctctgctgggcaacctgctggtcatcctggcccagctgctggcggcctgccagttcatcggtgaggagaagctgctgacccagcaccgcgccccggtcctgctggcggtgggggtggagggcgcctggggcctggccatcgccgcgctggccctgccgctgctgtcggtcgtgcgcgggcgcggcggcgagccgctggacagcctgcccgacgcgctgcgcgcgctgcgtgccagcccgcgcctgcagtggaccacggcggctgcggtggccagcatcggcgccttcaacttcttcggcgtcagcgtgaccaagaacctgtcgggcgggtcgcgcgccgccatcgacgcctgccgcaccctnnnnnnnnnnnnnnnnnnnnnnnnnnnnnnnnnnnnnnnnnnnnnnnnnnnnnnnnnnnnnnnnnnnnnnnntggctcttctccctctgggcggggtgggagagggcgcacgtgcttcaggtgagtcagtgggcggatggggggttggggatgggaatggggtgggggtggggggtgtcgatctcaagtccatgatggcaagtgcgtgggagggaagggcaatgcctcttcctgtgcgcgatgcaggacgctgtcgagtgctggagagcacccaccctcccgcacctgcttcgcctgtgggctcgcacctggccacacactcattgttcccacacaaacctcctccccttcccgcatccccgccacagctggtgggcttcgtggtgctcatctccggcacctcggtgtataacgagatcctgcgctcgtgcctgccgggcacgggcgaggaggagccgggccccgcccagggacggcggacccggggtcaaaacggcagcgaggcgagcggcgacctggaggacccgctgct

SEQ ID NO: 36773 - DNA, 61 bp, Chlorella protothecoides
ggttcgcgaagctgacggacagcactgcgcaggcgcagtggcgtggccaatttccctttac

SEQ ID NO: 36774 - DNA, 116 bp, Chlorella protothecoides
tccaccacgcagaagaaggcgtctgggaagggaggggtggggggagggggatggatttaggcatgaacaggcatgcttcagggtgaggtgcagggcatagagacacatcccagtag

SEQ ID NO: 36775 - DNA, 61 bp, Chlorella protothecoides
ggacgacgcctacctgctggccacgctgcggcccacggccgcgcacgacgacttcgtggcg

SEQ ID NO: 36776 - DNA, 72 bp, Chlorella protothecoides
gaaagttcatcacggaaaagggggccgcactgaattatggccagctgcgtggcctggtggccaaatttcaga

SEQ ID NO: 36777 - DNA, 70 bp, Chlorella protothecoides
gtgtgcccttgtggtcatcgctgatgcagcatgcggtgtgcatggaccctccctcggtccctgctgcacg

SEQ ID NO: 36778 - DNA, 61 bp, Chlorella protothecoides
atctgcgatgggagttgcccggtagtcagcgcctcctcgagcctctgcacctccttcaagg

SEQ ID NO: 36779 - DNA, 61 bp, Chlorella protothecoides
caaagggtcaatctggatgcgtgagatttgtttgtaatactagaacattgtataccgtgcg

SEQ ID NO: 36780 - DNA, 131 bp, Chlorella protothecoides
ggtcacgagagcgtttgccacgcattgcaagtgccacccggagcactttaggtggccgattagtgccattcgagacactccctcttcctttgcatcacctttacaggacaaggttaaggaagttgagacgc

SEQ ID NO: 36781 - DNA, 61 bp, Chlorella protothecoides
gtaacgattgcctggcaaagctgtctcactgtccactcttccctagcccttgaataacctg

SEQ ID NO: 36782 - DNA, 61 bp, Chlorella protothecoides
tgcgggggaggtgcgaggtggtggggggggtggcaccttgttttagacctcttacccaagc

SEQ ID NO: 36783 - DNA, 61 bp, Chlorella protothecoides
ggcatgcactcccaccatccgaccccacactagaaccgctgcgcaccagtgtaccggattc

SEQ ID NO: 36784 - DNA, 157 bp, Chlorella protothecoides
tggggtgtctagattcggcaggctgtcgacaggacatgcgccctgaatcaagatccacgacctccacacacacacacacacgcaactcataactctcatctgccacccactccgcccccgccacgcctaccagacgcaccacgcggcgcgcgaggtg

SEQ ID NO: 36785 - DNA, 61 bp, Chlorella protothecoides
gagacgagagccaaccatcagtcgtccctgaccagccatggcagtagccagcctccagttc

SEQ ID NO: 36786 - DNA, 61 bp, Chlorella protothecoides
tgccagctccacataatgtgagattctggcaccagtgtatacaagccgccgtgagtagcct

SEQ ID NO: 36787 - DNA, 129 bp, Chlorella protothecoides
gagggggggattgaggagggaggggccgcatggggatctcacggggctgagcaaggttgccagggtggagggggcggggtcgaccccgcgcctcacaaaccacacccgcgcaccttggtgaagccgtac

SEQ ID NO: 36788 - DNA, 109 bp, Chlorella protothecoides
cccccatcctggatacagaatccccacctcaccgcagcgcagcactcggtcaacaacagccgtccccgggccctcgcttgaaagaacgacacctccccccacacgcgct

SEQ ID NO: 36789 - DNA, 143 bp, Chlorella protothecoides
atccaccgagcgggggctgaggcctcgcactgtggccacacgcacagagtcggccggcgcctggcgaggctgagattgacatggccgacctgccctcccataaagctcgggacgcgaccggcatcagttttgttgcaccagca

SEQ ID NO: 36790 - DNA, 97 bp, Chlorella protothecoides
ggaggccgcggaacgctccgaggccgggcgcggcgccctgaagggcgggctgcgcggccgggtggcggccgccagctcccgctccagccgcgccgtc

SEQ ID NO: 36791 - DNA, 61 bp, Chlorella protothecoides
ggaagcatgttgatccactcagcaatgaagtatactccatcccgccttaccccgtcacggg

SEQ ID NO: 36792 - DNA, 64 bp, Chlorella protothecoides
acaacacaactcaccccaccccacccccctatacacgcctctgcaggcgggacccccctccaga

SEQ ID NO: 36793 - DNA, 73079 bp, Chlorella protothecoides
  modified_base (293)..(302): a, c, t, g, unknown or other
  modified_base (4029)..(4038): a, c, t, g, unknown or other
  modified_base (6305)..(6314): a, c, t, g, unknown or other
  modified_base (6553)..(6562): a, c, t, g, unknown or other
  modified_base (7240)..(7249): a, c, t, g, unknown or other
  modified_base (8226)..(8235): a, c, t, g, unknown or other
  modified_base (8721)..(8730): a, c, t, g, unknown or other
  modified_base (9092)..(9101): a, c, t, g, unknown or other
  modified_base (9627)..(9636): a, c, t, g, unknown or other
  modified_base (10149)..(10158): a, c, t, g, unknown or other
  modified_base (10898)..(10907): a, c, t, g, unknown or other
  modified_base (11665)..(11674): a, c, t, g, unknown or other
  modified_base (12471)..(12480): a, c, t, g, unknown or other
  modified_base (13052)..(13061): a, c, t, g, unknown or other
  modified_base (14648)..(14657): a, c, t, g, unknown or other
  modified_base (15187)..(15196): a, c, t, g, unknown or other
  modified_base (16159)..(16168): a, c, t, g, unknown or other
  modified_base (17940)..(17949): a, c, t, g, unknown or other
  modified_base (18238)..(18247): a, c, t, g, unknown or other
  modified_base (21244)..(21253): a, c, t, g, unknown or other
  modified_base (21341)..(21350): a, c, t, g, unknown or other
  modified_base (23398)..(23407): a, c, t, g, unknown or other
  modified_base (24779)..(24788): a, c, t, g, unknown or other
  modified_base (24985)..(24994): a, c, t, g, unknown or other
  modified_base (25782)..(25791): a, c, t, g, unknown or other
  modified_base (26230)..(26239): a, c, t, g, unknown or other
  modified_base (27678)..(27687): a, c, t, g, unknown or other
  modified_base (28471)..(28480): a, c, t, g, unknown or other
  modified_base (28689)..(28698): a, c, t, g, unknown or other
  modified_base (29099)..(29108): a, c, t, g, unknown or other
  modified_base (29346)..(29355): a, c, t, g, unknown or other
  modified_base (29894)..(29903): a, c, t, g, unknown or other
  modified_base (30132)..(30141): a, c, t, g, unknown or other
  modified_base (30521)..(30530): a, c, t, g, unknown or other
  modified_base (31797)..(31806): a, c, t, g, unknown or other
  modified_base (32437)..(32446): a, c, t, g, unknown or other
  modified_base (32517)..(32526): a, c, t, g, unknown or other
  modified_base (32926)..(32935): a, c, t, g, unknown or other
  modified_base (33440)..(33449): a, c, t, g, unknown or other
  modified_base (33934)..(33943): a, c, t, g, unknown or other
  modified_base (34131)..(34140): a, c, t, g, unknown or other
  modified_base (34320)..(34329): a, c, t, g, unknown or other
  modified_base (34389)..(34398): a, c, t, g, unknown or other
  modified_base (34530)..(34539): a, c, t, g, unknown or other
  modified_base (35365)..(35374): a, c, t, g, unknown or other
  modified_base (35897)..(35906): a, c, t, g, unknown or other
  modified_base (36433)..(36442): a, c, t, g, unknown or other
  modified_base (36629)..(36638): a, c, t, g, unknown or other
  modified_base (36816)..(36847): a, c, t, g, unknown or other
  modified_base (37088)..(37097): a, c, t, g, unknown or other
  modified_base (37201)..(37210): a, c, t, g, unknown or other
  modified_base (37991)..(38000): a, c, t, g, unknown or other
  modified_base (38461)..(38470): a, c, t, g, unknown or other
  modified_base (38814)..(38823): a, c, t, g, unknown or other
  modified_base (39096)..(39105): a, c, t, g, unknown or other
  modified_base (41483)..(41492): a, c, t, g, unknown or other
  modified_base (42185)..(42194): a, c, t, g, unknown or other
  modified_base (42262)..(42271): a, c, t, g, unknown or other
  modified_base (42404)..(42413): a, c, t, g, unknown or other
  modified_base (42798)..(42807): a, c, t, g, unknown or other
  modified_base (43237)..(43246): a, c, t, g, unknown or other
  modified_base (43616)..(43625): a, c, t, g, unknown or other
  modified_base (43930)..(43939): a, c, t, g, unknown or other
  modified_base (44347)..(44356): a, c, t, g, unknown or other
  modified_base (45672)..(45681): a, c, t, g, unknown or other
  modified_base (48796)..(48805): a, c, t, g, unknown or other
  modified_base (48937)..(48946): a, c, t, g, unknown or other
  modified_base (50787)..(50796): a, c, t, g, unknown or other
  modified_base (50910)..(50919): a, c, t, g, unknown or other
  modified_base (51692)..(51701): a, c, t, g, unknown or other
  modified_base (51885)..(51894): a, c, t, g, unknown or other
  modified_base (52169)..(52178): a, c, t, g, unknown or other
  modified_base (53138)..(53147): a, c, t, g, unknown or other
  modified_base (54110)..(54119): a, c, t, g, unknown or other
  modified_base (54623)..(54632): a, c, t, g, unknown or other
  modified_base (55188)..(55197): a, c, t, g, unknown or other
  modified_base (56120)..(56129): a, c, t, g, unknown or other
  modified_base (56341)..(56350): a, c, t, g, unknown or other
  modified_base (56770)..(56779): a, c, t, g, unknown or other
  modified_base (57891)..(57900): a, c, t, g, unknown or other
  modified_base (58900)..(58909): a, c, t, g, unknown or other
  modified_base (60066)..(60075): a, c, t, g, unknown or other
  modified_base (60428)..(60437): a, c, t, g, unknown or other
  modified_base (60632)..(60641): a, c, t, g, unknown or other
  modified_base (60935)..(60944): a, c, t, g, unknown or other
  modified_base (61332)..(61341): a, c, t, g, unknown or other
  modified_base (61884)..(61893): a, c, t, g, unknown or other
  modified_base (62855)..(62864): a, c, t, g, unknown or other
  modified_base (63696)..(63705): a, c, t, g, unknown or other
  modified_base (63789)..(64027): a, c, t, g, unknown or other
  modified_base (64523)..(64532): a, c, t, g, unknown or other
  modified_base (64926)..(64935): a, c, t, g, unknown or other
  modified_base (65347)..(65356): a, c, t, g, unknown or other
  modified_base (65568)..(65577): a, c, t, g, unknown or other
  modified_base (66205)..(66214): a, c, t, g, unknown or other
  modified_base (66483)..(66492): a, c, t, g, unknown or other
  modified_base (66559)..(66568): a, c, t, g, unknown or other
  modified_base (66635)..(66644): a, c, t, g, unknown or other
  modified_base (67042)..(67087): a, c, t, g, unknown or other
  modified_base (67321)..(67330): a, c, t, g, unknown or other
  modified_base (67629)..(67638): a, c, t, g, unknown or other
  modified_base (67893)..(67902): a, c, t, g, unknown or other
  modified_base (68180)..(68189): a, c, t, g, unknown or other
  modified_base (70306)..(70315): a, c, t, g, unknown or other
  modified_base (70759)..(70768): a, c, t, g, unknown or other
  modified_base (70954)..(70963): a, c, t, g, unknown or other
  modified_base (71120)..(71226): a, c, t, g, unknown or other
  modified_base (71460)..(71469): a, c, t, g, unknown or other
  modified_base (71751)..(71760): a, c, t, g, unknown or other
  modified_base (71824)..(72037): a, c, t, g, unknown or other
  modified_base (72747)..(72756): a, c, t, g, unknown or other
cgacgaagctctccacggctgcgcgctcggcctcgcggcagggcaggcgccgcggcgcggcgctgggcgccagcgcgtccctggcacgcgccagcgggcacgccgacagggcgcgggcccgggcgacggccgcgacggccaggtcgtcgccgtcggcgcccgtgcggcccacgactcccagcagatccttgccgccctgcaggagccgggaggatgcgtggggtcagggtcggcgcacagacatccagacggcagtctcgcgccgatggcaggggaggcatgcgatgcggcannnnnnnnnntgtggggccagggtcggcgcacagccatccagacggcagtctcgctccgatggcaggggaggcatgcgatgcggcacggggagcgagcacgcgtgcgcgatcttctcgccgacgcaaacccacctgtctggagggacgcggggtggccgtgccgtagccacgcaggttcttgggcggcaccaggcccttctcggcccacatggcgtacacggacttgcagtgcaggccagcgtcgccttcctggttggcctcatcggcctcggcctcgggccgccagtcatcgccctcgtcctccgactcgctgggcccatactccggccggcgccggaagcgctgcgtgtgtttgaggtggtggggagggggcgctcgtgggagtgggtgctggggatcgccgcccgaaacaacgagggaagcccatgcatccacggccagcggcacgactcactacgctgccgctgatcggtcatcttttctcgccgtgacgcttccgagcgcagcgtcacagttgcacaacccgtgcccaggcctgtgcacggcgcacccgttcccttccccatctccaaggcctccccccctgaaatccagggccccccatccacacaaaacaacacctgccaggcttcgttgtactcgtagtcgcagaggaagacgtcgtccccaagctccggtggcgcgtgtcggaactccggcgatggcaggacgtgggcgtggcgcaggagggtggtcacctcattcaggtcgcgcgtggaggtcaggaacacctcgcgcgccgcgtggtgcgtctggtaagcgtggcgggggcggagtggttggcagatgagagttttgagttgcgtgtgtgtgtgtgtgtggagaggtcgtggaacttgattcagggcgcctgtcccgtcgacagcctgccgaatctagacaccccacacctgtcacacaaggaaaaccacgccacccccacctgccgcccggcgtgcgtctcctccggcaggcagtaccagcgcagggtggcggcgtgtgcgccgccgcccatggcccacagcgcctcgatgcgggccagcgccaggcccgcccgcgtcagcaccctggaccgcgccgtggtggggccctgggcagggacgggcctgccctgctcgcagtccgggcacacccagtcatccttgtggggatttgaggggggccggttgaagtttgagaccagggacttgcattgaggaagggcagcggccagtgcaacatatcccaaaccctcatctccgggtagccaggtcacaggaacccagcttccagagggtgaagaaccgcacgcccagcgcatcgtcctgcagtctgcttccaatcgagaccaaagccacccccaccctcttcaactaggcaacggtcctcacctctggcacggcgtccaggggcgggtccagacagcagaggtggaaaccgcggaggcagcgcccgcactccagcatgtcgacgccggcgcggtccacctcgccgcacgtagcgcaggcctcctcctcctcgtcgtcgctgtgtgagtggaggaaagcgaccttgggggatatgtgacacaggcaggctgggttgacaaggaactggggtgaggactcctgcctggcagggctgcaggcggtgcgcatggaatccagatcgcaacaccgtacagcggccattggatgccacccccccaacacatccccggacctgaggccttggatggcagagtcgtccagcacgacatacacggagtcaccggtacgaaaggtcacattgtcgatctcgacagactccacagccgttcggcggttggctgcacgccgctctgtgccctgctgcttctcctctggggccacggtcttggcagccaggctggcctttctctgtgcaggtccggccttcttcttggcgtggggggctgctgggaagagctgcaccttggcaagggtcttggccgcagcagtaggcttgccacccttggcgagtgttctggccgggacgaattccagcttgtcattccccagccggaccttggggcccaagcccctctgctcccgcttgcctgcaactaccggtcccttgcttactacggcctgccggggatggatcacaccgcacatgagctactgtagtttgaactgatacagatcacgagtctgtgttgtcactgctcccccatcgacatgccacctacctgggtccggcccggcttgcgtgcggggtagtgggcatccacggtgctccgtccatcgtcatcgctcttccgtttggatggagacagttgtttccttgtgctgaccatcgtgtcgaacagcggattgccaagtatgtgcaatgcaatgggccgatgatctaggcgcgaggtccgttggtggcttggatggagtcgcgcatttgaaaacaaaggcacatgcagtgcctgcaatactgcgtgcaacacactatggtcttgtcctggtgaagcgagtgcaacatgccttcaacgcgcgcactcgctgctctgcctcatgcatggccccccggcagcttgacgtggtttgagcgacgtgaaggaagaaaactggaatggtacaaatatgtatctcgtcaaagaagattacatgacatacaacaagaaacaataaactcacaccgggaacttgtgccctgaacatgcatcaagtgttaggtgcagtctcctcaggtgcttttgtacaaagaaacaagtactgccaggaccatggccagcagtgcaagcaggagtgccaagatgtggcaccatggtccaaacttcgcccaattcactccagcaaaccagtcgagaaggtcctccttggcgttgtagactgcatgcagaagagcggtagcgtagccgcggtgtgtcgagggctggagtgccacttgaggtgccgggcgcgtctccgccagcgctcgctcacatacgtccctgactatgtctgccacctgcatgagcaatagtttttggatggtggtcctgatgatacgagagatgcatgcgtatatgaacagaatgaatcgagcaagtgcagggggtgggccatcttgtcttgggagggtgtataagggagctcccaagagcagcagcgcatcacgaaaggctcacacttgcaaacaacaccacaacgtgcatgcttcctcgcccggagcatcccctgcagccaccaacaggtttccccacacctcctccgcgcgaactcctatccacaccacccacctcctgatactccttggccacaaagtagtggtcgcccgccctgatggggatgtgggtgtgggcggcgagggtgtgccggccccaccctcgcatggccccacgttcaatggtcccgtccagccgcccgtccagggacacgatggggcaggccaggggcggcacgctagggtcgtggtggtaccgtaccgccatgctgatgtcagcgacgcctaggggggcgacgcgccagaacaggcggtcgttcctccgcatctcctccaccccggcaaaatttccggcctcaaaggccttgagcagggtgtctttggagaggtccttccagccgctcaagatccccagcacctcctccacagggggtggctcggaccgacctgttgggtgccaaggggtgtcagaggttggagatggtgtcgggcacaagggcgcggggggtgaagtgacgctggccgagggttattgagggggccaattgttgggggccacacacaggacatctcactcactgtgcatcctttgcaaacgccttcttgnnnnnnnnnngcctgttgggtgccaaggggtgtcagaggtcggagatggtgtcgggcacaagggctggggggggtgaagtgacgctggccgaggggtattgaggaggccaatcatttgggggccacacacaggacatctcacacactgtgcatcctttgcaaacgccttcttgcccattctgtgagggccgcgggatctcagcccaacccactccctcatctcactcatggcccgctggaggtaaaggcgcatgacagcccgagcatagaggtggggcggggccacggccgccacgatgagggccagcggtagccgccggccctcctccctttccagcagtgcggccagctcataggccacgatggagcccaggcaggtgccgaagaggacgtagggcagctcgtccagtggcagggtgtgcgccaggtaggcggccaggtcctggacctggccatgcgccggctggggggcgagacgacccctgcccgggatctccaccggccagacctcgatccaggcgggcagccgctccgggtacctgcagcgttgcgagtggggatggggctgatgggacccatggctgctgggggtctgcactggagaaggtgagaccagtctcctgtgtctaggtgctcacgctctccaaaccacgctgccatcgccataccttgcaaagacgttggcggacaccccagcagcgtagggcaggcagaacatgcgcaggagtggcttctgcatcgggtgacgaggcggcgcaggtccatgggtgtctcccctagtgacagcccccgcttcaggggtgctgcttgcacttatgggcgttgtggccaggatctggaaggtgtggcctgtggggttctgggctcgtgctgtcttgaccatgccctccctgacctctgccaccacggtggccagcagggcgcctgcggggtcctgcacgaggctgggcgccaccactccagtcagatcctgtggggttcagattgtatggggttggatcgtgaggctttcacagcggaaattttcaacctgcaagagtaaagttcgccatgacctccaagctcacctggatcttctggcgcagctccagtgccgccaatgagtccaggccctgcaggcccaggggaacacctggctccaagctttccaccccgagcacgctctcaacaagcgctcgcagcccaggctcgacatcgcctcccttcaggtggtgctgttgcgcagtcgatgcaccctcctgcggggacgcacagtggaggggagggagcatgggtgggagtgtggacatcaggtcttgcggtcaggggcggtggtaatcaacctgtcccaattcttccgtaagccatacgctcctcagcgggaaaaaaacaaccaacatcctacctggacgtggtcctggcagggcgccatgaccgcgctgcctgtcgtttcctccatgacatccgccaggagcgaaggcacctctgccatatactgcagcacatggtgccagtacgaccgcggtacagcgccccacaccgcgccagcacggtcccagcttcccgccagcagccgtcgcaggacggtcaggcccgcctcgctggtgagcatgcccatggccttgatctgggccggggacggcgcatgcttgcggtgcaccatgcctgagggggggggagtttggggtaatgtggtctgtaccagcatatgccagggagtgactcagcgtgtggcaggagatttagctaccaaggccctcgcgccagcaaggaaagggcgaggtctgtcaccgtcccactcaccgacggtggcccaggcgccccactgcacggcagctaccgggtggccggcagccgaagcgccagcacccacagcatccaagcacgcgttggcgaccgcgtagctggcctgcccggcaaagccggccagggaggagagggaggagaagagggacacgcccagcgtgggcacagcgtgcgccgcggcgcccagcaggagccttccgcccgccagcttgggggccagcaccgggctcaggctcgcggagcggagcgccggcacgccggcggccacctgcacgcccgcggcgtggatgaggaaggcgcgggcgcccgttgagacggggaggccgccgcgcagacgcgcgagggtcattctcaaccctgcagcatctgcagagcaggccacgtccgccgcgacggccgtgacgcaataggatgcgtccagtccagctgtttccaggccgctgctgggggccgcgccccgacccgtccgcccgaccagcaccgcgtctgcgnnnnnnnnnncaggatgcgtccagtccagctgtttccgggccgctgccgggggccgcgccccggcccgtccgcccgaccagcaccgcgtctgcgccctcgccggtcagccacagggcaacgaggtggccgatgccgcccaggccacccgtgaccagcgccgtggcatggcggtccagccactggcgggtccgcccggcccccgcctctcgcccgtacctcatcctcctggcaatcgcgaggccgccctnnnnnnnnnntcaggcactggggggcccgcccggcccccgcctcgcgaccgtacatcatcctcctggcaatcgcgaggccgccctgctggaggtcatgtggcattccgacggcgccttctgccccgaggacaccctcggcttccagcgcgctcctcacgagatcgctcccgccgtgcgccagcttcctggcctgggcggggagctccagcgctgcgctggccagcagcgccggcacgacgccggagagtgccgtgccggcggcgccggggacgggcgcggggatgctgccgctggctgcccagctctggagggtggcaggtgcatcgccggccagcaatccctggacgacctgcaccgcccggatgcaccccgcgcggtccccggccgtcgaaggccgcagcgccagggcccagccagcgcggaacgtctggaggtggggcagcgttcccagcacctgctcctccacctcgtactccagcctctcttccagcccagccgaggcagcgccggcgacgatgggcgttcccaggggcacccactgcaagccgcgtgcctgcccagcatcggagtggaacagcgctgaagcaccgaagctggtgccccatgagatggactgggaacctgatgcggcgcccagatccaggacgagctctgcagccgccagcagcaacgggtcgggagacaggnnnnnnnnnntgactgggaacctgacgcagcgcccagatccaggacgagctctgcggccgccagcagcaacgggtcgggagacagggtttccaggcgtgccaggcagaggatgggcaccatggggaagccgtccaagacatctgctgggctgtccaggcaccatgtcgcggattcctgtctgggcacctgtgcaatgttgcaggaagaggactgtctgaggcgcaggacgcacagattgctgcatggctgccagggcacggaaactgacactctattagttcaagaccataatacaccaacaacaggccgagcagccagcaacacatgcccctccgtacctggacttgcagacctccctgcagttggcacccagcaggcccagccactgcaccccgcgcgccagcagggaccccctgcaggtgtaccctgcgcgcctctgccgtcagcagctcggtcctgccatggccaagcccctccaggaccactgccacgccccccgaccggcagtcggtgaggatggtcagggacacggagttcccggcactcaggctcgcccaccgccccgccaccacgccagccagggcaggcaagactcctgaaggaatgcccagcgtgcgtagcgcggcggcagccaggctcaggcacacttctggcgctgcagcggggctgccgtgcacgcccacctgccacagcggctcgcagcgtgcgtgccccaggtcaaccgcaagggcgacctggccggcatgcctacccagtgaagggcagagggcggggtgagtgtcgggcagcagggagtgcttgctcctctgccagggcagcggcagacgcctctgcaggaaagggggagggtttatcattgggtgcctcagtctctggagcaagagatggcccagcatctgccaccaaacatttgcagagcacgcccgagtgttccctccttccctgctcatttgggtcgccgccctgataccgccctctagtcttcnnnnnnnnnntgacatttgcggatcatgcccgagtgttccctccttccctgctcatccggttcgccgccctgataccgccctctagtcttccatacagcatcgccgcccacctcccaagctgatccctctgcagatcccagcgcaagcctgtcgactggtgccaggaccacgtgcgtgttcactccgctcatgccgaaggagctcgcgccggccaggcccctgccgttcccaggcagcccggcgtactggcgggggagcgcggcggccgccttccctcccgggcctcgtccccagtcgccgagcgcgcccgccacgtgcgggttcagggtgcgcaggtgcaggacgggggccaggctgcggtcctgcagcgtgcacagcgcgcacagcgtggccgtcaggcccgccgcgccctccgtgtgcgcgtgcgtggccttgcccgccagcagcgccggcgggctggacctcggcgcgcccagcgctgctcccgcggcgccnnnnnnnnnnagcgtgcatggccttgtccgccagcagcgccggcgggcttgaccccggcgcgcccagcgctgctcccgcggcgcccacctccagcgggtcacccagcagcgtgcccgtgccgtgcaagctcagcgcagcgaccgcgccggggtccaagccgccggcgcgcagcgcgtcgcgcacgacgcgcgtctgggcggggccgctgggcgcggccagcgccgcgcgggatcccgcctggttggccgcccagcccgccatgcgcgcgagcggtggggggagcagggtgccatgctcatctcttgtgaccaatggacccaggcccagcgtgacaaagccgtcgccccggccgtagccgtcggcggcggcgnnnnnnnnnnctgtggccaatggacccagtcccagcgtgacaaagccctcgccccggccgtagccgtcggcggcggcgtcaaaggcgcggcagcgcccgaccggcgacagcgcgcccagcaggcagatggcggccgtggtcgcgccgtccagcagggcattcaccccagccgccagcgcgacgctggcctggcccaggcgcagcgcgtctgccgccagcgccagcgccatcagggaggaggagcaggcggtgtccagggacaggcagggaccgcccaggccgtgcgcgaaggaggcgcggcccgccaggaaagaggggccgccgccggtgacggcgagcggggagggcgcggcgcccacgcgcgccgccacacccgcgtactcgtggtacatgctgcccacgtacacgcctggatggtccaggttggggagattttggatgaagagtgaaagggtgagggaggatgactgggcgtctgagtccaggctgcgcaggccctgacgccacattgtgcatcccctcagcgcatcgcaagnnnnnnnnnngagagtggaagggtgagggaggatgactgggcgtctgggtccaggctgcgcaggccttgacgcgacattgtgcatcccctcagcgcatcgcaaggccccacttgtacacccattttaatgcatcatccgtcagcgcccaagacgtctcaccggtcgtgtccctgtccacccgcatgccatcgcccagctcctgcaggctcagacccgccagctccagcaggatgcggtgctgggggtccatggcggccgcctcggcgcctgctaatctgaacgcccctgcgtcaaaggcccagatgtcctccaggaaggccccgtgccgaacgtatgctgctagcgagtggctgccgccgctgcctccaagggggcggtaggttgcctccacgtcccaccgcgaccagggaaccaggcccacagcatctgtcatggtcaggcagaagagaaggtgtaggtgatggaggagtgaccatgcgcgattctgtgtcaccttgctgcaactggacagtggctgccagnnnnnnnnnnagaggagtgaccatgcgcaattctatttgaccttgctgcaactggacagtggctgccagcgccttttcgccggacaagaaagcgtgcacccttatccacgcccacgcacctggcgagttaccgacaggcgtggggaacctcgaagcggttgtgtagatggccacggatgttgatcgcaccggcgaccccgccaatgcagcgagcccgtcagcagcgcccatgggcaccacctcggcgcgctcagccagctgctcctcgagggcagccgcgagcgctgcggggtgcggggtgtcaaacaggatggtggccggcagggcggtgcccaggcggcgcgccagcatgtcgcgcgcctccaccgccgccaggctgtccaggcccgcctctgcaaaggtggtgtcctctgccacctgtgcacatgtgatggagggttttggacatgtggggtgagcttgcaggccggctgtgctattgtgggcacccctgcccgcataacatccctcccttgcgtccaagacccctggaacaccttcctgtctacaacacaaccacgcacctccgtcggcaggagggtcgccaggaccaacaggatctcggccagcagtgcctcccgcgtccacaccctggagctggcagtcattggcggggtcgttggtgtgctgtcagcgtgaggccgatccaccctgctcacaactccttcatgtttcacaggtccctgccgctccccctgcgcctcagccgcnnnnnnnnnnccgtgctgtcggcgtgaggccgatctaccctgctcacaactccttcatgtctcacagctccctgccgctccccctgcgcctcagccgccagttcaaaaacggcagggcggacctggccctccccggcggccgccatgcggccccagtggaaggggctggccagcacatcaggcggcgccccacccggcctggcgatgagtaatcgctgcagtgcccgcagccccgcggctgggcggaccaggcccaccccgatccgatccagccgcgccaggagggctggggagcgggccgccatgcccaccacccaggccccccactgcacagacagcacgggcaggccgcggtcgctggctcgcgccgccagcgcgcccagctcagcgttggcggccgcgtacccggcctgccccggcggcgacagcgtggcagatgtagacgcgaacagggccgtcacgaggacaggcaggacgcttgtggagcgcagcagcgcaatccccgctccggccttgggagcggccagttctctcagctgagccggcctgtgcgcggcgagcggcgcgtccgcgagcacccccccggcgtggaagaggctgagggtgggttccagggtggcgctggtctgcaatgttgggacctccaggaggtcgccccacaccgacacgtccgccagggtcagcgtcagcaacccacggagcgccaggctcgtgctttccagcggagccagcgcatcagcacgtcgccgccggcccagcacgtggatnnnnnnnnnngcggagcaccaggctcgtgctttccagcggagccaacgcattagcacgtcgccgccggcccagcacgtggatcgccgtgtgccggccagtcatcgccaggtgccgcatcaccaggccgcccagctcgcccaggccgccggtgactaatgcaacgccatgcgaggcgccgacatcattgccgcgcagcgcctcgcccggtcccacccagggcagcagccgcggctgcatgcgtacgccgcctgccccccgccaggagccgtacccatcatcgtcatcgtcggcgtcgtcatcgttgtgcggtgggatgatgcttgggccgccagacggtctcacaaaggatcgcgatcccactgcgtgcaggtcgccgcccgcggcgtgcacttgaataccaccaggtcgctcgcgggctgccacgcgtgccatcgcccccgtggcactcagctggggctgcagggagcagccccagaggctgagacttgtcaagggacccacacccaggctcagagtctgcagcagagccagtgctgctgctggctgcgcagtgttgaacgccgagtccccagccagccagagggtctcctgcgctgctgacttgttgggatgcaggttggcgtgctgtcgcgcgccatcaatcctctcacgttgctggtggtgccggattgctgctgcatacatgagtgcggcgcatctgctggtggcagcagcaaccccagcatcttgggcctgccactgcgtgatgtacaccatgtgagccacctcctgcgccccgctcgacctgccgctcccctcgtggtcgnnnnnnnnnnagcagtagtgctcaggggcttgctctgtacttttatgagccgcgcctcgctggagccgcgcatcccgaagctggcagatgccggtccccgatgcccggcggcctggaagtccccggcctccacccaggcctccctgtgacgctgccaggggggcaggattgccgggctcgcggccacggcaccaaaggagaccggcaccgtcatcctggcagcaatcgtggcgcccaggtgcagcccggcgtccaccctggctgcatggaggacggcaggcagagtggcgccacccgccaggcagcccagcatgccactggagggacccgatgggccattggagatgccgcagaggactgctgcccgcgcagggtttggcgcagcttgacaatgtggtgcacgccaggacgccaccatggcgtgcgccacggtggcgacgctcccggcgccggtgatgtgcccgccagactccatgctcacgcttcctccccgcaccagcaggcgcagcggtgcggtggcgccgaggcggagtggggatggcagggtcacgcccaccagcagtgcgccaggctctgcccttnnnnnnnnnntgccagactccatgctcgcgctttcctcccgtaccagcaggcgcagcggtgcggtgccgccgaggcggactggggatggcagggtcacacccaccagcagtgcgccaggctctgcccttccgggtgcagtgggatttccatgcacaagcatagccgcgcccgaggccatcagctccagactcatggcggccgggagcagtgcctggcccagcacctgttgtttgggtgatgggcgatctgacaagcgcaaggagactgtcaggatgcaatggcctccattatcatcatccagcagacggccctgatctgagcccagttgttcaacactctcacacccaggaatcccacgccccaccctcgcacctggtggtccaggaggtcggccaggcccggctgggagagcaggacgtcgaagcggactgtccccggctctgccagggccctctccagggccgggctgggcgccgggcgcggccacaatcgccggcgctccatcaggcgctcgtcacgcgccccgctcttcacctcatcactgatcgccacacgcccggcatccaagatggcgtgcgcgttgacgccgctcatgccaaaggagctggttcccgccgcgccgcgtggcagcagcagcggggcgcgctggcgtggcaggagcacggagaaggaccccccccccgcccccagcgcggcgcccacgtgcggattcagcacgcaaaggtggagggtgggcggcgcagcgcgggcgtgcagcgcgcccagcgcgcccagcgcccccgtcagccccgccgcgccctcggtgtggcccaggcacgccttggtggagagcagggccagcggggcgcctggtcccagtgccgctcccgccgcgcccacctccagcgggtcccccagcgcggttcccgtgccgtgcacgctgagcgcggcgagcgcgccgggtctgatcccggcggccgccagcgccgcgcgcacaacggcggtctgggcggggccgttgggcgcggtgagggcgctgccccgccccgccaggttcaccgcggacgccgcgagcgctgcaagcgcgtgcggaggcctctcagcattgctgcccccgcccgcggccagggccgccgccaggaagccctcgccgcggccgtacccgtcgccggctgcctcgaaggacaggcagcggcccgaggtggagagcgcgcccaggcgcgcaatgcccaccatggtggccgggtccagcagcaggttggacccagtgaccgccgcgccagtggcctcgccccgggtgagcgtggcggctgccaggtgggcggccaccagggaggaggagcaggccgtgtccacgctggagcttgggcctgatttcaggaagagggcatggtgctgtgatgcgcttgggtaagacatttgccttgcagccgaccgacgggtgggatgtttgatcatacaacattagcaccagcgtcggaagtaggcggcttgctgccgagcgctgccagttccgtaggaggcgacaccatgatgcagaagcaccacggtgaccccaacccttagttcctgtatgccaccccccaacacacaacacccccattcagcaaccccacnnnnnnnnnnagatgcacaagcaccacggtgaccccaaccctcagttcctgtatgccacccccccacacacaacacccccattcagcaaccccactcacccctgaggccaaaggtaaaggcgatgcggcccaccatgtagggcgccccgctcccgacaaaggccgggccgggcagctgctgggagccacccgccgccagcacagacaggtactcgtgatacatgcagccagagaagaccccggtggccctggggtcgagcccgctggagcccgccagcagcgagtgcacgccctccagcagcaggcgggtctgggggtccacgagtagggcctcgcccggcgagacgcgcagcaggccggcgtcgaaggcctccacgccgtcgcagagcgcggcgaagcgcgcgtaggaagtcgggcgctgggcggctgtggtccctggaggtgcatagatctggtccacgtcccagcgggccaggggaatgaccccctgcaggtccctgccttcttccagcacggcccaggcctccgccaggtggccannnnnnnnnncggtctacgtcccagcgggccagggggatgaccccctgcaggtccctgccttcttcaagcacggcccaggcctccgccaggtggccacccggggtgctgggaagccgcgaggacaagcctactagatgcacggccttcttggcggctgttgtatcgaatgaaatgggccgcccgacatcctcccaggtctgagcctggacctcctgcctctccccagtgttgtcgacttcgtgctccgccgccagcacagctgccatggctgcgatggttggcgcatcaaagacaaagctgggggacaggctggtgtggaaggcttcgctgatgccctgcctcactgcctcactccctgcagtcaggtgcggtgcggaggtggattggattgggaaaggatttgcgatcccttgctgtgctgcctcaggcagacttccgaggcatgatatcttcacatggattcttcattgctaatacagcagccctcttgtcccctggttcttgggagccggcaacctacccagggagtccaggccggcctgcatgagcggctcgtcatcttccacctcccgccccagcacccctgccacgatggagcgcagcagctgcaccgtggtggatgttgtggctgagcgcgtcgtcgtcctgccccgcctcagctgggaaacgagggcggcaaggtcggcgatggtggggtggtcgtacaccagcgtggccggcaaggctaccaagaactggtcctgcagcagccgctgcagctccagcacccctgttgttgggatttgaggaggggttgtgaggtgaacaggggaatgtacgagtagagcctggcgataatgatagccgtgccacggttgcctgctcatgtcgacacgcaggatgtgatgctgctggccaaaccctccctcacaccgtcaccagctgcccctatcaatccacccaaccccgctcacccatggagtcaagccctgnnnnnnnnnntgtcaccggctgcccctttcaatccacctaaccccgctcacccatggagtcaagccctgcggagaccaggggctcatcggcggtcaggcgcctgcccaagacgcgttccacgagctgactaatcgtggggatcccgcccggccgagcgggcctggcaggaatctgcacgaccgcctccgctcgtgcaccgcccaccggcatcgagcctccaaccggctcaccactgctcagcaaccccgcaaacaagggctgggacaggagcccgccggccacgatggcagacagcagagcgaggccctggtctggtagcatgaggccgaggcccgccctggcgaagcgcgcctccagctccgggcgatcccttgtcatcccggacgcccaaggaccccactgcacgctgatacagggcaggccgctgtgcgcagcgcgcgcagcgtgcgcgtccagggcagcgttggcggcggcgtagctggcctgaccgggggtgcccgcccaggcggagagcgaggagaaggccactgctagcgagaggggagctgagcaaggagtcaggcggcgcagctgggccgtcttgggcgcggccgtggtccgcaggtgggccgcggtctggtgagaaagtggggcatccgccaggcagcctgccgcgtgaaggagcaggccgcagggctcgctaggagtggcggctgcttcaaaccggctgtcacacgacgccacatcagccgcgaagccgagatccgctgtcagccaggtggaaatgccgtggactcctgccgctcccgctctcagggcgctcgccgcagcgcgctcatgcccgaccctgggtctgccgcggcccagcaggagcaggctaccggctccggagtgcgtcgcccagcgagcgaccagccggcccagctctccgccggcgccagtcacccaggcgcaagcacctggcagggcaaggcggtggggagtcgaccgccgccgggtggcgtcgaccatgtccggcaccaataaaccgccgtgcacgaggatcacgcctttgccctctgcagcatcgaatgccatgggctgggaagcagcgaggcagctcgcttcaagatggcgccaaggcttgccaacctcacgcgccgccactctgaagagcgcggccgctgctgaggtactggaggctagtggagatgcaggtgcaccgccaccggtccagcttctcgtagtcaggcttgccatcagggtccttcccggcgcccgctgcagcgccgccagcagatcatgtggacgcctggggttgatcgcagcgccatgcatgtgcataagcacttgagcgccctgcgcccggctttcacctccatcagcccagggccggtagacctgcgcctctgccacccgcagcgcgagggacgcaggagcgacgaccgccgccctgctcctcgcgccacttgtcatcgccgcaaatctcagtcctcgaactgcggtggcgtggcccagacggaaactggcggtgttgccgtgcccgtccagaccaccctcgccccagccgccggcgggcatgcagccgggaacagacttccagcccaccagcgccgggcgctggtagcgttccaggccggcgggcacgctgagggaggctctggatggcgttgaggtggtctggagtaggtcgaccatagtgattccaagctgcgtggcagcgtccacctgcgcagggtgcgccgcgaagcctcctggctgcctgtcggtagagatgtcaggcagcattgcgaaggccgccacgctgtcggcctggggcgctnnnnnnnnnncggctgcctgtcggcagagatgttaggcagcatggcaaaggccgccacgctgtcggcctggggcgctgactcagccagctgaaacgaggccatttccgccagcatgcgccgtgcaggtactcggcggctccctctccaggcaccgggggccggtctgagctcgaagcagcgcagcacgctgcttgacaggtgcgtcgccgcgccgcagattctcaagccgccgcgcagggggtcgacctctgtgcgtagctttgctgcctggccggtgagtgccaggggcgccgagagnnnnnnnnnngagcacgctgcttgacaggtgcgtcgtcacgccgcagatcctcaagccgccgcgcaggggatcgacctctgtgcgtagctttgctgtctggccggtgagtgccaggggcgccgagagagccacccgtgccatgccgcccggggtgtccgcgccctgaacaggcagcgacacgtccaccgctgccgcggccagctcaaacagggcagcgccgggcatcagcacccgcccctgcaccatgtgatccatgaggaaagcgcagccgacgccgggcagcgagctctccagcagtagcaggttggggccgctgccgctgggaatcgcccgttctagcaaggctggggcagggcccgcaaaccagcacctctgtcgggtccaggcgaggaggggtgaagaagtgggcaggatctcgtcagccgcatcctcgcccacacagcggcccgccgccaggatgacgtgggcattggtgccctggaaggcaaaggcactgacgccccccagcaggggttcgccatcgtcctgctttgtacagggcagggcgcagcgctcccgcggcaggaggggcggtgcgccagcgcgcgctgccccggaccccgccaccaggttctgcaccagggggttcgggccgcgcaggtggagcatggcgtccgactcagcgcccgccagcgcgcgcgccaggcgggccaggcccagcgcgccggccgccggctcggcgtgcccgtgcgtggccttggcggcgcccagccgcgcggcgtgtgctccccggcccagcaccggcagcgcggcgccgatctcgatggggtcgcccaggggcgtccccgtgccgtgcagctccaggagggagagggcggcgcgctgcgacacttgagacagtgcagaagaaagcacgccggtctggctggggccgtgaggcgccgtcaggctgctggaccgcccgtcctggttcaccgcgctggctgcgacgcggatggcgcaggcctgagcatgttcgtgggaggggatgcggccgccagggtccgatgcctggcgctgcagcctgaggaccacgcaggcctccgcccttcaagagggggaagtcgatggtgggaggatcacgaaaagtgaagcagtttgcaagagtgcacagtgcacctgttcttttgagtgcaccaatgtgttggtcgacaggaaggcatctgaacgatgttctctttgacattgtgcagtgatgacgatcgatgagagcacatgcgcaggtcatgcctgcactccatgatccttccccacctgacgtagccgtccgctgaggcgtccagggtcttgcacctggcctgggggctgagcatgccggccgccgctgccgccgcaaacgtccccgggctcaggcacaggttgaccccagctgccagcgcattgaccggcgctgcagccgacctcgttgcctgcaggcccaggtgcagcgccaccagcgccgagctgcaggcggagtccacggcgacggccgggcccttcagaccgaagaggaaggcgaggcgcccggcggccacccccaggctgccccccgtcgcggtgtaggggccgatggaggtctggtggggcgctgactgggccccgtactccatctgctggatgccgacgtgcaccgaggtggcagagccccagaggctggagaccgagtccttcaccagcagttgccagcacgcctggcaggcaggggttgcatgggggagatggtaatcgaggagatgcttggggttcacagtgtgtgttgagtgtatttggggcgctggaagggccacgatggcaaagagacgggagccacagcatgggccccagccctgcacgagcaagcgccctgctttccttggttatcaccatactcacctccatcagcaggcggtgctggggatcaacaaggcaggcctccagggaggacatgccaaacaggctcaggtcgaaactctcaacctcggtgaggaatccagcctgcctgatgggctgctccatgcgcacactctgccaggaggggtgctgggatctatgcctggccctggcatgggctagctaggagcaggcagcgtttgttatgacactcacccaccacttcaaaatcctgccactcaccgccggctccaggtcccagcggctgaagggaacgtgggtgatggcgtcctgtggctgcggctgcatccagcccagcacctcctcctggcctggcaggcgggagatgcctgtgagggagatgtcaaggcccgggcttccggcagccaaatgatgtgtcgtaggcgggacaggaggcatgggagcaggccggtctgccgggcgcagggcctccagtaggtgctgggccatcgccggcacggaggggtggtcaaacaccagggtcgctgggaaatggtgcttgaggcggctcgagaggctggctgccagctccaccgcccccagagagtcaaaagcacctggcggaaaggcgtcttggtctgcggagaggattcagtggacttctgataaatacaaccgttcacttcccagtccaggcctatgttcataatttcctgctgggtgggattttgtatgatcagtggcccatgccatgtgcaaaaagcaatcccaatgcttcgctcctgatacccaggtatccttaccccctagctcgatgccggcgagatcggcggccagggactttaccagctgcttcatctggatcagggtgtgcgtagtggccaaacgctgggtgtctgttgcctcgctgaggcgcacctgcgtctgctgcgccggctcgagagtttgtgcatctttctcagctcgctgggagtcgagggtgccctccagcaggcgccaagtgccctgcatgtcatacagatgctgcatcctcgcgatgtctaggtcggcatacaggagtgtcggcgcctcgcccgccacctgggctgcctcccacacctgacagggattagggatgtggctggcacggtttgaggcctcaataataacctacaagcgcatcccagcatcaggcactgnnnnnnnnnnatttgagcacctttctcagcttgctgggagtcaagggtgccctccagcaggcgccatgtgccctgcatgtcatacagatgctgcatcnnnnnnnnnntaggcacacaacctcgatcgtccaaaccccttccctgaatccatgcctgtgcagggtgcaggcagcccaggcccagggcggccagctggtcggcgtgcgctgcagccatgcccgcccccttgaatggtcccagctggagggaggtgaaggcccggccaccggcccgctcgcgcgccgcgacgccgtccagccaggcgttggccgcagcgtaggaggcgccgccggtctgcgaccacacggcggccgtggaggaaaggaggatgaccgtctgtggcacgaggcgcgaggcaaggagggcgcggatgggggccaccttggcgccggccccagcccagaagctggtggagtccaggtcacagagggggacgggatttgacacccccgccgcgtgcaccaccagccgcacgccggggtgtgcgtcagccacccagttgaagaggccgcacgcggcatcgaagtccgacaagtctcccgcgcgggtgacgaagcgcaccccctgcccagcccactcgctctgcacctcctcgggcagccgcccactctttgacaccaccaccagcaggcggcagcctctggcaatgaggctcctgcccacctccagccctaggccctgtggtaataggagaggtgcggcgattcttaaattatatgtgcgtacgtgtgtgcatgttgtgctattcatgggccatgctttaaagagcagggaatgttggtagcctacgattgatggaagctatcttctgatacccctgactgagaggtctcaccctggttcctcccgtgatgagggcaccggaggcgtgaccagaagtgttgaatgccagtctgtgcaaagcgtctcccagtccctggtcccacttccgcttctgcctgaggcgaaggccgtgcagcgtgccgccccgcgtctggagcgcaaactccccagggccttgcatggcggccaggaggtgtgccccgggcacggagcagggcagcagcacctccaaagatggggcgtagctgtgcctctgctccatgaacagcgtgcgcgccacgcctggcgggggggatggggatttgggaggcgcagtacgcgagtgagggcaaggattatgtgcacatgtgtattcgacgcaaccgagcatccatcgcaaggatcctctagtctaggatgtgcatccctaacgttgcgcccattgctgcagtactagctttgcatgcacagggccccataccttccagcatcgaggcgaggggcgaggcctcacgaccttcatggcgcagcttgatcaggctgaacctgccccggcgggtcggcagtaggggcgacgccagtgtgccaagcatgccctccacctcggcacgctcggagcgggaagcctcggccaaatcatggctgtcctcatctccctccaggtgcacccaggccaccagctctggccgtacagccctcagcaggagctccaagtgcggggcgctggcgacgtacagacccggcatgagcagggcagagtcttccagcccagaccaggtcacccacgtcgcgcccggggcgtcctggaacgtccccgggtctgtgctgcgagacaccaggagcgctctagtgggctgcgagacgtctgcaacgtcttcctgctcctcccacacctgctcccagagcaggcgctcgcgggcggcgctctgccgcaaagccgcctgcgggccccgcaatacacagtcacgcgcaactgcgccgccgcccaagtccgcatccagttcgctagaagatgccgcggcgacagagcagaaaaggccagtgggagttgaggaaccaggggcaggggccgcaccaccaccccatgccatagcccctacgcctgcgctgtgcgacctccacaatgtgcaggccgtgatgagtgtggccggccctgccagctgcagcgcggccgtggcaggggcgtggggcggggagtcgggggcgggccgcgccagggttcccatcaaggtgcggctggcaaggccccacgcgccgctgttctttttgcagacaatggatgccagccagagcagccttgcgatgacttccaccnnnnnnnnnntggcgtggggcggggagtcgggggcggggcgcgccagggtccccatcaaggtgcggctggcaaggccccatgcgccgttgttcattttgcagacaatggatgctagccagagcagccttgcgatgacttccaccgagaccctgctgctggcgctcggccacgaagtagaccgagacctctcatttatgtgattgatagaggccacggccgcaagggacgcctgccctgcagccccttggcccggcaagatgtggacctcgcttcggccagtggcgaggcaggtggtgcagctcagcacggcccctggagcatcctgaaggtgcgtcggcatagccacctccccgacaaagggctggagatggggtgaggggtgggccaggcaggcacccgccgcatcgagtatctccagagccaccgccggtggatgaagcgtgtagcgctcaaacatgaccgctggctggccggcggaatgcaggtggcactgcatcgtgaccgtggaggcgctcctggcgctcgcgctcagcagcagcacgctcggtgcgggcaggggccagatgcgggtgggctgcaggagcaccgggagggcgccaccggcggcccttgtggcctcggcacctccgccgggcccggcaactagggcgtgggcgttcacgccgctcatgccaaaggcgctggtccccgtggcccacaggcctggggtcgagcgcgcgatgcccctgccctggcgtgggaggtgtgcgccgccggcggccaccgccgccaccgcgggattcaggtcgcggaggtgcaagccgggcggcatgcgggcgcgtgtggcgaccgccgcagcgcacgccagccccgccaaccccgccgcgccctcggtgtgccccagggcggacttgggcgcgccgaggcccagggctcggcccgcgctctgcggcggtagggcgccgagtagggcccccacctcgatggggtccccgagaggggtgcccgtaccgtgcgcgagcacgctttctacctcaaccccggcgcccgcctcgcccacagcgtcgcggacgaggcgggcctgggagggaccatggggcgcggtgagggccgccgaccgcccgttctggttcaccgcgctgccgaggaggagggcgaggggctgcggtgctgaggggtctgtcgccgtcgccgaccaccgcctcaacgacacaaccgccacgccctcgccgcggccgtacccctcggcgccggagtcgaaggccaggcaccggccggagcgggagagggcctgcaggctgcagatggccacgggggtggcggggctgagcatgaggttggcccccgccgcgacgccgcgggcggcccggcgcgccagcaggtcgcagcaggctaagtgagnnnnnnnnnnggtgctcatgcacgggcctggcagggaggtggtttggcatggcatactgaatttctgaggcttggtgcgcatgacgcaccgagacgatcgtgtcaggactgaggcaaacgctcatgaaagccagaaagagacacctcggcagcacaggctgtctgcctcagagcatgatgcccctccctaagccctgcaccaccatnnnnnnnnnnttgcgcacgacgcaccaagacgatcgagtcaggactgaagcaaatgctcatgaaagccagaaagagacaccacggcagtacaggctgtctgccttagagcacgatgcccctccctaagccctgcaccaccatcgctgctcctccacgcatcccaagatacctgtgaagccaaaggtgaaggagatacggcccaccatgaaggacatggagttgcccagcaccgcagaggagctcagccccgcctccgcggcggccaggacgtaggggtactcctggtacatgcatcccacgtagaccccgaccgggccagtcgaggagggcatggtcaccgttcccaccgcggccgccgtctcctccagcagcaggcggtgctgcgggtccatgcccgccgcctccgccctgcccagcccgaagagggccgcgtcgaagccggccacatcgcccagaaaggcggcaaagcgggcgtagctgcgccccgcggcccccgggtctggggagtagtgcgcctccacgtcccagcgagcgagcgggacgaggctcgtggcctctgtgccgcatgccagcgccaaggcaagatcggacagcccgccggcggcgagggggaggcggcaggcgaggcctgcaatggcgacgccgtcgcccgacagaccggcgtgcccgcgctccaaaacgaggttctgagatggccgcggggtcgtggcggtcctaccatgcgcccctgccagtcgctcaagaatgaaggctgccatgctctgcacgctgggatagtcgaacagcagggtggaggnnnnnnnnnngatggcgacgccggcgcccggcggggcggcttgcccgcgctccaaaacgcggttctgagatggccgcggggttgtgacggtcctatcatgcgcccctgccagtcgctcatgaatgaaggctgccatgctctgcgcgctgggatagtcgaacagcagggtggagggcaggtccagcttccacgcggctgccaggctggactgtagctccactgccgctagggagtcgatgccggccgccatgaggggctccatggatgatacctgggaggggggggggtgtccgagtatgtgccgtagtgtggagtgttgcccaaggtggaatgagatgctatggcaaatgcaatgtgttgcaaggccctgcatgaagctgcagctgcttggagattgcaagtaaaggcaggtcctacggaggacaaaccacagcaaacatgccagtccnnnnnnnnnncgcaatgtgtcgcaaggccctgcttgaagctgcagctgctaagagattgcaagtaaaggcaggtcctacagaggacaaaccacagcaaacatgccagtcctcctcatcgcataacacacaccttgttccctgagatgtcatggatgcgtgacagcagatccgactcaatctcagcaagggatgggactggaaccccatccatagctgcccggttcacttcatcgaaatggacactttgctctgttgctccaccaggcagcgtgtctcctgctgtgaaagcgtctgcaaacactgccatggtgcgggccggggtcgcagccaggatgccaaagtcaaaggggttggcagtgacctgtgggccaggcagaggagagggcttgacaaagagatgtccagcagggatctcattcgcgcagtccctcgctttagcaagcactcacaagggtattgaaaatacatcgctgtgctgcagcccttggccccagggatcaatgaacaaaatcagccgtctcaccagggggtggctgctatcagccatgagggctcgagcaagcatgcccagcccgagctcgggtgggattgaccccagccccgcagcctcagccctggcgatcacggcggaggagccatgtgccatgcccaccctactccaggccccccactccatgctcagccctggggcaatgggaagggatgaattttagtcagaggctgatagcatttgtagttggttggagggggtagtcgattacccgcagagaatagggctacccatagtccagcacctcctcttatcaacctagcaccacactcccaccccacccatcaccttgtaagccagatcgcgccacttgtccagcccaggcgtccagcgctgcgttgatgcccgaatacacagcctgtccaggcgacccgatgaaggcagaaacagaggagaagaggcagatggcctgcagcggcgtcccccagaccccaggcctcgtcagcgcactcaggaaacccgtcttgggagcggccacggcgcgcgccgctgccgcccgctgcctcaggatgatgccgtcctgcagcacgccgccggcatgcaggacggcaagcgaggcggaggagtggcgcagcgcctgcagcgccgacgcctctgaaacgtcgctggaggccgcatggaagtccaacacaggtgcaggggactgagcgcttgccccgacgcggccagaccggccaaccaagcatagctgcactgaggtggaagctcccagccaggctgccagcagcgatccgatgcctgcagaggcgcagccgggacaagagcggatcaaatatgccgggcgatcttcaccacaagctgcagttccacactgcagtctccttttgctcccctgacctaacacagacacaaaatcacaacaccaaacccccctgcctcacctccgagtccgcctgtnnnnnnnnnntgagtatgccaggcgatcttcaccacgagctgcagttccacactgcagtctcctgttgctcctctgacctgacacagacacaaaatgacaacaccaaccccccctgcctcacctccgagtccgcctgtgatgagaacgtgtgtgccgagccgctcagcgtcgatggctggcgaggatgtgccgcgcagggcatgggccaccaagaggggaagagttgccaccccctcgcacaccgcgctgccgccggtgtccccacccagcccaggcgccgcgccgtcgaccaggctccagcgcgtctgcggggcctctgcagcggctactctggtcatgccccacccgacggcggccgagggcagggggctcgcgccggagctgagcccggggccggagccggggtgcgcgcctcgggtcgccagggccacgctgcgaggcttggcatgcgccagaccctgcagcgctcccaggagggtggccaccagggtcccggcgcctgcacggccacgcagcgccagcccagcaggtcgcacatccgccggcgcgtgcctgcccccgaccgcgacggagatcgcgggctgggatgcgcccggagctggacgccccgcgccgggctgggaggcctgccacagcgtcacgtacagcgcctgcgctgcagccctgggccccccacgcgcctcgccggtggccctctccggtgccttcgtgaagggcacctgcctggcgctggggcgtgcacccctccctgcccgcacaggccccgcagaggtgcccaggtccaggaagtcgnnnnnnnnnncggggcgggtacccctccctgcctgcacaggtcccgcagaggtgcccaggtccaggaagtcgcccgcaaccccggtcggcgcaagcatgcggtgtctgctcagggcggcgccggagaccacgctccccgtcacgtgcaggtccagtgggccgcgctttcctccagactggcagcagcccacggccgccacgctggcgggcacggccggnnnnnnnnnncagcatgcggtgtctgctcagggcggcgcccgggaccacgctccccatcgcgtgcaggtccagtgggccgcggtttcctccagcctggcagcagctcacggccgccacgctggcgggcacggccggcgcccgccccgccgcagctgccatgtgcgcgcccaggtgcaggcaggcgtccgcggcgaatgggtccaggcagaatgtggccgcgtcaacgcggccggggcgggtgcccaagtgtgccaagggaaccagcgctggagggagagcggcacggtgtatggtggtcgcgagtgcggcccttcccggcgaggaacgctcggcgggcacccgctctgcagccatctcagctggcgtgctcccgttcgcggcagcccacgccgacatgtgctctatcgcgnnnnnnnnnnccccgctctgcagccatctcagctgacgtgctcccattcgcagcagcccacgccgacatgtgctctatcgcgcgagaatccatgcccgccacggacagccggccggatgggaggtcgaccacagtctccagcgccgcctcggagatgtcacccgccgggacgcacggcgcgctgaaaaccacgcctgccaggccgtggcgcggcgctgcagccgccccgccccgccagcccagcacgnnnnnnnnnnagaaaaccacgcctgccaggccgccgcgcggcgccgcagccgccccgccccgccagcccagcacgcccaccgcgccgaggccagcctccacgagcgctgcgcctggcgccaggggccggtccgccacccagtggtccaggaggtgcgccaggcctgcctgccccagccggcagcgcacgcgtgccctgcgcggcgagatcgctgccggtgatgcaacgtgcaggctcgccatgagcagcgcgggcggcagcggccacaggctgcggatgggttccgggatgggtgagaggatgtgcagtggagagactgttgtgcgacgcaaagcacatggcactcctgttgctgtggccccgcccaacaaaggcacagtctgtccaccatccaacggcccgggctcctctggcccgcgctgcgatcgcgattcagggaccatccaaggccccccccccaccaatcccctcttctcacctgctacgacgccaggccttgggccgcgctgcggtcgaacagtccccttcctcgcccgcgcggctcaccannnnnnnnnnacgatccagggaccatccgagggtccccccccaccaatcccctcttctcacctgctacggcgccaggccttgggccgcgctgcagtcaaatagtccccttcctcgcccgcgcggctcaccagagcgtgcgcgttggtcccgctcatgccaaaggagctggcgcccgcaaaggcacccgcccccgccccccctggcaggggcgccggggcgcgccccgcgccgccgcgcnnnnnnnnnngggaacccgcccccgccccacctggcagtggcgccggggcgcgccccgcgccgccgcgccgcccggcccggcgcggccactcggtcagcgcggcggcgacgtgggggttcagcgcgcgcagcgtgggcagcggcggcagcgcgctctgcgccagcgcctgccaggccgcgcagaggcccatcagccccgccgcgccctccgtgtgcccgtacgtcccctttgccgcgcccagggccaggggaatgggtgggggaggctgcgtcttggctgggcttggcggcagagacgcggtcgatgacctcgccgcgccaggcgcggaccccccgcccttcccaccctgcagcgcggcgcccagcgcgcccacctccagagggtcgccnnnnnnnnnncaggctgcgtcttggctgggtttggcggcagagacgcggtcgatgacgtcgccgcgccaggcgcggacctcccgcccttcccaccctgcagcgcggtgcccagcgcgcccacctccagagggtcgcccagcggcgtccccgtcccgtgcagtgcgaggaaggcgaggcggtcgacctccgccgctgcgcggcgcagcagcgtctcgacaagtgccgcctgcgccgggccgctgggcgcggtgaggccggcgctgcgcccgtcctggttcacgcccacacccaggaggatggccaggggcggcgtggggccgggggtgcttccctcgaccttctcgtctgtcgggtgtgagtcctcgcccgcccaggccaccccccccagcaccaggacgacaaacccctcgccgcggccgtagccgtcgcccgcagcgtccagggtcaggcagcgcgcggcgggggacagcgcgcccatccccgccacgctggcggaggtggcgcctaggagcatggcgttgaccccggccaccacccctgcgcgcacctcgcccagcgccagcgcggtgtgcgcagcgtgcaccgccaccaggctgctggagcaggcggtgtcggtggccaccgccgggccgcgcaggccgtgggtgtaggccacccgccccgccaggtagctcagcccgctgccggtgatggccgcgggggagaggggcaggcccgcgccgtgcagcacctgcaggaactcggagtacatgcagccgacgtaggtgccccagggcgtggcggagggggaggcgggtttgggggggtgggctgcgtgcagcgccgacgcgctttcctccagcagaatgcgcgcctgagggtccattgcgccggcctcctgccccgccagcctgcacgcgggggggaggggagggggggggttatcaggggcttttatggggaagcatctgatgagcagggtgccgagtagcagatgcgcctgctccactgaatgtatggtgaggcaagagttgctcagccggctcctggcgagcacaaagtgaaagccgagaatagaacggccagctccacccaccccacctgaatgcctcggcgtcaaaggcgtcgatgccgtccaagaagatgccatggcggacgtacatgcggcccggtggggacggtaccgcggggtcgtagtagagctccacatcccacctctgtggtcgggcgttatggagggagggagtcgctgcttcagaaagacgcacgctctcaatctgtgtgctattccaagcannnnnnnnnnaccatggcggatgtacatgcggcccggcggggacggtaccgcggggtcgtagtagatctccacatcccacctctgtggttgcgcattatggagggagggagtcgttgcttcaggaagacgtacgctctcaatctgtgtgctattccaagcagctctgagaatcaggatggtgcattgcagagaccgcacccaggtatcctcgcctggaggggaatgggcgtgaccaggttccgcccgtcgagcagtgtcccccagaaggcggccatgccagagagcagcgggtcagcaccagggaacctgcccgcggtcgaccagacggcggttgtagggggtgctccagggactgatggtggcgagatgtgggatgggagcgcaggctgccggtcctgggagtggacctcgtcgacggctgaggcatcctcaaccggcccgggggaggggtgagcatcctcatgtgtgggcatctcagggactacattgttctgcgtgcagacccatcaggatgagacactgtgaaataagcagtcattggaaggtgcacgatgccagacttgaatccccataacagcaaatgtgaccctgagggcaacacctgtacatgaagcccctgctacaaacctccttctctctnnnnnnnnnngagggggtgccccagggactgatggtggcaagatgtggggtgggagcgcaggctgccggtcctgggagtgnnnnnnnnnnttccccataacagcaaacgtgaccctgacagcaacaaccgtacacgaagcccctgctacaaacctccttctctctcctccacagacctctgtcatgattgactggacagtcaagggacctggtccccagtctgggacggtgcgccccacctctatcatctcagatacgatgaagtcccgcatgctgtccctggtggggtagtcaaagctggctgtggcggggaggtccagcccaaaagcgccagccaggtcgttcctcagatcgacggcgccttgattgttgttgtggggcggcggctggtgttgacaaccatggagcatagccaagcaagaagttgaagcgggtgctccctcgagccattgtttcaactgtgaatgcaaccatgcacaccaataccatnnnnnnnnnnaccttggttgttgttgtggggcggcagctggtgttgacagccatgaagcatagccaagcaagaatttgtagcgggagctccctcaagccattgttacaattgtgaatgcaaccatgcacaccaataccatcagcaaacccacccctgccctcccacctagggagtccaggcctgcttcggcaaatggctgatccgctggtatggctgcaccgagcagcttctccacgaccatctgcacagtcgaactcacagcatcctccaagctgggggcagcggggtcctctggcagcatggcaggaatggcaggctcaggctctgagcgccgtgctcgaaggctggtaggggatgctgttgcatcaggaatgccagctggcgccggtctgatgcttgccgtcgcaggctgcggaggtggtgtcggcattgggcatggacagctgccacagcctggccatgcacgcccacacagcctgcgtccctcatcacacccattctcacaccatccctnnnnnnnnnnactgcggaggtggtgtcggaattgggcatggacagctgccaaagcctggtcatgcacacccacacagcctgtgttcctcatcacacccattctcacaccatccctcaccctgagctcaaagctggaaagggtgacatcactctgtcccagagtgatgtctgcaagcacagtgtccagaagctgggcctggccccggcccgtcgcccatccagcatttgcgtcccctgaccgtggcgcgccagtcccagctgaggcagtggaaatcgcggcccggatgcccaccggcatcagcagctccccgggcttggcatgcacaggccggggcaggctgcagaggacatggctggcggcatccaggcgagcggggtgggcgagggcgctgccatccggctggcagctggtgtggagccgccgtccgttctcttgcctctgcccagcatcctccaggcggcccactgccgccgcgccgcctgccgtgctccctnnnnnnnnnngtgcgtcccccgaccgtggcaggccagtcccagctgaggcggtggaaagcgcggcccggatgcccaccggcatcagcagccccccgggcttgccgtgcacgggccggggcaggctgctgaggacatgggtggcggcatccaggcgggcggggtggctgagggcgctgccatccggctggcagctggtnnnnnnnnnntctcctcccgttccaggaaggacggccttgaggagggcggaagcggtggccacgaaggcgtcaaacatgcgctgctgcagcgaggggcgggggggcgcccgcgcacgagccgcagccagggcggctgctccgcgcgcctccagcgccctcccttccaggggatggtggagcgagtggatnnnnnnnnnncccccacccgtcccaggaaggacggcctcgaggagggcggaagcggtggccacgaaggcnnnnnnnnnntgggttttatgttctcctgcctggcgcgctgagcttaccggacaatggtatgcatttgtatgcacttgtctgatggactctctgatatgctttcggtaaattgctcaagcactggcctccccgattccatgnnnnnnnnnncgggtttcatgttctcctgcctggcgcgctgagctcaccggacaatggtatgcattcgtatgcacttgtctgatggactctctgacatgctttcggtcaaatgctcaagcactggcctccccgattccatgaaaacctctccctccgcttcatacaaaccctacaaacaaaaacaaccctagctcaccagcctggctcgtggcgtgaagctgggtcccgcctcctcccgccgcagtcctgctggccagctgcatgccggccctggcaacatcgacatccacgcccacctccatgcccctgcccggatgcagcatcaaaggagcgctgatgctcaggcgctccacaaagacattcacggcgatacccgcgttgtatcccggcaccacagcggccgccatgccctccagcatggcggctgcggggaggacgcagcgccctgccacccggtggtccagcaggtacgctgcccgcgctgcgccaacctccagccggaagcgcagcatgttgtctgggcggggccggactgaacttaagaggagcagggctgccggcccgaaccagtgccgctcccgcatccagggcgtggcggagcttggggtgggggcgccctcgcccccgggtctgcggtccagcaccgcatgcgcatttgtgccctggaaggcaaaggcgctgacgccgcaggccacgccacccaggcgctccgccctgccagcgccctcccgcgccagcaccggcgcaggctgcccgcgcggcaggtcggcgaggcacgcggccacgtgagcgttgactcgcgcaaggcccaccagggggtgcacgctgtgtgcgnnnnnnnnnncggctggcgaggcacgcggccacgtgagcgttgacgcgcgccaggcccaccagggggtgcacgctgtgtgcgctgagctgggcggcggcctgcaggaggcccacggcgcccgcggcgggctcggcgtggcccaccctggccttggcggccgagagcctgatcgcgccggggagcgctgcgacggctgcgttcacctcgatggggtcgcccagtggggtgcctgggagggaattggaggcgctcgggtgagtgtgagcatcggcatgcccaaggatgcagtgcgctcctgtcacgctctccaccgagcacgcataccggtgccgtgcagctccaggccagcgagctggggaggcgctagccccgccagctccagccccgtgcgaatgacccgggtctgggcggggccgttgggcgcggtcaggctggaggagcggccgtcctggttcaccgcgcagccgcgcagcaggatgacggtggctgggccggtgcgtctgccgccgtcgtcacgggcacccacagggcnnnnnnnnnntgcgcagccgcgcagcaggatgacggcagctgggccggcgcgtttgccgccgtcgtcacgggcacccacagggctgcaaaggaccagtgccgccaccgtgtcggctcgcacgtagccgtctgccgccgcgtccagggtcttgcagcgcccatcctgcgtcagcatgcctgccgctgccgcggcggcggaggtgttgcgtgccagcagcaggttcaccgccccgaccagggcgggggcgccggggtctacccggcccgcacccaggctcagggccaccagggccgaggagcaggcggtgtccagggagactgcggcacccgtcaggccccatgagaaggagatcctccccgccgccacgctgaaaggcgtggaggtggccgaggtggcgcccagggggtgccaggcggcgctcagcccgccatactccatctgctggatgccgacatgcacagacgttgaggcggggggctggtacgatgtgggggagaatgcgccgctgaaggcctcctgtgtcacctgatgggtgnnnnnnnnnnaacatgcacagaggttgaggtggggggctgggacgacgtagagaagaaagcgccactgaaggcctcctgtgtcacctgatgggtggaggtttggagcggacggatttctgagggccggcggagagctgtactcggggaccaaagtcatcacccagacattgtctctcagacacatacccctgcaatnnnnnnnnnngtttttgagggccggcggagagctgtacttggggaccaaagtcatcacccaggcattgtctctcagacacatacccctgcactgcttcacttgagggagcaggcagaggggtgacccatcctgcatgcccatcgccctcacctccaggaggaggcgctgctgggggtccatcagctcnnnnnnnnnnnnnnnnnnnnnnnnnnnnnnnnccggcctgtttggaaagggttgaatatgggggtgtcagctggggtttgaatcacagtgaagctggttggagtcgtccccggagttggcaagattgggatcgctcctcttcagtagtgagctccagcaccggttaccagcgtccaaagaggcatgatcggagaagcagcgacggtctggacagaacattacgccgcaaatataaggaaatgcaaacccaaacaacataccttggagggcctnnnnnnnnnnggcctcggggcggagcaggccaaacagccccgcatcaaagtgttcaacaggctcatgcagaaacccgccaaagcggggggcactcatggcccagctgcttgtannnnnnnnnngatcggggtaaccagcgtcccgagagccataatcggacatgcagcgatagtcgggacagaacattacgccgcaaatatgaggaaacccaaacccaaacaacataccttggagggcctggcctctgcgtcccagcggctccacggcaccaggccaatgcagtcactggagaatgcctgatgtagtgggcctggggtgagtgccgccatggctgcgacccagacagcctggtcgagagtgctggctggatcggaaggttgagtgggcgcagcaatggcttgccctgctggcgcaggcagctccgcaccacctcccaggcgctcagacaccgcttgcgcgatggatgggatggaggggaagtcgaagaccagggtgacgggtagcgtcaggcccaggctctgccccagctttgacgccagctccaccgccgacaaggagtcgaaggctcctggggccgggtgttggacgggcagggggatgagggcttgacgtcggagtgtgcctgacaagcgggcatcccgccactgaggcaggcagagtttcagtccacatccccgattcactcaaaacgcattgctcgtgccccggtaccactccatccagacctgcagcaaacatgccggaggaggtcagggcgtctgcgcccaccacctcgatggcaacgccctgcacgagagcgagcagctccgtctgatcgatgtgaggccgtgggggctcccaatcgggaacggcttcctgctgctggcctggagaggtatgcagccgtggctcccctgtctcgcnnnnnnnnnnctcgatgtgaggccgtgggggctcgcgatcgggaacggcttcctgctgctggcctgaaaaggtatgcagccgtggctcccctgtctcgctccgctcgccggcctgaagcccgtccaggaagctccaggggcccttgatcgagttgacggcgcaaaaggtggggaggctcaggcgggccacgacggcgtcccggaggccctgcctcagcaccgtcctgagggcgtgcaggatctgcgccggctccagcatccccagccccaccgcctccatggaagcgctgcgaggaaagcaaggcggagattgatgaaggtctgaggctgatgtgagagcgaaccctgcacgatcccacgtccatctgtgtgggtagcacctctgcacatccctccattttcacctcatggagacggccatgcctgcgccagagaaaggaccaaaggacagcgtgaccacgcggtgtgagnnnnnnnnnngttcacctcatggaggcggccatgcccgcgccagagaaagggccaaaggacagcgtgaccacgcggtgtgaggccctggccctcaggaaggagttggcagctgcgtagtgagccgcgcccgactggctccaaacaccggcggtggatccgaagagcagcgtcacctctgcatctacgccggtcaccgcgcccagcacctgcgtggggaaacaggatggtcacggtgatgcattccggtttgagatgtaggattgctgtgccacaatgagaatccaaagattccttgggtcctccgtctcagtcacctttggccgggccaccgccaagaaagcgtccctggtcannnnnnnnnnaagaatccaaagattccttgggtactccttcccagtcacctttggctgggccaccgccaagaaagcgtccctggtcaggtcagggatgaggtcgtaggccagcacacccgcggcgtgggcatacagggctacaggaggcaggtcctgggaggccagccaatgtgccaggtccgcattctgggcgggactggacgcgtcctggctcagaacaaagacctcggtgcctgaggcagggtggggttggaggttctgttgtcacagtgtgcagagggnnnnnnnnnntggtgcctggggcagggttgggtcggaggttctgttgtcacagtgtgcagagggaagttcaagctgacgcatggggcatttgtggaatcgaacgccaccccttttcaaccctaccctgctcacactcatcccagacatgaagcgggactcaccatgccgagcaaagaagcgttcatcctcctgggcagccagcttgccgcgccggctggtgagcacgagggacttgaccccggccctggacagctgcctggccaggcgcaggcccaggccctgcgtgcctccacagataaaagctgtcttgccttgcagctggagttccagggcggggtgagggccggcaggagtcacgtggcgccgcaggtgctcggagaagaggcggccgcttgcaaccgccagaacgtactccgtcccccgcccagccgccatgactgcccggaactgggcggctgtgaccccgtcccccaggtccagggtcacgccgtacgagcccctgtcctccatgaactgggtgcgtgcgacccctagggctagcgcctgatgcgcggctgcctctgaaccggcgggtcccagcaggccctggctgaccaggctcaggctgtgcctcttggcggcagagcccagcgcacaaagcgcggccgccgtgtacgcccaggccatgctggcggcgtggaggcagggctccggcgctggaggcgccaggaccaacacagcttgtaccttgctggaggagaggagggcatgcaggcctgcctcggtgctgacgacgagctctgtgttgcgagggggcagccaccctggcgcagctgtctcctggcagcgcgtgacgcccagcatacagccacgcagttgttgcaggctggcgggtagcgtcatggaaggtgttgcattatctccagaagtgtcttgtgcgatggagagcgccagccagcgtgcagagtgatcactgcggcagggagggtaggattgagtacatacatgtgggcaggatgtggagatgacactctatgggaacctgaaatatccccgccatacctatcttgcggccagtcaaccggagaccactctgtcgtgtagagcaactcagagagggagtcctgaccgcccctgacaagaggcttggaacagcctcccttgagcctacatccaggcagggtagcagcatccaaacccgcctgcatgctcgcccagctagatgtgtctccagcaagctcttctggcagcagggcgtccagtgcggtcaagccatgggggcagtgaccaggctgacccagggcaacaagcgtgtccaacgtcctccatgatgtacaggcgctgctgtcctgcttgccgctctgggcaaggtggcaagtgaggttcacggggagtgcctccttcaccactccatgcagcagcaactcaggcagaatgggtgaccccttgcggcaggaaagatcgtaatcagggtccacacgcttgcaggatttgcctctccagggcccaatctgctgcattgctcctgctagtagagctacatcatttcggccagcggccgccacattcactgtggcggtaagaaagtccacccccacttcaattctcgttgccaaggagtcgaaggtggtgggcagcgagatggatccaagacctgtcctgcctgcatttgttggagtggcatagggcctgagcaccatgagcgctgcagaagccaggccgatgacgatgcctgggaggaggatgctccctccctcaaagctgctatccgcaaaactccagctggggctcaggtaggcatggaaggaggctgctcgtgagctggaaccaatgctggcgacggtgagccatgggtgggctgcaggcgacacccacacactctggcgctgccatggaatgggcggcaaaattgcttcagtatccaatgcagtgcccgatggtgcgtccagcagcacatgagcattggttccctgccatgtagaaaaggtggtggcaggatatttgataccacgagacaggactaacattcgagttgcatgcacatgaagagtgatttaactcgaagcctactttcatacactatcaaaataccccctgacaactagcctggaacgcgaatgcggacactcccgccaccctcgcgccctctgtccggttcaggggagcctcctgacggggcaggaggaacgcacggcggccgacggctccctgcacatgtgggtttagcccgcggaggtgggtgatcgctgcgtaggcgccgcgctccatctggctcagggcgtgcacaacccccgtgctgccggccgccgtctccccgtgccccacgcgcgacttggctgccgtgaggaccgggccggcgcgggccgggatcaggccagccaacgcccccagctcgatggggtcgcccnnnnnnnnnncgcggtgaggaccgggccggcgcgggccggggtcaggccggccaacgcccccagctcgatggggtcgcccagcgcggtgcccgtgccgtgcagctccaccgccgccaggctggccgggatcaagtgggcggcgcccagcgcggcgcgaaccacggccacctgggcagggccggagggcgcggtgagggccgaggaccgcccgtcctggttcgccgccgtggcggccagcaggcatgtgttgccaggggcgcggccgaggactgcgctggattgcgagcccaggcggagcatggagcagccctcgccgcggacgtacccgtcccccgcggcatccagggtcttgcagcgcccatcagcagccagcatgcctgatggtttcgtggggaggggcgggggtaaagtggttgtgtgcccgggtctccaaagagcaagacctcgagccctgccagcagcccagcacagccttcccaccggtgatggcaaaggctgcggtcctcaggggagtcagggtgaggctgacccccgccgccagggcctcctcgctgtccagcgacctcacgccctgggccgcagcatgcagggctaccagcgaggaggagcaggcggtgtcgatgcactgggaggagccgtgcagatcaaaaacatacgacagcctgcgggtttgggtcggtgtggatgaggagctggggaggnnnnnnnnnnagtctccaaagagcaagacctcgagcccaaccagcaacccagcacagccttcccaccggtgatggcannnnnnnnnnttgggtgcaaatgggaactgcgcggaaatacatgcatcaactctcacgctggctttaaaatcacaatgttaccttccggctgcgacactgctggctcccccgctcgcaaagtagagggtcagtgcctgtcggnnnnnnnnnngtgggtgcagacgggaactgcgcggaagtacatgcatcaactctcacgctggctttaaaatcacaatcatacctgccggctgcgacgctgctggctcccccactcgcaaagtagagggtcagtgcctgtcgggcagtgagatccaggtaatccacggcccctatacccacggcaatggcggtgctgggcaggagagcgcggcaggctgacagctccgcggcgcagtccaggagcagccgctgctggggatccatgctcgtggcctccgacctggtgggtggggatgtgggactccactggtgtagagcacagtgcgacgagaggtcacagccaccacaagggtcggagataaaaatttcaccctccttgaatctgcacaatccannnnnnnnnntgggatgtgggactccagtggtgtagggcacagtgcggcgagaggtcacagccgccacaagggtcggagatgaagatttcaccctccttgaatctgcacaatccaatcatgctcaccagttgacgccgtacagcccagggtcaaagaggtctgcctctggcaagatggccccaaagcgggcctccaagcctctgggtgggttggacacatactggtcgacatcccacctgctcagcggcatcactgcagagcacaggaaagggaggcgaatggagtactgacgcatgttgtaaagatcacagcgtccgaatcaagccagcagcgccctggagtaaagacagagggccattgcaatcatatgatgccgccgtggcctctgactgaagccgtacctgtaatagcatcctctgggaatcgaccagaggaagannnnnnnnnntgcgtcaagccagcagcgccctggaataaagacagatggccattgcaatcatatggtgccgccgtgacctctgactgaagccgtacctgtaacagcatcctctgggaatcgaccagaggaagactgccaaccgctttctggagccggcacatgaccagcatggtccaagatcagaacaacctgtgcgcttgcgaggcaagatggcgttactaattggtcttgagtttgtaaacgggtcgacctgaaaagtcagggagtcgcttctcagagacaacagccctgaaacctatattgaagagaggcctgatcatgtcaatcatgatcttaaagccatgtcaaactccgctgccttaccacttgactgcccgcnnnnnnnnnnaaacaacctgtgcgcatgcgaggcaagatggcgttacaaataggtcttgagattgtaaacgggtcgagctgaaaagtcagggagtcgcttctcagagacaacagccctgaaacctgtattgaagacagacctgatcatgtcaatcatgatctttaaagccatgtcacactccgctgccttaccacttgactgcccgcggtgaggtttgctgcaggtgtcagacggccatcaggagttggctgcacgtcctccatcgtttccatgtccccatcgtcttcctcatcgccagcccccagtggcagcannnnnnnnnnatcagacggccatcaggtgttggctgcacgtcctccatcggttccacgtccccatcgccttcctcatcgccagcccccagtggcagcatcagggcatcgatgtgctttgccaaggcagccggggtcccatggtcaaagaccagggtggctggaagctccagtccggtggcggtcgccagggaatttcgcagctcgaccacccccagcgagtccagccccgcctccatcaggggctggtgtgggtctggcagggtgcctcccaccagctcctgtacagcgtctaggatcatcggcagggttgaggcggcccgatgggtaggcccagagccacgtgcttgacgagcggtgtgcgtcatttcctgggaaggtccggagatcgggctgctctcctctggagccatctcctgnnnnnnnnnngctggcaaggtgcctcccaccagctcctggacagcgtctaggatcatcggcagggtggaggcggcccgatgggtaggcccagtgccatgtgcttgacgagtggtgggcgtcattgcctgggaaggtccggagaccgggctgctctcctctggagccatctcctggaagaagaagggtacctggcccctcgagccctgcgagcaaccagggtgcactcatgtgttgggaggagctggacttgctaggctttggctattcaacgctcgcatttcacatcctgcagtgcaacccaggcaagtgatctgctgctcaactgtgcatctacttccgcgttatcagacctgtgcacacccaccttgagcagggtcccccagatcacaggcacggctgccaggaccggcatggagaccgaacccagcagcctcaggctggactccagcactcccaagccctgtgcgggcgtcagcagcaggaggccggtgcgctgggcacgctgcctcaccacctcgtcggcggccatgccaatctcccaggcgccccactgcagcgcggaggcctgcccccccgcgccagccgccaccgccgcccaggcctccagccccgcgttggcggcggcgtaggtggcctggccgggcgcgccaaagagcgccgcggaggaggagtagagcaggaggcggtcgagcggctggagcgccgtgagccggccgtgcatgctttgcgcgctgagcagcttgggggccgccgagacgcggacggcagcgacatcctgccgcgccagcacgccgtcggtcagcacgccgccggagttgacgacaaggcccaggtggcgcaggtgctgcagggaggaaagcgcggccgcgtccgccgacgctgcgccgtcgcccgccaccatggacactagggaggaggaggagcggagagcggctccgtgggtcgatcgtggcgccagcctgcgattatattgtagagtgggatgacatgggagagggattggggccttcattgtgcagtcagtggcctccacacctggcgccaaccgcacctggcgctgcgtcccagcagcacgacgtgccacgcctccttcttgagcagccatgcgccggtgagcgagcccagcgcgcccagtccgccggtgacgaggcagctcccgtgctctgtagtctgttgcacgacagggtatgggggcagagtgtgatgtggcatgtgagggtctcaaatcctatagagggccgctgttcaaaccactgcacactcttgactcagacgtcgcagcagacacggcggtatactccgctcaccttgatgccagggttctnnnnnnnnnngcctatagagtgccgctgttcaaaccagtgcacactcttgaatcagacgtcgcagcagacaccccggcatactccgctcaccttgatgccagggttctggaccaccaccttccccacatgctgagagagggagagctgcctcagagccgttgccgtctgggacagggtgtaggctgtgcacggaagggctccgagctcccccctggcaagcagtgcagacatgcccaggaggcatctgcccaggacctgcgaggtggcaagaaacagcggcatctcatcaacaatgggcgctgcgagtatggtgtgcgctcgtgcaaacggagcagcgtgagggcatgctccgccaacagcaaacctgtggtgggagaaagtcaatggcgaccgtgctgaatgccacgtctggtcgctcctgcccgacgcggctggcggcgtggatgtcacgcttccccacctccacaaagctgcctcccctggccaggacagagagggaggccgctgtcatgcctgttcaggagcatggggtgggacttgtgattcacgtgcagtgagggcactccgttcaagcacgggagttgctgtgcgaggacatgcaccatatgtgcagactacatcccattgtgggcaaccgtcccaaatcacatcctgaatgcatcagtcccaccagaacgccccacaaatccacccgagcatgacctggagaggtgagcgagttcaggaccaggctgacgctccccaccacgaccgcaaggtcctctgcaaaggtggtggacctggagtccaggcagaccgccctgccctccagcatcccccgcagcctggcgcgtttggccggcgtgccggcggtgcagctcaggactttgcaccccagccctgatgccagggaaaggaccgcgaggcccacccctcccgtggcagcgtgcaccagaacctggtggggggaggccgtgggtgaataggacgtctgcgcatagtggcacatacaatgtacccggggtgagacgccctcctcatgcaacattactgcatcacctcgccgtgcatggccccactccggtcaagcacccaccctggagtgagggccgcaggaggctgcctgctgcagcgccagcatcgctgtgatgaagacggtgggcagcgcagcaccggtctggtagaatactgaaggcgggagcggggcaaccaggtctgccaagacacgcacgcgctgacccaggcagccgggcgccagcccaaagacgcggtccccgggcctgagcccaccgccgcctccgggattggacaagactacgcccgcgcagtccgctcccgggtcgccggggtcgccggggtacatgcccagcacattcagcacgtccctgaagttcaggcccaccgccctcacgtcaatctacgatgcagaggattggaaatggcaattctgtcggcgttgtggggaatgctgtctgccttgcttatgcagtgaaaggcttggtctcgatggtagaatgggccggcctgccatacgccatcattctctgcacgatatcagatatctctgcacacccctgtgcacctctatgtggccagtctccactggctccatgctgctggcaatagggacccatcgcagggaggacagggagccgcggggctggggaaggagccgtgcctcctgagcaggggcgtgatgcagagcctgctcaaccacggggagcagtttggctctggacagggtggcgccccggacctcggctccataagtatcgttctccatgtcgtgctgcagcttggaggccgagggtgaactggtagcgccattcctgtgcagtttcactgccgatatacgggcattcaactcgccggcagccaccctcgccagcgcggccatcgactcccagtgcgccgatgagccggacagggctagagagccagagcgggcctgcccagcgaagccctgtagcagctgaagcattgtggccgaggcagctaccgggaaggaaggggcttggagaagctttaccgctgtgctctcgccctcctcatgctccatccatggctgggtcagtacagacaggatggcattccccgaccggccgctttgtgcgaccaagagagggtctgtagcctggagaagggcccggtaggtgatgccctggttggcccgggtctgagccgtgggtccaggttcagaacccagctctctgaccctcaggccggacaagcgccagcctggggggctcgcactgctggctggtgctgcatccttgacatgggcgaggtcgatggaatcctttgcctcagctcttgccatgaagaacagggcgccgcagccatgcccgccagaccggccgcccagctcacaggcgtccagcccaactggcacacgcagggaggagctgcggggtgccgccgccgctggcagctgcagcgagctgtctgtcgcggcggggtggctcaaagcgtagttggccgaccgggctggtggctgaacggttgccatgcaggcaggggagctgcgacccgtggcagggtcaaggaggaggccaaggttcagcattgcaaggtatgcggcgccaggctggccggcgatgtgagaagctctgtcaccggcttgatcgacggcagctgccacaccaggccctgcccgtccccgggcatggatccgaacaaggccattcgccgccgccactgtgcacaggtccagttcgccgtgcttggacacccgcagcctgtgcttgccggccgcggcgtgtgtgcccagatggagcgcctccagcactgcaaaccccgtgagcaaggccgccccccagcgcagcgtgcccagcgccgccgcgcaggcctccagcatggcggcggcgggcgccagcgtgtggccctgcacgacgtggtcccgcagtgtggcgcccaggctggggccttgaagatccagctcaaacgcgcagcaggcgcttgcggagggttccgctgacacggccctgcgcaacacaaaaaaggcgggggccagggtccattgcttcgcctgcagccttaccacgcctgccggcgtgcctgaaaattggggacaggacagagggtgggcaggcatgtttgagagagccttgacatgggcatggcgcatttgggaatccctcatgannnnnnnnnncgggcaggcacgtttgagaaagcctttacaagggcatggcgcatttgggaatccctcatgatcgctcaagatgggaggtgctcagagcattatgacggggccctttgctggggggcaggctcaagaacctgnnnnnnnnnncgggaggtgcacagagcattttgacggggacctttgctggggggcaggctcaagaacctggacggcacccattgtgaggccgagctgacatgttctcagggaggacctggccaatctgcagcggaccaccccctcctactctctcccagaatttctcaccgcctgcgctcggagtcaggccctcctgggcggcctctgtccactcaaatatggcgtgtgcattcacgccgctcatcccgaacgcgctggtgcccgccaggggctggtgcagtggcgccggcgccagctggcgagggatgctggccaaaaggccgtgcctccggggccagtcgccaaaagtcgtgcccacgaacggattcatgtcgcgcaggtgcaggacgggtgccgccgcctgtcgcatggtgtggaggcatgtggagtgaaatgacgcactgcctttgcacgaggtgtacaacgctgggccatcttcctgcctgccatcgggcagtctgtcaagtcaacccgcagcagcatgcagtgaagacttgtccactgactttgtctgacagcgcgcacagggcctgcagtgcgccggtcaggccagcagcgccctccgtgtggccatggcaggacttggtggcgcccagggtcaggggccctgagtccatgctccgcgccgctgccgaccccagtgcgcccatctcgatggggtccccaaggggcgtcccggtaccgtgcactgccacgtatgacaggtcatccccggcaagacctggaaggttggtcggggggcgtcgagcggtttgtaactgttgacaaacatggggctagaggagcctgcactcctgaatggtcgctgtaaggtctccagggaccaggcgatgaaagtgattgcgacgtcttacaccaccctatcctcctcactcctgcatggtagctgcacctgcaacatccagggccttccggaccagcgcagtctggctaggcccatgcggtgcagtgagtccgctggacctcccgccctggttgaccgccgtcccgaccaggtaggccaggggcgccccggtttcctccccttcacccatcggcgccaggaccagcagcgcacagccctccccccggccgtacccgtcgcccgctgcgtcgaagctgcggcagcgccccacgggggaaagcgcccccaactggctgatacctgcggcagtgccgggcagcagcatgaggaagacgccggcggtggtcgccagctcagcctccccgcccagcagccccgtgtgggcaaggtgggtggaaaccagggaggaagagcaggcggtgtgcgtgctgacgcagggcccggtcaggccaaaaacgtaggacagcctgccgatcaggaagtccatgccgttgccggcggtgacggcagggcccacacccagccctgccgaggccagggtggccaggaactccatgtgcatgacgccgacatacctgggcattatcgagtttggtggggggggttctgaagtatgttgcgggaacatcaaggcacctgtagctgcaggttttacacaacttgaagtcattgtcacagcaccacaggcactgtgctgaaatgacctcccacgtcacccttccagacttacaccccgcagttgagactgaggctggctgcagatcgcccagcagcttggctcaggccttcctgtgtctgctccaggaggattctggcctgcgggtccatcaccgagctctcggcatggccaagcctgcgtgttcgggttgtaatgagtgtgatgggagtgggggtgttggcgagatgcaggtgcagatatgttctttctggtgcagatgtcttgccccagactcatgcagcgaggtgnnnnnnnnnncttgctccaggatcgagtgccagcatcctggtattactctgcccatgtagagcagagatagcgcaggcaggatacctccctaccctcaccagagatgtccgggctgtagtatgnnnnnnnnnngatgagtgtgatgggagtgggggtgctggcgagatgcaggtgtagatatgttctttctggtgcaggtgtcttgccccagactcatgcagcgaggtgtgtcagcaccacacctgaaggcatccgcgtcaaagtcctccagtccagacaggaaggctccgaagcggacgttcattctgccaactgcacacgtgtggatggtcggctaggtttttgctccaggatcaagtgccagcatcctggtattcctctgcctatgtagagcagagacagcgcaggcagggtacctccctgtcctcaccagagatgtccgggctgtagtatgcctccaggtcccagcgagccagagggactggcgtgggaaggtcctggccggcttgggccgcggatctgtagccgtccaaaccctggccctcgccgccggggtagcaccctgccacccccagcacactcgtgcagctgtcctgcagctgctgcccaggggcatttgaagccggtgcagggtgggcagtcacacctatgctgccctccggtgccacctcggccgcgacgaactcggcgagcgcagccggggtcgggtagtccatggccagggtgacgggcaggtcaaggctgaagcgggtggaaagcatggaacggagctgcactgctccgagtgagtccagcccagcggccatgaggggggagtccgcgtcgagggtggcccccgtgatggaggcggcagcctccatcacggcctgaaggcagtctgtaccaccttgctggggcggagcttnnnnnnnnnnataatggaggcggcagcctctatcacggcctgaaggtagtctgtaccaccttgctggggcggagcttgagcggctggctgctgctcatcaccgcctcggttccgctcacccgcagcggcggggtacagaggtgccccagcgtcgcttctcggcgccgcagcgatgtggcgagcgaggtcccggnnnnnnnnnntggctctgctcacccgcagcggtggggtgcagagatgccccagcgtcgcttctcagggccgcagcgatgtggcgagcgaggtcccggggcgtggggtagtcaaaggtggaggtgggcgacagatccaccgtggggaaggcgaggcccaggctggtgcgaagctgtgtggcacctggaggagtgagggggcgtgggagatggaactataggttaggttaccctcctgggcattttctcttcaagtttgcaccggctttaatctaaagtcccgaccnnnnnnnnnncgagggggcatgggagatggagctatagcttagggtaccctcctgggcattttctctgcaaggttgcaccggctttaatctaaagtcccgaccctctgcagcaccaatgctctggagaggtgcatccactgcagtgggcacaatctccataggttgccctgtgcctcaccaagggagtcgagcccagagtccatgaacggagagctggcatccgctgcagcacccaaagctgccagggaggagaggatcacctccagcacagcactctcatctgtgccgtctggacccatgggctggcggggggcagctgcggcgcttcgggcagaccgacccccctgcactccaccacgggccctcctccctgccatctgcctgatgggtgaagtggcaccagctgccacgctccccacccgtccaatcctgcagtgtatgagggtgaatggagggtctacaccatgctcatgtgggttgaagggtccaaggtggtcagaggtgtctagcactcaaagtcaatggtgctgatgccttcctgcaatcagtgacatttgtctcgccacgtcgtgtcctgcagcacccacccatattcccttcacccactcactctgtcgactgaatgaactcctggaagatggggtccactgtcgtcatgcccctggcaatgttcttccagaggaagacattcacggtgaggcgacgtggggccccgacagcagaagtgccagaggaggtctggccgagcagtgccgccatggcggcgaggcccttgccggggtcgatggtgcccagccccatgcgctccatcgcggcgatgaaggcggggttgcgggcggccatgcctccgccgccccagttgccccattgcacgcagagggagggcctgcccctctcctgcagctcccctgcggccccctccacggcctcattggccacggcatagcttccctggctggcggctgcgcnnnnnnnnnnaggccatgcctccgccgccccagttgccccactgcacgcagaaggagggcctccccctctcctgcagctcccccgcggccccctccacggcctcattggccgcggcatagcttccctggctggcggctgcgctgaaggccgccagagacgagaagagctgcatgcaggtcaatggggaggcaagcgtggaggcagtcatgttgtgtgcccccgagaccttgcctgcgatgggttgttgggataatgggtgtgatttattgctctgacctttggagttggcaatatgctgctgaagtgcagacccactcctgatgtgctctaactatccagcaagcatgccacgtgggagacgagcactagcagcacgagtggaacaccccatcgaatgtcccacctccatgttccaggcgcatgctgcccagggtgatggcagaaagggtctttgggtcgagaacggctccagcatgcgcaaagctctgtggatgctcggatgcggaacggtggcacggcatcatgggacatcgaatgcggcagctgcagtcaatgtgcaagatgtctaaaccagtaccactgagacatgcagacggcaggaatgcccatccgtcttcgcgtcgtccagtctctcacctggattggggatctggcagtcgagccctctagcaggtccagcagagctgccacctccgaggccgcactcatgtcggccctgacggcctgcaccacggcagcaccgcgcatcagcctcccggaaaagaccgtctccggccccgccctgccgctcctgcccagcagggccacgctggcccctgccccgccggcgctgctcagccacagcgcgtacagcatgccgagggagcccaggccgcccgtgacgacgccgcctcccgtcaggtggtccacccggctcacacgcggcggcggcggcgaaggtcccggctcgcgcacgaccaggcgtgggagcgnnnnnnnnnntgcggcgtaggcggcgaaggttccggctcgcgcacgaccaggcgtgggagcgccagcttggccgccgcctcccgcgagccaaaggtgttgccaatccgggcaggcttggatgcgttccggccagggtgcggccggatgaagctcagctccgtgctgtcaaccgcgcaccccggcacctcctggggcaggagcctgaggaaagcagggacgcaggagggtgccctgtcaacccctcgcctgcccaccggcgcgtcacagccgccccaggtctgggcagaggcacgctggagcctgcctgcagcaatgctggcctgcaccgcctgcaccgcaaccgcgcactgcacgaggctgcttgtgaaggaatgggccgccacagtgttctctgtggcagccctgtgaccctgtcccaactgtggtggagaggtggtgggttggaatacggtgagtccgacagggtcgattgcaatgaggggcactccttaactctgcccttcaggaaatgcnnnnnnnnnngaagaatgggccgccacaatgttccctgtagcagccctgtgaccctgtcccaactgtggtggagggttggtgggttggaatacggtgagtccgatagggtcgattgcgatgagggacactccttaactctgcccttcaggaaatgtcttgcggcatgaagtctcatgaggtccctgacaggtgtccagctgaatccctaccccctgaattccaacctgcagctctgccgtgatgctctgcggtggccctgatgccacttctcgcccagctgcagcctttggcacgagctggaggaccatgacggtctccctgcgccttgcgcggccgacttcgccaccgacaccttgcgaaacctgccagtccgtctcataaatcagcctgctgcggtttgggtctgtgccccccgccacgcccgacagatcgatgggccgggccagtagtccctccacgctcagtgccaggggctggatgctgtggtcggtgatgacagtgccgtctagggtcatgggggcgcgtcgccctgtaacccaggctcccgttgtcatggcagggcccnnnnnnnnnngagtccctccacgctaagtgccaggggctggatgctgtggtcagtgatgacagtgccgtctggagtcatgggggcgcgtcgccccgtgacccaggctcccgttgtcatggcagggcccgcctgcacggcaggagggcggccagccgcctccatgccggccacaactcgggtgcgtgccacgctttcctgcacacccacgtctccggtggcggggcccaagtgcagggccgcatctgccagggcggggtgcacctgccaggcgggatcgatgacggctgtctcgctggctgccgccaggctgtggatgtccggggggtggtccagaatgctcagcagcgcaatgctcgtcaggccggccaggagtgcagcggcagccgtgggaggattgctggctgtctcagtgcatgctggcggccccgtcgcaggggacgccctgcaaccggtggccaggaggtgcagcctccgcgcggtcgcggtgccctgttgagcagctgatgccaccctcagtgcgcctgtggcggggtccgcctcgcaggacagcacggaggttctgccgtccaggggcagcggggccgggatgctgacggcggcgaggaagccgtgtggaagcggggtgcccctggaccccagcgtggacagcgtggccagcccgcactccagcatggcggcgccaggcaggatggccatgccctggaccacgtggtccagcaggaaagcgaggcatggcgactgcagccgcccctccagcctggcataggggatggcgaggggcaagggggaatcgatgggccaggcatcgagaagatgtgtgtggaccactcgatgccactgtgtagtttcaccaccgccagtgtgttcccggctgtgtagccgtgccgcacaactctcacagccacatgcccctacctgatggagcccatcgnnnnnnnnnntgaggggcaaggaggaatcgatgggccaggcatcgagaaggtgtgcgtggaccacttgattccactgtgtagtttcaccaccgactttgtgttcccagctgtgtggccgtgccgcacaactcttacatccacatgcccctacctgatggagcccatcgctagggacgcaaagcgacacaggatggcgtgggacctcggtaggggccagtgtnnnnnnnnnnggggacgcaaagcgacacagaatggcgtgggacctcggcaggggccagtgtcgtctgcgcatccaggcgaggtcttttgaagcaccctcctccagtgcaccggctgcctcaagcagcgcgcacgcgttgacgccactcatgccaaaggagctgcaccccgccagcgaggtatgaggctggtgaagtagcgcagggcccggcgcgtgccccttcgtgtggaagaaaggggggagggagggtgtagcatgcagagggggcccctaggtcgtggcacggtggggcacacttgggcgactcagaggacgccacctacaatagcggccaacagtagccattgaatcccccacccccctggttaaaacgaattccctgcgcaaacccagccgagcatgccttctgcctccccctccctcaccctcnnnnnnnnnnaagggtgtagcgtgcagagggggccctaggtcgtggcacggtggggcacatgtgggcgactcagaggacgccacctacattagcggcccacaatagccattgaatcctccacccccctgggtacgacgaattccctgcgcaagcccagccaagaatgccttctgcctccccctccctcaccctcggaatgatccccgggcggcggcgctgcgtccaggcctccagcgccgaagcgacgtaggggttcagggagcgggcgtgcgggttggcggggactgcccccagggtcaaacaggccagggcggccagggcgccatgcagcccggcggcgccctcggtgtgccccagccgcgccttggcgctaaccaggtgcacgccacgcgcggggggcgggtccccgccgccgctccccagggcggaacccagggcctgccccagggcagccacctcgatggggtcccccagcggggtgcccgtgccatgcacgctggccagcgccacgtcagcgccggccgccccgcaggcggccagcgccgcccgcaccagcgcggtctgggcggggccgttgggcgcggtgaggctggaggaacgaccgtcctggttgtaccccgacccgcgcagggccgccagggggcgcgcagtgccatgcgagtcacacaggcccagggtcacgaccaccgcgccctccccgcgaccgtagccgtcggcggccaggtcgaaggcgcaggaccgccccaccgccgatagcgccgacagctgggccaggtggattggggtgctggcaaccaggcacaggttggtgcccgctgccagtgccgcgcccgcctcgccctggaggagcgaggcgcgcgcgaggtgcgccgccaccagcgaggaggagcaggccgtgtccatgcccaggcaggggcctttgggggggtgggaaaggaggaatgggaaaggtaggatggacaggggagtggaaaggctggccaatgttgaatgagggcatgcacaggaatcagcagcagtacgactggaggaatgagcagcggtgcacagctgtgttttgggctgacagcagcgtgaggaccccatgaattgatctactgtctctcacaacagggatctgnnnnnnnnnntgggaaaggagggatgggaaaggtaggatgggcaggggagtggaaaggcaggccaatgttgaatgagggcatgcacagggatcagcagcagttcggctggaggaccgagcagcggtgcaaagctgtgtttcgggctgacagcagcgtgaggaccccatgaaatgatctactgtctctcacaacagggatctgcaccatgcccaggctggcaatgactctcatcaaccctcccaggacgcacatccccgtcgtcccaccttggaagcccagggtgtaagacacgcggccgaccaggaagttcagcccgctgcccgtcagggccgcggtggtggcgggcacccgcagggcgtcctgcagcacgctgtactcggtccagaccgaccccacataaacgcccgccgaggcggggggaaaggccagttgcgtcccggccagggccgcgaccgcctcctccagcagcagccggcactgcgggtccaggcccaccgcgtcggtggtggatagctggaacagcgcgtcgtcgaagctggccacctccgaggtccacaccgcaaaacgcggcccggtggactgcgcatgaaggtgtgtgatgtgggccgtgggagtgggggtggggcggggagcgcatcagccatcgcaggcagcgcacgaccactggccaccccacgatgactccttcaaacgcacgtgcttgatctcgtctggaagcagcagggtgtcgacgtcccaacgctccagaggggccacgctgacgaggtcctcctccacccagagactctttgtaaagtctggagatggatgagaagtggggctgggtgagggagagggctgggttggtgggaagggacaggggaatcagtgctctgcatcctcctttgacttgatgtgtggaaaaccacgcaccgcgagtgctgctgcatcccattcagcctctcatgaccagcgcccatatcccgtctcgcacctcccgtggccgccactccgcccacagctcgagtcnnnnnnnnnncaccacgcaccgcgagtgccgctgcatcccattcagcctctcatgaacagcacccatatcccatctcgcacctcctgtggccgccactccgcccacagctcgagtcgctgcgctccagatgccgaccagcccctccgcaccctgcatagggacgatgggagcatgcacaacctggccttccccctccccattccccccatcaacccccgacccggcaatgagctgtgccatggcaccaatggtggggtggtcgaaggccacggtggctggcagctccatgccaaaggccgaagccacggcgttccgcagctccactgcccctgcggagacagggagtttgggaaagggtgaccaatggatggtgtccactgatgttccacctgatgacgctcaagcccttgctggacacctgtctgcatatagatggcctaggggggattgcaaaacaatcctgcctccaacccttcagaccaccccttcttgcacccacatgtcacctctccgcccaacacaatcacccaccgatggagtccaggcccgcggccatcagcggctgttcctcctccacgtccccccccagcagctccgtcacgatgtggaccagcttcagcctgacttccggctccgtccgggccacggccttgctctccaggtggctcggctggcccttggcccgcgcctcggcttccgcccggctcgaagcagccgccggcgcctcggacgcggccgccgccgccgcggcccgcgccgcccattcctccagggatgcaaactggttgtcgtgcagtgagaccagcggggcgccagcatcacacagcactcggtgcgagagcagcgtcgcgcaccccgcccgcaccgcggccacccaggcggggcgggcgtgggcgggcgaggcgtgtgggcggcccaggtaggcctccatgccgacggggagcctcaaaggccccctgggggccgtcagggccgccgccagctgcagcgatgcgtcggcggcggctgggtcggcccacgcgtcggcgtgcgggccgcgcggccgcccggcgcaatccagcgcggcgcacgcgggcggggggttggcgtgggagtgcgcctgagcccgctcgtcgagaccgggggccaggctccagtgtgccgggcccggatgatttgaggctttnnnnnnnnnntgcgggcgggaggttggcgtgggagtgcgcccgagtccgctcgccgagaccgggggccaggcaccggtgtgccgggcccggatgatttgaggctttaggcgccagcaccagagctgcacctgcctccctggccagttccgcgcctgccttcaggccctggcgagtggcggcctggctgaaagcattgccgaggagccctgccgagacccccccggtccacctctccagctggacctccagcacgagggactgtgcggccagcgtgaggggcatggggaaggccaccgcgccgagggcgacggaaccctccggggcagatgcaggcccgcccagcagcgcggccgccgccgccnnnnnnnnnntgacggacccccccggggtagatgtgggcccgcccagcagcgcggccgccgccgccgccgcctccaggagcagggcggtgggcagcacgctgcgcccctgcacagcgtggtcgtgcaggaaagcgaggccgggcaggtccagctgcgccgcgacgcaggcggggccggcgggcggcgcggtggcgcgctgcagcnnnnnnnnnncgcgccgcgacgcaggcgggaccggcgggcggcgcggtggcgcgctgcagcagggggtgccagaccgggaggcaccagtgcacgcccggccgcgccacgtgggccagcacccctcccgccggcacgagctcggcgccggggtcggccgcgagcacggcgtgcgcgttggtaccctggaatgcaaaggcgctcacgcccccgtgcgtggcggcgtgcctgacgtggctgcatgtgtgtggggtggctgggggaggagtggaagggtctgcggagtgctgagtggtggccggaccnnnnnnnnnnactcacgcccccgtgcgtgggggcgtgcctgacgtggctgcatgtttgtggggtggctgggggaggggtgaaagtgtctgcggagtgctgagtggtggccggacctgcatgcacgaatgcagcagcagccctggctgctgcatggtgcgagcaggagcgagcacgggattgccagccaggaggccacctctaggctgagccatgctgcaggcttccagaccaccatccccaacaacaaaccctcgcctgctgactggggcaccgccctgccgccggacagtccaggccctgccatcttcgctccttcggtgctctccgtcaaagatggtcgcaacgtaagggttgagggtgccgagatgcagggtcgtcaggggcctggcgaggaatnnnnnnnnnnatccaggccctgccatcttcgctccctcgacgctctccatcaaagatggtcgcaacgtaagggttgaggatgccgaggtgcagggtcgtcaggggcctggcgaggaatgggagggtggtggtgtggtgtacaaggcatgaggcacgacaagaccccacgatgataacaaagctatttaatgtattatcggcctcggcgcatcccactctccacttgacagagcctgggcaggacaacgcccagcctccccatttgctccaagaccatccagcaacccaccctggccccacctgtcctcccccagcaggcggccggccagatcggcgagacccaccgcccccgcagcgggctcagcgtgcagcgcgcgagtcttggaggccatgagctccagcggcacggttggggcacgattcccggcacaccgttcccccagcgcaacccccagcgcagcgccgatctcgatggggtcacccagcgcggtgcctgtgccatggagctccagcgcggtgagcgcggaacccctcggcaggccggccagcgcgnnnnnnnnnngcggttggggcgcgattcccggcgcaccgctcccccagcgcaacccccagcgcggcgccgacctcgatggggtcacccagcgcggtgcccgtgccatgcagctccagcgcggagagggcggaacccctcggcaggccggccagcgcggaggaaagcacggcggcctggctggggccgtgcggcgcggtcaggctgctggaccgcccgtcctggttcaccgcgctgccagcgacgcaaagcagcgcgcgccctcctctctcggcgccccactttccccccgcaggcaacaatgcgtgcacgacgcaggcctcgccgcgcgcgtagccgtcggcgccggcgtccagcgtccggcagcgcccggcgggagccagcatgcccgcccgcgccagcgcggccacggcgtcgggggccaggcccaggaagaccccggcggccaggccggggaccgcggcgcagagcgagccggcgcagaggtgcagcgcgaccagggccgaggagcaggcggtgtcgacgcagagggcggggccggccagggccagggtgtaggacacgcggccggcggccacgctgagcgtcccgctctgcgcgctgtgcgcgctgaggccgtggggacgcgcacgtgcaccatactccgcgtagctgatgcccaccgccaccgcagccgggggcggcggctggtctgagggcagcacggcggcgcaggcctcccagcacccctctagcaccagccgctgctgggcgtccatggcagatgcctgggggtggtgagagggagggagggtgggcattggagaagttggagaggcgagtgaataggtcgagcagttacgtccgccgcgtgggccagtgggtcagagcagtgtaatacggtgtgcaaaggggtgtacaaatgtggttgggggtgaaggaaacaccagaaaataagtatatcgcatgcaagcttcataatgctcccagtagannnnnnnnnntgagcagttacgtccgccgcgtgggccagcgggtcagagcaatgtaatacagtgtccaaaggggtgtacaaatttggttggaggtgaaggaaacaccagaaaataagtctattgcatgcaagcttcataatgctcccagtagagggagttggcgcatctctcgtgtcatgcggaagtgcggcaccatgcccacctgtcaactgcttctcagtgtcgacacctctcaggtggatcagccctcgatacccaaagtgatacccctacccacccacctcctgggtgccgatgccaaaaagggctggatcaaagagctcgacatcgtcaacaaaggcaccaaatcgcttgacagccagaccggagtctggccactcagtgtccaggtcccaacgtgaggcagggacagacctgggaggatggcatgtggggtattgataggagactgtagggatgatttcaagttgtaaggcttccattaaaacctgtgatcactaaagaggggaacccaggcggagcaaccagcacacctgctggcgtctgtgctgggaggtcgccaggacccacgcacaatgcttgcagccaggagcatggctggccgaggagcatccaatgtaccgcctccaagaccatgaggcaagctctgatgagtcgagggtgaggatgtttagggagatcgaggtgggactcaaaaccatggagatgcatcatggtgggtgatgcgagggtggcaccatggtggaccactcgatgattgcagcatgcactggatttcgtgggcaatgtcattatgcggccaatgagcctatcggggctagcaggctctcgagcattggannnnnnnnnnaagggatgatttcaagttggaaggcgtccatcgaaacctgtgatcactgaacaaggggaacccaggcggagcaaccagcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgcaccggatttcgtgggaaatgtaattatgcggccaatgagcccatcggggctagcaggctctcgagcattggattcctggctccggatgacgaggcgatcggctcggtctcatcgacgaaaccctcccccaaatccccgcagccggaatcgcgagacccacgcacctgcggaggcatgacctcctggaactcagcaatttcttccagatcaataccataatatccatccatatcatctagagccgaatcgtccataattgaggctgggtcgaggccccaggtgcccgatccctgcccgcgcacgcggatggtcgatcacttcccttttcgatccagcaactgaaacctgcaatctgtcgagctttacgagcacgccggactcttttgcatgttatgttagttgccatgagagtgttggggtgcatgtccttggcgctctgcgcaatgttgtgaggggaaccgactggtcggaatggctgacgactgccaannnnnnnnnntctgcaatctgtcgagctttacgagcacaccggactctcttgcatgttatgttaggtgctatgagagtgtcggggtgcatgtcattggcgctctgcgcaatgttgtgaggggaagcgactggtcggaatggctgacgactgccaagtgcaccgacaccgacaacaacgacggcagaggagcacagcccggctattggccatcgacgggtgcctttgggtgcatttgaatatatcctagctttgtaatacatcctgcctcgggacacctctcgggccatcgctgtgcatcccccgagggtagtccatgtgttccttccgggatgccgtgatttgaaaccgtccccccgcagcaaaatttagagcgtaatgctgaccactggtagcatgtgaggtnnnnnnnnnnatgcatttgaatctatcgtagctttgtaatacatcctgccttgggatacctctcgggccatcgctgtgcatcccccgagggtagtccgtgtgttccttctgggatgccggtatttgagaccgttcccccgcagcaaaattcagagtgtaatgctgaccactggtagcatgtgaggtggttcggggtttcctgtgaatatcaagattgttggaggctgcttgtcgtgctgcaagtatcgtcggtctccttcgacgccacgcacgagcaccgggcccacaaccgggccctcactgaacactcttcataaaactctatgcgtgtcctccagcccggcacagcgatgattgattgctgcaaagccagtcgtgcacggtcagagggaaagatctcctgggtgcaggccggagacccnnnnnnnnnnccctacagcccggcacagcgatgattgattgatgcagagccagtcgtgcacggtcagagggaaaagatctcctgggtgcaggccggagaccctcagctggggcaggaaagggctatgtttaccggccacccacggggccagcgatcgccaaaatcctccctcacactccccaccacgcacagtcgcctagtgcttggccttgtgccgggagnnnnnnnnnncatgttgaacgattgccggccacccaaggggccagcgatcgccaaagtcctccctcacaccccccaccacgcgccgtcgcctagtgcttggccttgtgccgggaggtgacgatggcccagttggtgcgcgcgcccttgtcgcgcgtgcggtggcccttggtgggcacgccccagggcgtctgcgagatgcggcccttgaccttgccgcgcccgccgccgtgcgggtggtccaccgagttcatagccatgccgcgcacgcgcggcttccggccccgccaccgcgtcgcgccggccttgccatgcttcacattcttgtgctgtgcgttgcccagggcgccaatagtggccgtgcaggccaggctgaccagccgctgctcgccggagggcagcttgatggtcgcatacccgtcggtgcctgaattgttggttttggtatgtatggggaatggggggggaggtgagggggggtatgtgttgaaaagtccgcgtggaggcctggagcaaaagtagcactgcagcaggggtgcggcatgccagtctgtgccccgcttccctccctcccgcatctgccccccaaacccttaaaaacacaaacccacacgctcacccttcttggtgatgctggcgnnnnnnnnnnttgcggcatgccagtctgtgccccacttccctccctcccgcatctgccccccatacccttaaaaacacaaaccaacacgctcacccttcttggtgatgctggcggcggtgccccccgcccgcgccagctggccgcccttccccgggcgcagctccacgttgtggatgggcatgcccacggggatggcggagagggggagggaggagccagggacgatgggcgcgtcggggccgcaggtcacgcggtcccccggcgccagcccggcgggnnnnnnnnnnagaaccggggacgatgggcgcgtcggggccgcaggccacgcggtcccccggcgccagcccggcgggnnnnnnnnnncgagagtgtcctcaaagtccacaaggggccgtccgcacctggggtgttgggcttgtacgccttcagnnnnnnnnnnggccagcatgtaggcgtggctgtcggccgagtccagccccgcgccggcgaagccgtcgtagcgcagcagcgcgatgcgcgcagagcggatggggtcgtactcgatgcgctccacagtgccggccggcgtaccagtgccgcgcacaaagtccacgaggcggtacacacggcgcgagccgccgccgcggtggcgcgctgtgacgcagccggcggcgttgcggccgcccgtgcggcgaaggccctcggtcagcggcttgaaggggcccccggaccagaggtccttgcgcgcggtaatgatgcgcccgcgcatgcctgcggggcaggtggggtgagaccccggggggggatgtcgcggggtgacggagcacgtgcgtgggcaagaatgccgtgggctgacannnnnnnnnnnnnnnnnnnnnnnnnnnnnnnnnnnnnnnnnnnnnngccaggggaggtgtggtgcaccttcagcctcacctgaacgccttgccaggacccggcgggccctggggttcgggggagcaccacatggacagggtggtggagtgaggtgcagggcacgatggcgtggagccacccgatcgatgtcgtgaccagatacgtacctaccacgacatcaagccccccgatccataccttctgtacgcagactagacgcaaaactggtgctgcagccgnnnnnnnnnntgggggagcaccacagggacagggtggtggagtgaggttcagggcacgacggcgtggcgccacccaatcgatgtcttgaccagatacgtacctagcacgccatcaagcccacggatccataccttctgttcgaagactagacgcaaaactggtgctgcagccggtcgaggacgccacccgctcacaggcctggcaagggaggaggggttgggatggatgacgggcacacgtaatacgatacaggttccccaggatattcatgtacgatgtcgaagttcaacgcgccccccccccccccnnnnnnnnnnataatacgatataggttccccaggatacttttgtacgatgtcgaagttcaacgccctcccccccatgagtactcacagccggtgttgtccactgctgcagagctgcgcgcaggccggaggcctgggccagccgccgcagcatcggacacgtcccgtcctacactccccgaattcgctggattttgggtgggtaatactgcatgcgcctcttgcattcctggtgttgtgctccttgtcgcacatgggttttgcacnnnnnnnnnntcggacacgtcccgtactacactcactgaattcgctggattttcggtgggtaatcctgcatgcgcctcctgcgttcctggtgatgtgctccttgtcgcacatgggttttgcacagttcacatcggaaggtactgcactgtaccacgatgaccgctggaggggtcgatgctccctgcacccataccctgggcggcttcacttgagtctacagtgcaccaccagcttgccgcacacagaccaggaacccattgcaaggggtatcatgctggctgcagggnnnnnnnnnncctacagtgcaccagcagcttgccgcacacagaccaggaaccaattgcaaggggtatcatgctggctgcaggtccacggcagcttgcttggatgcttggagggcttgccgcctggcggccacatacgcgcccacccgcgcccccctgggggagaagaaggcggcgtccaccacgccgctctcgcccttggacgacagctggatggtccagcccgcctgcaggtcgtccagctcagcgcagcgctccctgcgagaggcatactcgtcgggcagcccagcgatgggcccccgagggtacagcaccgtctcctgggccggtgcagcctgtggcgctgccgaggcagctgctcgtctcctctctgctgcaggactggctgctgctggatcagcatctgcagacgccgtaggcgccctgcgaagtgattcagagcagaaggacattcactggtgcatgccgggcttcggcagaacagccatctgcatgaggcctggaggacagacaaggacacaccccatcggccccagagcttcgtccagacaacagggcccggacagcatgggcgattcatcgcggcgaccaccccgaatcgaagcgagccccaacccacctgtcaggattggcggcggggtgcaccgtagcgctaggagctgggtcatccagagtcagatcgttcaggcccagcgagccctcctcagtcgtggtcgctgcgagcgccaggacctcggtcctgccccccacccctgccaccagcgaatgcaccggccggaagagaccgggatcgatgaggcagaacatgatcagcgacgagcctgctttgtgatgagggggaatgagtgtcaggggggggagagccagggggccgcacttcagcgtccgcaggggcacgctggtaatggattgaggtgcccacacctttcagcctgctctgtaggtatgtacagcgtcctcccaaaccagctcacccgacagctcgcagtcctgcacggcagccctctcgggggtgagaagcccctgcagctcgtcccgattcgccaggggcagcgtgatcttgagacgcatgcgtgcgcgctcgatggggaagcgctcctggagcgccggcaaagcctgtgggagggtggaaagagcggcgcctgagccactttggtgactgagctggtgcaggctggggtggcccgcggcagccccaccctgctttgaggtgggggccagcgagccctggcgcctgggtcatggaagccctgcagtcgatggcagccccccgtcacctttcccccatgacagtgcccccacctcgagggcctgcgtcttggcagggcggttggagtcgacagagaagtgggtgtctttcagcgcgcgctcgatcatggggatggtgtaggggcgctgggtggtggggtttatgcacttctcgctgatcacggccgccacgtcgcggaacttggtgtctagctccagcttccgctcccggtccgacacctggagatccccgtgggcgaggatgaagcggcacaccgcgtcctcgtcgtccgtgccgaagaccagcttcaggtcctcccggctcgccaggaccgccttggagacgttggagtacaccgtcgtggtctgcagcacctcgtccaggtccttctcgctgcagagcggagagagatgtaggggggcgaatcgaggacggtgacggaggaagtatagaggggcgatggggatcttgcaacactcctgtacgcacaagtgggcgacgccggcatcccaatccacatccttgcgcacatgccgttgcgccagttgagaactttgttcttgtagcaagcgatctcaaagcgcttgccatgcttcttcatgcgcaccaccgcaatgttggtcagccgcttctggcctgaatccaggtacgttcatggggtcaggggggggtggcttatggctttgcacggggtgctgtcgacccattcaaggccacgggagcatgttacaatgcatacctacgggttggaagacggactggctcatcgcagcgacgatgcggtcaacggaataacaacagtctgcactgtggcagggccgccgacagtgtgactccctcggtccagttggtggagcgaatgtgcgtcgtctacactcgnnnnnnnnnnaacgatgcggtcaacggaataacaaaagtctgcactgtggcagggccgccggcagtgtgactccctcggtccagtcggtggagcgaatgtgcgtcgtctacactcgttggttccatggaatttatttttaaccagagaagtaatgcagttttaaagggcaccgtgcgtcctcgacatgcgcgtgcttcgcatgatcagggactggacgacagacctgtccagaccctcgtttttaaggcaaactgcgtctcagattaaaaaccttctgcttgcatatggaatggtggaagattcgccctgggacagtcagacgaggcattgattcctgttgatcttcttcatccgtcgtgacaaccactgtcccttcatgatgcaacatggcaacgagtgggggtggcatccgtgagcagaaagggaaagcacggaatacccttgttcccctannnnnnnnnnatcgccctcggacagtcagacgaggcactgattcctgttgatcttcttcatccgttgtgaccacccactgtcccttcatgatgcaacatggcaatgagtgggggggcatccgtaagcagaaagggaaagcacggaatacccttattcccctacctggcttgcgccggttgctagcagcttattccnnnnnnnnnngcgggagcgtctgacatcgtacagccccctgtgagcttcctttttctacaaggggtcttgagaaagttcaaacctcccctttcgtcacctggggcgccactgaatgggccgggggctggcgcattagcccgtgcaccggtcaggcatgctccgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggattgtttgaacagagtcgtggcctgtgcacggtgtgttcagtgtatcgtggacggcacggagacataacttagtaggcaatattaaacgggcttgatggtgctgctgatatgtgtagcagcgagctgcctccgtcacacctggcaaaaaatgttaaacttacctacgacactgactcggccgggagttgccacgccgtcgatagcacgagtccgatcgaatgccagatnnnnnnnnnntaaaaatgtcaaacttacctacgactctgactcggccgggagttgccacgccgccgatagcacgagtccgatcgaatgccagatggattaaaagcggcacaagcaccgggtaatagctcagattaaggcgaatggaaggtcactctcgaatatcattcatcctggaacggtttgaattccgcatccggagggggggccttgaaagaaaggcgtgagggggcacccgggaaagcacggaataccccccccttccgggcttgcgccggttgctagcagcttatnnnnnnnnnnaggtggtgtgacaggcgcagcacactttggaaatcctgtgctcgtcaaccaccaccaccctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcagctgggtgatggcccgctccctgacgacgtaggcctggtggcgcagcttccggaacggcttctcgtgcatgtgccaggccaggccccatcgcaaaggtggggacgatccacgcgacccgcgacaggagcacctcagcattcgctgtctcataggtcgggcacctgcgggaagatgggtttgagcaaagagattggtacatttggagcaatggggttgtcgtgacaccggccccagagaatgacactgtatgcacaggcaacgatgctggggttgcgaagggctgtgttgatggccagcagagtctccacgaggtcaatggcccaccgggacaggcgcagacagtgaaaagtagcggcattgtggcccgaatgaccaatgtcagggtagaagacaatgccctgttggagtcttgcctcagctgcttgatcgtaaatgtatgctggcagccggtcctctcagagcggcggcgcgacaggctcgtccgcccatcacggtggctggtgctgtcattctacactcactcagatgtgcccggaccacgggcgcacctgtagtacccgactgacaaccagtcatgtgtgtgtattgaagggctgggactgagtgcagcgggaatgggaccggctgcatgttgatcacacggcccatccgttgcaggtgattcgaatccagtagaagcgtggggatgaagcggagcaggactnnnnnnnnnncgcacctgtagtactcgactgacacccagtcctgtgcgtttgttgaagagctgggactgagtgcagcgggaaagggaccggctgcatgctcatcacacgggccttccgttggaggtgattcgaatccagcagaagcgtggggatgaagcggagcaggactcgaaataaatgggtagaatttcatcgtcatgggttaactctcttcgaaaaggtctgcacctttttcgtacgatactgaggcccccccccgaaacacgtgacttctcagcgggtggcagccaccttggtccgaagccatgacggacgggactgtcccagcccgc

SEQ ID NO: 36794 - DNA, 104 bp, Chlorella protothecoides
tgtctggctcctgctgcagcctgtggggatcacagcatggagagagcatctggtttttcaggaatcgtgggaaaaaagcggctgcagttgagtcatgggccgga

SEQ ID NO: 36795 - DNA, 143 bp, Chlorella protothecoides
gggcataggagccggccagggcctcgtctggggatcctgcgtcggctcccccgtcagagtcaccctcgtccacgctctcttcctcctcctcgccgctctcgctgcctccctccaggtcctcgctctccgggtcggaggcgctg

SEQ ID NO: 36796 - DNA, 98 bp, Chlorella protothecoides
agagcgcctgctgccggcctacgacacgccgaccggcatcccatacggcaccataaacctcaagacgctggcgccgcgcaaccccaagtgggcctcca

SEQ ID NO: 36797 - DNA, 202 bp, Chlorella protothecoides
gcccagcaccacaaacagcttgcgaacctcggagccctgtggggagcaagtgagggcgaagggggtcggggcgatggtcctcacatgtgggagggggaggggagcagggcgaggtcgcggcgccgacccgtggtaggcaccctcgcatgcgcgcggaccccccatgctattcacctggatgtagatgtcccggccgtccttg

SEQ ID NO: 36798 - DNA, 394 bp, Chlorella protothecoides
  modified_base (132)..(296): a, c, t, g, unknown or other
ctcgccgcccccgccgcccatggcgttgtacaggggcgggaagccgcccaggagcatgctgtcgccgcccgcccccgtctgcgccagcaccgggttctccacgatcatgctgaccgagttgcggcggggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcgcgttgtgcagagaatccacctcgttgaaggacgcgttccacacgatgcgcgagcgctggcgcatcgcgccgccggggcccgcgccgtcggccg

SEQ ID NO: 36799 - DNA, 101 bp, Chlorella protothecoides
ggggaagggacgtaggattgatgattcttttccaatcaacagggcctgggccacgcgtatcacttcacacacccctggagtacacaccaggggtgtgtttg

SEQ ID NO: 36800 - DNA, 142 bp, Chlorella protothecoides
gctccgcgtaccgcccacccgcagccagcaactgggcgtgcgagccctgctccaccacccgcccctgtgccaaagtcgattgcatagcatattgtttgtggagaaacaacacgccagtcaacccatcgagcctcttggagca

SEQ ID NO: 36801 - DNA, 99 bp, Chlorella protothecoides
ttcaggcgacgcacgacgtagtctgcgagggtcaagagtgggtgaggtgaaggtggggaaggtatgctggaacactagtcatggagcatctaaagacag

SEQ ID NO: 36802 - DNA, 64 bp, Chlorella protothecoides
tctgcaaagctgggcaagcgagggggtgtgcaactgctctacgacctcatcgccctactgggac

SEQ ID NO: 36803 - DNA, 135 bp, Chlorella protothecoides
aatttaccttacacaagtaggcccggcaactccacccaccctccccaaggagccctctccacgcaacactcccttactcacaaacacgcctcgtagtttgcgggtgcctcgatgctggctcatgaggccggctac

SEQ ID NO: 36804 - DNA, 2351 bp, Chlorella protothecoides
  modified_base (115)..(124): a, c, t, g, unknown or other
  modified_base (1138)..(1147): a, c, t, g, unknown or other
  modified_base (1952)..(1961): a, c, t, g, unknown or other
  modified_base (2178)..(2187): a, c, t, g, unknown or other
acgtcgacggtcatgctggtctcgggccggtagtaaaaggtgctggggctcgacctcccctacgccaaggatagacgcccgcaggttgatgaggcaggagtcaggggctcctgtnnnnnnnnnntcccctgcagcatggaccgttgcccgcaagttgatgaggcaggagtcaggggctcctgtcccaccaatgctgcaacccaaggctgtggactgccaacaggggcgtgccggcgcatgtgcctggccagccagctggactgcaccctgcacagcaggattccacccccaaaccctctggctcccagggaccctacccaccttggctatagtctggccaggcataggcgttacctcgtggatgacgtcctttgccaggaacagctccagcatctggggccggggttggaagtatgatggtggtatcggggtgtgaagaggcattggtcctggcacagcaagcccagatcctggtgggcatccctggttgaggcctgccgcgcagagcagctggactgcatggggtgggtggttgactggtcctggcccttcgtggctcccgaacgtccccagcctccctcgccgagggacgaattcgatatggtgacagacgccttcccagtgaaattcagactctcgccaggaatgttgaagtctgtcatcgggctgaccacgatgtagaagtctgcagcattgagtgttgaacagggtatgcagcagtctgcagcccagcccagaattgtcactctgacaggtgaccggccccactcaagcccccttccaaacaagcatgccccaggcctcgggtgtgggtgcagtctctgtcccgaccatcggtagccgcgccggccctgccctaagaccctccttccctccttaccctgtgcccgatcaagcgcagcgagagtgcgggagcacccctgcctcgggattccggtggtgtcggtagcctgcctgcaagcgatggggtggggccctggtggaccattgcagcatacaggcgtttgggccggtgcatggagagccacaggtgtgagactcatccagcggagattctgacaccagatgaggtcacagccagccgtcccactcacggaatgtcactgtagagcgaccagtcctggtcaaacacggcagnnnnnnnnnngaatgtcgaagtctgtcatcggggtcaccacgacgtagaagtctgcggcatagagggtggagcaggtggtgtggcctgcagcccagcccgggattgtcacgggcagcctcatgccctttgcatgaatcagtgtcgggcgcaggaagcgggtgcagggtccaccccccctctgctccggccctggcgccggcccaacgcccacatccccttctcaccctgtgctcgatccagcacagccagggtgtgggagcacccctgccgcgcgccctgtatcatggtggtgtattgcctgtgcgggagcgatgtggggaccggtggtggaatggggcagcgtcacagcggtgtgggctggcgcaaagatggggtaccagcatggcactcgtccgctgcgtgtcatgatgccagacaagaccctggaaagccggtagcactcacggaatgtcctggaagagcgaccagtcctggtcaaacacggcagagacgatggttgtgttgtcgctggccttgccatgaggacaagtctcgatgaccagaccctgtgtgggggtgggcgcttgtgcgatcattgcagggtgagaggcgccgctcaaggcaccagcagccaaaacgctgcactcctgtacttgtgcagcactgccatgggcaaggctcacaccagggagcctgcacccacctgtgggccggtggcagtgtacttaaaatactccacaggcttgaaggggccctcacggtcgttgatcagggtcacatttgtgttgtatcgctgggcagggaacatgaggggggggggggggggggggggggnnnnnnnnnntacatttgtgttgtatctctgggcagggaacaagaaggggagggggggggagggggggaggaggagaagtggttagaccaggctgggaagcatgcagcacagcgcaggcagtggcctggttggcgcagagattggcgtgccgtgtgccaggccccgggccgcgggcaagcgcacctcactaagtatcgtcctgtcctgcgcctcacctcgagactgnnnnnnnnnnaggggttagaccaggttcggaagcatgcagcgcagcgcaggcagtggcctggattgcgcagagattggcgtgccgtgcgccaggccccgagccgccggcaagcacacctcagtatgtcccgtcctgtcctgcgcctcacctcgagactgatcacatgcctgaag

SEQ ID NO: 36805 - DNA, 77 bp, Chlorella protothecoides
accctgctcacgcagtccagctgcgcgtcgctctcgccttctcacgtcccaggcttgagggcgctgggggtctcagc

SEQ ID NO: 36806 - DNA, 66 bp, Chlorella protothecoides
ctgccagtatgtgccaccagtgccgcttagcgagaaatatgggggggggggggggggggggggggg

SEQ ID NO: 36807 - DNA, 74 bp, Chlorella protothecoides
gactcacatctatgcgggaccggcgccgcgcttcggcctcgctttcctgggcgtggttggcctccacctcctcc

SEQ ID NO: 36808 - DNA, 70 bp, Chlorella protothecoides
agcacatgcggcccaagcccggtgaacctggtcgccctttcctgtggtgtggcaccccggcccgtggtat

SEQ ID NO: 36809 - DNA, 16226 bp, Chlorella protothecoides
  modified_base (389)..(398): a, c, t, g, unknown or other
  modified_base (1072)..(1081): a, c, t, g, unknown or other
  modified_base (1872)..(1881): a, c, t, g, unknown or other
  modified_base (2225)..(2234): a, c, t, g, unknown or other
  modified_base (2941)..(2950): a, c, t, g, unknown or other
  modified_base (3333)..(3342): a, c, t, g, unknown or other
  modified_base (3605)..(3614): a, c, t, g, unknown or other
  modified_base (4311)..(4320): a, c, t, g, unknown or other
  modified_base (4718)..(4727): a, c, t, g, unknown or other
  modified_base (5782)..(5791): a, c, t, g, unknown or other
  modified_base (5998)..(6007): a, c, t, g, unknown or other
  modified_base (6726)..(6735): a, c, t, g, unknown or other
  modified_base (7054)..(7063): a, c, t, g, unknown or other
  modified_base (8418)..(8427): a, c, t, g, unknown or other
  modified_base (9658)..(9667): a, c, t, g, unknown or other
  modified_base (10558)..(10567): a, c, t, g, unknown or other
  modified_base (10873)..(10882): a, c, t, g, unknown or other
  modified_base (12317)..(12326): a, c, t, g, unknown or other
  modified_base (12533)..(12542): a, c, t, g, unknown or other
  modified_base (13246)..(13255): a, c, t, g, unknown or other
  modified_base (14040)..(14049): a, c, t, g, unknown or other
  modified_base (14353)..(14375): a, c, t, g, unknown or other
cggcggaggcggaggccgctgcgcgcgcgctggaggcccatgtggcgctcgtccgcggccgcgtggaccgccggctgtacgagtcgcacgtgcgcacggagaccgcggccgtcaagcgcggcgaggcggggccgctggaggcggaggtggagcgcgcgcgcgccgagaccacgcagcacgaggaggcggcggaggagtacggcgcgcaggcggagcgccacctggaggcggggccggccgtcgtggccgccaactgagcgatggatgcggaggagagggggtggtgtggggccctgcaggcgcaagaccgcgggaggtgtaggaccgcaggaggcgtcgacacagtgtgcgctgggggaagtgtctgattggcacccgcgctccccagnnnnnnnnnnagggggtggtgtggaccctgcaggcgcaagactgcgggagatgcaggaccgcgggaggcgctgacacagtgtgcgctggggaaagtgtctgattggcacccgcgctccccagtctcaccctggccattctttcggaccccctccaaagccggtgctgaggctgcaggcctgacccgatgcatgaccgccgacgcacctgcgtcggctgtccacccacacgccaggcggcgctcaccagccggcctggggctgaatgtgtagctcttttttcccctacgtactcacctgtaggtcgccgtggatgccttgtctcgtaaataccccaggcctggcatgataccttccctacaccataccgctccacgtgctgtgctacccatcgtcttgaacccatgagccatgcaagaatgtgcagttttcaggacggcaggggtgttgcagggggctgcaggactgcttgttaagaaagggggaaacaatattgatggggggtcggtggcaactcatcaggccgacgagcgcacgattcacgaagggcgccgagcaggaagccgagtcctggcaaatgggctggaacaacccaattgcgcagccacgagcgatctgatatgcctgaatactatatatgtcctagtttgagtttacccacccgtttacataaaggtcttccgccnnnnnnnnnncatgtatcctagtttgagttaacccacccgtttacataaaggtcttccgccctcccatcatgagaggcccggccaaagacgtggcgcccgtgagcagtattctgcccaccgacgcagaggccatcagcgaggatgaagacgtggaagaggaggtgcatgagtggttgttgggattcgtggagaccccactgagtcccgagtccctcctgcgccaccgcttccccagcaagctgggtgggcgacccgcctggctggaccccttgcgactgccctcccccgcccagctcgcgggtcccgatgaagggtcaccgctcagcttcctgctccaagtctatgctcccgtcgactccaacgcggcagccttccacaggaccgtctttgtcttcatacacacagacgtgagtagcactggcagggctgtggggcggcgggaacggtaggtggtggtatctgatggacatttatatccaccaatttatgcaggcagccttgagtaacctgccaaggccaatgtaacacgccgtggtaactcaccaggctccctttgcacaccatgcaggcggctaagctgctgcagccaggcggggtgcgggcgctgaggtgccagctgcccctcgtcaacgaattctatggcgaggcgcctgcgccagaggaagagtcccacccacggcgcgtcctccaagatcccacccaccccgacctgtgggatgttgctcgggccgagcagggcgacctgccgcagagcaccggccgatcgcccttcatcttcccggaggccgagctggtggttnnnnnnnnnnagtgggatgtagctcgggccgagcagggcgacctgccgccgagcaccggcggatcgcctttcatcttcccggaggccgagctggtggttgaggaagagagctcggccagcgatccagagcagcaggagagggagctgcagcgactgatgaagcgtgcctgcattcaggtgggggtgctgggcgaatggcttttatgctccaggctggggtgtggaggggaagagtaggggtacctcattcagtgtctggcacctcgcaccgacctcctttcttccacaccgcgccaagcaccctgccctctgcgcccccggcacagaacacgggcggcggcggggctggcgacnnnnnnnnnngtcttccacactgcgccatgcaccctgccctctgcgcccccggcgcagaacacgggcggcggcggggctggcgacgaggacagtgaggacgagccaggagtgatggagggcgtcgaggcacagatcaccgacgatcagagggactttgctgccttctctgccagggtgggtgggtgggtgcgatgctgcgctgcggttggctggcgggatgggatggcggcttgttggagcacgggtgcggcattggcttcatgtgagcagcttacgagagaccctcccactcgctgtcgttcctgccactcactcgcttcaccccgctccttgattttcccttgcagattgcaagtgagccggcgcagtgcctgcgctactgctttgaaccgggcgcacggcccctgtggccttgcaggaagcagacgcctggggagcaggacatcccaccctgctcccggtgtggtgccccccgacgcttcgagttccaggtgagccagggggagcgggtggtgtgcttgagagtcgacagaggagcgtcgtcggaggaagtgtcttccctggtgaccaatggaaggcctgctgatgggtgggctggtcgtggcatcaggtgcaggagggaattcctacaggcgtgtatcgacagcaacctcttccctgccgcacctggtctcccagtccgacctgccaattcccactaccacccctgcagatcnnnnnnnnnnaaactgctacaggcgtgtatcgactgcaacctcttccctgccgcacctgatctcccagtccaacttgccaattcccactaccacccctgcagatcatgccacagctgctgacccacttgggcatcgatgatgcgagggaggatgcccttgattgggccatgctggcggtgtactgttgctcagccagttgtaccccaggcgagaatttagcttcagcatacctggacgagtttgtgtgggtacaacctcccttacgatgaggttattgcagtggcagagtcgttatgagtttcccaacccaaacccttgcaaacccctcattgctgatttgttcaaggtgttgaatgtgaaattgaatgtatacatgtcacacaatcaccaannnnnnnnnnattgctgatttattcaaggtgttgaatgtgaggttgaatgtatacatgtcacacaatcaccaagctgacgggtgggtgcaagggaatcaggattatgcgcaagcccacccgttcaaccaggaatggaacgacacatcactcaaggcgtgaagttagcaagacaatgcagggcacaaaagcaggggtaacgaagtggtttactgttcaccggatgggtgcggggggagagaggggggtgtgatgcaggatgtggggaagggtannnnnnnnnntcggatgggtgcaggggagagaggggtgtgatgcaggatgtggggaagggtacactgaattcagcgcactgtatcaatgcaagtactcccaggggagactacagttcctctgttcactgcttgatggtggactcctgctttgctttctcctccttgcggtactgctcagtagtctccttgacgggaagatccacccgcccggcagaggtgcccttgggcttgctgggcacggtgtcagccaggttggtggtggtaatctcctccctctgccccgactcgctgctctccacacggccgcggttgctggtggtagtcactttctgatgctccacctcgctgtgctgggcggtggtgcccccgctgccgacggcttgcagcctgcgcttagtctcctcgttggagatctcgcgcgccgcatcaccatgctccttggcgcgcgcccagtgctcctcctccttctgcttaagggccagggcctcatcgcggtacgtggtcacactggacagcttatcctggctggctgcctccgcctccagcttcagcttctgcagacgctcgacatccgactccagtccatccttcttggcggcggcggcgtcagcggcgcgccgcgcctcctcagcgcggcgcgccaggtcggagtcagggacgacggggatgaccacacgctcggcctcggtgcgcttggacacagcannnnnnnnnngtccagtccatccttcttggcgccggcggcgtcggcggcgcgacgcgcctcctcagcacggcgcgccagatcggagtcagggacgacggggatgaccacgcgctcggcctcggtgcgcttggacacagcaatctcctcgtgcttgcccgcctgcgcgcggcgcgcggcggcctcgcgctccagctgcgcggcacggtcctcggcgctggccttggagcccagcagggcctgggcctcgcgctccagctcggccttgcgctgcagagcctcctcagccgcacgctccgcgccatctgcacggccgtccagcttgtcgacagccgcgcgcttgcgctccgcctccttggcagcctcagcagcctccttggccaactccttggcatgcgcctccagctccnnnnnnnnnnggccgcacgctccgcgccatctgcgcggtcgtccagcttgtcgacagccgcacgcttgcgctccgcctccttggcggcctcagcggcctccttagccaactccttggcatgcgcctccagctccttggacagatcgcgggcggcccagtacaccttggcgatctcgtcagcctcacggatcttgtcggatgcggcgcgcatcgcggtgtcggccgcctgctgcttctccgcagccacacgctcctcagccgtcagctcgcgctggagggagcccacctgagcgcgcaggcgcgcagcctcctcctcacgctccgcagcctgctgcgcgggcttggaggtgcgcagcgcgtcgatacgcttctgcaggtcgatggccttcttgtgcgcagcctcggactcggcgtccagcttgtcagcctcagccttcaggtcggcggcgggggcggaggacttggaagcctcctccaggatcaccgcgcggcggcgctcggcctgggcggctgcggcgcgggctgcctgcagctgcctctccaggtcggcagcctcagcctgcttgctctcggcctggccatccaggtcggacatgcgaccctgggtgtcgcgcagcttgcgctccgcctcagccctggaattgaaggggggagggggggggggaaagggggatgaatgatctagaataaacaatagatgcatgcaaggttaccaagattaatcgttgaagcttcaaaccagcaccatgatccttcaaactcaaggtaggcactgcagatgggaaactacgaggtataaacacaccctgcaacaccaatacccagcgcacttgagcttggcggcctcggctgcctgggcattgatggtgtcgaccttggaggcgaggacctcggccttggcagcggcctgctcggcacgcacggtctcggcctcggccttgcgccactcgtcggtggtctcctgcggtgatgggaatagtggtacttatgagcaagatgcaatggattgaatctcacaaactaggatacgaaagggcctccgcgcaatggctcgcacatgtcggnnnnnnnnnnggcctcagccctggagttgaaaggggggagggggaaagagggggatgaatgacctagaataaacgatagatgtatgcaaggtaaatcaaattaatcattaaaacttcaaaccagcaccatgacccttcaaactcaaggtagacactacagatgggaaaattacaaggcacaaacaaaccctgcaacaccaatacccagcgcacttgnnnnnnnnnnagtaaatatgagcaagatgcaatgggttgaatctcacaaatcaagatacgaaaaggcctccgcgcaatggctcgcacatgtcggggacatgcccagcaaatcccaagccaacccctcagcacaccttgctcgcggcgctggcgctggtggaggtggtcacggtctcgacacgctcgctcacaaccttctcggcgctggtggtgttctcaccgaggccaaatgtattgcgaatggcgccgaagacgccaccagacttgttctcgcccacggggtggctctggacatcgcgggcagacatgatggatgttctttagtggacaggaagtgggttttcggattgggtcgacgttctggatgatgggcgaatgggcgaataatggtgcctggcaatcggattttgccatttaccgtgtccatgatgcgcgccggcgagttgctgtgtagttggatgtcgccttcgcagcagctgccgccgggcagcttctgcctagatgccgccgcccgcgcgtatgctgtgtccatgcctcccggcgctccgtgcgccggcgtgccggcgctgaataatagaataatgtagtcatgcatatgatggtgtttgaagctaaaccagtggccaccgtgcccttgaatctctcagtcggagcttgtccgccacttcatacggatgggatctggatggctccatcttagaatgtgccagtccctcaaaatgagcgcannnnnnnnnngataatagaataatgtagtcatgcatttgatggtgtttgaagctaaaccagtggccatcgtgcccttggatctctctgtcggagcttatccgccacttcagacggatgggatctggatggttccatctcagaatgtgccagtccctcaaaatgagcgcaaagattacagaagtgaccaagttgaaagctagtggttctatgatagcatgtcttacttataaagtcttggctttctcgggtgaccattgctctacgggctgtttctcagtacggctttcgtaagagggcaatctcacgcagagctgctggtgccgtactnnnnnnnnnnatcttaattataaagtcttggctttttcgggtgaccattgctcaacgggctgtttctcagtatggctttcgtaggagggtaatctcacgcagagctgctggtgccgtactgcatcatacgcggtccactggtatggagtgcgccattcgtgtgaatgtgtggaaggagagcatacatgagcgggcaactgctacaaggggatagtgggggaaggggtccccttcgctggacgcccggtgcccattcccacccacctgctctccattattgattcatttttcacagagcatcgcccatcttctttgcgtgatgcatggcatggcaagggttggtgtacgggtgaaaggggtttgcctcacgtgggaatcccttcagcattttcgcagaggcaggttcccaatgcgttttctgggaattcatgtgagcatgctcacaatatgaatacaacagcatatttatttgctcgccatctccctgatcagccaacaggctggtagctaaaaataagatattgcaattacatccacgtaatttcataaacgtgctaagaactgtctgccagtggtaatgcaggtaaaagttgcaagattatcatgtcctgtgcatggtatactcggtctctaggcagttaaaatcgagttgagctcctgtgtgttaagtggggagattgtctgcgtgtcttagctactcaacttctatctagctgcgatcactcaccaacaagcacgccccccccccagatacattgtttaccccgtcacaatatctagaatccttccatcacaccattgcagagcataaccttctcgtcacactctctcgaattctttcatcatgtcgtcggagggtcgtcccaaccccatcaccaaagccgccgagtcttcgaacctgccgcgagaggcccgcgctcgtctgggtttgaacaccgatcccgttcccgagggaaagatcatcgatgccgccccggagtgagtacacacggagtagctggtagccccatcatgtcggagtgccgaaggtcgacatcccgcttatggtgtcgggatccgctctcaacccatcgctcgcatccctcgggtacacaggcactaccataagatcacgcccgaggtccgcgatggggagaagagccaggagggggacgaggaggaggatggtcctgacgccgtggcccgtgccggcttccaaaaggtgggaagcgggggtggtcatgcatggcgtggatataaatcttcgcaggccccagatgggcagcctatggatgccatgcatgtcttcatttgcaggctgatgcaacagcagatgtaacgaatccctcccctccctcttcccacccctgcacattggcaggagannnnnnnnnncatcgatgccatgcatgtcttcctttgcaggctcatgcaacagcagatgtaacgaatctattcccccgctcttcccacccctgcacattggcaggagatgaacaagatgcaggcagagcaggtcaagaaccagggcaagaaccaggcagggtcccccggacaccaggtataccacaatgcaggccagatgcggatggactccaggtccaggcaagttggggataaagggggcagagctcttggtatgtccattgccacttttgtactctgtaaggttacaaacaccactcctccctccccatcattctggaacaggggcggcgcccagaacttccagggcagcaagcaaatggactccgtgtacaagtctcagtgactcgtcttccctgcagcctgtattgaactgatgctgatgatcctcttgcaagacacgaagtggcgcaggcaccgcacaccagcgcagggaaggggcagtcgggggttgtggtcgccagcagggtgaaagggtatcgatgtttcgacactggcgtgcagaaaaataagcagggaagcggtctatcagcatcaaagaaaggaaaatcggtcaaatcactcctgggcgtgctcgtttctgcacagtcaggtctgggccgccgtcggagtcgtcctcgtccattggagtggcaccgccgtttggcacagtgcctgctgcgtcagcatcaggatcttcctggccctggtctgactctgcttggatgaccacggggaggaatagcaggtccgaggatgcaggggtgggtgtgttgctgggcccccgggtgacgatgtccaagtcagcatccacatttgcaggcagggattgatctggggacaggtggggcaatgcaatcctcaagagtgaggcagctttgcaggaagtggctcgacaggatggaatatggatcgaccaatgatatcgtgtccatctcaaccatcaaggtttacagcggggcgtggcaaccgactcctcacatttccatgccagtctcaccgggagtagctgcacgctgcaccacgtcaaactcgtcctcacgctctatgtactcctcgttctcctcgagttcccggaagtctggggcaaaggctgtccacttgtcactcaagatctgcgtcgggtgggactggtgttttggttcagcgagagggatgcctggggtaccctggcaaccacatgactttaacaaggaagcacaggctcgcatgccaaacgccnnnnnnnnnnatcgggtggaactggtgatttggttcagcgagagtgatgcctagggtaccgtggcaaccacatgactgtaacaaggaagcacaagctcgcatgccaaacgccaccttggtccagatgaagatgctgccgctgcctccgagtgtgagcagctgcatggggtagagctgaggatgccacgccattgccaaaacaccatgcgccccgcgtatgcctgtgaggggcagggtgggggcgggtgattggagaagacgggggcagtagcaggcggagacctggtgaggagaggcacaggggcaagcatgcgccagcgccgggccggggcacccatgctgaggttggatagttttttcagacagcgtcagatgaggttcgacgtgaacacgcactttgtttgctaagatgcctcctccacttgccgcctagcaccccactcctttttcctgtcccacccgactcacactccaacacccggtcggtgtgcccgtagtgggagttccatgcgtagatgacgtgctcggtctggccggccacggccgccagcacatactccccatctgcattgaatttgggatgaaaaggcacatcatgtcgcgggtgcgtcggtacacgcccaggggcagaatcccagcccgcatcgcacacaggagctcgaacagacacagccagggagccagcccaaggcaacggcgctccctcagaagacccacctccagagaaagtggcggcactccacgtgttgcgctcgatctgctgctcaaagcgacgggagggccgcagaagagctccccgctcctcgtagaagatgctgccggacggccgccgcgtctgcacgatgtgcgtgcagacgctcgtgcgggattcgcgcaggggaggggcggctgccgggcccgnnnnnnnnnnatgcagaggctcgtgcggggtccgcgcaggggaggggcggctgccgggcccggcgcatgccggcctcctgggttcccccctcgccctgctgcctggccatgcatgctgctgacccaccccacagcgtccctgccccctcccgtcggaactccattccccactcccgcgcaccttggcggccaccagggcctccacctcgccaggatcgcgtgccggcagggcctccagcccctgggccggtgcctgcatggcgtacacccgcaccgcccgatcggtggcgaggacgatgagccgcgtcccgccggnnnnnnnnnngtgcaaggcgtacacccgcaccgcccggtcgttggcgaggacgatgagccgcgtcccgccggggtcgagctcaaggctgctcacacgcagcgctgcctggacctgggaggggggacgcggggagagtaaggaggggcagcgtgccgagtgatgagactgtccacggtgtgcaggaagaaagaatgaccaggagtgtggaagatcatgtgcacatggcaaaaaagtcgacgccctgtctgagctgcaaggtgctggccctgagtgattgtccacgcagagcatcatcttgagcaggaataggacgggcccttgggccaggctctcactcctctgcacgccatcctctttaccaagtcacgatgcacaggtcgcaaaaccacacactctccccgaccatgctgccagcacccccctcccgactcgcaccctgatggcgtcgatgatggccaggtccgaggcccggacgaccagcagggcccctcgcatggcggcgtagatgagggcgctgccgggggcggtggcggccgggtacccgctgctcgcggcctgctcggccaggctcgcgccgcccctgccatccttgccagcttcggccccggcgctcatggcctctgcaggggccggctcgggcgcctcaggtgggtcgcacgcgctccagccggccaggggcaggtgctggatgcccccgccgcccacagtcagcacggcgggcggggcggcgcggaaggtgagcagcagctggccgggaccgggaccggggcacagggagaccacggcgccgcggccgaggggctggctcgccgtggggcggccggagaggacgtcccaggtgacgatgctgccgtctgcgcccccagacatgatactatggccatccgggctccacaccaggcaccgcacggcgccactgtgagtgcaatgggagggtgcttgggtcgttgagatatactgcgcaaccggtgtgcctgtagcatgaccttgcatggatgccgcttggtgcggcgcatgcataatggatggcaggggagcaggcgtcgcctgcgccacagaccattcccctggaatgcaggaaggaatcgatcttgctcctgacacaaggccaagcacccgtgatcaacaatgtgtgatgacgccccgtgagcaccctgcgcacttgtgcccgtccttccaggtccgcaccagcgccctggtctggtagttccagatcaggatgtcaccccccgcacatccggtggctagcagtgtcccggaagggttgaaggcaaggcagagggcgggctggcctggtggtggtttcaacacctcctcgcagtgctccggcaaacccaccagttcagatgcatctgcgatgcaatcaatggggcacggaggcggaagttttgtcctcataggtacaaattttgaaaccacaccccttgacgttcacccttccgtnnnnnnnnnnggttttgtcttcataggtacaagttttggaaccacaccccttgacgttcacccttccgtgccagaggtcctgagcgagcgtaccgaggaggtctgtggtgactcccatgccggagtctcccacgctgactcccttcctggaccagaatggatttggaatgagatggagagtatctggcttgtagcagcatcgcctcatgcacacagnnnnnnnnnncgactcccttcctggaccagactggatcgggaatgaggtggagagcatctagcttgtagcagcatcgcctcatgcacacagcttcacaggccgatccccagatcacaggttgaaccaggcgttcgcgcgcgcctggcaccccgggccctcagtgatgcaatccgcaaaccccttccactcccagaaacccagtcaaccctccccgaggccgccagtgccctcgatactgcgtccccagtggtccttattctgattcgcctgcgtcgttggggtcgaacaggactcgtcagtaggtgtgggcacctccttgtcagcaaaaggcgacgctcaccgcccattccccgcgacgtcagcaccaccatggcgagcggattcgggctgcgtggtggacccaacaggcacgcggcaggagggcaggatggtcgtggaggagtgctttccccacccgtgcgtcatccctgtacggctcaccgtgctgcaggtgttacgcagtgtacatggacttctctgagtgcatgagcaagactgacgaccccaagaagtgcaatgacttccgggaggactacctggagtgcctgcatcatcgcaaggaggtgtgctagagggagggggcgggcaccccgcatcttaggggctcggcaaccaaatggtagtggccagatcgacagcacctcaatgcaaatccttacaacacgattgtgcannnnnnnnnngagcgcctgcatgcgaggagtctccctgtgtccctgcacccacagctcgactgcttggatgaaatccgagcggaccgtagaatcaccgccaggggaagttgatcaggaagaggatgggccagctagtatgcgtcatagccaccctcgtcaccaggcgacctcgacacgaagaagaggagggcgctgcccaggatgcatgccacctccagcacactcgctatgccgacccatcgggtgtctgccaggggaattgggggcaggggggttgtggagatccagattccgatttgaaggccagcccatgggggctggtggtgtgacggtgggcgcacacgggaatagaaggaccatctgggaaggcatccaagtgtgcagacagatcatggaaaggaaacatgcaccccttcagtccagggggcgcttgctgtgggcaatgttgagactgggaagccctacaccgcgacgggcaagcatctgcagctgcccgggcgacagggcagccaagaagaaaacccgtgaggatctggccctggcgtgtcccggggggcacacaagagatggggtccccatcaagcaccgcacaggttcaggggccttccctgccaataccgagccagatttggacgtcaacccaggccccatccctggagtctacccatcaccttgagcaatgctgccaaagtggtgcagcatgacaaacactgagcctgtgacggctccagaggagacgaggtaggccgccagcagccaggaccgcgaccgacagtacacgccgtcatcgctgnnnnnnnnnngggggggggggggaccccgcatcctaggggctaggcaagtggtagttgccagatcgacagcaccccaatgcaaatccttacaacacgattgtgcagtacctcaagctgaacacgctgttcaaagaggttgcaaggcaggaacggggcgagggcgccgatgaccaccagggcggaggccattgacagtctgagctggggagtcactcgaggcagcagggccctgcgcacacgagcgcctgcatgcaaggagtcgccctgtgtccctgcacccatagctcgactgcttggatgaaatccgagcggnnnnnnnnnnnnnnnnnnnnnnntgtagaatcaccgccaggggaggttgatcaggaagagggaagggccagctagtacgcgtcatagccaccctcgtcaccaggcgacctcgacatgaagaagaggagggcactgccaaggatgcatgccacctccagcacgctcgctatgccaacccatcgggtgtctgccagaggaatgagggggaggggggctgtggagacccagattccgctttgaagaccagcccatgggggctggtggtgtgacggtggcgcacacggggatagaaggaccatctgggaaggcatccaagcgtgcagatagatcgtggcaaggaacatgccccccttcagtccgggaggcgcttgctgtgggcaatgctgagactgggaagccctgcaccgccacgggcaagcgtctgcagctgcccgggcggcagggcagccaggaagaaaacccgtgaggatctgggcctggcatgtcccggggagcacacaagagatggggtccccatcaagcatcgcacaggttcaggggccttccctgccgataccgagccagatttggacgtcgacccaggccccatccctagagtccacccatcaccttgagcactgctgccaaagtggtgcagcatgacaaacactgagcctgtgacagctccagaggagacgaggtaggccgccaacagccacgatcgcgaccgacagtacacgccgtcatcgctgaagggatcgtaacttatctcgtccctggaggcaacggcatggcagagctggacgctgaacaaggtgcattgcgttctaagctgtacggtgacatgtatgtgaggctctctgatgagtggggctgccaagcaaggctttgcagggtgaaggccttgactaacccctgcttgcctacaccccctacctcctgacagccgtgatcatgagcaaggcgaggaccgccaccagtccagggagatactgcagtgaggtcggggagtgtaggcggtggggagggtctggtctcactcctgctgccagcccctcaaggggtttgcaagctccacccctcaccgacccccgacgtgcctgagagaagggcaccttgatggggctgatggcaacagcatccagccagaaccagacaccaatgccaaagagggcgccactcagtcctggcccgtacttttccgactttgacctgcagaactccgccacctcgggtgagaccagcaggctgagggtgtcgctgcacctcacagccgcgctctccagggtgtaagcggccattcccggcagactggggtcgcagacttgccaggggaataggggagggtcgtcactgcggggtggggcagggttgatcactttctcaaccctcactccgcgcgcgcgcattcggtagcgaggcgtcacactcccacctcctcctcctcatgcgcctcacgtgcatgccagccctcgcacgggaactttccgccgatctacaaggctggtgtgctggcaggacggtcgccactcgaatcccgagtcccatgggccagaacgagtcttcgggggtggagatggcgtcggaggaggcggcaccccggccctgcgccttggtggtggtcggcccctccggcgtgggcaaggggacgctcatctccaagctcatgcagagcagctccaagtacggattctcctgcagccacaccacccgtgccccccggcctggagagaaggtgagggactgctggtgcggtgtgggtgtgcatggctttcaggcccctgggcgccctgctctactttgtggcaggcttcacgcatactgccttggaatcgcgactgcacgtccctttctcggcaccagcgccccccacccgccctacccaccccacccac

SEQ ID NO: 36810 - DNA, 64 bp, Chlorella protothecoides
ctgatctgcacggcgagcgccacgcaggattccacgctgcgccaggcgccgcatccgatggcgc

SEQ ID NO: 36811 - DNA, 178 bp, Chlorella protothecoides
gggtcctgcttagaaactgggcctgatgcttgatccaggcaacccaattgcattctgtggcagactctgcgcgccagccgtacatgctttgctgaaccatttgaggtgatctgcatgtgaggcgtgtcgtcaacgaagcactccattttctatcgcagtggagaacgatgaccggccc

SEQ ID NO: 36812 - DNA, 61 bp, Chlorella protothecoides
aggggttgagggctgcttctgcctgcagacccttttggtagggggcggtaatgcatgcctg

SEQ ID NO: 36813 - DNA, 4379 bp, Chlorella protothecoides
  modified_base (342)..(351): a, c, t, g, unknown or other
  modified_base (992)..(1001): a, c, t, g, unknown or other
  modified_base (3609)..(3706): a, c, t, g, unknown or other
  modified_base (3978)..(3987): a, c, t, g, unknown or other
ggtggcacgctccgcgccggccccgcgccgcgccgccgcgcgctggtacaccgccagcgcacgcggcacctcgccggtcgtggcgcacagcgtgcccagcgtgtcctcccagcccagcgacagcaggcgcggctccacctcgggcagcacgaccgcgttgggcacggcggcgaaggcggcggcctcgtcctccgcgcccagatccatgagcaggtgcaggatcagggtgtcaatgccgtctttggcctgggcgccctccatctcccgcgcctgccgtggaaggaggcgtgacggtgaattggagggttcaagcgcgcacgtgaccggtggagaggtggtggnnnnnnnnnngcgcggaagcaggcgtgacggtgaattggagggttcaggcgcgcacgtgaccggtggagaggtggtggcggcgagacgcgtggcacgcagggacacccaatgctcagaatgacatggaatacagcatgcacagccaggggcgcgcactgtcaccctcgcatgatgcacccaactcctggcgccatacccggaagaagtaggggacgaaggcttccacggcctcgcggagctgctcctgctccactccgcgccttgcccgcttggcatctctaccatcctccagcaccggcagaccctgccagccgccgccggtcgcagcaaagggggagggcaggcccgcatctggggtccgaacccccatggcatccccggggtctccatgcctggtcgcgcggtccagggcttccagcaagggcagccagctggccatgcgctgcggccacagcctgagcagctgggcgggctggaatgcgtggcacgccacccgatccagcactgcgaggccctcggtgaatcgggcccctgggatgtgggagttgggtttggtggtatgtgcacgtgtgtgtgagaggaagaggacattctcagacatgccctctgcacaatgccccaacaatcgggccagggtgctccacccatcnnnnnnnnnntgaggaagaggacattctcggacatgccctctgcacgatgccacaacaatcgggccagggtgctccacccatcggcgatcatgtgaaccgcgcgaccccacacgacagtcctagcgacatgccctcccatgcactctagatcccaaccacatcagcgcttgcctctgagcagggccaggccgaccaaggccaggccggcctgggcccaggcctcgccccgcgcctcgccccggctcgacaggcgcagcgcggcttccgcctcgccgtgggccagcgcatcccgcacctggtcccaggcggggacgggctgcgccaggaagacggtggccccggccgagcgcgccgccgtggacccaggcgcggcgcggggcgcgaccagcaccgcgcccgcatcgttgcaggccgacacggcctgcccggccgccgcgccaccggggtccgcggccgccaggcccagggtctgcacgcaggcgccggtgtcggcctccagcacgcacaggcgctccggggtccagaccagcaggtgccgccccacgccactcagcgcgcgcagcgcgccgtagccctccaggctcaacgcgtcgcccacagggtgccctgcagggttgatgcggatgcccgtctcgccctgggcgtttggaaaggtgggcagggggaccgggggggttggggagtgttggctgtgaatgctggctggagtcgaggattccaatgtcgtctgaggttcattggggaagaagcaaaggccatgcgcaaccccgagcctgaggtgctgcttgggactcagctgccagctgcgtcgaagggactgcatgtgggctcccaaggccaccactcccttccccttcccctcccaacccccaccaccagcagctcaccagtaatactacggcttgggccagggagggcagccccaccgctcgaggcggcacgtatgccagctccggcggcacgtcgaaaagctggcgcagggacccccccgccagaggggctgcgaagcagtagcgcatcccggcggcgcacaccacctgcgcgcccacccaggccgggcaggtcggggaggcgatgccaggcagctccatctcggccgccacctggcccagcttgccgctctcggccgggaagaggagcaggacggtgagcctgccgacggtgatacaaagcgggggaaggacgatcagaggcattgcatggtgggcgacggggcgcacaaaggagccagaagagacacctgccaagagctgtatgccaggcatgtatccttgaaatatccgccaataaatctctcagccgccagccccaaagcccctcctgcaacatcgtacacctgcaggagcgtgccccacgaagcctgtggaagattgccaggcgaggcgcgcggcccggctcctcgttggcgcaggtggccagcgcaattcccttgagtggcaggggttgggagcggaggctcccggcgtcgagtagggtgagggagcctccctcctgcagtgccaccagcctcgagacggaggagaggtagtgcagccccactatcgcctgcatggatcggggtgctgtgtgagggagcagccgcggcgtacataggcagagtggatggggccagacgacacagctacgcgacttcggctggggtgagttgcagctgagccctctggcagacgccaacacgtcctgaccaagcccagggccttctctgcatgctcgtgcgcacctttttgcccagatgcttcctggcggcgagggtgagggagccttcaggccccaccctgtgctcttccagggagccgtcttccaggcccaggcagacccgagacccgctcgaatccagggcggccgatcgcacgactggagctccggccggtcgattctgggcgtgccatacccggaacacccaccggccatccatgtgcgacctcaccccgggctgggcatgggcacgagatcacttgcgctgggaggcggtcacgggatacccatcgtgccgacaagtgggtctggagtcgacattatattctcatttttatgcagaaattttcagcctcgtgcaaaacttccatgatcacctagacatccttgcgcgcgatgcgcggtgtcctagcttgacccctggtggaccccatcaggggccgccaccagcagaggacccgtaccttgctctgccccctttatcttgacccctgcatcatccccctgcctcactgtcccctatacttgcagaatggcacgagaggccagtgaaagctttctcagtgagatttactgcgatctgaccctcacctcacagcatgcggaagagggccctgcagtcctgagcaaggaaggacttgagcttccgggcagccacagcgccccccatggcctccgccagctcggcctcgctcagcttggccagccccgccagactccctcctgcccgcatcagcggcctcaggttcccctccgtcacgcctggaggtcgttgtgggttttgggaagagcggtcgtgaacaggggtggggtgggatgaggggttgcccgtcaagcggcgactcagtggaaaataacagactaagcctgctcttccgcacacatttgacaccaacaaccgcctccatcgcattccacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctttataacccccaaacccacctggcagcctgcggaggacgtccatggccgggcggttgaccagggtctctcgatcagccatggcgccctcccccgcctccaagggcacgcctgccgtggcggcggccaccgggtctggctcctcctggttggccttcagcgcggcaaaggtcgcggcggtggcatgcagggagcgcgaccagaccaggcgcaggcgcgggtggtgcagcgtgagcagcaccaagcgcgccatgaggctgtgcaggcgcnnnnnnnnnnacgcgggtggtgcagcgtgagcagtaccaagcgcgccatgaggctgtgcaggcgcggctcgtccccgacctcccccgcggcctgcagggcaaaggcgcggtcgccctcaaactcaatcagcaggacgggggtggcgtagtgccgcgccatggcctccgcctgcgcaaagaggcggccggaggcgagcgaggcgcggaggtcggggatggccttgcgctccacgcagcaggaggcgctgagcacgtagtcgcccacctccagggtgaggggaaccaggtcgcaacccgccgcatgcaggaccgcggggaggggtgacatgaactcgcgcacatcgacgacgacgcgccgtcgggcggggcgggcggcggcgccggtggacgcccgcccgcccg

SEQ ID NO: 36814 - DNA, 61 bp, Chlorella protothecoides
gggacgcgaccacgctgcccgccaggtcatcgcgcagtgcgcacagcgcgtcgcccaaggc

SEQ ID NO: 36815 - DNA, 61 bp, Chlorella protothecoides
aggccctggcctagttccgagtggtggctgtggggaacactgtgtctgggaagctgacggc

SEQ ID NO: 36816 - DNA, 94 bp, Chlorella protothecoides
aagtaaaacgcctgggcagagccagtttgatacccacctggcaatataaagagcatagagaaggcatcgctctgggtgttccaggttcttggaa

SEQ ID NO: 36817 - DNA, 96 bp, Chlorella protothecoides
tccccgccatcctctccaacagatatggaccacaggtctacatgtgggaggctagcagcgcggataacatttgcaagtgtgtactcggcccttgtg

SEQ ID NO: 36818 - DNA, 93 bp, Chlorella protothecoides
cgccggcagctgcgaccccgcgccctggccggacccgggcgggccgccgccctgcagggaacccccgcccccgccggccccataccccagcat

SEQ ID NO: 36819 - DNA, 206 bp, Chlorella protothecoides
gagtcgaagaaggaggtcaggccggagaagatgtccagggaggtggggcggctctgcccgtcagcagcgccggagccgccggcggcaggggccgaggggggtatgttgccggtggggaccggcggcgagtgcaggacgccccgctgccgcgcttgggaggaggggccccggggccccccgcgggagcccacgacgccggcgatggg

SEQ ID NO: 36820 - DNA, 103 bp, Chlorella protothecoides
tgacctcatgtttcctcctgtcagcaccaagcagcggtgacttcccacccagaaccaaccgcccactaaaagcccacctgtatatcggaggggtcgtccccta

SEQ ID NO: 36821 - DNA, 61 bp, Chlorella protothecoides
cgtaggcgccacgccaggaggattcggacgtgcgagcctccaggtctgcggggcaggagag

SEQ ID NO: 36822 - DNA, 61 bp, Chlorella protothecoides
ctgccctcaggagctcctccgtcgttccgattgtccacaggcgtgtttgccaccaatcccc

SEQ ID NO: 36823 - DNA, 104 bp, Chlorella protothecoides
gctgggagctctactgcctcgagcacgggtaaggagaagtgttccgggccgatgatcgccaaccgacactgccttccggtgggcggccctgctcgcacccctac

SEQ ID NO: 36824 - DNA, 85 bp, Chlorella protothecoides
gcagagagaaagggagggctgtcgaacgatttgtgagccacgaccgatgcgtgtctgcaacacctggtagcctcagcgtcatgat

SEQ ID NO: 36825 - DNA, 151 bp, Chlorella protothecoides
caggggcaaggcccccatcgcggcccgcattcccgatgacaccgacgagtcgcacgccgcctactctgacgcggtccagcacgttgcggctgaccgaaaggatgccgacgccgtgaagaacgctctgaaggggcgggaattcaatggtgcg

SEQ ID NO: 36826 - DNA, 247 bp, Chlorella protothecoides
ggatggggctggggcgctcaaggatgtgccggtgagtggcggagggttgtgagggggggcgccggggtttaaggggagggggtggagagggggacaggaggcgctggggtagggggattaggatagcggtgaggggatctgctgcttctgcttcatgaggggtttgtcccgccagtccattgcgtgccagactacacgaaatggtctcacagtacatatggagtcctcacagcctgctcagtggctt

SEQ ID NO: 36827 - DNA, 72 bp, Chlorella protothecoides
tccaagcaccgccactcgtcggttcactgcaacattgccatcttaacccccccccccccccccccccccccc

SEQ ID NO: 36828 - DNA, 63 bp, Chlorella protothecoides
ggcataccttctccatccccaatctccccactacccacagcaaatccaccccctcctggcata

SEQ ID NO: 36829 - DNA, 61 bp, Chlorella protothecoides
ggcgcatgccgggagcgtggagtggcagggggccgcacggcggagcgagactcagcatgcg

SEQ ID NO: 36830 - DNA, 72 bp, Chlorella protothecoides
cggggcatggctcgtggtggggtgtgatgcagctgcatcagggcatcatcaagaagatggacttcctgatgc

SEQ ID NO: 36831 - DNA, 61 bp, Chlorella protothecoides
tccacatgccatggcagcatcccgtgccatcgcactgagcgagaatactttgcatataaca

SEQ ID NO: 36832 - DNA, 79 bp, Chlorella protothecoides
cacagccgcggcagccgacgtggcgaattggaaatcgcaatgcagtaggctgcctcccttgctgtagcgtagcctgcca

SEQ ID NO: 36833 - DNA, 61 bp, Chlorella protothecoides
tgcctgagtgattgggtcgggtgggggggaggcaggcaggtaagtgggttcggcaagagtg

SEQ ID NO: 36834 - DNA, 95 bp, Chlorella protothecoides
gtgttcaggcgtcagtcagatggatgagggccagcctccgttgccttcgaataaccagaccatccccagcaggggcgcagaagtctcgactggca

SEQ ID NO: 36835 - DNA, 69 bp, Chlorella protothecoides
agaggcctcaaaccccaccgcatgagacacattgcagcggcagcactgcccagcagaggcaggggacct

SEQ ID NO: 36836 - DNA, 65 bp, Chlorella protothecoides
cccgaacattgcatgccgacgcagcattcctctcattacttcacttcagccctccggtatcagcc

SEQ ID NO: 36837 - DNA, 63 bp, Chlorella protothecoides
ctgcaccgagaagtggacggagttgcagctgccctcgcttggcacattctgctgtgcgtgctc

SEQ ID NO: 36838 - DNA, 68 bp, Chlorella protothecoides
ttcagaagggactgcagcttggtgtagtcctgcttggcctgcgtcgaaggaggggcccagggtgaggg

SEQ ID NO: 36839 - DNA, 61 bp, Chlorella protothecoides
tcgaccctcccttccccccattccccatccacctccgcagtgatgcctgccatcgtcatcc

SEQ ID NO: 36840 - DNA, 69 bp, Chlorella protothecoides
ggcaccttgttttagacctcttacccaagcgccgtcctgtgggcagacacccagacccacgacatcgcg

SEQ ID NO: 36841 - DNA, 67 bp, Chlorella protothecoides
ctgggggctgggaggaggtgggctgggaggtggggaaggtggaggtgggggttgcacagcaagtggg

SEQ ID NO: 36842 - DNA, 70 bp, Chlorella protothecoides
cccctctcaccgactccctctcacgcgaggagtcgcctccatctgagcggcatgggcaggcgtggagggg

SEQ ID NO: 36843 - DNA, 480 bp, Chlorella protothecoides
  modified_base (164)..(357): a, c, t, g, unknown or other
gtgtgagtgtgtgtttggaggtcatggggattagtccaggaaacaacgagcacgctatggtgtcagaaaggtgaatgttggcttgtttctgctctttcactccgaaagttatgagcatggaggtctgtccatccatcgcaggcctggcggcgggaccccttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcagtctgggcatactcaggaaccaagtggtgtaccgtcaagaggagaacagctgagaggacatacatcagcatggcaccccttgacgcccccccttcccccctgtctcagcgccgacgc

SEQ ID NO: 36844 - DNA, 64 bp, Chlorella protothecoides
caacatggtcaacgccttcctggcagtgggggggtgcagcgaggcccagcccgtctgactgggt

SEQ ID NO: 36845 - DNA, 88 bp, Chlorella protothecoides
agaacatccggagcatcctgctggtgggccagtgttgttttcatggatggagttcaggggaggatggcggacggggctgcgcaggggg

SEQ ID NO: 36846 - DNA, 73 bp, Chlorella protothecoides
gcgtcggcagaccggcacgcagggccaagaggaacccctccccccccccaatgcatctcctcctcacctggag

SEQ ID NO: 36847 - DNA, 61 bp, Chlorella protothecoides
ttcctccgcccgccgccccttcaagcccctccccctcacctccacagcgggttccagtcgc

SEQ ID NO: 36848 - DNA, 63 bp, Chlorella protothecoides
cccccccccccccccccccccccttcctttccccccgcaggtactgatgctgggcgccaccaa

SEQ ID NO: 36849 - DNA, 285 bp, Chlorella protothecoides
gggggggtcccttgaggcatggattgcacaaataggtgattttcagtacactgccggcaatcgcatcgtcaaactgggcgcagcaaccgaggggtcccgcatgcatcctgctgctcgctctggagaggcatctcatccagcccctgtccttctttcctcctccggaaccaccccaaccctgaccccacggacacgcccctgcagatcgccgacttcaacctgagcagggccatggagagggaggtgatgatgagcaccatctgcataaccaaccccaggtagggt

SEQ ID NO: 36850 - DNA, 129 bp, Chlorella protothecoides
tcctgcagagaccgacgacttctgggagggtctggtgggctccggaggcatgagtcggtcggcgcctgcgccactgcagccggggctgggacctggcgcggtgaattctggtgcatcggccgagacggc

SEQ ID NO: 36851 - DNA, 142 bp, Chlorella protothecoides
tcttgccagctcaatagcagggcttgcgctcgtctgcctttttcagcagatctccagggcaacaaaaaatggcagtgcatgcgctgtggatcatgacatgatctggcgcaacgcgtcgcccacctgagtagcgaagggataa

SEQ ID NO: 36852 - DNA, 106 bp, Chlorella protothecoides
gcccgcctcctacctgtcctcccagcagggcgtagtagagaccagggtaaggaagaaagggtgagcacaagtggctgcagggctgtgctctgtacctaggcactgt

SEQ ID NO: 36853 - DNA, 16538 bp, Chlorella protothecoides
  modified_base (2524)..(2572): a, c, t, g, unknown or other
  modified_base (2624)..(2633): a, c, t, g, unknown or other
  modified_base (3407)..(3416): a, c, t, g, unknown or other
  modified_base (3945)..(3954): a, c, t, g, unknown or other
  modified_base (4903)..(4912): a, c, t, g, unknown or other
  modified_base (6700)..(6709): a, c, t, g, unknown or other
  modified_base (7840)..(7849): a, c, t, g, unknown or other
  modified_base (8127)..(8136): a, c, t, g, unknown or other
  modified_base (8752)..(8761): a, c, t, g, unknown or other
  modified_base (9418)..(9427): a, c, t, g, unknown or other
  modified_base (9959)..(9968): a, c, t, g, unknown or other
  modified_base (11187)..(11196): a, c, t, g, unknown or other
  modified_base (12488)..(12497): a, c, t, g, unknown or other
  modified_base (12621)..(12630): a, c, t, g, unknown or other
  modified_base (12752)..(13001): a, c, t, g, unknown or other
  modified_base (13232)..(13241): a, c, t, g, unknown or other
  modified_base (13469)..(13478): a, c, t, g, unknown or other
  modified_base (15017)..(15026): a, c, t, g, unknown or other
  modified_base (15819)..(15828): a, c, t, g, unknown or other
  modified_base (16063)..(16072): a, c, t, g, unknown or other
cgccgccttcgcccccggccgccgccggcaagttcccgcccgccccggcgccaggggcgcgaacggagccggccgaggccgcggcgtcggccgagcggcgcaggagctcgccgctgcgctcgcgaccccaccagccgccggcagaggaccccgcgagcagggcccccagcgcgcccttccgcgggcgcttgtgcacctccgcgccgaggctgaccgaggggctgcagctgctggccgcgtgcttgccgcccacctgattcacgcgcggcggcgggcggtaccactcccccgcgccgggctgcccgcgcggcgggaccctgtggtgagaggggcccgcccgcgagcctcccggcgacgtggcgagggccccagccgcctctgaagagggagtggtcggcgccctggggcgggcgggggcatccaccagcggatcagagcgtgtacgtccggggtcgctgccgcccgcgccccaacccgccctgctctgctggtcggaggaggaggaggagccccctgcagaggaggaggcgccggcgctggtcctgccggccgaggcctcgtccaccctgctggcgtcgttcgacgagccagggtctggcgccccccgcgacgcaccgtcgctgccctcatcccagctcggcctggcgcgctccccgcccacgctgttctgcgcgctgcagcagggccgctgcgcggctggagggcccacgggcatgcaaggatccggcgtgcgcaagtcgcgcggaggagcctcgctccgcaaacggggagccggttcgcaggacgccggctccgctggcagcactgagtccgacgcctggggcacctccccactccctcgccgcccagcctcatcgtcaggggccgccagcgagtccgccagcgcggcgctggacaggcgggcggccaggctgtcggcgctggccgcggtctcatcctcctccgtgccgccgcggccgcgcgccgcggcagaggcgtgcgagtccgcgcgcgccggctggggttggggcgggggcggcgggggtctgctgccacggcggagagcccgtacgggagccaccgccgcagcgctgccctcgccctcgaggctcggcgccgcgccttccaccccgtcgctggcgagctcggcgtcgcccgctccctcctgctcctcctcccagtctgtggagggggaggtgcatggggagcatcacaacaattcaaagaaacaaagcagccatgaccaccactgtcaggtcaatctgatcaggcctgcaggcagcaaggctgccaggcacatgacacggatgtcccccccccctcctcctccgcaccactcagtccgcaccttgctcggcaaagcgtgcaacggctctcagggcgtaggtgcggagcagtgtctcctgagcagggttcccctcggcccgggcacgaagccgcgccaggtcggcagccagcgaggcgcgggcggcgccgaccacacgctcgaaggcggcgcggttcagggtgagcggggactgatgatgtgtcgagtgccgggccgctccatctgctggaaagagggggcagcatgcatgcatgagggtcaagggtatctaatgaccttggggaggagaggtacggaacgctgcccgattttcacatgaagcacctgccaggccgcccttggcatcgcctgccgcctccattccctaaaaaaaacctcggttgctatcgcattgtctcacccagggcggcatgagactcggtgcgttggatggccgccagcatgtcggcattcagctcgatgcggccaaactcggccagcagatcgtggagggcacgctggggtggagggctcccgcgacctgtgacatgtgtgcggggcgatgggtcgtgcacattgctgcgtgcagaggccagcgccctgcagcgcaagtccaaacagtggaggagctagacgtccacctgcctgcggtctggggcgcccccgccttccgcttcttcggggagggcggctggacatcgcgagcagcagcagccacagctcccagtgcatccgccacctgtccgtccagggcctggaccgacagggtgcggaaagccgcagtggcgcctgtgcagttgagccgggagtgaggtcgacgcggtcggatggcccacttggcactccagctcctcagtgagaagcaatgtcagtcccgtccatctgcaacaggaaccctcacactggaccccgctcacttcctacgacggcagcatcctcctcgccgtccagatccggctttcccgtgccggtgtcattgctggcacccacagacagggcaggagccagggtagtgggcacccgaggcgagccctcgtaccggggagcgcggggcgagctggtctcatgcgggtccccaggtctcttgagtgttgcatttgcccttgttttgcgctgtttcttcggggtgggcacgtccttggagtcctgggagcccgccatggctacctcctcaccagcgacagcccggccatgagcgaggccttaccgcggcacgagcagcttgatcgaggcgagatnnnnnnnnnnnnnnnnnnnnnnnnnnnnnnnnnnnnnnnnnnnnnnnnntattcatgttaccatgctggaggcatacgcggcgccactgggttgctcaatnnnnnnnnnncgttttgccagtgcgagatacatctggcgcggtcgcgcgctcgcgtcgagttccggtcacattcatgttaccatgctggtggcatacgcggcgccactggctcgctcagtcgagaccctctatcccgcggtgatataaaataaacgaccgctcctcattgaggttatattcctccaggaaggggccatgccgcggtccctcgcccccgctcccgaggggaaggggccccccgccatcatctcaccatccatcctgtcctctgactttgctgatctggctgcagagagcaagaaaattctgagcatgggggccgactggctgcacgtcgacgtcatggtgatcagggggacctggggttggtcaggtgcagggagggcatgggaaagtactctgcactcgaccatctcacaggccgcgggccaggctgccggtggccttgcatgcaccggcgtctcagcatacagacgcccccttgcaaacacgcgctcaagcatccccccacttcccggcctacacaggacgggcactttgtgcccaacctgaccctgggccctcccatcgtcaaggccctccgcgcccacaccgacgccttcctggactgccacctcatggtctccaaccccgcgcagtgggtggacgactttgcggcggcgggggtggacatgtacaccttccacctcgaggcggtggaccccgagccgggcccgggcgcggaacccctccccaacgtctcggccctgatacgggccatccgggcggcgggcatgctggtgnnnnnnnnnncgaacccctccccgacgtcgcggccctgatccgggccatccgggcggcgggcatgctggtgggcatcgtgatcaagcccggcacgcccgtgcagcgcctggagccctacctggacgccgtggacatggtgctgatcatgacggtggagcccgggttcggcggccagaagttcatgcccgaccagctggacaaggtgcgctggctgcgcgcggcgcggccggggctctacatcgaggtggacggggggctggcgcccgccaccatcgaggccgccgcggaggcgggggccaacgtcatcgtggcagggtcggccgtgtttggcgcccaggacccgcgccaggtcatcgccatgctgcgggccgccgtggaggcggcggcctgacctttggtggggcggcggcctgacctttggtggggcggcggcctgaggatgggcggagtggcagcctgatttcttggcaagggcagaggccccatggggtcctgagggccggcctatcagggccgatggatgcaggcaatgaaacgnnnnnnnnnnattcttggcaagggcagaggcctcacacggtcctgagggccggcccgtcagggccgatggatgcaggcaatgaaacgcccgcgccacgacagcctctggaatcggggtgcagcctgctgcacgcccatgctgggccctcatgaacgagcgtttgcttggcacatggcccctcgaacccccgcagcatgcttctggcagagccatgcagccccttgtgcgtgtcactggaacttggcccctgccactcagtgcttcctgtaccatgtcacacccgcacttttcggttgacaatgtggcaagctgtaaacagagatagtggtcggtgttgactggggatgctgccagccctgcaggccggccggcaagcacggggtggtttcgcggaagctgcatgtgacaggctggaaagcggcccatgacggccaaccagcactgctgcaagtgggtgggcagtgtccaaaaggctggggccagcagttgagggctgaaagggaatgggcagatcccgaccacatgcatgatgttgggtagaatggcccagggggacatcggaggccagcaggccgccgccgcggtctcgcgctgcagatgggccaggaggtcacagcgagccaggtcgccgctgggtctcgtcgcaccgaagcagccacggtcttgatcacgcagcagtacgggcccttcgtccggggcctgcgcagtgccccctcccgccctgcaggtcagagcttggagagccagagggtgttggccacgcccacgacgcccatgaccagtcccagtccaacgcagaggtagcccagagcgcgcgacaggtgcgactcccgctccagcctgacgaccaaggcccccggcaggatgaaggcgaccatgacagcggcagtggcccccgtcaggctcatggctccccaaaccgaggggaaggcgatggagacgacgtagagcaccgccnnnnnnnnnnggcggcggtggcccccgtcaggctcatggctccccagaccgagggaaaggcgatggagacgacgtagagcaccgccaggatggaatagctgacggcgtagaaggcggcgccctcgggcatgtccacgcccagcgcgatgcgcgagagcgtctggcgcagcgcccagttgagcatggcgaaggtggccacgaggcagaggcagtaccccgcgcgcaccgcgatcgagagcacggcagcaaaggtgtggggcacaaaggctgccaggccctccggggtcaggttgttcaggatgttggcgtcggtgtccgggccgaagagcatgtagccgccgccggcgacgagcgtgaagacggtggtgcagacggcgagcgcgcggcggatgaccatggccatgcgccggtcgctgaagcgctggagggaggctgccaggggcaggatgttgtagtggcagacgaatgagagggagatgacggggaggacggagaggagggtgagcgcgatgcgcgcggggctgccgcccagcgcctccgcgctcggcagccagtggaaggcggccaggcgcccggtccaggccgcgcgaccggcgatgcccagcacgctcagtgcaaaggcgccggccacgcccacggcggccgtggaggcgggggccagcagcgccaggtcgcgcagagagagcaggggggccaggcacagcacgcacagcgcgcccaccaccacggggcgggagacataccatacggccgggtcgtggatgcccaccaggttggtcaccaggccggagtagtgcgggggaacgcccaccagcacgtcggcgatgatgatgaggtagatgatcatggtgcccgcattgtttagcacgatggacccctccagcaggcggctgcccagcatgccaaactcggcgtgcaccagctcggcgtaggtgccgcgccgcgcgatggccgcgcagcgcaccaacgcatccagggagaagaaggatagcgcgaagacggccataagcaggccgaagcccaggcccaggcccagcgtcgcgaaggcccgcggcagcgccatgatgcccgcgcccatgatcgtggtcgccagattggcagtggcctgatgcagggaggaatgggggtgggtggagaggggaagtttggggggtgggaaggggttgggagggaggggggcaggcgggcaatacagggtgcacatgcgtgtgttgctcgtgggtttcgggcaggcaacgagacggggaggacagacgatggggcaggtgtccagagccattgaggccggcagcagcggctgggagtggagtgcgacccgctcccccgtcaactttgcagcggaagccacagcagccggattgcgtcatgagtaggaggtcgcagccatgcacgatgcatgagaaagcacctgcatgcggccatggacgcccacatgtacacactcccccattcacgcaccgatgtgacgcgaagaccatgacgaccggggctcaggggctcgttggggtaacagagctccctcctgagcgcggtggtgggcgtggacggggctgagaaggtgggctgcagtactgttcctcgccgacaccccaaaccctgctctgaccgaggagaagggtgccccaggcaacatttcaaaacttcggagtcggactcggcaccaactcactcttcttcctcttcagcacgtttcctgggaatcaggagagcctccaggtcggggcgctgctcgttctccatgcctgcagaatcccgggacagtagcgctgcagggcttttgacctcgtaccacagggtnnnnnnnnnnaaagggtgccccaggcaacatattaaaacttcggactcgggctcggcaccaactcactcttcttcctcttcagcacgtttcctaggaatcaggagagcctccaggtcggtgcgctgctcgtcctccatgcctgcagaatcccgggactgtggcggtgcagggcttttgacctcgtaccacagggtgcgacaccacgaaaacttgattcactgggaggaagcgagctctgtagtcatttgggttggagccttgtgacatgattcatcccacgcgccattgttgagaatcgcccaaccctcccgggccgcgcccagggggggccgcggatctcgtcacagacaattctcggggacccaatgtggggccacaggaaggggctttgaacacgggatagcgatgagtcttgaattgattctgcacgatgcgttctttccatgtgcttgcagcaagggagtgcgcaggagtaatgggtcaaggtgggtgtgttcctgccgaagggaaaccctatcatgaccatcagcgtgtggcaagcacagggccaaaacaacagtgcctgctgttccctgcttgtgcaaagtcaggattgcagctcattacaggcatgctgggagtacgccaacctggcgacatactcatgagtgtgtgtgtatggttatctatcgcaagatcttcacccaggagcctgcgagcgtcagtgtcagacatcgatgtagtcatgtggttggacctctttcttgccatcaaacacgctaagggatggggcctgcggaggtagagggtgcgggtggattggtgccggtggggccggccgcttcatcgtccggttctccacaggcatccggggcccttgcagggccttcccccatacacatgcagggcgtgcaggggtgctgagtcagcactcatttcacgcaccagaatccgggtgtaccggtcaaagtagaggagctgcttgatgagcaagccgaactcgcgtgggaagcggatgccgtgcttctcgcccatgctcgtgaggtccaccaggatcttgtttatctggcggtgtgtgggggggcgttgggagggggtgtgcggaggggtatggcaaagacgagcagcccgttccactgaccgcaaacggcatcaaccccnnnnnnnnnnccgttgggagggggtgtgcgtaggggtatggcaaagacgagcggccagttccactgaccgcaaacggcatcaaccccgtcccctcgtggcgatgcctgtccacccggtggtagccatccatcacatttcctacgaactgccgccgggacatcctgtcagcagcctccctccccctttctcacccccccttgggatcaccatcccacaccgcaaaaacacgccctttcccactttccaccccaccccaccccacctgcggctcgatggcctcaagggcnnnnnnnnnntccccctgggatcaccatcccacaccgcaaaaacatgccctttcccactttccaccccaccccccccacctgcggctcgatggcctcaagggccccggcgctggggcccccctccatggaggaaagcaccgcggccgcgtccagctcccccagccgccccgccagccccgccaggtcggccgccaggccctgcacactgacccgcgcctcggtgacgcccacggtggccagggccgcggcggcggccgcccagtcgccggcgactagggcctggcccagcgcacgcacgcccgcccaggtgacgggcgagacggagcccacgatgccaaagtcgatgaagcccacccggccgtcgcgcagtaccagcaggttgcctggcgatgaaggggtgaggagacgtgggcgggagtcggcgcatggtcgtacgagtctcctgtgcgcctgtgctctgagccctcggaccacacactcctattcctgtcttgactccctccccccttctcccccaccccccccagccaacctgcatgaatgtcggcatgaaacgtctcgcaggccagtagggagccggtccaggtgtccagcgccgcgcggagcacggcttccgggtccgtcnnnnnnnnnncaaggagacgtgggcgggtgtcggcgcatggtcaaacgcgtctcctgtgcgcctgtgcactgagccctcggaccacacactcccattcctgtcttgactccctccccccttctccacccacccccccccaagccaacctgcatggacgtcggcatggaacgtctcgcaggccagcagggagccggtccaggtgtccagtgccgcgcggagcacggcttccgggtccgtccccggcgcgtgcgccaccacgaccgcagcgtcggtgagggggacgccctccagcaggtccatgaccagcacccggcggctggaaaaggcggggtagggctcggggcaggtggccaggcgccgcgcgccgctggcgtccaggtaggcgctgaaggcggccatgtgccgggcctcagcctccaggtttgcctcgcccaggaccgaggtccggaagtcggagagcatggccgccagggaggtgcgagataaggaagggctggcagcctccagcagccgcgcccccagcaccaggaaggtcatgtctggggatgttatgaaggcaaaggaggagggaaggggggcaggggttgggagtgaggtgggccagagggggagggccgtggaacctgacaacggcggcttggcacagcaggtaccccagctttcggnnnnnnnnnnaagggccgtggagcctgacaatgccagcttggcacagcaggtaccccagctttcggcgaggggagccggtggcagacggccctcccacacggaaccaagcgcgaatgggtaaacctcaagaccgatccttcgagaatgccgccctctacacactcacacctgtgcgcaaggtgtcctcgatgccgggcctgagcaccttgatcgcaacacgctttccagaggcacgcagcacgcccacgtgcacctgagccacgctggcggcagccagggggaccgggtcgatgtgggcgtagacgctgtgcaggggggcctttgcggctgcctctatcagcggcctgtaaggacagggggtgggggaggggagaatgggggttggacattggtgccagtcgcaggtcacggcacttggcggccccatctccacagacatttggtgcccaacgcagacgcagtgcgacagaaaacttatgcctcagtgcccagcctcccaccagcccacttcccagccgctcctcccccaccccacatggtnnnnnnnnnnagcacttggcggccccatctccagacatttagtgcccaacgcagacgcagtgcgacagaacagttctgcctcagcgcccagcctcccaccagcccactccccagccgctcctcccccaccccacatggtcccccgcctcagcagcacacctgatctcggagaaggggacggggggggccgcgtcgaggcatgcctggaactcctggacatactctggcggaaagaaggagggcatggaagcgatgacctgacccagcttgatgtaggtggcccccagcccctcgcacagcctgcgcagcaccgccgggcctgggaggggcggccggcgctgggcgacgcgctgcgcctgctccagggtcaggccggccgcgatcctggcgacctgggcgccacgcaggatgccccgtgggcccgaggacaggagggcgtcctggatgtccgccagcaaggccgattgctgagtggtgggccacagggagggcctcgagatgtgggtgggtggggggcatgccctggtccgatgctgtggcacgagcgtataggtcgagaaggggcggacgggtgggtttagtgcgctgagcatgccgtgcatggcggacaggctgggatgcacgcccatcattgccggggccgcgcaggccgtcaggcacccatgcacgactgcctagctgatctgatgggcggcgagtcaatggcaatgatcatgacaggaagctgacatgtgaattcgatggcggcactcggtgacaatgccccttcgatcgctcagtggtggtgagctccccgagctcccgccagctggcaagatgcgatgccgtggggaagcccacacacccctccaagcactcacaagttgcatcacatgggtgcgatggcaataaaacctgacaaactcaacatcatggcagacagcggaacccggcacgcgcgtgtggtgggcccatcgacacatgaggaggatgtctcggacgtgaaagaggccaaggccatcgcccaggactacaacccggtgcaccacaccctgtccgagaagccggcatccgggacagctacaagcggctcaaaggatgcccaggtgtgtgatcgggacggtgatctcccgagtacagggcttggatgtcttcgagtgaacatgctggtcactgggagtcttttgtattgcaggagtctaccctgatgccaatcctcctcctctactgggctgcagactgctgctgcnnnnnnnnnnaatgtctccgagtgaacatgctggtcactgggcgtctttggtgttgaaggagtctaccctgatgccaatccttctcctctactgggctgcagactgctgctgccaagcccctccaggagtgatgtgtctctccctctctaccctgttgtcattcggcaccgtgcctcgacgtgccactctctgcctccgctacagacaccaaagaatgcatgcagtcgcatttacacggtgtagcggtccttgggcttgtttgactgcttggcatcagactgcatggatgaaggggatgggaggaaggggtcggtggcaggtgaagggacaagcaatctggaagcgcacaggcctgagcagatgtgaacgcccaggcactccatcacccccagagagggactgccgacttcgcccacgtgaaccagctatatggcaagcgcgatgggccagcactgcagccccgactcgcgaatgcacacacgaccacaggccctgacgtccgccgctcgtgggcgccaccattccagccccgcccattccaccagcccccggcctcacatgtgccatgaagccgatcttggcgtggtcgctcatctggaggacctccttcagctgcttggcgatggccacctgcaccgcctcgttggcggcggtgcgggtccacagcgcgatacggtattgcttggccctgacgttgaccaccccaccgcagatctcctcgccgtcgtcaaactgctcgccgatgcaggccaggatcttgcgaggagcaggaggggtggagggcgactgaggatggcgcccagggggaagatctggtgggaccaattgtgcatggactggggatggaggcccccctggatctgcgactcaggcccggcagccatagcatgaggcaggtggcaacgccagcagggcctctctgctgcaagagacgcaggaccccatcggtcccctgctccccatccaagaggcctaccacgtgcagccagttggtgtccagcagttgggcagccgagggagagccccccctggggatgaggaaggaccacttgccaccgttggcgcaggcagggtcctcccacttgggctcaatgccatcccggaagagatggatgtcggctcccaccgccaggcgggagggcggcaggatgttgttgtacaggctgcgtgcgcgggaagggatgtgggggacggtgaggggctggcggatgtggcttgcacaggcaaatggaggcgaagggaatccattgtacaaataaaaatcatagtatgtgtagatcagctctgcatctgcgcattgnnnnnnnnnnggggatgtgggggacggtgagaggctggcagatgtggcttgcacaggcaaatggaggcaaagggaatccatcgtacaattaataatcatggtgtgtgtagatcagctctgcatctgcgcattgnnnnnnnnnnaccagcagggtctctctgctgcaagagacgcaggaccccattggtcccctgctccccatccaagaggcttaccacgtgcagccagttggtatccagcagttgggcagccgagggagagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccacaccaatccgcaaggccacagagggatgatagcagatccgcacggccgctgtgattctccctcccaaagactccatccaccgcgcaggggggtggctctctggataggaggtcccattgccacccgaaactgtcacagatccgaacagaggtcaagatactccgatccccaatcatccacttcgctcccgggaataccctcctcacccccagaactcctccacgnnnnnnnnnntcgaacagaggttaagatactccgatccccaaccatccacatcgctcccgggagtaccctcctcacccccagaactcctccacggtgccaaaagtgtagacaggccgcaaagttttgccccactgcgcctgatgttgctttccctcagggttatcgaaccagaaagtccacttcgtctccaaggggtgcgtctcctcgttggcagcctccactgtggtcaggcaccgnnnnnnnnnnatgggtcaccttttgcgggagatgcctcgccttcctccctcgctaccggcttgccatcctctgccattgctgtgcgctgcaccctctcgcccgcgcggatgcaggaggtgatgactggggcggcaggtgtatgggatgtgcggaacgctgcactgacagtctgatctcgtctcgaggtttgcaaagccgatgtcaggaggtgtgtggtacatcaaatcacacgccaagctccctccaactctgcatggctgcagaacttacatttgaccctgaccttgcgaacggctcaggagcggggggggcaatgataccacgcacacaagttcttaaattacaacaggggtgtatgcccatcagggtattggatgaaactgtggtttctgcgcaagcatgctgtaaagggggatggacctaactcaggtgtagtcagacagcgaaaaggaggcggtgcaaggtccgcagacaccctctcagccctgaaggggagtcctcattcatcctttgtcacggtgacctcctcagacaccctgcaggccaccatagggatatttagggtgggttggaggggatggggcggactggggtgactcgaacagcattcaaaccaggcacgacgtaccaatcctcccatgccggtcagcgcagtcgccgcctgcaccccccgacgcacgtcggttctgccctgggcgcatatgacgtgtagtaattccagcctgcccccatccagaggacagagaccgtggcgacgatgccgggctgcagggcgcctcgccaatcgagtgtgccaaacaccgtcagctccagcaggaagtgaaggagggcgatggcaaaggatgccagggtcgccccgtaaatggagggcacgcaggggttgcgggcacagatgaggcagaggacggaggatgtcagggtccacaccgcaaaggtgcggccttgcaggtcgttcactgtggggcggggtcatgggccgatacaaggcattcagcgacgaccagtagcaatggcaggccggctcaagcgttgcccttcgtgctcgtcacccaccaaggaaaggcttccgattgtaaagattcgtgcgcagcttgtctggggagccgaagccgatgaccactgcacgggggagggggcgccgagttttcaacctgggcactgactaccgctcgctcaggcctgaacatgctcccccaatcgccatgcaggctgcacatcccccaggcgccccggatcacctgcaaggagtcgcaacagagcaacgaagacgagccagcgcctgagcgcggtgacagagggcattccagaccagctgcagagaatggcagcgtccccagcaggttcgcacttgaggtgccttttcagctcaaggactttgactggctcgaaggtgtttggcacggagctactgccccagtacagcgccccgatcaaccttccttcgtgatgcaggcacaagggccttccccgctttctcacctgtcgaaggggggcacctgcagcacctcgacgctgctggacatggcagctggaatgactcacactttnnnnnnnnnnggggccttccccgctttctcacatgtcgaaggggggcacctgcagcacctcaacgctgatgggacatggcagctggaatgactcacactttggagctcatcacgcagaaccctcttggaccacagacaatcactcggcacactgacagatcgtggtgacaagagctaggctgcaacatcctcttcctatacactttgacctccttcacgacataagatcactggattactgaccttcaaaagcctggacatgcaacgacaacattatagaagcctgcagctgtatactcaggcgttctgacctggggaaaaggggtttgccgctggcagaacaatgtgcacaggggacggaggatgtgggtatgtggggccttgggggtgctagtgcatacgggccaggaaagcctcgtcagcgaggcagtgcaagacgcagggcttgaggagtgccgctgtacgcatgaaaaaagtgtcctgggcagtcaggaaagggaaagaggtaggagaagttgccggagcgccatcaagggcgatcaccccggcaggcacgagaaggtcgcgctcgagagacggcgacatgatgagataaataccgggaagagggggatgggaacggaagggctgaggggggatgggaacgtgggagctgccagcctcggaagggaggacattcgcctgccggggtacccaggcatgggcagcggcagcaagtacaagtgcggatgatgaggatggggatgtgggtggggaggagggcgtggggattgcgtcgcaggctggaccacttcagcagggtnnnnnnnnnnggcctcggaagggaggacattcccccgcaggggtacccaggcatgggcagcggcagcaagtacaagtgcgggtgatgggtatggggatgtggatggggaggagggcgtggggatggcgtcgcaggctggaccacttcagcagggtgcccgccgcccttgggtcaaggtcgacgtggacgggggcggggggcccaggccgcgcgctgcgcgtcgcgccgcgcggccgcgcggtgcnnnnnnnnnnatgggcgggggcggggggccgcgcgctgcgcgttgcgcgtcgcgccgcgcggccgcgcggtgcaccttggccccccccctggcattccctcctctcagcgccccgcctgcgcctgcgtgtaggcgtaccaggagaccctgtgcagcagggtgtccagcgccaggggcgccgcgagcaggggcaaccccacccgcagggcgcgcaggaggcgcgcggcgggcccggcgccctggctggccagcaggtcgaaggcgacagcggcgccgccacggaccagcagctggaggcgcgcgtgcgcgcggtaccgcgtctggcaggccagcagcacgcccaggacccagaccagggtccaggcgtccatgacgcgcgcgggcgggaccggggcggcggccgcggcggtgggcgccggctccagccccgcctgcccgtcccgccccaccacgccctgccacacggacaccgccag

SEQ ID NO: 36854 - DNA, 61 bp, Chlorella protothecoides
gggcggcagctccgtcggaagctctgctggaaagaggtcggtgtactcgtccaccagctgg

SEQ ID NO: 36855 - DNA, 73 bp, Chlorella protothecoides
cccgccgccgcccagtcccggcctgctcacgaccgcgccaacaccgccctggatgcaacgctatgccgaggtg

SEQ ID NO: 36856 - DNA, 61 bp, Chlorella protothecoides
agttccgggggcgcggtttacagagccccacagggcgacgaggtagtgcagagctggcaaa

SEQ ID NO: 36857 - DNA, 70 bp, Chlorella protothecoides
cagaagtcggaaaaggttgcatcggtttactactcagtgtgttgtgcgcccagtgcctctcggcgccctc

SEQ ID NO: 36858 - DNA, 72 bp, Chlorella protothecoides
ggcggcaggcaggcgacgagcggggccaggtatgcacgcgatgccaaacaccagggccccaacgagccacag

SEQ ID NO: 36859 - DNA, 61 bp, Chlorella protothecoides
tgtggatggggtgagcataatggcagggcctgcatacccgccttcaaatccttgtaatggt

SEQ ID NO: 36860 - DNA, 61 bp, Chlorella protothecoides
caggaccacgacgatggggacgaacaccgctgacacgcggtcggccagggcctggatgggc

SEQ ID NO: 36861 - DNA, 101 bp, Chlorella protothecoides
acctcgacatgtaggcaaatgaacgagtaagagccaaacggacattgactgggatgtgtagcccatccttttcatttgcctctcacccatgcagcgaggtt

SEQ ID NO: 36862 - DNA, 62 bp, Chlorella protothecoides
ctagaccatgatcccttgcgtccggatgtgctccggagagaggggaccagggggaatcgaac

SEQ ID NO: 36863 - DNA, 61 bp, Chlorella protothecoides
agtctatgcgctgctgttcccggcagctgaacctgccagtccctccggaaagaggggaaga

SEQ ID NO: 36864 - DNA, 73 bp, Chlorella protothecoides
acacaggatgctaccgcacagctgcgctccttgcttcccaaacaagctgatgtcagcgtctcagcagcaccga

SEQ ID NO: 36865 - DNA, 158 bp, Chlorella protothecoides
ggaggagaggaggctgggtcggcggtaggggtcgcgcggcaccctctgcttgccaggtgcacggcgagggccagcgggggcgaggccgtgtgtttcgcatgcaggtgggggctgttcactcccacatcgtacgcacacacacaacactccatcccctc

SEQ ID NO: 36866 - DNA, 76 bp, Chlorella protothecoides
agccatcgtcaccatttatcagccacgttaaacaatgcattattgcgacagcccgtgcaagtggcttcttcatccc

SEQ ID NO: 36867 - DNA, 61 bp, Chlorella protothecoides
atttggcggctgtgcgcgcgggcacatgggggcgaccacccaccctctggccctgatgctt

SEQ ID NO: 36868 - DNA, 87 bp, Chlorella protothecoides
cacccacagcaccctccctccctcagacgtgacatccaagcaaagggcccacgcacagcgatgtatgccgcctgggagccctggaag

SEQ ID NO: 36869 - DNA, 61 bp, Chlorella protothecoides
gctcggccccgacacggagttcccgctcgtaaacggtgtgtgcgcctgtgtagagcagggg

SEQ ID NO: 36870 - DNA, 61 bp, Chlorella protothecoides
gacacacaaggaggtgaggcagcacctggaccagggttgggggagcattctgaccgccatg

SEQ ID NO: 36871 - DNA, 61 bp, Chlorella protothecoides
gggggagcattctgaccgccatgctcttgagatcgcacactgccttcgacagaccagatgc

SEQ ID NO: 36872 - DNA, 64 bp, Chlorella protothecoides
cgggctggtgggcgcgctggccttcttccctctaaccatcttcttccccatcgagtgctggtga

SEQ ID NO: 36873 - DNA, 190 bp, Chlorella protothecoides
cggggtgctggctgggctccagccagactgtgccggtcggcccatcaaggtctacgtcacaggccacaggtgaggtgcggggcaactccggctgctctgggatctgccggaccctgtgcatggctggaagtggcgatgggacatcgccgctggatgcacggggccgatggccctgccaggatgtggcgaa

SEQ ID NO: 36874 - DNA, 61 bp, Chlorella protothecoides
gaacggaacaaccacctgggaggggggcgggcggcaggacttgagaactccagtgacatca

SEQ ID NO: 36875 - DNA, 75 bp, Chlorella protothecoides
ttgtggaggaacgacagggtcctcgagcctaactctggcagcaggtagggagcgcgagacacttgctagaacagc

SEQ ID NO: 36876 - DNA, 64 bp, Chlorella protothecoides
cctggaggatactgtaacagatgcagagcacataggggacagggaatctgtctacatggggtcg

SEQ ID NO: 36877 - DNA, 62 bp, Chlorella protothecoides
gatacaattgtatactgtgtggagaaggggtgggccatctgggatgaggtgactcttgtcat

SEQ ID NO: 36878 - DNA, 71 bp, Chlorella protothecoides
ggcagcccgatcaccatttccaaacgtattttgacttctcgagcgtaccaagttctcctcgatatcccacg

SEQ ID NO: 36879 - DNA, 61 bp, Chlorella protothecoides
agggagggaccagggctgaggacggattgcgaacaagaacgacgctggtcccatatgctca

SEQ ID NO: 36880 - DNA, 65 bp, Chlorella protothecoides
ctgcagggaaagcaagtgcttgtggatggagtggggcgctgccccgaaacagaggtggaggtgcc

SEQ ID NO: 36881 - DNA, 3729 bp, Chlorella protothecoides
  modified_base (813)..(822): a, c, t, g, unknown or other
  modified_base (2431)..(2564): a, c, t, g, unknown or other
  modified_base (2793)..(2802): a, c, t, g, unknown or other
ggggggggagagcttgtttgggggtgtaggggagtattctggagtgcccgggcctgcaaacctgggcggagcattgctacgtccttcagcatacactgcaccatgacagaggcaagaggctgtgcatggacaattgccaggggtggcgcaggcccactgcaacccctgccctccctgccccccctgggagaacagaggctggcaagggggcagtgcaacaacacagcgcccccaaccccagcaccctatgaccccccaaacccctatgcgccactcctcccacctgccagtgcttcccgcgggggaagtgggtggggctgtcatccggtgtagccagccccgttctggcaggggccgtgctggcgccctggcaggtgaccgggcgactggcgtgcgactggcccggtcgagtgtgcgcggggcggaatggcagggatccgggggtcacgcaacgggagggcggggaggcaccgggcggcaccatgacggatgcccttgtggacggtggggtgatgccgctgaccatgcccctcgagtgcccaggctgcgcagatctcgatgcgcgggatccggggtgagaaagaggaatgcaaggattaggatatgccctggggtggtcgcatgcgccgagcagtcgaacgagtactcggggccctggctagagcacgtgacgggatagcgcgcatcctggcttcgtggatctccgaggtgtacaggactgattgctcaggggggcatgtggaggcattacatgcatttaggagcacctccactcagttgcctgtctgaacacccctccaggccagccagaannnnnnnnnngctgattgctcaggggggcatgcggaggcattacatgcattaaggagcacctccactcagttgcttgtctgaacacccctccaggccagccagaatgccagccccgccaggcaggtgtagaggacgtctgctcgggcgctggggtcgtcgctgagcaggtcgccgatcaccacggccaggaggacagaccccagcgccaccagcagccctcgagagagggactgggaggtggcagaggctgcgacgccctggatggcctctgcactggcccgccctgagtcggcgcggcctgctgcgccggctggactcctgctcccctcctcggtcctgcggggccgctcctcgtcctccttgtctgccgtgtacaggctctgaaagaagtggccctttgacctccggcgagcgacatcccgcttccattcagacagctcctgggcgttctctgcgctttcctgccgggaccgcttgagcacagcctcgtactcgtccagctcagccatcaggtcggtctgcgggcagggaggggtgggtgtgaggtcggcaccaggcactgccgggcctcaacaccacacagaaaggggagcaagcagaggatgacaatgtgtggcctgagatcttgacatcctgctttcccctcttcccaaaccagacccaccagcttgttatccatgacgtccatggactcctgcatgtactgccgcgacctggagtcggtgtcctccttcactctttccaccattgcacgcatttcatcggcgagcgcatccacctccttgtccacctgcggccggcggattcagtgatgaggcactgcacatgcaagagctttgtacctccgaggagcaggtgctcgttcaaattcgatgaacacaaagaccacgttcgcccttgcctttttcttctcgatctcgctctggatctgggaaaccagctcctcctggacatggtttggctcactgctgtcacccttggcagccctggggagcgctggcatggagtgggagcgaccccatgagactgcataacgaggcagtcttgtttctgggagagtcgttcggaatgcggggcgtgcccccgacggtctgcatgatatccctgttgacatcccgtgccgggaaggtcaaaagttgagtccccctgcctccgctttcgttagattgatgtaattcagaagcgtagtcttacaattacttaactggagatgcaatgcatgcatgcggttctctatgcgcctgttgtgtaccccaaatcaacggcatctcgacaacgacactgggcgcgcactgaaaatggcctgaggaactgagtttcaggtctgagatggcatccccaagcacgctctttggtacaccgcgagcatcacttcagacttcgcggaggaattgacctctcgtctcgcgccatggagctgaatgaggcggtgttccgaggtgcgtattcggacaagcccatcggccttgaccacctgctccggtggcccggatctcacgagtccctttcccaatccctggcgcagacaaattgaggacgctgaacagctcatccgccagcatcgagggcaccagcacgtgggtctgttaccaccgggcacatgcacagcgggtggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacgtcggtggctagagaggctccctgcggcctggagtgcggcttgctttggtgcccccttctgtgcctgcctgccttgcgatttggacatgcatgcccgccgctctgcacgagttagctttgcatgcactgcgtccagcagcaacccttgcaccaaaacctcgcagacccctctcacccctgccctcatcactggtaccatcctccctgccgcagccggcgcaaggnnnnnnnnnnttttcccaatccctggcgcagacaaactgaggacgctgaacagctcatctgcaagcatcgagggcaccagcacgtgggtctgctaccaccgggcacatgcacagcgggtggccgtggtgtgggaggaggtattcagcaaggcggaccagcccaagcggctcgcgctcgtgtacctcgcctccgacatcatccaaaacaggtttgcttgttgagaggtgacgtcggtggctagagaggctccctgcggtctggagtgcggcttcctttggtgccctcttctgtgcctgcccgccttgcgatctggacatgcatgcccgccgctctgcaagagttagctttgcatgcactgcttccagcagcaacccttgcaccaaacctcgcagaccccactcacccctgccctcatcactggaaccatcctccctgccgcagccggcgcaagggccctgagtttgcctctgaattcttgaaggtggccccccgcgccctgcgacacatgctggcgcgggccgacgccgccaccgccggccgcgtgcgccgcgtgatcggcgtctggcgcgaccgcaaggtgtttggcagcgccgccgggcgcgcccttgacgagttgctggacgacgccgccgggtcaggggcccccggagctgggggccctggcacagcggtccccggcgcgccgcatggtgcgcccggccccggcggttatcacaacccccctgcccccggcgacaacgacggccgctctgatagccccacccctgtcgcgccggaggacctgctgcgcctgctgcaggccgcgcaggccgcgcggcacgagagcgcggcctcggctgcctcgctggcgcgcgtgccgctgcaggcggcacgcagcacgctagaccccggcgcggtggcggccgcgcacgcggcgctgaccgcggcgctgggcgc

SEQ ID NO: 36882 - DNA, 132 bp, Chlorella protothecoides
gaggagaatagaggttgggcaccagcataccgagccccccccaaggaatcagcaatcggcagacggggaggagcacgcccgaggaggagcagcgcgcggcaggatccagatccggggtcccacaccatgcgt

SEQ ID NO: 36883 - DNA, 511 bp, Chlorella protothecoides
  modified_base (303)..(382): a, c, t, g, unknown or other
ggcggcgccgtggcgcgcggcgcccagcgccgccagctccgaggacgcgtcccagtcctcgccgtcgtcggtgtcccgcgcgaggtcggaggaggtgcgcgcgctgggcgccgaagcggtggtggcgtccccttcggcgtcggcggcgtccccctcggcgacggcggtccccgccgccacagtccccagcagcgccgcctcgctgccgcgctgcgagggcgagcgccagaactcgagcgtgggcgcgtggtccaggtccagcaggcgcgcgtgcgagccgccgtcggcgctgaactggaagcnnnnnnnnnnnnnnnnnnnnnnnnnnnnnnnnnnnnnnnnnnnnnnnnnnnnnnnnnnnnnnnnnnnnnnnnnnnnnnnngtcggcgcggggcgtgcgcgcctcctccccctcctccgtcgtggcgtcggagaggcgcggcgcgatgggcacgccgtgggagaggggagaggcgtgggcgccccgcgccgcgccgcgccgcccgcgccc

SEQ ID NO: 36884 - DNA, 89 bp, Chlorella protothecoides
gttactggatgccgtggaggcacagcaggtctccctgagtaaagaagaggcgtggtcctctttggtatcctcgcccctttgattctctg

SEQ ID NO: 36885 - DNA, 138 bp, Chlorella protothecoides
gggcgcgtgagggggccgagtggcgagcaggaggccaccggcctggcgggggatgagtccgtggcagccgagggtctccagcccgataagggtgacggggaccccctcgaccgcactgagtcagccacgtccccggcg

SEQ ID NO: 36886 - DNA, 406 bp, Chlorella protothecoides
  modified_base (94)..(343): a, c, t, g, unknown or other
atatgcataccagggtcgtgccgatgcgccgcaggttcgtggctggtggtatgtttaggaagggcatcctgcacagtggggcagcaaccaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagggtgagtaggatgctgactgctgggggttgaggaagggagggggggggggcgggagggg

SEQ ID NO: 36887 - DNA, 76 bp, Chlorella protothecoides
tgctgtcgggggcgcacgggtcggtggcatatggaccctggggggtagcgccgtcgggggggcagcgcgtggcgcc

SEQ ID NO: 36888 - DNA, 129 bp, Chlorella protothecoides
gaggagcaggctccagtacgctatgttcaaatagtagtatacctggagtgggagtgggaagaggagagaggaacttgtagcctggagggtgagagaccagcgggcgggcggggggagccaggtgtgtgc

SEQ ID NO: 36889 - DNA, 74 bp, Chlorella protothecoides
ccgcgtcagcttgagtatcaccgagcgactccaccaggtcgtcacgcgtgcgcagcagcagctgcaggcaggcg

SEQ ID NO: 36890 - DNA, 65 bp, Chlorella protothecoides
ccccgcggaggactcccggtgagcttgaacgcagtgaaccccttggggcgcggtgggcatggtgt

SEQ ID NO: 36891 - DNA, 90 bp, Chlorella protothecoides
gaaagcatgcagtcaccacttctggtgtcccactggactcctgagtcccatgttgagttccccatgtcccaggcggcggtcaagcgttac

SEQ ID NO: 36892 - DNA, 80 bp, Chlorella protothecoides
taaaaccctcgctcatgatccctcccccctaccccaacccctcccctctgggcacacaggagaagaccaaggactgggac

SEQ ID NO: 36893 - DNA, 61 bp, Chlorella protothecoides
gtcagggctagaccctgcacaggacgccattcttcaagttgccgtcatcctcaccaatggc

SEQ ID NO: 36894 - DNA, 67 bp, Chlorella protothecoides
gcccgggggtgccatgatggcagcacttcccgtctggtccttaccaagcccacttgaccgacacccc

SEQ ID NO: 36895 - DNA, 61 bp, Chlorella protothecoides
cctccaacgcccctgccatgaaggtcttgatcaccaaaagcaaactctttgcagccttcat

SEQ ID NO: 36896 - DNA, 4288 bp, Chlorella protothecoides
  modified_base (236)..(464): a, c, t, g, unknown or other
  modified_base (939)..(948): a, c, t, g, unknown or other
  modified_base (1308)..(1317): a, c, t, g, unknown or other
  modified_base (1660)..(1669): a, c, t, g, unknown or other
  modified_base (1886)..(1970): a, c, t, g, unknown or other
  modified_base (2200)..(2209): a, c, t, g, unknown or other
  modified_base (2334)..(2343): a, c, t, g, unknown or other
  modified_base (2460)..(2469): a, c, t, g, unknown or other
  modified_base (2648)..(2657): a, c, t, g, unknown or other
  modified_base (3106)..(3115): a, c, t, g, unknown or other
gccgcgccccgctgccgcctcgcccaggcgcggcgcgacctgcgccgcggcggccgcgccctcgcgcatcagcgacgcgaaggcttcctccgccccgcccagctcctgcaccgcgcccagcacctccaccagcacggccaggcaggccacggcgtggcgccccgcgccctcccagccccccgcccccgccagaaaggggcccaggctggcctgccacccggcctgcatgctgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagatctgcggagggcgccggccccagcccagcaggcatctgggggggacggacacagcctggtcgcctgcgccacggcagcgccacaaggcacacagcgccgtctgcggcgagcagctgctgcgccggcatgggcgcgcagtgcagagacgttgccctaccaccctcttcaccgggcgaggcgtggcatcagcagccccacactctcccctgccgcagctcacccttgagaccgcggacgcagtgcttgagggccctgagggagcgcagctttgactccagcgaggtggggctgtccatgcccgccgaggctgccaggtcgccgacgaggctgtcccagggccgcgggacgtcaaagcgcgccaggttgctgatgagcagcgccagctggacggccacgcgggacgagggctcgctcagcaggcacgccgtgctggtggtgcgcacgtacgccttttcggcatctgcacgcnnnnnnnnnnattgaatgacgaatgttacagacgagatcccgaatacggtgaggggctttggtgttaagacattgcaccaggcgacgaaggcatggcacagggcacggatgcaggtggaaagtggggggagggccccaaacagggcgccccacaacagtttcaggggccgagttcgaggcccggacacaggaagaaagggtgaaagaaggtcggcactacaccgctcccgcaacgaaggggcactttcacaatggaaaaccctagcggatttcttacgtcatgggaccgaccaaaccgggtatatattatgacagattacaaatctgtcaccgacatacacaagcgtgcgagaggtcgggggttcgattnnnnnnnnnntcttggagctgcaccctcttaccctccacttcccaggactgtttcgaccacgctgatgtcaaccaagggtcctcctttgacatgtatgtcccaccagtccatgcatagaattcggatgcagaatctgccagatcaaggggtatcactggcatgcagttgcttgtgtgcaggcgagttcaggcatggtttcctggagtctgcacccctgatcccacacaacacagagacttgctgtcaggacccagccctgacaatcgttacatgaatgttctagcgagaaatgcgacgccgtcggcaagaagcgcggcgcgccgacagcgacgggcgccgccagctacagacnnnnnnnnnngctttctttttgcttttgctattcatgaatactgttactattacaatcttgtaagaaatgcgaagccgtcggcgagaagcgcggcgcgcagggtctgaggggcgccaccagccacaaacgaagctgcaggctgcgtggaactctttctgcacctcaccgacgacacgcggcttgacggatctaatactgacatctagaaggctcctcatgaagtttnnnnnnnnnnnnnnnnnnnnnnnnnnnnnnnnnnnnnnnnnnnnnnnnnnnnnnnnnnnnnnnnnnnnnnnnnnnnnnnnnnnnncagagcatacatgtccttgctctgagtacacctgcaccttgatctctcccctgtaagacaagctcccccgtaagacaagctcccccgtaagacaagctcccttcgtgtgtcaatcccaggatggtacgtaaaggatccaacctgtcatagggtggggttctttcacttgctgttgtcgaagcccgcagttggaagatgttgttgggcctgacttgggctccaccccgggnnnnnnnnnnaagagcatacatgtccttgctctgagtacatctgcaccttgatctctcccctttgagacaagctcccttcgtgtgtcaatcccgggatggcacataaaggatccaacctgtcatagggtggggtnnnnnnnnnnctgggagtgttgcgtacaaggaccctcagtatagtgcggggcttgggtttctgttgtgggggtggtttagaccctacaacgtggattgctgtatatgatctaaggtaggaatgttannnnnnnnnnctgaatgttctagcaaggaatgcgacgccgtcggcgagaatcgcggcgcgtcgacagcgacgggcgccgccagctacagacgaagctgcaggctgcgtggaactcgtcctgcacctcaccgacgacacgcggcttcacgaatctaatgctgacatctagaaggctcctcatgaagtttnnnnnnnnnngagcctccggagagggggccctcacaacacttttgcacctgcctgcccactttaagccaagagcatacatacccttgctctgaggcaatctgcacctattctctcaaccattctcttctggacacactcccctgtaagacgagcctcccccttccgtgcgtcacttcaaggaaggtacgcaaaggatccagcctggtacaggttagggttcgttcatgctttttgttcaactgttttttaaaagttttgggcagctcttttgctttttgtttatgtgtttaatgtcttttttaaaagttttggatatgatcctcgctttggaggtcgggcaggtgccctattctcctaccaggcttgcgccggttgcacagctactttcgaagatcaggctggcgcatttggttgctcagtcagcgaaccagagggagttggaggggggggtgggaggnnnnnnnnnnaaagccagcagttggaagatactgttgggcctgacttgggctccaccccggggaccgatgtacatgacctctgggttgggagtgttgcgtaggacccgaatacggtgaggggtctgggttagtgttgtggggccgggctagacccacagcgtggactgctgtttatgacctgaagtagaaatgttacagaacaagaccccgaattcggtgaggggcttgggttttaggttcggtgccaggcggcataggcgcggcgcagggcccggacgcaggtggaaaggggggaagactccggagagggggcccccacaacacagatctaccatttcagagtcagggcatccgaggtgctgccatcatctttgactctcacaacttgggcataagacacaagggctaccatgttcgccggaagcctcacagtaaaaaaggtgaacaagccggtgtacgaatagcttcccactataaccactgcattgtccctagtgaagaaagcgagcccaaccctgccagaaaagatgcttccctcattgattgtgaatgtgaactcgttccctgattttgagacgctcccagtaatgggtccaagtgctggtggggggtgaggaaaggacatgggggggaggagagggcgaattgacgaccgtcagcggcacaatctcattgatgatacctgcactcaagaagagggttgcagagccaaaaacatactttgacatgctcgacggatcctgcgggtcccccgtgagtgtagtgacagcagaggtgggcgatgaatcaaactcggtcacgagtctgtcaaaggcagctgagtacaggatgaaaaagacggaacggggagtgtatcccacagtggtcaccatataggtgatgggtatcttcccacgggcaacagcaccaaactggattgtagcagatgcccgtgggggtggtggaggcgaggagctgggtggtggaggcgggctgggtggaggggaggggctgggtggaggggaggggcttgggcttgagggtggaggaggtggggagctaggcagaggaaggggggcaaggcaggggagggaggctcgggcctgagggcgggggaagagatggccttcagggtaggggtgtggattccttggagggcgtgtttggagattccctactgagtcagggtgaagatgtcttgat

SEQ ID NO: 36897 - DNA, 63 bp, Chlorella protothecoides
ggtaggacggttgctgggcccgggggtgtgatagcagggccgggggtggcgccatcgtcctgt

SEQ ID NO: 36898 - DNA, 73 bp, Chlorella protothecoides
gtgcaggcagcttcgtacccgcccaccaacccacccgacccacccatacaggtcttcctgcatctccggatcg

SEQ ID NO: 36899 - DNA, 5201 bp, Chlorella protothecoides
  modified_base (1169)..(1178): a, c, t, g, unknown or other
  modified_base (2478)..(2487): a, c, t, g, unknown or other
  modified_base (3019)..(3028): a, c, t, g, unknown or other
  modified_base (3365)..(3374): a, c, t, g, unknown or other
  modified_base (3750)..(3759): a, c, t, g, unknown or other
  modified_base (4051)..(4237): a, c, t, g, unknown or other
  modified_base (4469)..(4478): a, c, t, g, unknown or other
gctccgccgccgccgccgcccaggcgctgctggacacggcgcggctgtcgctggaaggctgccgccgcgacgcgcaggcctgggccctggaccgcgcggacctggaaagggcggcgcgcgaggaggcggcgcgggccgaggagctggcccgcgacgtggcgctggccgtctccagggtgggtggctggggtgggtggctggggggaggaaggcgttgtaggtggagggaaccgggggtggagaatgcatggcagcgatagagagggatcaaggggggatggggtggcaaactggtgccaagggcagctgggccgggccgcactggcctggtgcctggagtcctcagcacacaactgcatcgtaccctgccaaagctacagcgctgccccgcacccccctgccaacccaggccgcggccgcggaggagctggcctccagcaccgccgcccagctggaccaggagcgggcgctgcatgcccagctgctggccgggaaggaggccgaggcgaggggggaggcggagcgcgcggcgcgccagtaccaggtgacggggtgcggtggttgcgtgatcgactcggcagtcgccccatgcgcccgcccgcgtgtgaatccagcgccggcctcccaccctctgcccccactcccccttcctccccaaaggccgaggccaacgagacgcgcgccgcgctagagcgcaccgaggcggcgcgccagtccgctgcgcgccagctggacctggcgcgcatgcagctggaccgactgcggggtgcgggtccccgggggccgcccggggggaggcggggcggcgcggcgcagggccgattcgacgatgaaggcgacggcgacgtgttcgatgcgctccacgacgggccagcgcagcggcggggcgccgcgcgtgccgcctcgccgcccgggcaccgggaggtgggaggaggtggcttgagggagcggctcgggtggcgtgccctgtccgacgcatgtccgacagttccagggccagggctcccatctccgccccccggcaccagctcccttgcgtcccgcccagctcccccagccttgcgcacacctcgcctccacacgtcgcagggtcgcatccgcgccgtgcaccatccgccggagtggggcgacgagggcggggggcggcgggcagaccggccgatgcccgnnnnnnnnnnacggctcgggtggcgtgccgtgtccgacgcatgtccaacagttccagggccagggctcccgtctcacatctccgccccccggcaccagctcccttgcgtcccacccagctcctccagccttgtgcacacctcatctccacacatcgcagggccgcatccgcgccgtacaccacccaccggagtggggcgacgagggcagggggcggcgggcagaccggccgatgcccggcggcgggcgcggtccgctgggccgcgacatccccggggtccaccacaagaggcccccagccggggaggagctccgactggggacgagggtttccgacgcggacgaccccttggcgacggtgcggcagcaggtccaggccgccaagcagtacctccgccaggtcgccgacgcgaatgccgcggtacccggccgcccctgacgcctgcaggttgagggggcggaaagacgactttgacccgatgcgcaagccatcgcatgcctccccacataccctgacagacatgaccccggaccagccccctcttcccaccaccctcctcaccgcgatcattgacgatgccagacccctcaccacccatgttgtaagttgacagatcaccaatctagcctctgactgtgacttgaaagttcccttgtggcacagcttccttcacttcacccaaatttgcaacgagagaatcgcaggggatcttggatgcacgggcagcacctgtccacctcacactcggagatggggcgcctatatcaaacccacgatcaccgcaacgtaaacctctcacgtcctgctgacagagacaccacccagcccagccatggcctccagagtcgcagcctcctgcctgagcaccaaatcgacctccgtctccgcagtctcgcacatgcaaagctgctcccggctcgtccagaagcccgccttcgccgcaagactcagcgccccggccttcacccgtgccaggccttcgagagccttcaccacctccgtgcgtgcagcagtcggcaccatgcctggaaccgtgtacgatttctccgtgacggtgcggcggggtcgggagctgggaggtgggctggaacttgcctggaagcagggtttccacggtctaccccttctcgaccatggcccccggcccttttcaacctgcagagcatcgatggccagaacgtgcctctgaaccgctacaagaacaaggtcctgctgatcgtgaacgtcgcctcacaggtatggttttgtttagggtcgtggtggtgagtgttctctgggagggttggccgccgtcctccgtccagctgccnnnnnnnnnntgcctcacaggtgtggttttgtttagggtcttgatggtgagtgttctctgggggggttggccgccgtcctccgtccagctgcctgtaggtggctgatcgcccgatctcactcagcatgtcttgaatcaaacgtatataatctcggctccccacgcagtgcggtttcacgccccagtaccttgagctggtggagctgcagagcaagttcaacagcaagggtttcgaggtcctcgccttcccctgcaaccagtttgggaagcaggagcctggtaccgccgaggagatcaaggcctttgccaagagcaagggggccaacttccccctgtttgccaagatcaatgtgaacggcagcgatggtgggttgagtgggcctgatctgtggtgggagcatatttgggccagtggcttcccagtgagatgggtggggggtctgttctggtgaaccgtctatcctcctagtattctagtcagctcctgatctcaatctcttgctgtgcacctgacagctgaccctttgtggaagtggctcaannnnnnnnnntgtgggcctgatctgtggtgggagcatgtttgggccagtggcttcccagtgagatgggcggggagtctgttctggtgtaccgtctatcctcccagtattctagtcagcttctgatctcaatctcttgctgcacacccgacagctgaccctttgtggaagtggctcaagggcgagaagggcggtttcctcgtggacggaatcaagtggagtgagttttggctgtgcattctggaacatggctgctgcacagaaaagagtttatgctgaacatcccgtgggtgaacggatgtgatggccttattgtgatagtggcagctgtggctgacgacttgcctcnnnnnnnnnnaaaaaaagagtttatgctgaacatcccgtgggtaaacggatgtgatggctttattgtgctagtggcagctgtggctgacgacttgcctccatccagttgcataatgtcctccccctgccaaatttccgacgtccgcagacttcaccaagttcctcgtcgacaaggagggcaaggtggtgaagcgctatggcagcaccaccacgcccggcgccatcgccgacgacatcgccaagctggtgtgatgcagactctcatcgctggagcagacttttggtcgatggcatgggctgttcagctgtgtcgagatggttccagacatgttacccccccctcctattacttgcaatggcctcggtgtgattgcaccatacccatnnnnnnnnnnccgagatggttccagacatgtttaccccccctcctatcacttgcgatggcctcggtgtgattgcaccatacccatcctcccccagtgttggctgttccttccaaatggtccaattttttgtggcatgatttaatgtggtctgacttggttgaaggaatgagggaagcgtgagcagctttcccccggggaggggccagccagctgcaaatcaaagagtacatggggcagggtcaggggtctcaaggggtgcatcaaggtaaacccgggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggggttgacggccattgatcccagtccatgctggcccaggcccgaggttgcctggtcgtcagttgtaccgagatcatccggccgcgcgcggtcccaatgtgccgacctgctgcgctggtgggcacccctccacaccaagcaaccatcctggagcctggtcccgggcttcctcacgtgagccccagcgcgcaaactccgcttcttccccacttccccaccccctcacccnnnnnnnnnnacgtgggcctcaggagttgtcggccggttcgctgatgatgggtcctaggtcgccaaagtcgggcatgttgaaggaaggggaggagacctctgcggcactcggcagattccagtaggggtctccgaactgggttgccccaggtccaccattcaagagcgactgtggaggggagggtgcaatagggttgacggccattgatcccagtccatgccggcccaggcccgaggttgcctggttgtcagttgcaccgagatcatccggccgcgcgcggtcctaatgtgccgaccttctgcgctggtctgcaaccctccacacgaagcaaccgtcctggagcctggtcccaggcatcctcacgtgagccccagcgcgcaaattccccttcttccccacttccccaccccctcacccaccctgtcgacgtcggcgaggtggtcaaactccaggtcgtccagggagaagccgtccaggcccggcagctcgcccagcggctccggccccacctcggtgatggtgggccccggcccggcgtccaggggcccgaagccgggcgcgtcgcccagcacaggcgagctggtgaccaggctgggcgcctccacgcgcgcgccgccctcgcccagcaggccctccatcgcgcccgggtgggcgggccccgggggcgagagggggatggcaggcatgccgccccaccccgccgccggcgctcgcggcggcgaggccgcggcg

SEQ ID NO: 36900 - DNA, 111 bp, Chlorella protothecoides
gtcagcgaccactgctgaaggctaccaaaacgagtccgtgatagaaatgggaactctgggccacgtttgcatcatcgttcaccctgttggaaggcgaacaattgccatccc

SEQ ID NO: 36901 - DNA, 103 bp, Chlorella protothecoides
tgaagggcgggtcgcggcccgatccaaaggaaaagtgcgcaggtgtagcccagaatgcaggcggcgggccgtcgtacgacagagaccccaggccggcggggtg

SEQ ID NO: 36902 - DNA, 61 bp, Chlorella protothecoides
tgtatgcccacgtcgggtatcaaacatcaatggttacaggatttgctgactgagatgaaag

SEQ ID NO: 36903 - DNA, 63 bp, Chlorella protothecoides
ggatcctttggtccggggggtcccaaccaggccacaggattcacggctccctggtctgcaggc

SEQ ID NO: 36904 - DNA, 61 bp, Chlorella protothecoides
gcggctgcctcctccgcctcctgcgtgaccaagaaagcgaggggggggccagtcgatgaag

SEQ ID NO: 36905 - DNA, 111 bp, Chlorella protothecoides
gctcaccccccattcctcccgtctccccacgactctaggtgtcatgtcgagactggggcctgcccaggctgagcgcatggtggaggaccagaggatgagggaggaggaagg

SEQ ID NO: 36906 - DNA, 62 bp, Chlorella protothecoides
cactgccgttgcctgatctgcccactggagactgaaacgctaataggtgatcaaagtatcgc

SEQ ID NO: 36907 - DNA, 76 bp, Chlorella protothecoides
caaaaccgcgatgcgcagtacagctcatgggccccatcatggataatgcccaggatgcatctgaaaccgcgtcgca

SEQ ID NO: 36908 - DNA, 61 bp, Chlorella protothecoides
ggggctctgggctgtggaggagaggcgggggcgcgccctgcgtgttcccgggaggggtttc

SEQ ID NO: 36909 - DNA, 12648 bp, Chlorella protothecoides
  modified_base (1684)..(1693): a, c, t, g, unknown or other
  modified_base (3432)..(3441): a, c, t, g, unknown or other
  modified_base (3530)..(3627): a, c, t, g, unknown or other
  modified_base (4961)..(4970): a, c, t, g, unknown or other
  modified_base (5886)..(5895): a, c, t, g, unknown or other
  modified_base (7374)..(7383): a, c, t, g, unknown or other
  modified_base (9944)..(9953): a, c, t, g, unknown or other
  modified_base (10292)..(10301): a, c, t, g, unknown or other
  modified_base (11543)..(11552): a, c, t, g, unknown or other
  modified_base (12019)..(12028): a, c, t, g, unknown or other
  modified_base (12461)..(12470): a, c, t, g, unknown or other
ggcaggcgggggccgaggggggggtggaggcagtgcgggcttcggcgcggggtgaggacgactgggttcctgtgcctcctcctgcgcggcagcatccgggggaaaagggtcgggggatggaacatgagaaagtcgcccagatatcgtgacaacagcacctcggggggaatgtggacggatggcagctcaggcctgcaatcagctagcccacctggggtgtttcagccgcgatgctggccagctccgcctcaaagttggcgagctctgcatccaggtccgtcatgctgacgagctcagctatagagaagacagaggatattggccaggcaagagcctgcacagctgtggtaaaacaatgcgtgccaccttcggggaggacaatcgtgctacactcgaactctgacacttgcaccagattatggcgagcttgtggaattcagttggttagccagtgctggtcagggcactctcgcagtgaggaggcaagtgtgtcgagtgcatgcttgctctcgacatcccgtgttcatgtccgaccgcatgcgcagcgcggaatcgcgcctcgcacacttccgcgctcctcgggtctcgagggccaattccttctttgagaatctcttaaatgcgatccccttcttgatacatcttcactgtagagctcttggaaatacagtcgaggcggaacattgggaaggtgcacctgcccaccagaccctgagcagctatgggacgcaagggaggaggcaaggcgggcttcatgaaggcacagatgcgccagaaggaggaggtcagcccgccagagcaggatactggtccagaggaggcgcatcccgctactagtgccccagggaccacccagaaggaggagtcgacgtccaccaccagcgcaaaggcgagcgccttccttgtggacgacgggccagaggagtcggctggggagagaccctccgtgagctgtggaggcgagacgcgggggaagatgctgcagcggcacaagcgggtgaggcggagcgattgcgtttgtggtggattgccgcagctcagtggcaggggagccagcacaactcttatggcatcagaatgcacacaccctcgtggtcttcctctgcgcgtattgccctcctctacacatcgcacagccagcatctcatccgctgctgcacaccccccattccccgggtgtcaggaagcaaagtcgctcaaggagcaagtgaagcggctcgggaagaaaggacgggaagaggccgcggccctgcagcaggccttggacgccgcccaccagcaagatctggaggccatggcccgggcagaggaagaaagcatgagccagggcatggaatcgctggcgctggggcccggcgccgcgccgcctggcggcgaggcgctgaagccgaccaaggcccagcggaagaggcagcagcgggctgcagcagaggtatggctcttggtcattttttcatgtactagtccacccaatgcatgtccaggcgtgcatgggcattcgcatcggggccgtacccacgaaatggcggcccaggcggatgaactgaggccatacgctctgatggatgattgttgggaggttctgtgacacagcctcaggcagggcccgaggaggagccatgcttgacattgcgtttccaggcaacgcccctcccccccactccccatgtcctgcccaggcggnnnnnnnnnngggccacacgctctgatggatgattgttggggggttccgcgacacagcctaaggcagggcccgaggaggagccgtgctcggcattgcgtttccaggcaatgccccttccccccactccccatgtcctgcccaggcggagcgcgaggcgcgcatcgccgctgagctggcggacgcagacgacagcctcagggtgcaggaggaggaggcgatgagcagcacgctggcccccctgggcctggccatccacgagatcgcgcccgacgggcactgcctctaccgcgcgctgggtgggtggcggcatgcaggctgttggtgtctggaagcgctgtatcagttgagcccagcctgcaagctttgtgctcgccctgtgtggccggccctgcttgagcggcctctgattcgatcggggcctggcatgatggagcgccaggcgttctactccttccggtctacacctttgggagacggagccccaggcaatgcatctctcatgcatcacccgggagcttactcacccctctcctccccgccgctcccctgcagagcaccaactggacctccaggacgggagtggcgcggcatccttccaggagctgcggcgcctggctgctgagcacatgcgaacgcatgccaatgacttcagtccatacattgccgaggtgagtctgtgtgaaaagttggctcggtgggttgagagcctcgtgctggcctggcatgggaccctcggtgctgtgcgctgctcacgtcgcaaacactctgtttcatgttggggtgatgtgtggccatcaaacaaagtgtgtcacccctgctagcattgccgaccttattcccatgtgatgtgctcaacgagttcacgattcgcactcaacacaccccgttcaggatgatgtaaccgggcctgtggaggatggggaggtgtttgaggcctactgcaaggaggtggaaagcacagcggcctggggcggccacctggagctacaggccctgtcacaagccctgggcaagccgatcaaggtgtgggctgctgctgccgcaccacagctgttgggcgacgaacacccaggtagttgagctgaggagcttttgattggagcttggaaagcagagaggtttcatttgtaggggacgaaaagcatcaatgttgaaggtcgaatgatgggcatctgtgcatgcctggttgcagcttgggcaacgatctacgagaccctctcctatgcttgatatgtcaaactcattcaagcccattccatgcaggcccagcactgcaaatatgttacctgcaccatgcctatggcctgggcgagcactacaacagcctggtgcccgttgtgaaggaggaaagcgagggagcagcgtctgtcagtggcgacgagtgattcctgagcacatggtgtggcagcactgttgctgagtgcagaaggaagagcctctctgtcccatgtaagacatgccacaatatcggacccggcagaaatgtgtgctgtaaaggcacagaggatcaggagaaatgaccaacaagagccctgggcgatgggcaatagtcagagaacacaaaggcttctgctgccaaccaaggaacctgcacgctgctgtacatcacggttgcaccggtccaacactgtgactctgggttgataggactgcaagcccggtttgagcatgagcatatcgagtcctgcagcccattttggtgttggatatttaccccagtgcggtacatatatgaattatctccttcnnnnnnnnnnagtttgagcaagagcatatcaagtcctgcagcccattttggagttggatatttacccaagtgcggtacatatatgaattatctccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttttgatgcatgttgctgcgcggtgcgccgttcaggaacgaacagggattgtgatactgaccgattccagataaagcttacttgatgaaggtgctgagtggaataccctgtgacgctcagggtgcccagcgggggatgaaccagtaggcctcagtcaccaacttcccaaaactaggagatacaagatggcacaacctataacccactctgctcaaaagagaagttctacaggattggcgagaagccctctgtctttgtctggttcctgccctgtgggagcttgacagatcaagtcctctatatgctttgctaatatcctccatcccacaacttctgggaatgcaaatcatcaccgcttttccagtttcagtagaaacacgacacttccacttgatgctgtttcccgccgatttttatatgcttggggcgggagttgggcaccgccgctgcgatacaaagagtcggctagaatccctgcgctcaacagaattcttacattgcgaaatcattcagttttacttgatgtgagcgatcatttgatccgatggggttctcatccctttagctcctagctagtactgagcagtcaccttttgcttgaccaccaagatgctgatgctcgccctttgacgagatggtggaggaaaacaagccatacgtagacgcaggtatgagatgtatgggccaatgaatgcatggaggctggtatctgtcgtcccacgcccgtgccatcaccaacagcccacgcacccctgtcctgcgcaggcagcgccctggctgcacccttccggcggagcaagaagcaaagaacaagcggagagagtgatggcgtgtctccggggacctgtgctcttcctggcgaagatgtgaagccggccctcccagcccctgtgaagctgtcacccacagatcgagctccccaaaccagcatcaccaacgacctcaccctctccagctcccgcggctaccgtaccgtgcgtgccacacatggcgtgagctctggggcatggtactatgaagtgaccgtggagtccctcggtcagaccggcgcagcccgaatcggatgggccactgctgtggccgaactccaggggcctgtgggtggggatgccaagggttactcctaccgctccctggaagggtccaaggtatgctgcgtgtgtcattgccgaggctgaagagtggaacgatctgccgcggtgcccatgggcgtggaaggggttctcgtgtgtatccgctgcgtcttcctccaggggtcaagcattaatattgaccatgcctcaactcctcgcttctccccctcaaccaccgccaggtgcatgccggggtcnnnnnnnnnnagtcaagcactgatattggccatgcctcaactcctcgctcctcccactcaaccaccgccaggtgcatgccggggtcagagccgactatggctcagcctggggggagcgagacgtgattgggtgcctgctcgtcctcccccccccgccggcctccaggacaggtgtgcagccgggctgcctgcaacgttgcggcggtcagcatcgccctgcatgccccgtatgtccgccgcgcaatgattacagaacattcctcgaacagtcgatctgcacatgtgtgcagagacatgactgatctcacacccatagaatctgagcgcacatgatttcggtcctgtcttgcttgaagcagtgtcatgtttggggccagaaacgtctcgatccagcaccaccaatccctcaagcgatcccttccccatcctccctctcgctcagaggcaggcgaggaggctgtggcatccgcgtccgggtcggtcttctttttcaagaatggcgaggcccagggggaggccttctccggtatccctctggcgacctactaccccgctgtctccctgtacacccacgcctcccagccaactcccgctcgcgtctctgtcaactttggcgcaacgcccctggccatctgcggtgggcgggacagctccgaggccctcgccgctgccgtgcaggtcccggccgtcgaatccgtcgcggccctgtccctggcagtgagcgcacctccgcgtgcccttggcgcagcctgagtacatggggcctgtcctgtacatcaagtttttgagagacagcccacgcagcacacttgttgtacagcgcctcaagccatgcctacgcatgtccacggcctccccctttcgacgctgcctaaattatgatcccatcacgcgcccctgtgtctgagaactgggccctgtacatnnnnnnnnnngcgcatgtccacggcctccccctttccacgctgcctaagttatgatcccatcacgcgtccctgtgtctgagaactgggccctgtacataaaaagactgccatgcacacacctggcacagcggggagagctgcagtgagaggcgcgcataaacccctcagagctcttcatgcactggcgcccccccataccgtgccagctcgcgctctagggcggcgacatcgacggcgcggcaggccgcgggggtctcgaacctggcggcgtattcgcagcgggagggctcgctgacgtcaaacaggcgctcggtcgggccgcagagcgtcgtcgcctgcaggagcagtggggagacattgctgtgattgctggtcgggaagctgatcggcggcaggctgactgcgggccgggctggcgtgtgcaggctcattggaggacgggcaatgtccgcaatgtgctggatgtccccatggatacggtgcacaaccaccccttccctgtccccagacccaacatcacgtgagccagctctgcgaccatcaggcaccggcacctgcaggctgcgcgccggcccgttccagcactgctggccgcgctggaaagcgaggcgcgccccgtcgtccaggaggccctcccagcggcccaggtttgtgccgccgccgctgccctccacctgcttggcggcgccaaaggggcagagctcgtaggtgtacttgtccacctgcgccgagaagcagcggccgtccagcgccgcccaggcgctgtcctcgccataggcgcccttcccggtgttctccagcttggtctccagctcggcgatggccttcttggtctcccgcacggccgtcgccgcggccgacgccgtggtgcgcgcgtgggagaggggggacttggctgcgtccaagtcggccttcagctgggccaggactgggcacaggaaggggtggtgtgggatggaaagcgagaatgcaacgctattatggggtccaagtgggcggccagtgcaggcccaggcgggaagtttgatagtcagtttgcactcctgggaccaggcaaattttgggattcaaggctttccctgcaagctgacaaccacagggaacaagcaaggttcctgcaataccatcttccaaacctcccctttgaatcagattcctcacctgcatctgaaaccttgctctttagcacggccggggcagagcggctccgggagcctgggagcagggacagtgcggcgctccacacgtcagccagggctgtgaacaacgcgaggagtgggccttggaacactcctggtcgaagatggacatcacgccagggaaacccggctcgcaaccaagcaccttggtgatgtgcagctcgcccacacacccgcacccagccagctgccaagcattccttccatagccattgccctgcaccaatcccacccgtctttgccctgcccaggactccaggagggacggagaccgcggccgctgcagcannnnnnnnnngaccaagcaccttggtgatgcgcagctcgcccacccacccgcacccagccagctgccaagcatttcttccatagccattgccccgcaccaatcgcacccgtctttgccctgcccaggactccgggagggacggagaccgcggccgctgcagcagccatgtccttgtctgtctgtgttgcaggctgagcggtgccgtctccttgagcctcagccatctgcagcgccgaaggaccgagaaaccgaactaggtcacactctgcagcagccagaacactcacgtggggcgcgtccgcgttgttcctccaagccaagctgacagcgggctctcaccctcgatccttacctcctccggcagcagcacatgttcatggacttggtccgccgccaccacttcatcggcagagatggcctctggagcagcctggtcggcgtcgggggtcccggtgcttccctgatgctccttgttggtgtcccctcccgaggcaggcgccttctcggcagcctccgcggcagccttcagctcatcctccttggcctgaagggagtccctcagggctgcttgggggacgtttgcgatggaggaaagagtgaaaactttgggagctgggtgaaggaggtcctttgcagtatacaaaggcagtgctcgcgatgacgttcattccgtagggggtgagtgccagtccctggaaccctgggcacctccatgtcgtagctcgcaacatcccccgcccactggccagccatccccacacaccttctgccgcattttgctcaacctcctggcgcgacagatcgtcccggagacgcgccagctcggccttccagccggtcagcttggatgcggcctcctgcacgtactgcgcccggcgctgcagcccggctcgcgccgcgtgcaagcgctcagccagctcggccttcctggccaggccgcgggcttggcaggtgtttgcgcaggagcctaccggctcgtcggagccgtcgcagcagtctgcggggccaaggaggggcacctcgagtcgggatgtggtgtggtttcctccatactgccattgtcactggtactagatacacctgatctcctccccaaggcattcagattccgaacggctgagcgaggcaacatggccaccagggcatcgcctcaccacagactccgtcatccaccaatgcggccttgagtgtcctgggctcgaagcccacattggcacagtagaaggacccccccgggcaggcggaggtgcctgcactcgcacgcgcggtggggaccagggaatcgaggggaacagcgactgcattgcgattgcatcgacgagacagcctgtgcatgggctcgaggcaatcccatcctcgtactggtccctcccagcacccaccaggctcgtcactgccgtccgtgcagtcgcagtattcgtcattgatccgtgaggcgggcacactgcctcgcccatccagacactcgaaatcggcatccgaggggatgctgtacctggggaggagatctggcgtcaccccgcggacatcgggtcccgcctcgacggcaggagtgatcaacgttgccagcgcgagcaggatggctgtaccccagctgctgcataccgccatctcaatttaaagttggttcacagatgaaaacaagccattgatagaaatattgagagctcaacataaatttatcgagagtactccgatgtggaatgctcacccgacccgcgcggagcgattgtgcgacaggaccttgcgcatcatgcacagcacccgctcccagggggtgggctagcccagtctgtacccagctgccctggcagattcccacgtgcatcgtggccccgtccggctgcgcctcagagtcccctgcggacacccatcgtaccccctgggactccaggacctctgccccaggctagtgtttgggaaactcgtgtaccgttgtaaaacccaccctcgccattggacgagactgatttgtgactcatcaagttgggaacacagacctgttccgagggaggactcggggcagagggcctcccacggcacctttgggcgcttgagttgcagtttcggtcgagcgcaggcgagtgtcgtacaaatgggtgaaaggatgagcaaggccagcccaaagaggcaaaccaaacgattaggttgatagaatctcggacagtgccttattccggactccgaaggaatcccgcagattcctgggccaacggttggacctgacccttctgaatcgggcccatctagctacagaccggacccacctctcctcaggtcgaggaacacacaatggcggacgtgctggaggcagtggcaaggctgaccgatgatcgtgtgaaggccaagtgcaagagcgccatcagcgtcgtggagcgagccatagcactctacgggtgaggcccttgggcatggtgcagaccggctgggtgcggggccattgtcactcaggagtgcctcatgtacgaagagggagcttgcgactcacacacctcacaccacctcctccaggctgccatccctcgccttctccttcaatggtggcaaggattccacggtcctgctgcacnnnnnnnnnncacgaagagggagcttgcgactcacatacctcacaccacctcctccaggctgtcatccctcgccttctccttcaacggtggcaaggattccacggtcctgctgcacatcatcagagctgcggtggcgatgcacgagcaggcgtcgccctccggcgccgcacaggcaaagggtgagcctgggtttcggcccctggagaccgaggggctgccagtgggtggcagggctgacaatgctgagcgctgagcaccccctgccgccccttcccactcgcgcagtgggcggcctgtcagacatggtcaccttcttcttcgacaaccccgcggacttccgggaggttnnnnnnnnnnaaggggctgcccgtgggtcgccgggctgacacagctgagcgctgagcaccccctgccgccccttccctctcgtgcagtgggaggcctgtcagacatggtcaccttctttttcgacaaccccgcggacttccgggaggttgtggccttcacctacgccactggcgcagagtacaacctgcagctcaagtccctgcatggcggcttccgccaggggctggaggccctgcttgaaagcacgtccgtcaaggccattctgctgggcactcgcaagtgggtgcacgcgcggggggtgtccctctagggtgtccggggtcaatgcccctgatgcctggcaaggtctgggggacatgctgaccaccccctccaggtccatcccctcgaatcaatgcgcaggggcgaccccaacgcggtggaccaggagacgttctgtccctcctccgccggctggccgcccttcatgcgggtcaaccccgtgctgcactggacctaccacgacgtctggaccttcctgcgcgaggcagggctgccctactgctcgctgtacgaccagggctacacctccctgggcgcggtgtccaacacccaccgcaacaggtgcgccagctgcttgctggttttgggtcgcagggacgtttttgtatgggggcgaagggctgacgggagggctgacgtggctgcaggcatgcccgtggccgtctgcatccccggccaggagccaggatccctgtgagcctgggcctgcccactggtccaccatcccttgaggggcattggggcctgacccaggagagcaggccacaccctcctgtcgccgaccacttccaaccccacccatctccaccgccatcaccctgcaccgccagcgcgctgctcaaggaggatgggagctacgcgccggcctacatgctgcccgacacgcggctggagcgggcgggccgtagcgatcccgcccgccacgcctccgtcctgtcggacgcctgcgagaccgcgggcgtgatcatcgtcggggacgagatcctggccgccaaggtggaggacgtcaacacccgcttcctgtgcaaggagctgcgcgccgccggctggcgggtctgcaaggtgggcggtgctggtttttggagggtatagtatctctgaggcaccagatcatggagaatccatatgtcaagcccccaagcacactgcccaccttgggtacatgggagcgctccacaccgtctgctgctccggcgtgagtacgactcnnnnnnnnnncggagggtgtagtatctctgaggcaccagatcatgggaattccaagtgtccagcccccaaacacaccgcccactttgggtacatgggagcgctccacgccgtctgctgctccggcgtgagtacgactcgattccgcaccctgcaggttgcggtggtgagggacgacgtgaaggccatcgcggcggagatcaaaaccatgagcgctgcgttcaatgtcgtactgacggccgggggggtggggccaaccgtggacgacatgactctggaggccctggcaggtgaggagggtgggagggtgttctatgcgtgtgatggggtggggtggcggaggcagggggtgggggtgaccgctaggggggggtggctgggagagaatggctgggacgagaaggaggagggtgaaggtaacacatcgtttacccgacccccagcaaatgcaagaggggcgatggctgatcctgcacacnnnnnnnnnntggaggagggtgaaggcaacacatcattcacccaacccccagcaaaggcaagaggggcgatggctgatcctgcacaccaactgtcattctacccaccctcctctcctgcagaggcatgcgacacccacatctctcggaacccggagctggagcggcggatccgggcctattttgggagtgatgtcaccaacgcacacctcaagatggctgagattcctgaaggcaagggtgacaccttgggctggcgggaggggcttgccggccacatgaccatggccttctggctcaaaaatcaggtccagattgagcatttgcaccttgccacacacctcgtctggtgatcctgtgttcctttcactccccccacaccccccaccccgcatcacccccatgccaggctcggagacctccctgattgaattccggacgggcnnnnnnnnnnagccacatgaccatggccttctggctcgaaaaccaggggcagattgagcatttgcaccttgccacacacctcgtctggtgatcttgtgttcctttcacaacccctccccccaacccccccatcccgcatcacccccatgccaggctctgagacctccctgattgaattccggacgggc

SEQ ID NO: 36910 - DNA, 78 bp, Chlorella protothecoides
tgggtggggggtgtggagggtgaatacagggtggacaggattgcggcccttagaggtgctacctgagcaatccatctc

SEQ ID NO: 36911 - DNA, 61 bp, Chlorella protothecoides
atccggcccagtggccgactgggacctgggtgtgtacgtgccctacctgcagcaggtggcg

SEQ ID NO: 36912 - DNA, 77 bp, Chlorella protothecoides
caaggtagacgctggggtgtagaactggcgtgcacacgggtggttgcgactccttcttgatgcgagaatgaggatgt

SEQ ID NO: 36913 - DNA, 65 bp, Chlorella protothecoides
tgggtgattaggggcggttgatgcgggggtcaggggggggccagcccggcttgagcggctgcttc

SEQ ID NO: 36914 - DNA, 61 bp, Chlorella protothecoides
cattccaaaactcactgacagactggtagggcacccaccaccaccattaccaccaccacac

SEQ ID NO: 36915 - DNA, 380 bp, Chlorella protothecoides
tgctgggcctccaggtgggggagcaggagggggggggttactcagaatgagggtctctgatgttttgagtgccccaatgttgcaggggaatttctcttgggtctcgaggtcattacaaatgttgtagtcaccccagttgcggttcccggtgttgaagcttccatggttgtcatttcctgcacaagggtggatttctttggtcactcggccaggctcgcacctaatgcatacattattgcactctccacttcctcaccgttgttgttgctgccatggttgttgtgtccaatgttgtatgagccggtgttgcgattgccaatgttcccattcgagtcaggtaagcacttgctgattccggtgggtagacactccaccaccga

SEQ ID NO: 36916 - DNA, 79 bp, Chlorella protothecoides
cagcgcggggtcgggagcagacgggcgtgggtgaggggcccgcagtgttgacccaggcctgcacttgccctccgccaac

SEQ ID NO: 36917 - DNA, 98 bp, Chlorella protothecoides
gagaggggaccgtggtcaggccccgagctcgtcacatgcagccggccagccccgaacaaaccctcgaagctctgcgtctcctcacctcagcagctcaa

SEQ ID NO: 36918 - DNA, 6395 bp, Chlorella protothecoides
  modified_base (117)..(126): a, c, t, g, unknown or other
  modified_base (938)..(947): a, c, t, g, unknown or other
  modified_base (1926)..(1935): a, c, t, g, unknown or other
  modified_base (2274)..(2283): a, c, t, g, unknown or other
  modified_base (3443)..(3565): a, c, t, g, unknown or other
  modified_base (3803)..(4046): a, c, t, g, unknown or other
  modified_base (4238)..(4247): a, c, t, g, unknown or other
  modified_base (5750)..(5759): a, c, t, g, unknown or other
  modified_base (6012)..(6021): a, c, t, g, unknown or other
gggaggagctgagggagtgggggcctcccgtcgcagcatcgccccgaagacatcatcaagcccacacgctggtcgcaggcactgactcccaccgtagtcaccttttcgatgggcgtnnnnnnnnnnctgcagcatctccccgaacacatcatcgagcccacacgctggtcgcaggcacaaaatcccaccgtagtcaccttttcgatgggcgtggcgcccggcaggtccggctcccggtcccaggaggcgtggtaccaggacaggagcggcaccacccagaccccgcccacgcaggcaggctgggtgtgaacccccagctcggcgcaggcgccctccagcagggccagcttgcccagggagtcccggatgtcccgctccgccttgcggcaccacaggtcgtggttgccagggacgaagaagacgtgggcgtaggcgcgggtgagcagctccatggtgcgtcggaaggtgggcaggtcgtcggacacatcccctgccacgattagggtatcctcccgggtctcgcgcgagctgcaaagctgctccgccctgtacaaggttaatcagaaggaagtggcggtcgacaggggcggggcccaagttgtgtccgtgaaaaatcccgcggccatgcatggggcaggccccggacgctcccgaatccctgaagcgctgcggcccgcctcgtaccatgccatgttatccttgtagtccgtatgtacatcgctcacagcccataccctcattgcttctggctgaggccgcaagccaggttcgtacgcgctactcaaccacaggcgacttgacagcgacgtcaacagtgagtccgaaagaggatgcagctggtaatgagttatttgacggcattactggatcatagttccactcttgctcggcagggaggtcgccttcgcgcgcccttgcttatcgaccagcggtcgtcnnnnnnnnnncatgacttatttgatgtcattactggatcatagttccacgcttgctcggcagggaggtcgccttctcgcgcccttgcttatcgaccagcggtcgtcagagcttgcccgtccgggcgcggatgcatgggaggtcgggaggcccgaggcaggttgcgcgggagcctggatctggcggcatgggacttcggagttgccgggctcacctcggatcttcgcaccaccaggtagtggagttggaaggaggccacggttgcgtttcattcgcagacatacagatctgtgagctggagcacgccgacgatcgcgacatcgtactaggtcccctggccgtgccagaacaactgggaccagcattcatgaccgcccagcctcgcgtcacaaagccaagcccaccggtggaataaaggaacacgtccatccctttcaggaagggaggcccgccatggacctggggctgcccagcctccctgccatgcccggtccggagtaccgaggtccgacgccatggagcaactgggtgatccggccccgcctgatcgcaggtgtggtggcatgggtgcgcggggtgatgccgcgggggggttgcaagtattattaccataatggggcaaagctacctcatgcccactcccgctccgacacgagctgtgtcaggtgcataccccgccggacaggacgatggggagacggaccggatcctcaccaccctcctagagctgggggtgaccacattcgtgtgcctccaggccgagttctccctccatacatccgagaacctatggcgcactggccaggtgttgggaggaacgtttggcggcatgctgttgaaagcctgtggtgctgtgcacaaaacttaccataataccatgggttcatccgacaccccttgcatcttatgacaaaattgctgactcccgttttcacaaccctaaactcaccactccgaaccctcttcttgcagggacttcgaccctacatnnnnnnnnnntttaccataattccatggattcatccgacactccttgcatcttatgacagaattgctgactcccgttctcacaaccctaaactcaccactcccaagcctcttcttgcagggacttcgaccctacatcaaagacgcccagagactgatcatccaagccaggactacacacagtcaaaggatattgcaggtaatcgagggccgagtctgttactaacaattaatcaattcctacaggaaggctcagaaacattgcaaaaccccccccacctgaccatggttacccaccggcacatgctctcttgcaggaaaagctggacttcctccaccttcccattctgnnnnnnnnnnggacgcccagagactgatcatccaagccagaactacacacagtcaaaggatattgcaggtaatcaagggccgagtctgttaccaacaataaatagattcctacaggaaggctcagaacattgcaaaactcccaccacctgtccatggctacccaccggcacatgctcttctgcaggagaagctggacttcctccaccttcccattctggacggcaatgtcacgaccgacacggccatgagtcgccttgtggatgattgctgcctgcgcctgctgcgaggtgcgagggggggatggctgaagaaatggtgtgcccttgtttatctttgctagccctggtcccttcctaccactgcaagatgcatcctgatggactcctgccagctattcccgtcctcaccgccgccacatgcaggggagcgattgtacgtccactgctgggggggccacggccgcacaggcaccgtcattgccacaatgctgggccggctctaccacctgcctgtggcgaccgccctgcgttacacacaggcattccacgacactcggcgatatccgcagggagtccggtccccccaaaccccagtgcaaattgctcaggtgaggggggcatgccaggtggggggattacacgcatgctcttgctgacttgccctgggtctcccccggcaaaggcatacgcgcaattgttagtgcttatcggtatgcccctcactttcaggtgcggcgcctgctgccggacccacccagttgccggggggtcaagtacctgcccaaccccctccccttcattgcggcacccagcatccccgcggggcagcctcacggtgacagacaaggatcagcaggtggcgcttcccccatcgcagcctctgcagcgcttccagtacctggcagcaattccatggagcctagaccccgggcagatcgtagagactcacatcctttgtcccccaccgctgcgtccaaggctgcgcagccgctccctgctctgcgcgacatggcatcgcctggtgccttgaagcagcccaacagagcgatggcgtcgagcttgcaggactgcctgcgtcaacacctgcgctgacgcagcgtgctgtgactgccatgaacctcagcacccatcacatgtcgccattgcctctggaaccttgccatgcattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcagggaaagaaccagttgtgggagatgtgtggttcagaccagtgaggttctggctagcctgaccgagcagatgcctgctgccaagtggtccaaggggaatcagcaggaggtcgacttgcccgcatgcaagggcaagctgtgagtgcagcgatgtgataagtcaggatcatgaatggaagcagaatccgaaataatcctagtcagtttgcttcaggggcggggccgcccagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggccactggagtgttccctgcatggacctggggtccagggtgggggttggggggcagggttgaggggaggcagtgtgtgtgggacttgccgtcgacagcccggcggcagaggccctgcgtcggagccagtcgttgagccacaggaacccgccctctataaccccgcaacaagacgcgcctccatccccnnnnnnnnnncgtgactgccatgaaccacaccacccatcacatgtcaccattgcctctggaaccttgccatgcattgcccatggtgatgaaggggcaggccatcgccacataagtcatcaatattcccttgtgatcattttctgtgctccatgacccctcctgtgaatgcagctacaatgaaggtgcaaggaaagaaccaggtgggggagatgtgtggttcggaccagtgagattctggctagcctgaccaagcagatgcctgctgccaagtgggccaaggggaattcagcaggaggtcgacttgcccgcattcaagggcaagctgtgagtgcagcgatatgataagtcagggtcatgaatggaagcagaaaccgaaataatcctagtcgctttgcttcaggggcggggccgcccagaaggtgtggatgctgatgtcgttgaacgcggagatcacggggaaggcgtactccggcagcgccacctcccgcatgcaggagccgggttggaccaggtccaggatggtggaaatcgcggcgtgcccagccgcaggtcccctgtgctgccaggcggcggcgatggccgacaggctgttgcccagcagcaccaggttgtgcagcgtgccggccgcacggttgctggaaagcagggaatcggtgaggtccgcgccgcagtgtgccaggaagaagagcgtgggcttccgggccactggagtgttccctgcgtggacctgggggtccagcgtggggggttggggagcagggttgaggggaggcagtgtgtctgggacttgccgtcgacagcccaggggcagaggccctgtgtcggagccggtcattgagctacaggaacccgccctctaaaaccccgcaacaagacgcgcctccatccccagggactccagcaggtctacatcggcaggggtgaaggcagggtccaccgcggttatggggccagagagccgctgcagcaccccagccttcaagaggcagagcagcgccagctggcaccggatgtgcgctgcgcgcggctgtcgcagcgagcccaggccccagactgtggctcgtaccgggacctgtgccagggtttggggtggggatgccccttccccagcagggtgctcctgagcatctgagggaaaggccagctcctggaagcttgccaccagctggctgaagaaccgggactgggccaccatgtcggtcgccttgtccagcaagccccgaaggtgggccctctcctcgatggatgcgggccgctcatccttgtgtaggccgtcgctgcaggccaaggcgccgtgacacctccgccgggcctttcggccccgtgccagggtccacaccccgtcgggggatatcatggtgtcattgcgctattctagtgtccattgggagattctatgcgtaaattaattgagctggatcgattgtgaagcccaccgcgccagtctcctggttttctatgggccgttcatgtcggggtgtggggctcgccatgccggatgaccggtgacannnnnnnnnncattctatgttttaattaattgagcagaatcgattctgaagctcaccgcgccagtttcctggttttctatgtgccgttcatgtcggggggttgggggctcgccatgccggatgaccggtgacagtatcgtcagggatcgctgacatgaagctgggcggggtgctcgacgacaacgattcacaaggcacggctgctccatgcaagagacagctgcaaaattgaaagaagtggccgagctcgaccacagcggaannnnnnnnnntggcgagatgctcgacgacaacgattcacaaggcatggctgcttcatgcaagagacagctgcaaaattgcaagaagtggccgagctcgaccacagcggaaagtcgtccagcctgtctactgctggggactggccatgcggttggggcccactcctccccctcccactcctcacggctggggaaagaccatcctccgctgcggcaactgcgcggtgatgcactgcaccggccggctgccgcccgcggccgacccctcggcgtccaggagcaggcggcgcgcggcgtcgcggcaggccggggccagcccccggtcccccagcaacgtgcgcagcgtggcgaccaggtcctcgccgctcgccgcgccgtgcgcgccg

SEQ ID NO: 36919 - DNA, 61 bp, Chlorella protothecoides
gggcgagcaagcgaggcgctgatgtggcgggtgccaacctgctgtgcctgctgcgcatcct

SEQ ID NO: 36920 - DNA, 150 bp, Chlorella protothecoides
ccccgcctctggccccgggaaaggacggagatggatccgtccggattcgagtctgtctacgtcaggcacggcgaaacacaagcaccccgcaggccgctctcgcagcccagcagcctgcccatgttcaatcgggacaagctcaaggccctg

SEQ ID NO: 36921 - DNA, 133 bp, Chlorella protothecoides
cgggtgagaggggatgttgtgtcgtttgcctggacataatgccgtccagatcccgcccactgccatcccgcgccgatgctccactggcccccgcatgcaccttgggaccctgggcccctccacaacagctgac

SEQ ID NO: 36922 - DNA, 113 bp, Chlorella protothecoides
atgagggagcggtgtggtgtggattgcatggactcgcgacttggggagggcgtcgatgtggcggcagaggggggttaccacagaggtcgctccagcatgatgcatcagtccac

SEQ ID NO: 36923 - DNA, 67 bp, Chlorella protothecoides
atgctgtggggtgcgagggagtggctgagtagggggttccgaggcgccctccaggcatgttttggtc

SEQ ID NO: 36924 - DNA, 80 bp, Chlorella protothecoides
catgagctgggactggacggcgcgcatgggttgacgatggcacagcggcccagaggccactggcatcaaaggaggagtca

SEQ ID NO: 36925 - DNA, 111 bp, Chlorella protothecoides
ccatgctccaccgcgtagaggcatcggtccacaaccccccctgcacctcgcgcccaccctcacttcagggccgtcaggcgtgccaggatgtcgtcctcctcctggccaggg

SEQ ID NO: 36926 - DNA, 77 bp, Chlorella protothecoides
ccagctgtcgctgtccatacctcctgactacccgtggccgtctgatgtgcaccagttcatcagcgcaccacaccagc

SEQ ID NO: 36927 - DNA, 78 bp, Chlorella protothecoides
tttcaaggccattgctctgttttgggctaagagttgaaccggaagcgggcgcgagatctgggccccggacatccgcgg

SEQ ID NO: 36928 - DNA, 97 bp, Chlorella protothecoides
ggcagaggtgaggaagaggggagcttcctcggggtttggtgcatggggtaatttccttccctgctaccctgcgagggcagccaggagctggcggggt

SEQ ID NO: 36929 - DNA, 105 bp, Chlorella protothecoides
gctgcaggtggagatgcagtttaacatccatgaccttcccacaagcactctatatcccacacccgcatgccaaactcaaccacccctgcctcgcccacgccaggt

SEQ ID NO: 36930 - DNA, 66 bp, Chlorella protothecoides
tttgatgggagatgcaatcgaactctctcatgttttcttgcatgaggcccagacaagaaccaggtg

SEQ ID NO: 36931 - DNA, 69 bp, Chlorella protothecoides
gtcttcccccctttccacctgcatccgtgctctgcgccacgcctatgccgcctggcaccgtgcctaaaa

SEQ ID NO: 36932 - DNA, 93 bp, Chlorella protothecoides
cgggctcagagcctcaaacatcaacccgccttcatgtggcacccctcttttcccctgcgccctcccttggcacctcggacaggttgaggtcgt

SEQ ID NO: 36933 - DNA, 25408 bp, Chlorella protothecoides
  modified_base (179)..(264): a, c, t, g, unknown or other
  modified_base (16632)..(16694): a, c, t, g, unknown or other
cggccgcgtcgcggcccctcgccgcgcttgcatcgcgacgacggcaccgcggcagccggccaggctaacgccagcctcttcaccgtcctggtcaccgatgcgcccgtggagaagctgcacctcctacgcctgggcgtgtttgactttgcgcgcggcgcgccggcggcggcaggggcggnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtgccggcctacaccgccgcgcaggacgactttgcgctggcgctggacggtgagcgctgggttggcagtggtgatttgtcgtagcgggggacgagaggatgaggagtggggagggacggagggaggggccgggcggggcgggcgacggagtgtgttgggctcggggcggggcggggtcgggaaccgtgcgctggggcgagcgcagatggtggggcccctgttggccagcgctggagggcgccctgggattctcccggcgcccctcagagcgaccacgaggccttggcttccatccgacggcgcatgactgccgcccggcactttcgcagaggtggagaacggcttgtggacggggtccagccccagcacgcccgagccggaggaggcggcggagcggcggcggtggcgcgtggcgcgctggctccgccagctcctgcgccgggaccagaggtgggtgggacccgacaccgcaggccgcccgccgcgtggtgtgccggtcgcaggcgcgcctgcctcgtggcgccaggctggtggtgccgcctggggtctgtcgcgggcactgccatgcccagcctggtccccctttccacccgcagctacaccgactggcgtcgggatgtgcagtgggccatgttcaacaagcgcgtgcgagtggcaaccgagctcttcacggagctgtttggcgacgacttcgacgccatcatccctatctaccccaccaaggtgcgcgcagggggcagacgggggccggcacggcgtgtggcacttgggcctggggtgtctttttggtacttaagatctgggcctttcggcaaccaagcaatctgaggtgggagggaggggccgacggaaattgtcaggcgcgcatgcaccggggggtagactgcaccgtggtgagccccctgcgcagacccctctgtgacacccctgtccccgctttctcccttcgaccgcgcagcccgtggacgacgtgatccacaggtgggatgggcagcaggccgcgttggagaggctgcagtaccggctgaagaaggggggcctgaagcctcacaagctggacaagctgcgggccagcatcgccaaggcccagaggcggctgagcaagctgcaggtgctggttaggggatgaaaggactccgtctgggttggcatttgtcaattttggaggtggacccggtcgccgcgaccagcatcgcggcggctgccgattgaacaggagggcgattgtctgcgagagttgccacggcagctcccactgcgccatgcatgcgcgcagtcgggcccacacacaaattccaatgttcacgctcgccctgcaacccctcagcatccacccacacacgccacacccattcccggaccatccccaaaccctccgcctcgatgcagaggaaggcggcggagcgacgcgaggaggtgctgtcggacctgccctccacatgcttcttcgccaccttcaggcaagtgccgcaggctcccccgggggccgcgagggaggggagggaggttgtcgtagctaagcaggagcatcttttcttcccacgcctcgaccagccatcggcgcaccctttcccctcacggcaggtcccaggaggcggcggccatcgccgtgcagaccaacctgaaccccatcatgcagcgtttgttccgggtggaacccgcaccgcgcccagaggacatcaactggccgtccttgcagcgcaggtgcgagcgggagctggggtcttcgatgtaactgcccttcccgacgagctgcaggagtttagatgagggtttggtcgggcatgcagtgcgtgctgcctgaccctgccgctgtgaacaccccccctcccccacgacctacccaaaacccgacgcgccgcagctggtggcagcgcacgctgcgcccgctgtgggccctccccggcatcatcctcattatgctggtgcccatcggcgcattcacaggtgatttgatcccctgaaatggcgacggtggcggcctcaggggccgggcgcctgcatggcacagggccttggacgcgacggtctgttcaacaccctcagttccctcatcccctcaccacctccctgcgcaggggcctttgcccagctgaccatagcgctgtgcggcaaccccgcagccggcacggcctcggccggctcagacctgtggatctgtggggagacgggtttccctgcgctgctgcgcaatctaattacctcgctggggccctcgatcctgctcagcatctacaacatggtcatcctgccggtcatcatctactaccttgcccaggtgggggggtgggctgattgggtgggtgagggtgaggggcttgatgggatcgaggggttgggggccgtcatggggaaggagcatgggcattgagcagtgtgctgagcactcgacgcgccagcacacagtatagccagaggaagacccaagcggacgactggcggcagagccccctcattttccccatcttcttccccgcaacctttcctccccctgcctggctcgcgtcgcaggtggaggggcaggcggtcagcctgtcggccctggatagacgctgcgccgacctattctttgcctggtgggtgccggtagctgcctcagggcccctgtccttttaccagacagcctgccctccacttgaaggcatgcacacgtattcccttaacccgtgtaaccagaagactgccatgccccccctcttcattcgaccagggacatctttaacgtgttcctgggagccatgctgggcggcaccatcctcggggagctgcgcaccttcctcacggagccgggccggatctggtcggcgctgggctcggccatccccgccgcctccaacttcttcatcaactatatctcgtaccgcgcctttgtcatggccttcttccgcctgttctaccccagccaggccgtggtgacgagcatcgggcgcctgatcaggctcatcccgggtgaggacttgttggggcttgggatggggtaacggggatgaagttcccgatcgggggggcagcaagtgatgcagttaatgagggaaaggcagatggaccggcttatgaggaaggagggcagcttctctcaggaagggaggcgcctgacgctggatgattctctacatgctggggcctgccttcggggacgtcgaacatggatggtgacgccgccaccttcaaaaactcctggctcagatgttctccctgcacctccccttccaccaacggacagcaagcaaaactgagagggacaaggccctggagctgccgaaccggaattgccgctttgggagggacatcggcatccccatcatgatgaactttgtcatggtctttgggtgggtacaggctttaggtgggaaagagcgttgaagtgttcgccgcgccatagcctctctaccccccatccccatatactgtgctccactccccctcctccccattccacgcatgacgcaggtatgcggtggtttcgcccctcatcctaccctttggcctgatctactttgtcctgctctggcccatctggcgataccagatgctgtgcgtggcacgaagggatgagagggggctgccatccaagttcatgtcttgactgtcgcccttgcgatttgcccttgcccgccattcacccctccaacctcaaaatcaccgtcgtgctccccgcccgccctcgcaggtatgtgtacctgcggcagtacgagtccggcggccagttctggccctacgttgcgcacaagctggtgtggtgccagatgctcatggtggtgttcaccgcgctggtgttcctggtcaagggcgcgtatacccaggccggcgtgctggcagtcaccctccccatcctgctcctcaacttcaagtcgtgagcggcgcgaggggacggcggggccgcattgctgaatgctggcttgcggtggaaggcggggatccatcgctgcagcgcctcgccctggcagaagttgcgactgcagcacctgaacccccccccccaaaaaaaaaacctcaggtacctgtcctcgcggtacgatgccgtggtcaaacaggtgccacttatggcggtgcactcggcggccaggggccaggtggaccccgacgtgtacaccgccccacccctgcgcatggaggcgcaggggtggcatcccgagtggggcaaggtgagtcgggcagccctgaattcttgctgtgtgtgagggagaggttgcctttctgctggtgagatgacatctcaacggagcctggcacacccctaacagccactgtcttcccccctctcctcatcccccctcactgcagtgctggcagtggtggggcatcccccggtacaccctttgagcctccatggcgctgtgccgggcaagcatgcgaccctagctcggaccgatttgcgaatcgtcttgtggagcatccctcccgttgtgtgttgcagttgcctgcgctgcattgtagctcagagcacgcgtggacatcggaagacatgaagaaggcgcgggcttgctgatgcggggcgcttttgagactgctgcgagtggcctgagtgggtccagagtgagcagctgggaagatgctgatccaccctgcaccaatgaataggtgcacgtggtggtcgttcacgtcgcagagcaccggacagtcccagcagggcaggggccacgcccacatgtttcatggcagggaggcgggtgggggaaagggagggcggcccagccacacacccctcagccggtgagcgtgaggttggccacccagagcagtgcgggcccggtgcagtccagcttgctgtgcagtgcggtcgggcggtccagcgctgcaggggggtgttgagcgggggccgcatggtgagcgagcgagggtgaggggctggtgaaagggtgccgcgaagaggctcgtcttcctggtgccagaccgccaaccctcatctggagccttgtcacaggcacaacggtgccctatgcccctccactccttccacccacgcactctccagcacggcccggatgcgctgcagcacgcggacgacggcgtgcgtccggccaccaatgtaggccagcgacagctccgggcggttgaggccctggggcagcatggggggctgctccccgccaaagcacatccggtacctggccccaaactgggaaggcacaggggttgggggggggaaggtgaaggtgtgagctgatcgccgtgacgtgcccaaatacctacgcgccgcaagaaagccagtggcaaatctctgcataatgtgcacagccatgcattgcacgagctccggcgcaccagctcgtctggcgcgccagaggccaggaacaggtccctccctggctgcgcccgcatgaaggcgatggggtcgccagggacatgcctctgcctgcagggtgtggatgggtgggtgccagtcggaagcagacgctgtgctgggagggaaggatggcttccattcacaaactggccctgctgagctttccgtgcctgtgcagagtgccggccctgcagcgtggtcagcagctgcggggccaggcggggctgtgcttgcaccaccccagtttcagaggacgccccccaacccctacatgtcaaagctgatgaagaggtagtcggcgacgacgtccgaggtggccagccagtccagtacgatccccacgccgacgtcctgcgaggctgacacgctgtcctcctcgcgagccgcggcctcctcggccagcaccagctccgcgcgcgagctcctctgccccgccgaccacgccgcctccgcgcagttgtgcaggagcaccgccgggcaggggccccctcgcagggtgcccgccacccaggccagctggcccgggttgcatggggcgggggggggctcgtccttcccacgctgcagcacctggcgatccaggtgcacgccgatggccaggccaggcccgcgcaggcgcagcaggcggtcaaaggcccaggaggcgacgggggcgggcgggtcggggaagaggtccacgttgaggaaggggcggagctcggcggggaggctgacgacctcccaggctacgccctgccaggagacggcaggtacgttcttcagggaggtgaaggacacctcccctaggccgcgggggagggggccgccctgtcctccctggctcatgccgatggccagggagggggaaaccccaccgaacctctgcgaacggaggggggcaggacggaagcgagtcgagtccagtggagcgtgtggatgtaggatgtagatatgctttgtaaggaatccaccccgccgacataccaccagtgccacgtagccaaccgatgccaacagggtcaggctgaaggcaccgaacagtctggcggagtgggatgaactcctctgcgcgtccttcaggggcgagcatcgtgtcgcgccccgagcctttgtcatttttagacaaaaatacaaaaccgaggcaccgtaagagactccttcaacatgtcggaggctagagcctaggtgccactgttgcgaaagtattcgttacaggtaggggtgcaaagccgaccgatgcactatgcagacgacgccacagtattattccaatgatccttggcatatatggagagtgtttgcctggcctctccgcccgcgcagggacctggcatcgatcgcgccaaacgagggtctcccagatcagttgaggatacacctgggcatattgggtcacccatgacggtctcgaacgcgatgattctttgtgaaaaaactttgaaatagcctacagctcctcctgtcctgggtctcgtggggagaatagcgttgtcattctcagcagtgagggaaaaacaggtcagtcactcggctgaaactcaatatgtcgtcaaggccaacaaacaattgcttaagagtgaggtatcttcttgtttttataccattcaagttgcatcagctggaattgtggctggcgataccactctctgcagatcttctctcgagtgccccctgcctgatccggcccccattcatgcggggccgcatggagtccgtcaaggatgattcaatattcctcccacagaagtatcagacggttacctcgactgtagtttattaatccaacctcacattatgtgggctcaaggcctcgctagtctcccggccgggacctgccccgggcctcaggtgccgacaaaggagtgcatgggtgatcgtaggtttcaaccgaccgctgcttgcatggatgacattgctcctgcactcgagtaaaatttgtcatgcgcttgtttgcaggtgaggtcctggaaaggcccgacgcgaggcccaagacccgtgacagtcagagctgccgtcccggaatcctctggccatgaggacgcccctaaggaggaggatcacatctgcgtcccggcgcccgcactcatcaccaacaggagggtgctgctcatggcgtcttctttcgccggggtgtacagccagaggcagagtgcacatgcaacagaaggtgggtgctggggcgagttgaggtgcgccctggtgcccctggcaccggccggtgctgagcccccgccccgcgtcctgctcccctccccatcccaggccccatggggtgcctggagtgcgctggcacgggcatcacgccctgcgacatgtgcggagggacgggcatgtggcgtgcgctgacaagaaagcgcgcacaggacacgtaccagttcacagagtgtccgcagtgctttggcaggcgagtccatggcagaggggtcctgtaggcggtgagggtggcgtgacccagagggttgctggacccagtgggttgtcgcccctccaaacggccgcttgtcgccagcctggacatgtattacgtcctgtgatcctcatgagggcttgccatgcatgggatggacctggacgcagtccttctgcaccaagattgagagcatcccagcaacacacacaggggtgtgcgcgtctgtggcgtgtgctttggaaccgggctcccgaatgtgaaggggctgctgaggaggccagaggcgacgcggctggtgcggcagatgcagcatggagagctcaagccaggcgaggtcaggaaactgctggaggaagccaaggctgcgcagaaggcagcacgaggagaggcctgatttcctcaaggggtgtggttgtgggactttgagctgcatgcaaggcatagcttgtggagcccccggcctgacatgacgtttgaagtgccaaggagtcgttttctgctggcagaggagtgcatcacgcaatcttgtgattgcaatgtggctcatagatgtgatcgagcttgtaatattctttcaagtggtgccacatctcgacgttgaggttggacttgagccgagtgccaccaatccgcgctttcttagtggtgaagtggtcgtgccccacccctggtagatattgagagcaaggcaagggctctctgtaattctcgaagccgggcccatggtgaagccgacaggggaaggccttcgggcctactacacgtccaagatagaggacctggagatcgagatcagggacaggcaacatgcactacagaggatgcaggcgcagcggaacgacctcaacaccaaaggtgccgtgcggtgcctgggagatcctgtgagtagctgatccactgcatccaaataaatcaaatggtaataatgagcccatgcagttagactgctccgggaggagctgcagctgctgcaggagccgggatcctacgtgggggaagtgatcaaggtgcaggccgggtgtcagcgctgagggaatgctgctgcgcaccagcttggacctgaactcgtgatattgatgagcaggaccgtcgcgtgacccgtgggccggactcggcgcgcggccgggacatcccgggagccatggagcttgccttgctcctgggcgcccccccacccgcgcaaatcctcattcccgcgcagctcatgggaaagagcaaggtgctggtcaaggtcaaccccgacggcaagtacgtggtggaccttgacaaggagatcgaccccactaccatcacgcctggggcgcgcgtggcgctgcgcaacgacgcctacacgctgcacgtgctgctgccctccaaggtggaccccctggtcagcctgatgaaggtggaaaaggtgcccgacagcacctacgacatggtaggggggctggaccagcagatcaaggagatcaaggaggtgagtggtgtggcgcgtgtgtggggggaagggggggggggcgcggttgtgactgttttgagtggggatactagtgagtggagggttggcgttgcacactcagactgccattcctaaagcacacacggatctggttctgcctggtgtccgcaccaggaacagaggcaggactgcctgtgcgatgcagcaggtcctcgctctccactccttcctatccacctcgctgatcccaacccaatccctgacccctcaacaggtgatagagctgccgctgaaacacccggagctgttcgaggcgctgggcatcgcccagcccaagggcgtcctgctctggggcccgccgggcaccggcaagacgctgctggcgcgggcggtggcgcaccacaccgactgcaccttcatccgcgtgtcgggcggcgagctggtgcagaagtacattggggaggggtcacgtatggtgcgcgagctctttgtcatggccaggtgagggtgatgaggggtgttgggcccggggcagccttcgccgttgagagcggccggtgtggaagggtgcccggcgcatgtgcctgactgtggttgcctccccggctgcactccccctcgacgagctggcatcaacagataccatccaacacacacgtgccttttctccatggcccccaccgccatctgtcatgccgctgccctggcgctccgcgcctgcaactggatcgatctcctcgacacctcactctgggcccctctccaacaaatctgaacagccccacccccacccccaaaaacccaaagggagcactccccctccatcatcttcatggacgaggtggactccattggctccgcgcgcatcgacggcagcggcgggtccggcgatagcgaggtccagcgcaccatgctggagctgctgaaccagctggacggcttcgaggccaccaacaagatcaaggtgctgatggccaccaaccgcatggacatcctggacccggccctgctgcggccggggcgcattgaccgcaagatcgagttccccaaccccaacgaggccagccggctggacatcctcaagatccactcgcggcgtatgaacctcctgcgcggcatcgatctcaagcgcatcgcggaccagatgacgggggcctcgggcgcagagctcaaggcctgctgcaccgaggccgggatgtttgcgctgcgggaacggcgcgtacacgtcacgcaggaggacctggagatggccgtgaccaaggtcatgcgcaaagacaaggacaagaacatgtcgctgcgcaagctctggaagtgacgtgccgcggcgcggcggcgtcgccgtggcggcgcgcggggcgatgcatagtccctgcggtcggcacggcgggcgcaacctgctcccggcgctggccgatgggggtgcccgtcaccagggggacctggcgtgagcgcaacagggccggcaccgtgccatgccactgtcatccccctggggtatctgaaccacacttcagctgaccggctatttacagtgttgggaggggtacagggatttcaaggggggagcatgtcaactccagggcaaagagagggagagaggaggcgcgattgaaaagttgctggactggaagaacatcgcgctctgggatacatcttttcctgaaaggctttatgcgagggggtgcacggaattgggcacgctcaggggggcagcgtgggagatccacggggcacaggaatcgagcacctgtgtcgggaagtccgaccgcacgtaattcagatagcgccggaggccgcggtgtcgagcgctgccgtcatggcgcgttgcagggaggtgctcgccgcccgatccaagacgactgtgggggtggtgggaggggggggggagcgtgtgtgtgcaagggtaggtgctgactggcagggtgaggtgcgccagcattgatagatggggccgggacagcaacacatctccacaacatccgaaacacaccagaggtggcgcggcacaggccagacatgccctgggcgaggccctgcagcgtggaggacagaatgtcgtctgcttgcacgaatgccgacgcctcggccacattggggatcatgtcctgcaggtcgagagtggtaagcattggttcagaggtggagaccaagggaatggggggtgaggatgtgcggccaaaaagtctaccatgccctgccgtccccaggacgacagacaggggcgaccacccgtgcacacgtcagagcaagaccacaggtgtccgctgcctaacactcacaggcaggccctggaaagggtggatggctgcggcaaacgcgtcggggctgctgccgtgcatgatgaaggcctgggccgccacgaagaagacggccttggccgcgaagcggcaaaccaggccgttgtcgatgggcagcgcctccagagcgcccgccgcgcggcgcagggcgggggagggccgcgcgtcctcgcccgtcagcacctccctggcaaagcaggagatgccggcggagatggcaaactgcagggcgctgctcagcgccaggcccgtcaaccacgagtccatgcccatctccacgggcttggtgctcagcttctgtacacgattgagagatgggaagggggcaaactgaacttgcgaggcgtgcgacagtgggtgaccccgtgctcaggtggatgaactaatcccctccttcgaggaaacaagagcccttgactttccggcaaccagcttccaaccacctcacctctgcaatctcgaggaagaagtcagctcgtgtgtgcaggatggaatgcacggccgtcgctgcggtgcccgcggccagtacattggttgccggggtggccagcacggacctccaggcattctcccagtgccgcgagatcgcaccgttccgtggaagggtcaggacagcgcgacagatctgcactcgcgaggcgtggtacgtggatcaagagatggaggtgagtgcactctgtcgccaacgggcaacccagccgcgtacaggcgggacgtcggggccactcaccagcttcgagtggggcgcgcgaacaactacacggtttgctctaccgcctttagatgtaaagctagtattccgatgagcccctagcggggacgaccgtagggcgagcatagcttgcgaggcaggggcacaggattgagtgaacgggcagctccgaacggagatgatgcgtatgcctttggcgttttaattatcttggtaaatagacgctgagtggtttgaatgtactcgatgtcgtttccagaagtcaagaggctagttgacatcacctcccaccttcgagcagctgcgcagtagctgatgtggaatctgtcaaatcttctgatcacggcttcaccatcctaagcatcaccctccaaaacctacacatccctaggcggatgccatttgcaccaacggtttctcactccaccaatcgtccttccgtactttgacatgctcagggtccaatgcacccagcacccccccgcaatgcttacaatcagatgcaacacatttcggcatcaggcgcctggcagggtgctgggcaggttggccacagaggtgaggatgttgttatcaaacggtgaggaaaggtgcgcggtgaggttctggaggggggtttgccgcgtcacggtcgcctgggccacaaagccgatgaaggcaatcatggccagcctgccgttcttgatctccttcagccgcatggagggggagtccaggcctgcagggtcaaaggggaagctgttcaggaagccgctggacccggtctccttccagccctggtagcgcttgagctccaggaagcccagggtcaggaactcgatggccaagagcggcttggccggcatccagtagtcctgtcggacgtgagtttggtttgtggtgataccatcggtgtgggttcacgcaatgaacccctgtatcaaagcacaggtcttcaaggtttgcattgcaggtgccacaacaccatcaccaccgacagcacagcctgatggacactcttcaggcgtgtgtccttcaacccctgcaaatcaggttcctcacacgccagcctagccaggaagactcaccagggccccggcctcaaaccacgcaggcctgcccaggaggtctacgcccaggattcctgccaccgcagccatggcccagcggccgttgatccgctcgccctcagcaaaccacttgaggcggtcggggctgttgcccaggttcagggggtcgaagccaaagtctggggggggagtagggggtagttgtcatgttccccggtatgtagggttttacatccaacacctgtgcctggggacgacttcggctgaaaccaacctcaattccatggcagtcgagaaaactcaccgccaggaagggagccgtccagatgagggggagatcccgcacctgtgacaaagatactctggcatttcgtgtccatttcggaggcgtcatgccgtgacccacccccacctcatggggaacccccgaggacgatgcatgccatgtgccaagattggatgtcttcacaaagtgagctgcaacatgcacatggaatgcgcacctggcagccagagggtacgctcggactgagcggcatgcacccgggtcgtcctcctctgctggggacggggtcccaccgccacgggcgctggacgggagagaaccgagagcatcatcctggtaatcttttgagtctttattcccgatgtgttcgcctgatggggggcggccttgatataagagagcagctcgcccagatcttagctctatccaatttgatactgcagaatccgtgcagaaaacaattacatcgatggacaggtggagcacctccgcagccgacccatgtggcatctagtcctcattaaagcgattgaatgaaacacatgagcagtattgcatgcattgaagactcctagggcggcccctctgcctgagttggaaaaatgcgtacttgctgagctgctcgacgtctggcgacacagttgtactccggcctaccctgtcctaataaaccccttaacaacaatattcacactcgcactcagagtttttgcggtcccgaggtcctctgatccaggccatgcggtgccttgcatctgcctagcggaacctgagcaatcctgtggttcacctgctgatctgtaaggtgcgtccatctgctcagtaccatgtcgcacttcccgagaccctaccttcatcgcgcactccagccttaccacagcgtccgaggctcggtgtgcaccccatcttggtggtgaggggagtgcaaccaccagatgggttccgttttatcgaggagggagcccttggggactgggagaccaccacagcccttgggaccagagaccatctctgctccaccgtggggacgtagaccgcttcgtactgtaccaggcaggtatgacccttacacgttggacagagtaactaccgaaagctgtcttgaaattacccacatgtgatcagtcatcttcccagccctgctgctggggagggccgtgtggcattgcagggtgtggacttccgcaacacgatctggagtgcatcgagtgcaagcgccttcaaagtccccttgggattgggtgccatcgtcccaagaaggtgtctggagggcgctgtgtgccaacaggtggcagagagtcaaggaagatatgggtgaggagaggtggacagcaacaattcgtcgagtgggtgctgtccgctgccaaacccagcaacattgagaagggcgggaccaacatctgtgggtccagaactccatgtgtaaatcgtgggtgggctcacctcctgcacagtgccctggcaagtatgctgtggctgccggtggatgcttgccttacacaagtcagggtgatgagcgcgagaaaggactaggggcagtgtcgttgcagaccagggatggacctgggtcatctgtcaggttcccactaggaacaggttgtcagggctctgcaccaatcctggctgcagtgagcccacctgcataggcagggtgccgggcagcaggctctgctggagacaggccaatatcacaaggtctggcgccacaacaggtacggggggagggtggccgcgactggcgttgccttcacagagcactgcaatcgcctgtcaccccactaacgtgatgtggttggattgtgggaatagtctgttgtccttatccctcagagcaccataccatgtgttctcggtcatgctcgtgtgtacctgcacaggactgtcaatgaagctggtggcaggagggtcgatgttgtcaagccatacagtctttccattcttaacaatgaagaagcgagtgaaggcgaccgatgcagtgataccaaaagtgtatgtgttattgtcgtttatcgtgagggtgaagacgggaaccggcaagacggggggaggaggaggtggagatggaggaggaggagatggaggtggggaaggagaaggtggagggggggagggcggaggagaaaaggggtaaggggaggggtaaatgggagagggtggaggaggagacagggtgaagggctgcgcaggcgatggtgaagggggtgatctcttcactggaggtgggggtgaattttttgctggaggtgggggtggttcttttgctggaggtgggggtgaggtcttcactggaggtggggtgggtctcttcgctggaggtgggggtgaggtcttcgctggaggtgggggtgaggtcttcactggaggtggtggggatgccttcttgggaggtggtggggatgccttcttgggaggtggtggggatgccttgttgggaggtggtggagatggcttcttaggaggtgggggagtcgtctgctttggaggcggtggggtcgcccttttggacggtggaggcggcggtgggctaaagtctctcactacagacttgcgaagatccttcagatcgcacatgttgggaccttttcgggttcccaccgcgttgttgcaccgtaggttggtgcccttgttgttgaatccccagttcaggtctcccttgtttgagttacctggatattgggagccaagagatgcgtgcaggtgtaggctgtgcatatgcgcatcattttatctataacccacctcgtttggcaaatcaccacagttccacctgttggtcttctccctcctgctcaccaatgttgctgtcgcccacgttgtcgccgaaattgtatttccctttgttcccggtgccaatgttgccgtccctgtccgcggcgcatgccttttgtccagccttgaggcactcannnnnnnnnnnnnnnnnnnnnnnnnnnnnnnnnnnnnnnnnnnnnnnnnnnnnnnnnnnnnnntgcagtgatgacctcaaaggggctcatcttgacggcgctgacggagagaccaagggcgtcaagagtatttgtttgggtagaacccgccttgctatatccctccgacctgcagatgaattgaatgggaaaccggctctcgcaagagtttaccagcagcttggaacatgggcttgatcatggggacccgaaggacaaattgaagctagtaatggggtccacaacaaacctgcagagggagtccgcgctgctgttgtccagcatatagacacggggcccgtgcctgtgcgaggacggagggatatgacgacgtccatgggaaaggatctagagtcccgatccgcacgcccttcagcggacccagcccctcaaacgtcagcctccgcactctccggagcaagcgtcgccatttacaaacccggaactgtcaagtgttcttacgtgactgccgggagtgagtaaaacttcgtcgtgcattcgcgctgagagacaagggtcggacttgcgggcgtcaacatccggacatggcaggggtcgtcaatcattccctcacaaacgagtcccgcacatcagtatcatcatctgcgcccaccctcgagagcactccaaggctcagcaggaggagcatcgtgctccagtggggtgtcagccctagcgacagcatggtccgccccaacccttggcaaagttgggattttaacaattgcgatatggatgcaacaaaccccaaagggcacacgataagccgcgttgttattgaaaatgaggttcacgcttgctgtatcgcatcttgctagccgggtcgtgaaagggttcaccggcgacaaccgggacagatcgcctcccctaccggacgaagccgcatcatgacggcaagtgggaatctatcatgtcctcaccaagggacgaacctctggcacctcatgcagcttcgagtaatcgggttgcacaaatatcagatcaagctcaacagtaatccctggtggtgacttcaggcctcgccaccttgccgggtccccgcgtcctccggtactcgaggggtgctcaattgtcctcacctgattcgaggattcccaacctgccccactcggcaaggaaatcgccaaaagtacgaaaagggtgcttgcggagacaatgcgttgataacagtgtgaaagatagtgacatcttgggagaattcctgtcccaagcctgccactaccacccaggacatcatggcttggtctgggtcccatgagggacgcagattgcgcaaggccccctcactcttatccaatggagacgaaaagaatgcactttagtttcaaactgataggatgtagagtgcgagaaatgcatggccgtgttggaacctggtcctccagtcgtgtttcagcagattctcgctgccctcccgggcagcaccgcagctcacgttgcatctgggactcatgtttttgtctgtcgtgacatttgcgtctttcatggaggccaaaatactcagaagttcagctctatgcaagtgaatgtaacgagtgagagcgtgagtggacagggctggcaagatggtggatgggctcgtttttcaagctggagtgtgatcattgaccagagaggaacacatggcagcacacttgctgcgcatcacagacccacgtcccaaggtgcctggctgtgcagaccataccgaccttgatcctggcgtcaaggtccgtcagcttctgaaatccagcatcctgtgggcattgacaaggcatggctgcacattgaagcttggcgagagcagcaagctgggactatcgccaattcctcgagtcttgggatagatttagagcgagcgttgacggaactgcttcgttccttgagcacagaatgcagcacatattggtttctgaatttctcctgagcggtgatcgacagtgaggttggtgtacaggcattggacaccaggacctacagcaccatactagggatggatcaggtgttgcccaggatgcacatgtctctcattggatcgcagggaggttgtcatctttttgcaaaggctccccacttgggtattggggcccatgggctggcgagaccggccattgtgcatatttatccctcacctgaggccctccgttgtcagtgctgtgcagcctgtcattgacacccctgtataatgcaacgcgtggcggtgtgatggcctgaggtggagcagtgcaaccccattgtctcgaaatgctgtggacccttgcaggtacaggtgttgtctgttccgtccacacctacgacaggctcgggtatcctagtatccttgatggagtgcgcagcaagcctcgccctttgtggtgcatcgggagagccctatcatgcaaacatcccggaatgagcaacttctcaccaagcagattgccggacaatgacggccaacgtctcatggcacactctgccaccgctcaaagaggcaagtcccaccccggacgacattgcgcacagcaaaaccctaaatttggacatgcggtggtcattgttacaatgagcagcgttggagggtcagacaacgtgcgaagggtccgcccgacaccctgtaaacaagcaggcgaaccccacagacatccacgcggcgggtcatcaatgcaataacaggcttgcaacgtcatatgagcgttgtatggagtcggttcggtgggtcgcagggacccggaatgcggtaatctgcggagggagcacttcccatccgcaccccagcagctgatgtacgaggctgagcctgctcccgtaaccacgcctcgagtaaccccttccctcggaatcggataccgacccacctcgtccaagcaatgagagaaggggtgtaggcatcattttatcgcgcagtatacccttcatttcccggcgggccgacgctccgtcctggctccccggccgctctaaccccccggcaacccctcgccccccccgtgcaccctcggcgcgatgcgcacgctgcctcctctccctgacggtctgcagctccacacactctcggatggcaggcagctggcgtaccagatcctgggcgcggagcccggcccctccaccctcacggccatgtaccaccacggcacgccctcctgctacatggagggccttgcgctggaggaggcagcccgtgccgccggcatccgcctggtcgccatggaccggtgcggcatcggggcttccacccgccgctcccgctccagcctggccaccgtggcgggggacaccctggccctcatggacgccttggccatcccccgggccatccagataggcaactccgggggcggcccctacgccgccgcctgcgccgcgctgcaccccgaccgcacctccgcgctggtcctcatggccgcgctggcctccacctccggccccgaccgcggcctgctgcgctcgctgggcatgatggacaagaccaccttctggatggccaagctgcccctgggcgggctctgggccgtgaactggggcctcaagtacatggccaccaaccacgcggagacgctgatcaagcacgcgcccgaggggctggccaaggtggatggggagctgatgcagaccgacccccgcgtcaaggagatgttcgcgggcgtgctcacggtgaggcgttgggatcgagggggcgggggatcgggccatggaactgggagagggcgggggaagagggagacggggaggggaggaagaggaagagggtgggcaagcgcatgcgcagggtagggcatagcgcgggggtgcccgtgagcgcggcgggggggggggtctagcatgtgggcccggccccgcacgctgctcgacggtgcaggctgccccacaggatagccctgcgcagctgtggtctactgtctcctgcgttttgcgcagtatcatgcgctgcatgcttcggctgtggcggggccttgtgcaccaagtaatcagacacagcaagagcacacactcgccgccctgaccctcccccgtctccccacagcatgcctaccggaacggcgtgcggggcatggcacgggactaccgcgtgctggggaccaagtggggcgtggacctgagcacgatcaagtgcaggtgaggcctgctcagggtctgggatgtgcgcctctggggagcggcccgaaccgaggatcagctcctcggcgagtacttcacccgcacgccaaggccctccaaggcgtgcacagctagcgcattgtctaatgggagtcattcccctgcacaaacgccccctcccaggaccatcatttggcacggcgcggaggacatcagcgtccccccagcgcacggcgagtggtgggccaagaccatcccggccgcgcagctgacgatcgtccccggcgagggacacatcacgctcatgatcaggcaggcgggacccatcctggaggccgcggctgctgcggccaggggatgagacggccacccccacacatcgtggtgtggagagtcgctggcgaggcgaaccagagagtgagaaccctgctgattaaacccatctcttcgctgtccgatattgtccttgtacacccgttcattgcgattgaccccttggccagacattacagctttccctgttgcctgagaactaccacccccttctaacattacaagggtgtccccctcccatccccttttccattacaaatcgccatgatgaaccggcagttgtcatgagtgacacaagtcgcaaagcggttccctcgggacaggaaaagcacactgtctcgagccccatccctcccgaggactcatctgtcatcccagccggagattgggtgctcggcatggacgacgggcgagcctcccagcggctcgcggttctgactcggcatatcgcgcagggtcagggagcaccatgtggccacatcccggcagattcagaagccctgggatcctgtaatgccttgccgaatgccgagctgggctcgcgggctgtcatctgcccctcgccgaccagcagctatgagcgcatgcatggacggggatcacgggctcctgcggcatggacctccatccccatggtggccggcgtgcagctgaaggagactctgtacaagaaggcagatggagagggcatcgccagggtgagtgtgccgagcctggcgcgctgggcgacaggggtggcggcatgggaaggaggcgagggactgcatggagtagcggcttcatgggaggaccgcgtgaatctgattgtgcccactctgcaacgagggccaaacatgcccggtgccttcaacttctttccccgcagatcagcatcaaccgccccaagcggcgcaatgccttcacgcccctcacaggtgtgctggggtgcgtgcattgatgcacacttcccagtctggctgcatgcctcccagttcagtaccatgacaaatggcactgctcctcagtcccagcatacgccttcaccctcctcccatgaccctcgcacagtgcacgagatggggctgtgcctccgtgacgcacaggacgatccagctgtcggcgtcatcatcctcaccggtgggaaccgggcggcggctggcaccctgtatcccttttgtctctgcgtggggtggcttggagatgcagaagtcataaaaagagggatctggctggccctcatgtgctgactagccagccgatgccctggtcgccgcatggagggtatcgctcacatgccatcccgtcggcctcgcccgctcagccggccactgccagtgtgtccctcgccgcccgtcctccatcctcactgcctctgagcacgcctgccgccatccatctctccccccccccccctctttgcaacacaacgacgcaggcgagggcgacgccgccttctgcagcggcggcgaccaggcgcaccgcggcgacggcggctatgtcggtgccgacggcgtgccgcgcctgaacgtgctggacctgcagattgcgctgcggcgctgcccaaaacccgtggtggcctctgtggcgggctatgcggtaggcggcggccacgtcctccacctcctctgcgacctcagcatcgccgccgacaacgcggtctttggccagaccgggcccaaggtgggctcctttgacgccgggtacggtgtctcccatctggcccgcgtggtgggccagaagcgcgcgcgtgaggtctggctgctggcgcgcctctacccggcgcagacagcgctggagtggggcctggtcaacgccgtggtgcccctggaccagctggaggccgagaccctggcctggtgcggcaggggttgatgctaggggactgccctttgtgatatgagaggggcaggagaactcccaaggcggtgggtggggtgtgcccgtagtaggaggcgcatgccacggccatggagtgggtcagtgaggcttgtgagactgcactccctgccgaaacaaggcgtcagctgggcgtgcatgtgactgccatgcatccatcccccattcgagccgccgtggacctcacacgaccccaaacgcgatgcacccatccccaacccggagcaggtgccgggagatcatggccaacagcccgaccgcgctgcgcgtgctcaagtcggggctgaacgccgacgaggacggcgcggcggggatggcgcagatggcgggggacgccacgctgctcttctaccagaccaaggaggccaaggaggtggggggaggtgtggaggagcagggctgggtgcaaggggtggtgaaatgagtgtgggactgtgaagtctgggaacccagacaccactgggggcagtaacgatgggtgccccccccaagcttacggaacatggaccacaccattcctcctgctattgcaccagggcaaagtggcgttcttggagaagaggaagccagacttctccaagttcaagcgattcccatgaggagtctgggccatgcagctccccgtttaacattaatccgcacaagggttcaccattgccacacagctgtgccttcctggtaagatgagccagtaatgcgtctcgttgcgaagaaaatagccctgggtaccgcattccatgacgggatgtgacagtctggaggttgggaatgacccgcgccaaaatctcgtttccgtgacgactcccgccccggccgctttaatacggtcacgctggtacagattccggaatgcaagggatattgggtgcatcccattacatgtttcacgtccaaccccattatactggtctcgtcctgggtaccatcgccttgccactctcgcacgcctagatcacttctacgcccgagctggcagtggtcccggagagtctctcaggcgatgaatgtcgtcccgggggtgtcggtatgtctgatatgcatcataggatgcgctcaggccggctatctggtgggaacaggtgcgcaagctcggattttatgagactgatcggggcgaagcctctgcatgtcgatccttaaacacgcgcatggacccacaatccacacctgcaggcaaggccgacatcacgggccctgtggcggacgtcaatcttatggtgagcactggcagcatcagcggcgaatgatggtggagcatcgactcgcatcgccagatcaaaaggtccccctccatgccggaaaggcacactgagcatccctccccccctgtcgcttgctgcaggggtacgccaaccccagtcaatttgcaggggggatcctcaatcgcctgtatgcaagggccctgctggtcgctgatgagaaggaccccaagtgagtgtggtggtgatgcctgctcagaaacctggtcctgggctgccacacgacaagccccatttcccccttcaacgcccctcccgacttggccttatctccactttccgacgcccacaggcagcgctgggtgttcatcaacctggacgcgtgcatggcctcccaggccgtcactttcaccgtgctggagaggctcgcgaagcggtacggacagcagtacaccgaacagaatgtggccatgagcggcacgcatacccactccggtccctcggggtacctgcagtacctgatatacggcatatcgtccctgggcttttacaccccctcctttgacgccctggtcgacggcatcgtggaggtgggttggtggggggttgggggattggagagtgtgtcggctgcggtatgagcagggaacaccggcgatgtgtggtgctggcaatgctcggcctaaggagagcacagccatttccaagagctgacgggcggtggtgggggtgactcgctctggttgaagcctggaatgctcccaaaaatcctcttgcgatgcacaccacctttacccaaaacctcagcgcccccactttcccacccaccatcaggccatcgagtcggcgcacgagtctgtggggcccgcctccctgcacgtggccgtgggcgaggtgctgggcgccaacatcaatcgctccccaaccgcctacctgcacaacccggcgggggagcgcgcgaggtaccgccacaacatcgacaaggagatgacggtgctggcggcgcgcggatcgggggcggacgccgccgccaccgcgcagccgcgcgccgtcttctcctggtttccggtgcacggaacctcggtcaacaacaccaacacgctggtcaacggcgacaacaagggcctggccgcgcagctgctggagcggcgggcgccgggcacggtggccgccttctgccaggccaacgtgggggacaccagccccaacacgctgggaccgcgctgtcgcgacacggggtgagggatttgtgtagggggggggggggggggggggggg

SEQ ID NO: 36934 - DNA, 71 bp, Chlorella protothecoides
catgcagccgacggcgtcgtacttgtccgggcccgcggtcccggccgaggcggcaaaaaaggcgggttggg

SEQ ID NO: 36935 - DNA, 23016 bp, Chlorella protothecoides
  modified_base (593)..(602): a, c, t, g, unknown or other
  modified_base (879)..(888): a, c, t, g, unknown or other
  modified_base (1541)..(1550): a, c, t, g, unknown or other
  modified_base (1826)..(1835): a, c, t, g, unknown or other
  modified_base (2300)..(2309): a, c, t, g, unknown or other
  modified_base (2447)..(2456): a, c, t, g, unknown or other
  modified_base (3445)..(3454): a, c, t, g, unknown or other
  modified_base (4403)..(4412): a, c, t, g, unknown or other
  modified_base (5920)..(5929): a, c, t, g, unknown or other
  modified_base (7262)..(7271): a, c, t, g, unknown or other
  modified_base (8039)..(8048): a, c, t, g, unknown or other
  modified_base (8142)..(8151): a, c, t, g, unknown or other
  modified_base (8329)..(8338): a, c, t, g, unknown or other
  modified_base (8480)..(8489): a, c, t, g, unknown or other
  modified_base (8817)..(8826): a, c, t, g, unknown or other
  modified_base (9303)..(9312): a, c, t, g, unknown or other
  modified_base (11171)..(11180): a, c, t, g, unknown or other
  modified_base (12504)..(12513): a, c, t, g, unknown or other
  modified_base (12834)..(12843): a, c, t, g, unknown or other
  modified_base (13976)..(13985): a, c, t, g, unknown or other
  modified_base (14343)..(14352): a, c, t, g, unknown or other
  modified_base (15055)..(15064): a, c, t, g, unknown or other
  modified_base (15176)..(15185): a, c, t, g, unknown or other
  modified_base (15489)..(15498): a, c, t, g, unknown or other
  modified_base (16717)..(16726): a, c, t, g, unknown or other
  modified_base (17232)..(17241): a, c, t, g, unknown or other
  modified_base (18855)..(18864): a, c, t, g, unknown or other
  modified_base (19895)..(19904): a, c, t, g, unknown or other
  modified_base (20576)..(20643): a, c, t, g, unknown or other
  modified_base (20970)..(20979): a, c, t, g, unknown or other
  modified_base (21285)..(21294): a, c, t, g, unknown or other
  modified_base (21644)..(21653): a, c, t, g, unknown or other
  modified_base (21854)..(21863): a, c, t, g, unknown or other
  modified_base (21992)..(22001): a, c, t, g, unknown or other
cccctgaaaccccatcccccatctcaaaaacaggacgctctggagatccgggcagaggaggttgaacccttgctggtcagggccatcggcaagaagctgctggaggcgcgcatcgaccagctggcccacaccgtgtcggtgtccaagtctgctccgcgcgcctttggcgacggcgactggaaggcgctgcaggccaccctgcgtgtctggcaggtgcggcgttggccgacgaggttggaaaggaggggatgtggggtggggagtggagaccggggtcttctcgccagcacacccatgcaccaagcacactgcgtgtttgacagccgagggtttgggagacctgcctctggaccggcgcactcagacagggtgccaacctctccaccacctcgcattcgcagggcgcgctggagcgggcggagcagattgcagaggaccgaaagggcctgctgcagcagggcctgaccgccatcaaggcctgagcggtgggctttgattgggtgctgcccaacttcacgccccttccacacacacacacacaccccttgcatgctagggtgatggggacagcaacctgtcgagcatgtatcaannnnnnnnnnccccccccccgtgcatgctagggtgacggggacagcaacctgtcgagcatgtatcaattcgaaaagagggtgccagggggcagcagcagcagtgggttttcagtgtgatacaggcagcgtcacgggaggagggtagggggaagaggcgctgtggtcttgagagctgcctgacccctggcacagcgcacagggaggacgcgggcttagggcagccttggggtaccgccatgcagtcaccctcgctgttcccgggtgcctcgcagagcattcgacgcannnnnnnnnnggggcagccttggggtaccaccatgcggtcacctccgctgctcccgggtgcctcgcagagcattcgacgcagtgagccgcctcgcccttccccctggccgccagcgtcacaccaccccatcaagtcatgtacttgtcggcctgcgcgctgagctggcgcgccgaggccttggcatcctggaagagcgcgtgcgcctcctccaggtccccccgcgccgcttccccccgccccgcgctccgcgctagcaccgcgcccggcgtcagcagctgggccgcgtggcgcaggctggtctcctccgccacctcggccaggaaggccagcgcgtcctcgcccagcgccacaccctccacctgagcgcggatggccaggatctggatgctctcctccggcgtgtaggtctgggtccggacgatgaccagccggtccaggaggtccacggggacgccgtggggtgcggagacgtcggtgccacgcaccgcacacatgccgcggttggtggccagcaccacgatgggggccaggctggactccagcgcgcggttgaggtaggtgaagcattctatgtccagcatgtgcacctttgcaatttagggggggagggggggaggagggaacaaggtgtgggtccgtgttgctgagggaatcgtgaagannnnnnnnnnctctatgtccagcatgtgcacctttgcaattgaggggggtggggggtgggaaggagggaacaaggtgagggtccgtgttgctgagggaatcgtgaagagcgccggctgggacggcaggcggacctggctgtcgaaaggcgcccggtccccccgtgcctgcccctgccgcatgcatcatcccccccaccccccaacctccccacccacaacagcaactcacctcatcgacgaagaggacccctggaaccagctcggcggtgccctcgtctatatacnnnnnnnnnntttacccccacccccccacctccccacccacaacagcaactcacctcgtcgacgaagaggacccctgggaccagctcggcggtgccctcgtctatatacttgttcaccacgcggttcacctcctggcgcagcttgtccgtgatctccgtcttcttgggcttcagcagctggcccatgagggacatgatgtcctgcccgccctggggcttggcgttggcggcgtccaggtcgtgcagcgtgacatcctggaccaggtccttcttcttgtgcacatcgccctttgggagggggacgtagacctccgcttccaaatcgaactcggtggcataggcgtcgctcctggcagagatggagaggcgggtgagcatcgggaaaggacaggggcggacccggcatcgggcaacagggaggcgggggaggaggaactccttccacagcgagtgcatgcagggagggctcttggcnnnnnnnnnncgggaggcgggggaggaggaagtcctcccccagcgagtgcatgcagggagggctcttggccctggaaggtgcattcccagcccatcagtgcaagaagccccaactatgtcgacacctcaccggccgacgcgcttcacnnnnnnnnnntcccatcggtgcaagaagccccaaccacgtcgacacctcaccggccgacgcgcttcacggatccgctgttggcctcgatgtagatgacgtcgccgggggagacgcgctccttttgcagggcgtcgtggatggtggggtccagcttcagctgcttggtccccttcactgtcttcagcccgatgatgacgtggctgatcaccttgccatagcccccgccctggttctcggtctcaacaggggtcatctcagtcacctccccctcgtacacctctttccgctcctttatcctcagtcctagagaattgttggaggggttaagtagtagaatgagcaaagctggaacactgatcgtacactaaggactctgatctcagtgaggctccctttcccatcaggtaggtgtgtacttcccaacaagaaccagcccagcgtgtctcaccgatggctctcctgaagtgttccatgagcacttcggtcttcttgacctcggcggagtacacctctgagcctaccatgggacagaagggcaccttggtcccgagttcctgggcgatgcccagtgccagtgccgtcttgccagtgcccggggctcccgtcagcagcagagcgcgccccgccatcttcctctgtttaatcatctcgaccaccagcccgcatgcctctcgggcctgctcctgtcccacgaagccggagcccagggggagcgcatcgccggcaggggtgaggcccaggcccttgatgtgggtatgggggctcacgcgcgatgacttggcggtggatgcaacttcctcaatcctcatcgtgaacaacgtgtgggcatcgggcaaatgcatgcacaatggctgtcccctggactcttgtcgttcccagagagattcatagctttccgacgatggtacggcttcggtaccgagttgaccaaatcaggcatacatgaggattccttgtctgcagtagggacaattgtctatcgaggaggtaacatggcnnnnnnnnnnccccatgggcatacatgtggattccttgtctgcagtagtgacaattgtctatcgaggaggtaacatggcgatgatgagcaccattctctgtggcagtcttcgaggggacgcatctttggtttgtacatgacagagaagggcactggcagctttctcaacgtatgtgtgcatggactgctgccactgagctcctcatcggtgaattaagttgaaaacaacagcgtcgtctgatccaaccacctggaccttggcgaactcctggactttgcctatggagaatgtcagtccctcatgtcacaggtgttggcggtgctgtccacgcactcaacccgtcctaagacgggtgtctttacccacttgcgccagcagtaatgcatcaatattacaaacttgtagcaaatcgcgacgaacaggcggggggagtccatcagtagagtggggctaacttactggagagaaccctagcaaagaaaggccggagcatccgtcgcgttcagcgcattaggtgcaacaaacctgcattgtagaggcaaccgcaatgcctgaaacccttgcaagtgatgattatcggtgatttgccggtgctccgctccctccgctgccagcttgatcacctcggaccccgtgccggcagcgctgcgattccaagggggggacctggagctagcattcttggctgattgggcatacgaccctcaacacgtgtctttcatactttgaagtatgtgatatgggatgtgacgctagctctcttgccgtgttcagggcgtggcatctctgcgccgggtcctttgaccatgcagtcgaggcacttggtcgcacccacacccagttcccaccctgcacagatcttgccacaatggcctccgtgcgacgatacatatgacccatttcgtagcttgttctgggaaataaccgtcctttgctcctggaggcgggccttcggtgnnnnnnnnnncagcttgttctgggaagtagccatcctttgctcctggaggcgggccttcggtgcatggcatgaccagtccggtggagctcgagaagtaccgacaaatggtgatgacccagttgggccatgcctttcttatgcaccagcagtccatgctgccggcaaactctccttcccacagctccctgcgagtcgctcagattccagaaggcagcgcgagggagaatttagctggaggactcgacaccggactccggcccggtcgaggtatgaccctgtgcgctagctgacaccctggcaatgggtgtagtgaggaaagaacctagtgggaggcgctccacgcaggtggccagccaggaaggcagaggccgtttgatgggctcctttgaatcaaccttcgcctgggtcctcccacctcccacaggcgatgacgagcccgcgagcaggaagaggaagcccacggcgtcccagggccgcacgccgccgcgcaagaagcaggacggtttttggacggctgccatgaggttcatggcctcacagggtgaggagctggccacccctgccgtgccgccctcccagcattcgccagcccaccagtcaggtaggctggttgggcatgcgagggagggcttgggcccctggtagtgagcatggctgtggcaaagacaaccacctgcctgcatgcctgtgccctgggactgcctgcggccacccaatgccaggccctttcgctccgcagcttcggcgcgagtggcagaggagcattctgctcgcctgactgcgggaccgcaggtcaccgggctggcagacggcggcggctctagcatgtctggcatgtgcgacgctggggtgccgggggtgttggaccctgtgagtgcgggggacaggccgaggagcgactcctccggctgcacgccaggccctccctctttccagcatgggccagtgcagcatcgagcagtccctgcgctgccctttccctccatggacccggcactcctggagatggtgggtgggcagcgactgcgaggggcggggcacagagggtgtagtgcagggtgcgctatcgcgtgcgctcgcaggtgacaatccttgcaggacgctgtgcatggcgcagcgggatgcactgacaaaaaatgtgcgacatcctttccgcaggcccggcaggccatggtagcgaccgccgtgcccttcccccccgactatgagcctcaggtgaggcgtgtgggtgcacagcctcaaggagggttgattgctttcgccttcaaaatacgtggttgactacctgatgctgcagtgcggtctgggtgcatggcgccgatgcattgcccactccatgcagcgattcaaatacctggtgtcaaatcttgccgggattctctcctgccctgccctcccgcaccacctcgtccaccatcgtccctgtaaccctcctgtttgagctggaatcgccaaggtattccctcatcgcccaacctttcaccctttccagctgcccaaactgctgccggaggccnnnnnnnnnntgctgtgcgtggcgcagcgggatccaatgacaaaaaatgtgcgacatcctctctgcaggcccggcaggccatggtggcgaccgccgtgccctttccccccgactatgagcctcaggtgaggcgtgtgggtgcacagcctcaaggagggtcgattgctttcgccttcacaacacgtggttgactgcctgatgctgcagtgcggtctgggtgcacggcgccgaggcattgcccactccatgcagcgattccagtacctggtgtcaattctcgccaggattctctcctgtcctgccctcccgcgccacctcgtccaccatcgtccctgtgaccctcctgtttgagctggaatcgccaaagtatcccctcatcgcccaacctttcaccccttccagctgcccaaactgctgccggaggccaccttcgacctcgtggcctccccccccagcgccggcccagcccacagctccggcagcgccgcgggcgcccaggccgggacccggcccctgcacctcaagttccggagcggcgccgccggtgctggtgctgccggcgacgccgcgggccccgtgctgacgcccaccgctcccgggctggggcgcagcgccggccccgccgccggcggcacgcccgacgcggtcccctccctggagctgacgggcgccgagctggccaggctgctggcgacgccgcagcgacctctggccctgggtctgggaccactgacccccttttcggccttcctcatggaccaggcggcaggggtgggggggtccaccgccgacgccggcactgcagcaggggggacgtccactggggcgacagccggggccgcggcggtgacgccgcaggcggtggcaggcctcgggccgctgcccgcccctgccgacagccccatgcagatggcgtacctggacggtctgctgctggacctgaactttggcgaggacgcgggcctgaccgcccccggcgcgccggagcagggcgcgtttgcactgcccgcgcagaccccggcgggagggaaggcggtgctgcatcacctgcagagccccgctgtagagggcctcacccagccccctgcagggctacattgccaggcctcgccaggactgccaggtctcatgtcccccagcctcctggcggcggccctgccagaggacttttagttctccgtggagatggggtttcgtcatgcattgtcagtccctgcctgcaaaggacatgggaggaatccagcaatatcatgcggggatctgttcccccccttttcttcaccagcagctcaaactcacatacacgcaatcgcacacttcctgttgtacatgctattacacannnnnnnnnntccttttcccccccggcaacccaaactcacatacacgcaatcacacacttcctgttgtacatgctattacacagatggaaaacagtgaccatgcgcagaacaggcagtgttgaggcagtgagacggcacgcgggggaatgcgcgcgcgtgaagcttgccattctggcatcatcattctgtacggagaacgagcattcgcgacggggggaagcggccatggggacacagattccctcatggaggagaccgatcacagtccgagttgacccttctctgcatgaaccccccttgcatagcccaggcgcaggggactatgcgcccgtgccgccgttggcctcgcctgactggggcagccaccccgccgcttcggcctcccccttcagctcctcgaagactgggacggccagcgggaagtccaggactatgtcgtcgaggttctcctcgacccgggagaacccggccttcagttgcgtctgcattgtgttataatgagcggagaagggggtgctggggacaggcttgaggctctagtccggcggaatgctcgacgcagtgggactgcaacctcactcacgaggcccgcctggtatccttcccagccacgcctcccacgcacctcggtgaccagaccagaggctgcgagtgaggccagcaggtccaggatgggccgcacctgctccctatgagcacaagcggccagcaggctcctgcgcggtggtgcagggatggaggcttgcgcatcgccgcggcagggtcttggtcatgtgnnnnnnnnnnttaatgagcggaggagggggtgctggggacaggcttggggctctagtccggcgggatgctcgtcgcagtgggactgcaacctcactcacgaggnnnnnnnnnnggcggctagcaggctcctgcgcggtggtgcaggaatggaggcttgtgcatcgccgcggcagggtcttggtcatgtgcatctccccgggttccatcgctcatgacccacaaccgagcagcggacgaggagggatgccacccccacatccaccatcaaactgcaacacatgtcagcccgnnnnnnnnnnggagcagccgacgaagaggggtgccaccccacattcaccatcaaactgcaacacatgtcagcccgcaggtgcgcacgcacacacacacttgtgccagcgccccgcagaccaacctgacgacaaactcgtggtggaagtgcgnnnnnnnnnntccacacacacacactcgtgccagcgccccgcggacccacctgacgacaaactcgtggtggaagtgcggcaccgccagatccgacaagcagcgctccgcctcgtgcacgtcgtgcgtcgcggtgtactcctgcaagggtgggaagctggcggggagctgacgtgcatgcagccgggcaagggcgcggggaccggcgactggtggcggtcgggcgggcgagcacggcgcggaatccgccctgaaagctgtacggaggtgtcgattcacacacactcagccacctcccccccccctcccctcccagctcacgttcacggcctcgcgcatnnnnnnnnnnagaggtgtcgatgcacacacactcagccacctgcccccccccccctctcccagctcacgttcacggcctcgcgcatggcggacgccagctcagcgggcctcgacacgcgctcgtgccagcaggtgcccagccgctcgccggcgtggcgcgccgacaggtgcgcgccggcgtgctgaatcacgcgcaggctggcgccgtcgccgcgcaggcgcggcaccgactcgacgagaaagcgcggcggaaccacctcatccacgatcgcgcggcccaggaagagggagagtaggggctccgcatcgggaatgtccagggtcaggtcctccgccgccgccaccaggcagctgaagcccaggcaggcttgctctgcgagggtgggggggggagaggcaagagacagggcttagcagtgtgatgatgaggtgcacctcacgtcacagggtgtcgctacttctctgaaatggttccgcagagcctcgnnnnnnnnnnggcgagagacagggcttagcagtgtgatgctgaggtgcacctcacgccacagggtgtcaccacttctctgaaatggttccgcagagcctcgacccggtgaggcaaaccgcacgctgcgctggccccacagcatggcccttcgccaagggacccctcggcgccgcaccgtggctgatgacagagggcaccagggtcgggagcagggccgacaccagctccctctcccgatccttgcggtcaagcgccagttgcacagcctggtgagggaaaggcgagtttggggagggcgatgaggggtgtgggcggccagtaaagatcatgcaccaatgctgagcatgatgacccaggccatcgtcctggctggcacgcaatgaaacagctggcctgcgtgtatcatcacacgcacatatttcacaaagatgtggtggaaccccggctcgtccagctctgcgagggacctggccacctcggtagggtcgcctacggcggggagcaggagggcgacaggtttgagtgtctgaccaggtggggcatggccgcgccacccctcgagcctgttccccctcgccgcctgagcctgtatgccccagcatagcatcactccaagacctcctagaccacaggcaggcgagccagaggcgccaaccacgtctcacctgcatcaaaatactctctgaggatggctttgatggcagacttgtaggatcccacatcagctgctcggaagccgccgttcccatgactccgcgccagtccgttgggggagcctgtttgatgagtcacggggcgcaagaagagtgagcaggatgcccttgttcgaggcagcaatggaccggctgcaatcagagggaaacaagcacaacagccagaccaaatacgactggggagattgccggttcagtgagatcccatgtgagcctcagatgtcccaggtgaatatcctcgtccttcctccggcagtgagagccgtcatgtcaatccagcgcgacaccccctcccccacccctttcctcccaagtcgacccacccatcggcgtctccccgccgctctggaagccctcctccagccacccagccttggtcgcggcggcgaccatgtcttcaaacgtctcgcgcgcggttggcacatccagctcgatgtcggccagcaggtcagaaacgcggccgaaaccctgcatcgatgaaaacggtgtgcctcttgatgtgccccaggaggcacgcgccctcacacgcacgtggtcatcggcacctgaagccgtggcccgcccccagtcttgcactgaaattcggccccacctcacctttccgacttggctggtggacagcacgcactcgcccgccaggctggaaagcagggcgacgtacggcgccacgtcccccgtctccagccccttgacgatggcctgcatgagaggggtaagcaggcccgtgctcggcgctgggagcaggcactgtcacgccgcgctgcgacgaggtactcatcagcgtcgcacggccacgtcgccgcacattctccaaaccctcttcgacccgtccagtgcccccaactccacgcgcctgcttcacgagctcgtggtggaagaagggcacggccaggtcgtggagtcggcgcctcacctcctccacgtcgcgacccgaggcatactcctgcgtggggaggaaagcgcggcgtgagacagcatggtgaagtttgcgcgccgagtcgctggaccgtggtccagagcagcggcttcaatcaaccccatcgcaccagactcccacaggacccacccaacgctcctggttccccagcgtactatccccgccctctttccctcccccccaaaacagcccacctccagcatgctcttgatggaggnnnnnnnnnngtactcctgcgcggggaggaaagcgcggcgtgagacagcacggtgaagttttgcgtgccgagtcgctgtaccgtggtccagtgcagcggcttcaatcaagcccatcgcaccagactcccacaaggcccacccaacgctcctggttccccagcgtacaatccccgccctcttcccctccaaaaaaacagagcccacctccagcatgctcttgatggaggcccggctctcctccaggtcgaacccggctgtgccgccccagcagcgcgccaggcgctccgcggcgtgcttggcagcgaggtgggcccggcacttgcgcgccagggcctcccccgccggccccaccgtgtccagggaggaaaggaaggcaggggccagcgcgtcgtccacaaccgcacggcagacgaagagcgcgacggcgtctgccgcgcccgggacgtccagttctaggtcctccagctcggccgccacggcttggaagcccttgcgcaggtccgaggacgtgagcagctggggtgggaagggaggaggggggatgtatggggttgggagtgggactgtggtgtggtgctagaagctgggacctgggtgacaggagggcgccactttgggagaatgtccccactcgcctgccaccccaccagggcaaccctcattcctcattcaaacaatctcccccaccccccccccaaaaaaacacacctcgccatgcagggctgccaggaggacgctggtcatctcccgctcacggtcgtggcggtccagcgcccccaccaccgcccgcttgaccacccagtagccgtactgggggctgcccaggtcgcgcaggcaggccgccacctcagtcaggtctcctgtgccgtaaaactcggccagggcggcggtcacgcccgccttgaaggccgcgacctcggagcgggcggcgtcgcgccagaacacgtgctgactggcgtcgtcgccgtcctccccggagtcgtagttggggtcgcggcggtctgtcaccgcatccgtggcgccgctctcctcgtcctccagcaggccgccccaggtgtacttcccgcccgacccccctttcttggcgcggccagaccctgggaggaaaggtacggaagcgggattggatgctgaggaggagcaggtgcggagtggtccctggcacagccttgcagtgataccttgagtgcagcgcttgcaaaactccgacactgacgctgggcacagacggaaaaacaggcgaccctgccgcatgccagccggccaccagggagcgaaaatcagggctcaattcctacatcaccgcctgctgaccagtgtcacaaccaagcannnnnnnnnnaaaaatcagtgctcaatttctacatccccgcctgctgaccagtgtcacaaccaagcaacaaaacagaacctcacccttggtgcggcgagaggtgtggtggtcgtgtgccacctcccgcttgctcttgggggctgggagggagctggccttgccagacgagaaccggccgatcagcgagctggggtccacgggcgtcagcggcgggggagcagagtctgtggtgggtttgaatggatactgcagacctcaaagttggcttggaaatgagtgaatttggggccctgccggcggtgcaggattctagaagaatgctgctgctgnnnnnnnnnnaaccggcttggaaatgggtgaatttggggccctgctgatccggcgtgcaggattctagaagaatgctgctgctgagggattcctctccattgttcaggattcatcatgcatgtgcaaacgcagaggaaagctcagtcattgttcaacggctcaagccatcgatcagtgctcaccggcctcggcttgcttcttcgccagagccgcgtccagggctgcccgctgctcctcagtgaggaagggctgggaggagagtcgctccagcccttccactgccgccgcacgcgatccgggcttgcgcatttcggatgctgcaagattgacatcgtggggagtgggtggtcgatgcttgcatgcgtgagcgtcgctggacgtgtccatcccccggcatcggagtccaacccgaggtcccactcccgtgcaacaccccgagtactggcaagtacctcaaccctcggacactcagatacacctacatggtatttatgtgtacgttcgggctcctgagtgtcgacggatgtatcggatacaaaaggtcggaagactatccggtctaccagactcgccctgggggttggctttctccggaacgcgaccgaaaccacacctccgtctgcgtgcacgcttggatggatgcgagaatgtaaggaaaagatacaatcaaagacttgaagattggtgtcgctgggtgtgcgtggagaatcagatccgatgttctgttcacggcacccccatcgtctccgcacacgggacaatcgcgccctcgggctgggcatggggacactaggggtcctccagaacatcggcatccttcacgcggccgtgatgacctcctttctgacggaccgcatacctgatcaagtggttttgcgtggttgtgtcgaggatccacgcctcgatcttggtgctcccttggggaggggaagtcggtgcccgactccacaccagctgttttgactgtcactcgatcacgacatcagcgcatctgggaagccctccaaactgaaaagggtcccggatctctaagagtttttacaactgggggcctttggtcatggtgagttgacctgtcgtcggggtggtgctggggttcgctcgcacactgttctgacgctcggtttgccctcctgcatccnnnnnnnnnntcaaactgaaaaaggtcccggatctctaagagttcttacacctgggggcctttggtcatggtgagttgacttgtcgtggggggtggtgctggggttcgctcgcacactcttctgacgctcggtttgccctcctgcatcccccctcaacttccacagattcggtgggttcttctcctcagtcgacaaggcaaggtccgcttggccaagtggtacaccaccacgacacagaaggagagggcgaagctgctcaaggaggtgtctcccctggtcctaagtcgggccgccaagctctgcaatttcatcgactggaaggaccagaagatcgtgtacaagcgctatgcctctctctatttcgtcnnnnnnnnnnttggtccttagtcgggccgccaagctctgcaattttatcgactggaaggaccagaagatcgtttacaagcgctatgcctctctctatttcgtcatgggagtagacgcaggtgcgagcgtgggcaggttgtctggtgaaccagcttaatggcagactccccttggcgcagctttacttgtggctgccttctggtgacagcaatctgcaggctggtatttgataggtagtcgtaggcttgccatagcccataccctccttcaacacaatttccccccaccagatgagaacgagctcatcaccctggagatcatccacgagtttgttgaggtgctcgacaagtactttggcaatgtctgcgagctggacctgatcttcaacttccacaaggttcgttgttggctggttcttggtcagcgcactcccttgcccctccacctgttgtcctgcgttgatactgtgttcaccctcctgtccctcctctattccccctttccaccaccaaggcgtacttcatcctggacgagctgctgctggcgggcgagctgcaggagcccagcaagcgcgtggtgctgcagaaggtggaggcccaggaccagctggtggagcaggtcaagtcgggcctgagcgacgagaagatcgtcatcaccgggcccaggggctgaagctctttggaaccaaagaacaggcacctgagggggggggnnnnnnnnnngtggcatcgggaccaacaagctgcagccacgggatactcaccattgcctcggcccctcgaccccggattccccttgcgtggacgcccctgcatttcacccccccctgtgcgnnnnnnnnnnccccctcgaccccggattccccttgtgtgaacgcccctgcatttcacccccccctgcgcgcatgctcagagcgccctgacaccgtgtacagtcatcttctccagtgtgttactggagcaaggaggccgttgcagagccggcggccagctcagggtcagcttggcgcggggtggagctgtttgggagggcgacacatggcgcatgcaggagtggtgaagggggagcgatacttgctggacactgcgcctcgccaccccttgcgtggcagggtgccgcccacccctccgccgcgatccccgctccnnnnnnnnnncggcgcatgcaggagtggtgaagggggagcggtacttgctggacactgcgcctcgccactcccttgcgtggcagggtgccgcgcccacccctccgccgcgatccccgctcccaccccttcctctttgtgaatcctccctcgcgttacttggactcgtccacgctgctgcgccgcgcgctctcggccatgcccgcatagctggcctcggccgccggccccgcgccgtccgcgccctcgcccgcgccgccgccgcgcttccccgccgcctcccccctcgcctcgtgcggggccaggtcgcgctcggaggccaccttgcccgactgccgcgccaccagcgtcgcgtacaaccccccacgccggaccagctcggcgtgcgtgccgcgctccgccacgcgccccgcggacatgaccacggtcaggtgcgcgttgcgcaccgtggacagccggtgagcgatgaccagcaccgtgcggcccgcctgccgcatcgcgcggtccagggccgcgtggaccgccgcctcgctctccgcatccagggccgaggtggcctcgtccaggatcagcacgggcgggtcgcggatcagcgccctgcggttgtcgagcaggggggaatgggtgtgggatgtgaggctgggggtgtggcgaaggggcccgtcgcaggcttcgtgtggtgcgaggtccagccggtctggacccctcctcccacggcccccttcacctgccgatcgccaccaccgccaccgcccctggggaccccacctggcgatggcgatgcgctggcgctggccccccgacagcaggcggtcggtcaccggggtgtcgaagccctcgggcagccgctcgatgaagccgcgcgcgttggccagctccgccgccctctccacctgggcccgcgtggtgccgggggtgccgtaggcgatgttctccgccaccgtcagcgagaagaggcgggggtcctggggcaggagagcggggtgtgtgtgtgggggggaggtgattgggggggggcagcgtcttgcgatgcggagtgatgggagacacggccaggcgtcgcatgcacgcaccccgcatcctggacagggggaagctggcgagcacatcggcgggtcctccgtcgtgatctacaggaaatcgcggggaggcaccgcctcccacccaccctgcgcgcggctgcccccttcccccccatgaccccccttcccatcgaccccatcacctggcnnnnnnnnnngcaggaaatcgcggggaggcaccgccttccactcaccctgcacgcggctgccccctttcccccccttcccatcgaccccatcacctggctgaccacgcccagctggctgcggaaccaggtggagtccagggtccgcacgtcgtgcccgtccagcttcacggtccccacacttgggtcatacagccgctgcagcagcgccaccagtgtggtcttcccgctgccggacagcccgacgaaggccacggtgcggccggcggggatgatgagcgacacccggtcctgatggagttggtggtgggggagaggggggaggtgggtgagggggcagtgttccaggcgagactggggcaggggcactgcacctcagcacaggcactcgccggcgtacagagtcagggcaagggccggcagccgatgacccacgggcaatgtggagcccaacgccacacgccgggccgcagccatgccgtgttttgaatgacacctcacaatgacattgtccccannnnnnnnnncccgatgaccgacgggcaatgtggagcccgacggcacacgccgggcctcagccatgccgtgtttcgaatgacacctcacaatgacattgtccccacaccgcccctgaacaccaacaagacgaacactccccacacacttttcaacgctgccagctcaccagtgccaggacattggggcgggaggggtagctgaaggagacattgcggaactcaatctcgcccgtaacggtgtccaggaccttgcccggcgccagctggggcgcggggggtttgcccaggtacgccatcaccctggttaatggtgagacaaggcatcaatacagcgtgtcggctcatctgtgccgaggcaatctatcgcaagcgtgggtaacaggcacctcactccttcaccaaaaaacctccttcccaagcctccctcaccgctcgctggcacccaggctctccatgatgggtccgtactggtctgccacggagagggtggccgacgcgaagagctccacatacagcatgaagctggtgagctgctgcgcgctgatctggcctgtgaatggtgggtggggtggggggcaaggcgtttcgaggtgggggaaccatcatggggcctcatctgtgggctaccgggctggatctggggcactccagtgtgacgcgcagcgacacggccacaccaacacatactccggaagctcgcggacgcactgcaccaccacccttcccccgctttcccactccctcccccccactctcaaaaaacgacctacctctaagcgcggcactgccgccaacgagcagggcggcggcgcgcatggcgttgtagccccagtggtttgccacgacaaaggaggagtaggcaaccgcctggcggctggagatgtgggccagcctgcccagcgtctcgtcgtaccgcgcgcaggcggcatcctcggcgccaaatgtgcgcacgacgcgggagagcaggaagctctcctccgcacgcgccgtggcgtcggccagcgtgtcctggtacgcgcgctgcgctgcgcgggagaaggcgccgtatgcgcaggcggcggccgccagcgcggcgccgacgccggcggccgcggcggccatgccgcggttcagcgtgtagaggtacagccccgcgccggcgcactggagcgcgttgcggaaggccacgttcacgctggtggccaccatgcgcgacacggaggcgcagtcggagccgaggcgggaggtgagctggccgccatcggcgccatcaaaccatgccactggctgcagcatcatggaccgaaaggcgcgcgacctttgtttgggggaggggttggattgcggatgaaaattggggggaagtcgggagagtgactgaagccagcagggcaaggaaggagcaacatcattggggtcactcattctccaggcagtcagtcagtgggtcacggacaggggtaacacccagcatctccaccgtcgagcagctggccaggactggctgtttccacctgctcccaagcactgacttttgaagcctccacgccctgtacctgagtcgctggagcaggttcatgtttaccaggctaaacaggtatccgcgtaaaccagcagccacagcaaacacagcggttgcgatcnnnnnnnnnngaacaggtagccgcgtaaacccgcagccacagcaaacaccgcggttgcgatctgatcacagcgtgaaaggaaggatagatgtgtgctgagcaagaatgtagagccagcgatgatcccaggtgcattggactcatcttccatccgggataccacagcagcctgctctggcccctgccttgagagcaggcacaaggtcaatgccagcaaccagctccgcaccgtgagtcgcgtcagggactggacaaaggcggggctggagccctcctgggccgccgcaaacacggctgccgtcacaaagtgggggatggtgagctctgcgccggcggccagcagcatggacgtaatggcgccggtgagcagggccgagtcctccttgaccagggcggacagctgcttcagcgtcctgcccagcggctcctgcggggccacactcgggccacctagagaccaccactccttccaagaggcacgcaggtgatgccatggcgggcgcggccttggtggagcggcagtggcggtcccgctgctcgctgcgatggtcaggcgacgaatgagcgggcgggtggaccgaaaacacagggcccttggggttgccaccgttctcatgggatgggagaggaccccctgacaccccatggaatcagttcgatcagtgctatttcatgtgtcggaaagaagagcaggcctgcagccacccggcacggaaggctcgagcgggcaagctccgtcaggagaggagaagaatcgacacgagtgcatgcttggacatggagggcgaccgaatacgcctgtgatcgacatcaaggtgagcgagtaacgctctgtgaggaccctgccgatggctggcacggccaggagcactgatctcatcacgtgaccgtgctgcgcgtgaacctcacagggaggccaaattaacggtgttccagtaagacaaaatgtggagcgaagcttcgagtctgcctgtcgtaacaagcaggaatgggcaggttgaatattgtcgatctccgtggtgccctctgatcacctttccnnnnnnnnnntctgtcggaacaagcaggaatgggcaggttgaatattttcaatctccgtggtgccctctgatcacctttccccctcctgcccaacaattccaagcagtacaatgagcgtcaagtggaaccccgggcaggtcatttcaagtgtaccttcttgccttggtaaatgttcccgccgacgggcagagtatgcaagagaggtctgatgatagtatgaagtgtatgtatcccaagggcacacccaaggtgtgctcgacattctgacgaaggatttcctcagtacgaccgcagtaccgacacctgtgaaacctgcaatgcagtgctcgagttcttttatgtcacataatgtttttgagaattgttccagcgggataaattggtaatatcgtattgctgattgtcataatgagtttcccgtcgcgattgcgcccacgatcacgcagccggctgtccgggccccggtggcaggtgcctggaaacagccctagatcccaatcagatactcggcactttcggaaggctcacacaggagccccaaatctgcgggcggcaaatcttcgtcatatgggcgccccgaatcaacccttcgatatttgtgattcattctcaaacagattttgcccgtggccacaaaggcatgcaagtctccgctcctcaccgaatgagcgccacggagannnnnnnnnnnnnnnnnnnnnnnnnnnnnnnnnnnnnnnnnnnnnnnnnnnnnnnnnnnnnnnnnnnnctcgccgagctgaaagagcccgcccgactccccttctcgcagaacgtgctgcaaaaggtgcagctgggggtatcacccaacacggtcacgacaggaattccaccaatttttaagaggcctccccccgtcaagcgtcaataacgacgagtgagtagctcagactcgtcctgatggcgaagtcgagttcacggccctgtagcgcataggtgtaaaccccctccttttcctgactgctttcttacctaggttttgaggctccccttctcccacctaagcgtggcgtgtaccagaccaggaatcattttccagatcactgtcactctctcnnnnnnnnnncaccccctcttcttcctgactgcttccttacccaggtttccaggctctctttctcccacccaagcgtggcgtgtaccagaacagaaatcattttccagatcactgtcactctctccgagtgcactcgcccccctttcattgtgaggagtacaggttgtatacagacaatgcccaagggcacatggtgaatggtagcagcagatcagtttgggagaggactcgtgtggacttgatcagtcaggcgaccgctcttgggttgtggcaaggaaaattgtatgatacaggaagagggcgcccctgctttgnnnnnnnnnnacacatggtgatggtagcagcagatcagtttgggaaaggactcgtgtggacttaatcagtcaggcgaccgctcttgggttgtgacaaggaaactgcatgatacaggaagagggcgcccctgctttgctcgagccatgcgtgccgagagtgacggtttcaagtgcagcaggtgcacatctttgcacacctgctgcgtgttgtccacggaattggtacagattggaccggccctgtgcagcagatgtgcttggcctcatgattcacccggttcgaagtcctgtgctcccttgcaggctttgcccgcgacagagactccgcgaatacctgaatggaccgacggtgacctgttnnnnnnnnnntttcacccggttcgaagtcttgtgctcccttgcaggcttcgcacgcgacagagactccgccaatacctgaatggaccgacggtgacctgttggtggaagagggggggggtgccatgtggaaggaatgttcctatccaaccttcagctgagtcaggcagtgggccgtccatgccctccctgccagggcctcgcccccccccnnnnnnnnnncagactcttggccacaccctgttcctcgtcatccgcccttttcccacctctacagccaccccccgcccgctcacctcacggcccttcacttgggcgctgctatcccgggcacccccaccaccgccaggnnnnnnnnnntcctatccaaccttcagctgagtcgggcagtgggccgtccacgccctccctgccagggcctcgcccctccccccggcctagacccccttcacggatccctgccgccacagcccagctcatagactcttggccataccctctccctcatcatccgcccttttcccacctctacagccaacccccgcccgctcacctcaccacccttcacttgggcgacgctatcccgggcacccccaccaccgccaggccgggcagctgggcctggaggcggaccgcgcccgaggcccgcgccctggtcccgtgcagcaccagggtttccagcgcggggaggcgggccagcgcggccagccccgcgttggacacccccgtctggctcaggttgagggcgcggaggcgggtgaggggtgccagggcccccagcgcgcgcgaggtgacccccgcgttctgcgccagggacagcgtgcgcaggtggatcagtgcggcgaggcgcgcgaccccggcgtcgccgacgccaccgccgcacacctccagcgagcggagggaggtgagggcggccagcgcggcgcagccggcgtcggtcacgcgcgcgccaaacaggtccagcgcctccagtgcccgcaggccggccagcgcggcgcagccggcatcggtcacgccccgcgcgtccaggttcagccggcgcaggctcgtgcagcgcgccagctccaccacgcccgcgtcgtccacgcccgtgaaggccagggacagcgtgtgcaggcgtgggaggcgggccagcgcggcgcaggcaccaggccccgccacgcgcgtgtcggacaggtccaggcgctcgagggagcgcagggcccccagcgcggccgcgccggcgtcgcccacgcggcacgcctccaggcccagggcgacgagcgtgtccaggctcgccagcgccatgacgcctgcgtcgcccacgcgtgtgtacgtcaggtccaggtcgcggaggggggggcgggcggcggccagcgcgcgcgccgcgtcgtcg

SEQ ID NO: 36936 - DNA, 61 bp, Chlorella protothecoides
tggaggtggtggacgtcgtgtccccgctctacctctccgaccgccgcaccaacctctgggt

SEQ ID NO: 36937 - DNA, 61 bp, Chlorella protothecoides
tgggcaccgctcgccgtcgctccttttgcaaggccgcaaagtgctggcgggccgccttctc

SEQ ID NO: 36938 - DNA, 61 bp, Chlorella protothecoides
cgcaaagtgctggcgggccgccttctcccgggcctgcaggatctgatgaggttggacagag

SEQ ID NO: 36939 - DNA, 4587 bp, Chlorella protothecoides
  modified_base (214)..(281): a, c, t, g, unknown or other
  modified_base (2011)..(2178): a, c, t, g, unknown or other
  modified_base (2252)..(2261): a, c, t, g, unknown or other
  modified_base (3988)..(3997): a, c, t, g, unknown or other
  modified_base (4180)..(4189): a, c, t, g, unknown or other
gtggacggagttgtgggacacgaagcggtgtgtcaacactgcctgcaaggtcaacgttgtcaatcgcgacgtgaatggagcggtgaacatcctgatgcagacccaagtaatttttttagaatgcaccttgtcccacagcttttagtggacccctgcttcccctctcaatcccctcgccccccaccccccccggttcgccattagaggcaaccannnnnnnnnnnnnnnnnnnnnnnnnnnnnnnnnnnnnnnnnnnnnnnnnnnnnnnnnnnnnnnnnnnngataaactgctagcaaccggcacaagcctggtagagagggagaagggtattccgtgctttcacggattgccctcgagcccactcactcactcatagattagcccctccctgtcaagacctttactgacagcccggctcgtgtgtttttgcactttacaaaggaacttccaggatgcatcaagggggggaaagagggttcactggcaaagggcatcagccctgtgctcggtggtattctgccaaaaatttgcccacacttcagactccagaaaatccggggacagggggtggggcgaggggggccgcgctggcctcccgatcaggcagaggcggccatggcctggccggagctgccctgctcgtaggccttgcggaaaaggtccacgatctcgtccttggtggcggggcgggggttggtgaacccgcacgcgtccttgagcgagttctcggccagcacgtcaaagtcctcgggcttcacgcccagggcctccaggttggcggggatgccgacatcgcgcgacagctcgcggatggcggccacgacggcggccggcgcctcggcggcactcagccggcccaggcccagcgcctcgcccacgtccacgaagcggtccggcacggcggaggcgttgaagtcctggatgacagggaggaggacggcgttgcagacgccgtggggcaggttgtagaagccgcccagctggtgcgccatggcgtggacgtagcccagggaggcggagttgaaggccatgcccgccaggaactgggcgtaggacatcatgtcgcgcgcgcgcgcgtccttgccgttggacacggcggtgcgcaggtaggcgctgatcagcttcatggcgtgcagggccgaggcatcggtcaccgggttgctgatggtgctcatgtaggcctccaccgcgtgcgtcagcgcgtccatgcccgtggccgcggtcagcgcggcgggcatcttcaccatcagctccgggtcgtccacggcaatggtgggggggacggcgctgtccacgatggccatcttcacgcggcgggaggagtcggtgatgatgcagaagcgcgtcatctccgatgcggtacccgcggtggtgttgaccgacaccaggggcaggatgggcttggaggagcggtccacgccctcgtagtcgtggatgcggccgccgttggtggccacgatggcgatgcccttggcacagtcgtgggaggagccgccgccgtaggagacgatgaagtcgcaaccgtgctgcttcagcatggccaggccgtcggccacattctcatcagtggggttgggcttggcgccggggaagacgatggcctccacgccgttggccgccagcatgtccagcacgggctgcaccgcaccggccttggccaggccctgacagggtggagaggaggaacgggggtgtcagctgggagcatgggagtgtggggcacggatggcgtatgagactccaggggtggataacccagcaatggacacaggccatgggctgcaccaatccagacccccatcgactcccacctccctcacctcgtctgtcacgatcatggccttcttcaggttcagggacttgacgatgttcccggcggtcttcagggcgccggggccgatcagggactctgcagtgcatgcgtatgggtgggaacgggtcacatcagtgtatgtacagacgtactcaaggtgattcatcacaggaaagcttgcagtcggtgactcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaagaactttgcaatgataattaaggacaaataacaagttcagggcttggatacgacttcgatcgcagggnnnnnnnnnntggtcacatcagtgtatgtacagatgtactcaaggtgattcaccacaggaaagcttgcagtcggtgactcacggcgtggcatgaagaaggagtagccgccctcggggttggcgttgtggtagttgacgccatgggctccggtggggatgggcagggcgccgctcttctgcgagatcggcgggggtggcgggatgcgatttcagaaagaactttgcaatgataattcaggataaataataagtgcagggcttggatacgacttcgatcgcaggggcaaactttccgtctcgatgatgactacaccccccaggatacatcccgaaacccaggtcgacagcccacccaccagcgcggatgtggtgaaggctcgcagggtgaccgtctcagcgatggaaggcgcggtgacggaggtgctggagttcagcagacgggcagcgacgccgcgggcacggctggcacgggaggcgacgatcctcagcattatgtctagccggaggtggagtgatcgatgctctggtgaatggaagaggaagttctggacagcaaaacaatcgatggtgaacactagggaatgttaaaagtctgtggggttcttgagaggagcgccgcgttatatagggaacccaggagttgatgtcatgccgtgtggcgaggtgtaatactcctcgtggagtctcaggctgacggccgattactaagggttccgacactcttcttgacgaatacagcgcaccgatggagacccagactgcgccacaaaatggagtatctgtacatcagtagattcatgagtgtcgacgagcctcatctggtccaccgagggagcttggacttttgcctacgaggattatctggggggctgctgggagggaagtcggacaaaatcggctccggaagatccgcgcgccattggccacattccagagcggcaccctcagacctgatgaggatctgatagtaatcaaatgctcgacatgggaagcccgggaggttcaacacgctggtatatgtggacgccgccgtaagccccccttgacgacatacaagtaccaggttgtttcctccgaacagcaacattccgccttccaactgcacaccttgaggatatagctactcgacggctcttttacgcaacactttaatatgggtggtggctccttgcgacccaccggcagagagcggggccaatgccaagcatagagtctcccccagtctggcgcattgcaagtcctggccggcagagtgctcacgacactcggagtctgagctcgtgactcccacgcgcaaggcgcaaacattgatcgaggactgcgaaaccgggttgggaagattctgccgattcacccgcggctcaaccactcggggtttgcatgacgacagatctccgagcactcgacatcgatttcctgaatgattatgcctgctcagagcagccagagcttggtgcagaggcaaaaggaatggcttttgttacctggctggtgtctgtacgcagtcaggtcccagtgcgtctgctcccagagcacagactgggggacctccagctctggatatctgtcagtgggtctgctcccccagcacggactgggggacccccggctctggatatctgtcagacgcagcaccctgcactgaaatctcgtcaaacctccgtctgggggtcaatcacatgtgtgtcagtatgcgtgcgcctcgtttctcaggcagcaaccactcgggatgcccgnnnnnnnnnncgaaatctcgtcacacctccgtctgggggtcaatcacatgtgcgtcagtatgcgtgcgcctcgcttctcaggcagcaaccactcgggatgcccgcacagttgaggcggaggaaggcggggcccgggcacagggcatggtccatgcaccccgggcgccgggctgcttcccctcgagatgggcannnnnnnnnntgaaggcgggggccgggcacaaagaatgttccatgcacccccagcgccgggctgcttcccctcgagatgggcagcacccctttgcacccctccgtcagcctccagtcccttcctcagccgtccgccagcagggcctcaccccccgcccagacccagtacaggccggcccccagcgcgtagattgcggcggccaggccgaacaccgcggcccaggagcccgtggcctccagcaccacgcccgacacgggcacggccaggaggccggcggcggtggcggcgctggaccctgcgccccacaccagccccgcgtgcttgggcgccacgtccaggtggttggcccccgcccccgcggcggccagcgcccccgcggcggcgcccagcgtgatccaggcggcggc

SEQ ID NO: 36940 - DNA, 98 bp, Chlorella protothecoides
aatatctcagatggcctttccttcccgctgctttgtgctggctgtaatggcttcctccattcacagacatcgtgcccagcagttcattcccaaaggta

SEQ ID NO: 36941 - DNA, 61 bp, Chlorella protothecoides
tccaggaccagcggctcggcgttgggggggttgaacacgcccatgaactcctccaccgtcc

SEQ ID NO: 36942 - DNA, 164 bp, Chlorella protothecoides
tgcgagggatcacggcgcggggatgcggggacgggttggaaaggggggcgctggcgcaggtgccccggcgcgcggtgccgcctcggcgtgggcgggcccgcgtcggcgccccgtacaggtctcggccggcccgggccggggctcagggccgggtgggcggctgc

SEQ ID NO: 36943 - DNA, 61 bp, Chlorella protothecoides
ccgtcacatagttgagtggatgaactgtcgaaagtctgcattgcatcctctagcgagacat

SEQ ID NO: 36944 - DNA, 61 bp, Chlorella protothecoides
agctgcaaagaagctgatccaggaggtcattgtgtggcccatgctgaaccctgccatcttc

SEQ ID NO: 36945 - DNA, 61 bp, Chlorella protothecoides
atctgtggaggacgtgcagggaagggtcagtcgggttccggcaccttcaccggccggcatc

SEQ ID NO: 36946 - DNA, 77 bp, Chlorella protothecoides
ttctggacgtcaccggactgggcgaccctttccagttggcgagccggctgagggccgacatccaggcggccacgggg

SEQ ID NO: 36947 - DNA, 13851 bp, Chlorella protothecoides
  modified_base (100)..(109): a, c, t, g, unknown or other
  modified_base (3261)..(3270): a, c, t, g, unknown or other
  modified_base (3641)..(3650): a, c, t, g, unknown or other
  modified_base (3952)..(3961): a, c, t, g, unknown or other
  modified_base (4775)..(4784): a, c, t, g, unknown or other
  modified_base (4866)..(4875): a, c, t, g, unknown or other
  modified_base (5505)..(5530): a, c, t, g, unknown or other
  modified_base (5727)..(5736): a, c, t, g, unknown or other
  modified_base (5804)..(5813): a, c, t, g, unknown or other
  modified_base (5881)..(5995): a, c, t, g, unknown or other
  modified_base (7749)..(7758): a, c, t, g, unknown or other
  modified_base (8497)..(8506): a, c, t, g, unknown or other
  modified_base (9147)..(9156): a, c, t, g, unknown or other
  modified_base (9392)..(9510): a, c, t, g, unknown or other
  modified_base (9583)..(9592): a, c, t, g, unknown or other
  modified_base (10200)..(10209): a, c, t, g, unknown or other
  modified_base (10374)..(10383): a, c, t, g, unknown or other
  modified_base (10543)..(10552): a, c, t, g, unknown or other
  modified_base (10627)..(10636): a, c, t, g, unknown or other
  modified_base (10796)..(10805): a, c, t, g, unknown or other
  modified_base (11599)..(11686): a, c, t, g, unknown or other
  modified_base (12177)..(12186): a, c, t, g, unknown or other
  modified_base (13444)..(13453): a, c, t, g, unknown or other
ggcgtgcctgggagccgacccggcagagtctgcgtgcctcgatggcgcacgacgacagccatcatgagattccctcccgcatcccggcggcggtggccgnnnnnnnnnngcgcctcgctgctgcccagcgaggacgactcgcccaccgccggcagcgcctcgccgggcgacgtcccggtgctcggcggcgcggcctacgccggcctggcgggcggcgcccagcccctggctgccgcccagtgaggcgcgccggggcgtgcctgggagccgacccggcagagtccgcgtgcctcgatggcgcacgacgacagcgatcatgaggttccctcccgcatcccggcggcggcggccgacgctcggcgcccgcagtccctcggtgtgcatggcgccaccaccgattaccggccccctgccggcgtcggcggtgtgggagctgcagggctcccccttttccaccatcacgaggctgcatgcccctcaatatacatccccggccccatgttgaacaagcatggtcacccgacccgcccaacctttagggcaggagcccctttcccccatccccttcccgcgcggctggccatctgccagccccaattgaaatcccgtccccatatgcttgcacttttgcgtcccaccccttgctatgcgacggtggggcggagcacacatcccgtcccggccccacacatgccccttgtccttcactgcccttgcgttccgggcgagccgtccacccaccgtgtctttgctttgcaggagtgtaaactgccaaataatgaagaggtcactgctcagcctgcaatggaagggccggaactgagcaaccgggtccatgcctgttgggaacccatcagccagggtgagaacgcgcagatctcatgcgcggaagtcggcatgaagtacgcgcatcggcgatcgcgggatctccaatgaccacatgcgtggtgtcgccctgggctcctggcctgtaaagtgaaaccctagtagcgcagccaccacacgagtcgagcatcatggacgaggagaaccatcccctgctcgtgcatgcgggggaggatgagctgtgggacgcggtggaggagggggtgccgggcgccgatcgcaccttcacggtgaaaaggctcctggaagagcaccccacagaggtcctgagaacgctgcagaagcgcagcgtgcggcgtgtggcggagttcctcgtcgaggtgggatcgggcaccccagatccgagggcctggcctgcccaaaggaccggcatccgtaccgcccccgccagcatggatcaatgtcagaatgcggtgaggacatggctggatacccatgcgagcatttccacaccctccctccccccttggcgcaggaccacctcgtcctggggcggctgggggacgactccatcctgaccatgggctccgacagccccaccctggacaatcccgaagagacctggctgcgcttcctgggcgcctcagcctccaagaagaagcagaagaagggacagcatggctggagcagcaccatcccggtgctggcatacagcatccgcgtggagaatgctgccgcccccgaccaggacggcctcctccagcccctgctcaagcgctggcagggggccggctgtggcatggatgtgtttgccctgcccgctgtgcaggcaagttgaggggattgtgtggttcagggatgagagatagtggctggagagttctggggatctttctggatttgatcctgcagcgaccctcccagccgccgcagtccttgtcacacgagtgcctcccactccgatcccgtcgcgctctgcacaggcggtgatcgactggaagtggacttcctactgccacaacctgctgctggtcgagctggccttcttcatgctctggctctgcagctttgccgtcttcaccgttctcttccaggtgggcgcatgggtggaaagcgggggatgaggggccagcgaaggttccaggcgaattgatttgagtttgcggggcggcacagagccggcaggactgcccccgcaaccctctgtgctggatactgccgtccccctatccctttccaacatgagattcctccccaaaactctcgtctcaccaacaaatacacaagtggatgactcatgaattacctgatcctcccaggacgaggacacaagcctgagcctgcgcgagctggtgcagacggcgcggggacgtggcacggtggcggcggacgtgctggcgctggtgggcatggcccctttcctggccattgagggcgcgaccctggcgcactacggcccccgcggctgggccagcctgtggaacctgctggacttgaccacctacggcctgcaggcctacatcaccttcctgcacctgggtcgcgtcacgctcaaggccggctggctgtcggtggcggcggcgctccagtgcatcctgctcctcttccgcctccagtacttctcccgcgtcttcaagtccacgcgcttctccttcgtggacgacctgaaggaggtcatgcatgacgtcaagtactacctcgtcttcctgctcctggtggtggctggttggggcctcgccctgcacatcctcttccgcgaggaccaggaggagcacaaggagttcagcacctacccgctcaccctcctcaccatggtcacctggctggacggcgacgtggagctggacggcctgcacaagagccacaacccagtcaccgcctccctgctgggcgtcggcttcgtcttcgtcatgggtgtggtgctcatgaacctacttatcggcatcctcaccgccagcctcgagcgggtgaccgacaacgagggcctgcgcatgctcctctccaaggcccaggtcatcgatgaaatcgacagcaccctgccaaggtgctggggaggaggggctgttcttcggtgatggggagggggaaggggtgtgtctggaaatggtgtctcggtgtggttcagggaagcatgtgtgcgcatgtgatttcagagttgagggcaagtcggatgtcgggggaaggggtggaaagacagctgtggaacccttgcatgtgcaaatgtgtgtgagaaggaatggaattttgggactccctgcacaagattcaaacaacacgcgaaccgggcagtgcagctggtgaggatgtaaacaacacctcctaccctcatccccaaaacacacaacccataatattgcaggtttgtggagaacaagtacccccacctctatcccaagtacctgcacgtcctgcgggttgaccccgggaggctggacnnnnnnnnnntccccacctctatcccaagtacctgcatgtcctgcgggttgaccccgggaggctggaccacgtggaggtggccagcgtgtggggcaaggaggaggagaacgaggcggggacggagaacatggaggcgggggaggacggcgaggagggcaaggacaaggggccgcaggggctggagcagaaggtggacgacctgaagaaggagatccaggagctgaaggatctcatcatgtccatgcagcacacctccaccgcatgaatggcttggcgcgggttgggagggccgctgcaggggcagactgtgattatgctggctggctgccgaggggggggcgggcacttcattactgatcattaagtgcagtggtatatgnnnnnnnnnncgccgatggggggacgggcactttattactgatcattaagtgcagtggtatatgttgaaaagcttggacgaggggtgatctcaatcccgcggtgaacctgagtgcgggaggatgcagtgctgacttcagggagggccgcatgacgccgcccgtacgcgcgcgcacgtggaaaacctagcagttgcgctcctggtccgcgtaaggtgccctcagcgtggcgatgtacgagcaatcattagcataccttaccagctcatactatcaacaggatcacttggtcaatggcatagtccctgccacannnnnnnnnncacgagcaatcactggcataccttaccagctcatactttcaataggaccacttggtcaatggcatagtccctgccacacaggggggatggccagcagggagcttttcgctgattggacccttcgccagctgcaggcaaggggactgcggctatgctgtccagatagcacactacgttctaatgcattacaatgttatccatgttcaaccacgaaaggccactcctcccactcctcaccccttgatgcccaggagtacattgacgaaagtggtggcaattctgccagtgcgaggagcagggagaatctcatcaccgaggcagcccgcatctcgcagcttgcacaggaggtgtgtagaagtctactgcgtctatttgggaacccgctggcacacatcagggttgcactgcctggtgttggcaccacctagtccagcacccttgaccaagtctgtgggtagtgcccctgattttctcacttccagcacacagccactcgcccatgccagaacaccaaattgttccacctgagcatctgcatcgcaggcagccgggaagtcagtccaagcgcctgctcccctgcctggccggggcccgaccgagttcttccccggcataggcagcgaatcagggccgccacccttcccacaggcacagccgccgcccctcccccccggtccaggcccggcgccgtatggcgggccacccatccctcgcgtcggtggcccgggtcaagtccctgcgcccatgcccccggctggtggggccaggaagaaggcgttcattgtgggcatcaactaccggggtcagcgcgcgnnnnnnnnnngggggtggggaagggggaaggggaagaacactgcttgaatcaggaaaaagcctgggtgcagactattccggtggcacaggcnnnnnnnnnncggtgggcccgggaagaaggcgtttatcgtgggcatcaactaccggggtcagcgcgcggagctgcggggctgcatcaacgacgcacagtgcatggagtacatgctgcgcacgcgctttggcttctcccaagaaaacattctgctgatgacggaggacatcagggacccaagccgcctgtgagataaggggggaagggaggggggagggaagaacactgcttgaatcaggaaaaaggctgggtgcagactattccggtggcacaggcagtgccccatgcctcaaatgagagagctctctcccctgactgacctccacaacacacagacccacgcggtacaacatattttgcggcatccagtggctcacttcagggatgaagccggtgcggtagggagcaggaggattcggttgcatgtccttgacgatgcagcgccctctttagccaatgcttggagggtgaggctggggatgggtctgcccggaagggtcaggattggcaagtgaactcccacatcaaatttccttcacccgcttccccttcaccagggggattccctggtcttccactactccggtgggtacgtgagcagtggggagcgtgggcatggacagagacacacccatgtgcnnnnnnnnnnnnnnnnnnnnnnnnnnagccagcagcctgactacagcggcgaggagccagatgggaaaaacgagacattgtgccccttggacttccaacaggccggcgagattgtggacaatgacctcaataggtacctcatcaatcccatccctcaggtaaggttgacggggtccagggccggcgcatggagtgcagaggcctccatgaggttccagcagcnnnnnnnnnntgtgtcaccgcagcccggacccgtgccccacccagctccacctgcctgcccggccacagggcatggcnnnnnnnnnncgtgtcaccgcagcccggaccagcgccccacccagccccacctgcctgcccggccacagggcatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcaataggtacctcattaatcccatccctcaggtaaggttgaagggggtccagggtcggtgcatggtgtgcagaggcctccatgaggttccagcagcagggcagacaaggttgggcctcttgtcctgtgtcttctacgcatcaacactcagccgcgctgcatctcccaacaccacaactcgcccgccccttgcccttttgcccagggcgtgaagctgcatgccatcgtggatgcgtgccactcggggtctgtgatggacctgcccttctctgccatgagctacaacggcgtgccccaatggaggagcgagtaccagtggcaacctcgcgcccacaaggtgccattgggttccagctggatacttgctggcaaggttgagggggtttggaggtggatgattctaaaacggtacgcccttgctgtgagagttcggatgcaaacctcgcaggctgggtcgtaactatggtcccatcttctcaatgtgttccagggcacggcaggcggctttgctgtgcagatcggggcgtccacggactcgcagactgccgcagataccacccagctgtcaggtgacggggtttcggcagtggcgattgggaagcaaagagtgctgtatatccacatggatgatatgcttgcgagtgcaaattggcgggaattacgcgacctgtttgctttcgtggtactcgatcttgcatcacaaagcatatcagtgcgcccactgtttgggcatgtgctcagggtatacgtccacaggagcagccacgtatgccttcatccaggcaatagagcagcgaggaacgaccatgacgtgagcagggcttggggctgttttggaagggtgctcgttgctgtgatagggttttcgacctcaccaggcatcagcgctggttgtccacggcagtcagccttcctcggctcagggagaatgcaggctgtgggccctgaggctgatcatacagccctagttctccctgttttcctccaaggtatggcgagctgctggtggccatggactggacgctgcaccacgcgctgggaggctcctcgggcggcggtggcggcggcctcggcggatccctgctagggggaatgggcggcgggggcctgacctccatgcttgggggtatgctgctgggcaacaccgccaactaccagcggcagcagccgcagctcagtagcgtgtacaccttcgacctgggcttcaagttctcgctgtgaggtggggtcgggatgagccgcagctccgcccagcaacctactgagaggctccttagacctctgacgaggacgcggcctgacaagccttcaggaaggaaggtcggagcttgtagcctggcacctactcaggcttgccatggtcatgctcttggcacattgcctcggggatggggatgcttgttcctaaccaaggatatgaaatcatcctggctcacagccgtgtctttttggggcgctgccccgccacacagcgcatgggtgcagtgtcatttggtctgacaccagaaagcatgccacacttgcgggtgagttcaagctgccgcaataattgcaactacttttcaagtgtgtatagagtcgacagctcccccccaatttatcttgaccccaaacattgctctcccaactctcccaatctccctgatgcccttcgtccggcacataggtatttaagtcttgcaccttgggacctgtaaacatgtgagatcgttcaatcctgtggtcatagatgctcttgccgtggtatgaagnnnnnnnnnngtgtgtgagatcgttcaatcctgcggtcatagatgctcttgccgtggtatgaagggttgcagaaccagtaaaaggtagaggggtgaagccctcatctgtaagagcagggcatcttgtccaaggtccagcaatggacctcgggcagaagaggaagagcttgatcaagtaataagggagggggaatgcatgggcacagcatacatcctaggtaattcccaggtacgtatcacatgtactttgatgggagaaagtcttggacatggacggagtgatagttgggaaatttcaaagccatcaggcactttgcccattggagggcgggatgccgtgcttggcgcgcagcagctccaggatctcggcctgctgacgcaggagcttggccacgtcttcctgcctggcgggcgtcccccgtggcttgcggggctccgcgctcgcctcgccgccctcgccgctcgagctcgagtcttcgctgtcgctcccctcccggggacccccacggtacctcgacctcaggcgcttggcggagcgctttcccagcctccggtgcagctggtcctcctccacctggaggcaagaggtggagagggcagggagacgtcagagggtggtgtaccaaggatccagcaataatgcttcccgatgatgcagcgccatatcaatctggctgggcttgaacagcctctttcagggcactgcccctcccctgcgggcagtgcccacccagccccaccggatccannnnnnnnnngataatgcttcccgacgatgcagcgccatatcaatctggctgggcgtgaacagcctctttcagagcactgcccctcccctaccggcagtgcccacccagccccaccggatccagcttgtcggggtggatgcgcaggacgtggacgtagtctgggtggccgtcggggcggttcagccgcaggaaggaagtggcgatgttgagcgccgaggccgtggcctccacctcatcgatcagctgcgcctggaccaccagctgcttggccccagcatgctccatgacctgcaggggtgtgccacgttggcgtcaggtactgggatgattttagcggaggagtgagtatggcgggacccagaggtcagcgtcaagcccttgcgtttcgactcgcccggtccaggctgttgatgatggcgccgatgagcaggttgaccaggatgaaaccctggacaaagatgtatgagactgccagggcggtggcaaagatctgcggcgggatggggatgagtgggcagatgggtgaggaagcttgggatttcagagtagggcaaggcagagaccaaggtgtggaagggaagcagaggcaggactccccttgcagccaggatgggtgtgtatcccagcagcatcctcagagtcgctcaccnnnnnnnnnnctgagtgggcagatgggtgaggaagcttggggtttcagagttgggcaaggcagagaccagggtgtggaaggaatgcagaggcgggactccccttgcagccaggatgggtgtacatcccagcagcatcctcagagtcgctcaccagcagggcgctggggtcctgaacaaaacccggcagcccaacaccgactgatacacaccaccccgtaccggcatggatttggaggagtaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccgaaacagcaagatgatgcactgcaccgccaggacgatggtcagccattcgctcttcacgctcagcctnnnnnnnnnnccacagcacgtcggcaaaggcgaagcgggtggcccggaaggcgcgggaccagtactggagccggaacaggaggaggatgcactgcaccgccaaaacgatggtcagccactcgctcttcacgctcagcctgcccaggtgcatgccggagatggccacctgccatgatcgtgaacgatcaagaggaggcagtaaaagatcagggtggctcaccagagcttgggagaagcagcacatacagacattgcaaccctcggaatcaggtcacttccttgacagagaacgatagacaagaggcggcactccaatatgcttggcagatgcaagctgaggcactgaggacctcaacattcacagccacaaagtctccacccagccctgctccactacctgattgatgtaggtcagggtgctcaggatgtgccaggggtcgcaaatccactggaggcggtaaatgctggccatggtcatgtcgatggcgaggaagggcagcatgcacagcaggacgccgatctcgaggcccacagtcacacaccctcgcgcggtgtgcagaagctccatcagggagtggctcaggtcctcaccctgagaggcggggaggagggccaggnnnnnnnnnntgccgatctcgaggcccacagtcacacgccctcgcgcggtgtgcaggagctccatcagggagtggctcaggtcttcaccctgagaggcggggaggagggccaggctgaggttttaacagtcatcgcagtaattgacagctggccaggagctgggcgtcaaggagnnnnnnnnnngggttttaccagtcatcgcattaactaacagctggccaggagctgggcgtcaaggagtcgggtcatcgattcattgcactatcaaagacgctgaaggttttgattatcagcaacgcttatccatggaaggtgtctgctaccattcacctggaacgccacnnnnnnnnnngagacgctgaaggttttaattctcagcaacgcttatccatgactgtgtctgctaccattcacctggaacgccacnnnnnnnnnntttgtccacttgtaggtaatgatggcctgtcgtatgatgtagtagttccgttaggaatggtgcaccagaggccatactgtatggtccttgccaatgttggaccgatgcccactggcccccttgtggaggatcagcttccaggggaaactctcccactcgnnnnnnnnnnaatgaagccatagaagcacaacagccagcagatgaagaggcccagctgaatcatgagacgagtgcgtgcatacattgtccacttgtaggtaatgatggcctaacgtagggtgtagtagttccgttacgaatggtgcaccagaggccatactgtatggcccttgccaatgttggaccgatgcctgctggcccccttgtggagaatcagcttccaggggaaactctcccactcgaaatgagcgtccatgtcatgctctcgtgcaccaatgcgaagatagcacaaacatgagtggtcagcttcttttaccatgtcaacacaccttcacagctggcaggtcgaacacagagtatgacaaacgcttggcttgaagtctggagtaccacgtcgaaggataggggtcaaatgagatctttaaaatcagccccccggagacctccaaccatgtaacccaagggctcagtgatcgatttcccaaacactgtcacaacactgtcgcagccactgctcctcattaattggaggactcggtcaatcgacccagtggatcacatcccacacctgcgcagtagggggtgcaggagacccttggactctgggtcagctgcacttcggatgggaaccacaaaggcctccacggtgatcgttgaatgccaacctacgggttatgaggtgcatgtgaggacccattcaaagacaagttataataagatagcttcaaaatttcacatagtgcgttgtatggcaatcagatgtcagaaaagggtctcagagtgtcagtcccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacgtttccgccactcctcctcggcatccagatccagctcatctgagccgaacgtcaacatgggccctcccttgaaggccgaaaacacgcgatcttcctgcagggtcgacagagtgcgacttgcggtccctgaacacgccacctcctggccattttggccggcttgaatcttcgaccacatgaatcttaaacagcaccgatagactcggatatctgccacccacctcgagatcaaattccgccagtttatgcatgccattggattgtatgtattgtagaacctccgattggcgaaggtgcagcaggctggcgacagtggcggtgggcagggactccagcctctcggggtctgactcgtgaccccgcaggaggtccacctccagagtctcctgatcccgcatcctgttgtatcaagaggggggaaaaaactagaaaaatggatgaagttccaatccctctaatggatgggccacgagagcggcagccctnnnnnnnnnngtgttgtgtcaagagggggaaaaaaacaagaaaaatggatgaagctccaatgcctttaatggatgggccacgagagcggcagccctgccttgttctacgaccgatgacccccccgccaccttccgagccgctgtccgcggactgccatgtggctggcacagctgcctccgaaactactcgcagcacttgagtgtgtctcccctccttgcagatgagtggcacgagaaaacaaagcaagtggaaaaatcacgcactgccgtcgccgttgggcaggccctccgtcgcagagggcggcgcagggctcccttgcgcaacgccctctgaccccgctccctgggctgcctggcctgcctctgcggcaccaggtttggcttcggacccagagggcgcggtgaccgcggccggcgtcgcctccccgtttgctctgggcgccacgggggcgggcgacgcacctgcggccggatctgcgccggcgccggcgccctcgccactcgccgccaggctcgcccgcaccgccgccgcacgggagcggtggaggtcgctgcccactggtcggcgatacggccgcacctccgtgcccccgtaccctggcacatggatgtccctgacgaggtgcgcggatgggagggagggcggtgtgcgacaggcggcggctgtgatcgtacatcagagcctgcagcaatctgtgtgcaagccgactgcacatcccaggatgcagagagacacatgcagcacctccctctccctgctgcccagacccagcaccttcccccacacatgccctcccccaaaaaccatgcgcatgccatgccgggcacgcaccagcagcgctggtagtagagctggaggtcggccgcttccagcgactccgactggcgctggcaggccaggctcaggccaaaggcgatgccgcccgccacaaactcctccgccagctgcttcagggcggcgatgagcgacggggtggccttcacgcgagggccacacacgtccttgaccagcttctgcgaggggtgggtgtgttggggggtagaggaggaggatgagtcaaaggtgtggcatggggatgaggacgctgcccaggaattgcacatcggcaaacgtggcagattcccttcggctgctcagcgggaccccgggtgacgagagtatgctgtctgacccggcgcgagtccgagttacgaaaggtcgacgaccacccatacaccaaagtccccaccccacactctctggcccccacctgcgctcgggtgcgggnnnnnnnnnnggaagagggggatgagtcaaaggtgtggcatggggacaaggacgctgcccagggattgcacgtgggcaaacgtggcagattccctttggctgctcagcgggaccccgggtgacgagaatatgctgtctgacccggcgcgagtccgagttacgagaggtcgatgaccacccatacaccggagtccccaccccacaccctctggcccccacctgcgctcgggtgcggggcaggaaggccttgtcctcctcgttgccgggcttggtaatggggggcatgttgggccgcgccgcggccgctgaggcgcgctccgcgatgcgggcctggagcgccgagctggcggcggcggcggcgggcttaagtgcggcggccgcggcggccgctgcggccgccggcgacgc

SEQ ID NO: 36948 - DNA, 75 bp, Chlorella protothecoides
cccctccctctcatcgaccagcagccacccgaaccctacccccctcgcccaccatgtagcaccggatctcctccg

SEQ ID NO: 36949 - DNA, 1390 bp, Chlorella protothecoides
  modified_base (534)..(543): a, c, t, g, unknown or other
  modified_base (926)..(935): a, c, t, g, unknown or other
  modified_base (1079)..(1088): a, c, t, g, unknown or other
  modified_base (1160)..(1169): a, c, t, g, unknown or other
cccacctgcggtcggagcttgctgcgcgtgagcctactgccacggcaacgagtgccctgcgcgcttgcgggtggctgaggggctcatatgccaacgcggcattggccagctctctgctgtgcgccggccgacactgagcgcgttttgtcgtgttgcctagatggaggtgaggggcctctgcaacctatgtgcgtcttggagctggtctgcacggcgagcgccacgcaggattccacgctgcgccaggcgccgcatccgatggcgcggacgctgctgggcatatcaacggctgtcgaggatgtcgcggaagacggtgagggtggcggagagctctggcagactgtgtgagagggaaagggtgcaccttggtgatgtaggcgctaggggcttggaggcatcatgattgctggtctggctgcaggaagttccagtctctgccagactcaaaatccccaagctgatccttgcaccctccgatctgcagggcctgcagctctcgcgcttggggtctctgctccatggcgcatcatgctnnnnnnnnnngtcatagttgctggtctggctgcgggaagttccagtctctgccagactctccatccccaaattgatccttgcactttccagtctgcagggcctgcagctgttacgcgtggggtctctgctccatggcgcatcatgctgcgctcagccatctgcccttcctatatcctctagagacaacagaaagcctgcgctgagtcaggcagatggaatcgcgcacggcaaggctgcaaatttgctagaggcagcgggcgctatggagggacccgacgagcttgcagcgccgagcgagctgtgcgcccggtatgctgacctcagcctcgtcttaaagatgcgagtggagtgacacagaggtttggtgactggggctgatggcggccaggagnnnnnnnnnnaagagcattggtgattggggctgatggcgtccaggaggtgctgcgggatggctgctgcacatctaccagcggcaatgcctgtgctcccgcaggagtggcaatggcaggctgcaccaccacacccaccgcccacgcaccctgcannnnnnnnnnccgcaccaccacacccatcgcccatgcaccctgcatgcaggctcggacgatgcttggagtgtgctgggattnnnnnnnnnncagccctggaggatgcttggatgatgctggaattgcactttctggggtgactgctgcggcccatctgcattgatggtgctgcgagactcatgcggctgccgatggcggtgactgttggaagactgcgtcgagcaggtcagccagggttagggttagggttagttttcaggtcagggttagttttagggttcggggttaggtttagggttagggttagggtt

SEQ ID NO: 36950 - DNA, 130 bp, Chlorella protothecoides
ggaggagctgggccatgccctccagggctttacttggaccctggagcgggtgggtggcctgccctttggcaggaggggaggtaccaggcagggtcatggccaggcacagcaaggttgcacccgccctttg

SEQ ID NO: 36951 - DNA, 2427 bp, Chlorella protothecoides
  modified_base (385)..(394): a, c, t, g, unknown or other
  modified_base (518)..(529): a, c, t, g, unknown or other
  modified_base (981)..(990): a, c, t, g, unknown or other
  modified_base (1224)..(1233): a, c, t, g, unknown or other
  modified_base (1461)..(1470): a, c, t, g, unknown or other
agaggcccggcggcacggcagcgaggggggagggcctgccagagcgcatgcgcggccgcgtgggatccctggacggggccccgcacgccccggcgcgggcgcccacggtgatgcaggacgccgccggcaggcgtggggccggcgatcgccgggcggggcggaggtaggcgggctctcctgcctggcccaggcaggcgtatattccctgctggtcccagggttgaagctgcaagcccattcccaactcaccgtcgctgtccttttctccctggtggttgtgtgttcaacaacctgatcgtcatggcaacactcccaaatttcagacagatcaggggatgggaaaaggacggggaaaagggggagggcacagctacagatagctggnnnnnnnnnnacggggcggaggtaggcaggctctcctgcctggcccaggcaggcgtatgttccctgctggtcccagggctgaagctgcaagcccattcccaagtcaccgtcgctgtccttttctccctggtggnnnnnnnnnnnnagacagatctcctcagactgcttggttggatcatggaatcccttgcttggctcgcgcttgaaatgtgttgcagcgcgcgagaccgctgcctttacatcttgtgtcagaccgaaggcagccgggtgcagacgcggaccgggacccgtctcccctatgtaaagctggtagggaaacgagctgaagtggttgaatgcggtggcggcaaaggagcaggaacctccagaaaggcagaggtcattgtttcgctgtcatagtggatctccctggtaggagtgccgacgcgacaaagtcgtcgcagccgcaatgtggacggagcatccggtccgctgtcggcctcccccttcagcttctggcccggacgtatgtaccgagggggagcttgtaaatttgtccacataaggagttctcagcatctacaagggtgctcaggggctctgtcatctctgtgcacnnnnnnnnnntccccttcagcttctggcccggacgtatgtgccgagggggagcttgtaaatttgtccgcataaggagttttcagcatctacaagagtgctcaggggctctgtcatctctgtgcacaaatttgggagacaaggactttcatatcttggccaagggtgagtggggcacgatgccgtcgcacgtgcggacacctcattggagcaccttgctccttctgctgagctctggcgtgctcnnnnnnnnnngcaaggactttcatatcttggccaagggtgtgtggggcacgatgccctcgcacgtgcggacacctctttggagcacgttgctccttctgctgagctctggcgtgctctcaatggtaggtccgatgggcgctctctgttgtcgttcgccttcctcagaaagggggggggacgcgcaacacttgccatgtccggcgatctgttgtgggggcgggttagaccctacagcgnnnnnnnnnntcgatgggcgctctctgttttcgttcgcctacctcagaaaggggggggacgcgcaacactcgccatgtccggcgatcgactcacgcgcgcattccccctctcagggtgcctgcatgacgaagttcttcgcccttccgtctgtcacgtgagtcgaggccggcttcttatggctccttattgtcgcctcttcgtccggaaggtgtggcggcctgcctgacgatgaactgcttttaccgcgtggagctcggcgtccagactcgggcagctgcgctaataaacctcaccaccaaccccatcgttgttgaataggtacggaccacatgtgtatatgctggagacccatagctcagatgatatctgcaggcgcgtaatgtgtggagattgggcatggcttcggaatgcacatcgacacccgtaaattgcccgtattcgctggccaccactccagccctgccccctgccaaccaccacagatttatggggtacagcaagtcgggttacatcaaagaaactagtcttgacatccttggtctttccgtcagcgccatcagcatggaaccctttgagatcaacaaggatcgatcgaccaggatccttttggcagtagaatgcctgaaggctggccagaaggcttgccccgccgacaaggacgggaatattggcaccggaaacaagggaaagaacaacttcggtgattacaacgttggtgactggaacattggtgagcaggaaatggggagacggtgggggtgacactgggtcgaggtgtcactcgagcatgagacagcggattgctgcgcatgaccatggccaggccctaaagatacttcgtgacgtcttgatccacagggatagctaacaagggaaacctgaattggggttacaacaatacgggctcattcctccgctgcaacaatgcggttggtaccttagggttagggttagggttagggttag

SEQ ID NO: 36952 - DNA, 76 bp, Chlorella protothecoides
agaggttgagggggagggcagggagccattaggacgcctctagtaggtgatgcagggccctgcgctcaaaaaggac

SEQ ID NO: 36953 - DNA, 79 bp, Chlorella protothecoides
cacggtggctgagcgccatccctggtaccccaaatcaacactcccccaacccccaccccccctcccctctcctctgctc

SEQ ID NO: 36954 - DNA, 19411 bp, Chlorella protothecoides
  modified_base (1757)..(1800): a, c, t, g, unknown or other
  modified_base (8243)..(8298): a, c, t, g, unknown or other
agcggggaggtgctggcgcgctggcggaacgacacgcccgcctcgctgctggccgaggcacgcgcgctgggcgtgctgggcgccgctcctgcccccgacgccaccctggagcaccgtgagcggcggcgccaggcggccgccgcgctggaggcctcgctgccccccctcgcgggctgggacacggggtggggcagcggcggcgcggcgaccgcacgggtcggcggtgaggccagcgagctcgaggagccgtggtggggcacggaggcggcggagcgggtggatcggtgccaggtgctggtggacgccctgtctggtgagggaggaaggagaagggggggttctaaggggcgaaaaggggggggaaactgggcaccttttggactctcctctcttgggtgtgcaggggtggcgtgtgccgtaccgcaagcaggacggcgtgccagcacaggtcgccctttcttacccccctccccctcaacacacacaccacaccacaccgccaggcgcccggctggactgggcccggcagcagtcctttgcctcggccgatggctgcgtggtgaccgcagagctgcagcctgcggcgctagccctggggtctcccatggcctggcaggcctgctgggcggtggcctgccccgtcaacggccaggcctggaagtcgctggggcccaagcagcagcagtgatctcgtggctggctatgaaccgggaagtcgctgctgcaccctgctgaaactttgacagtgaggtctttcacactcagaagaatatacacaacacactgacaatccgaaaagagggtacagatgattgggatcactggccagtttgggcccggttgctgagggagatgggttctacatggccacaggcttggagggctggggaggcgccaggacgacgtggttggagggcacggggctggcagcctgccgcgctatcccgggcagggcgtagctggtggtctctgcccccgcctgcagcagggtgcggatgggggcgggtgaggcggacgcccagagacgcccctgagggactcaagtacacgagggaaagcacctcgagctccgcacctcgttcttgccatcccattggaaactgaatttgtcgtcgtccgggctgtgctccgcctggtgcggtggggctgcataccagtgggcagggcgcaaccctgtgtgaggtggcgagctcgaggtggcgagctcgaggacatgaagggtccggcgcccgacttcccggtgcacccacttcagtcctcccttggcctccaggcggcgggaaatacagcagcgctgtcccacacatgcaggagaatgaagcatcaagtcgacgactcaccggccgcgtcgcgcgcgggcctcccttcctcgggcagctccttgcgccccacggccagggccgcctgcacggcggcgcccctggccttcgcggcgccgggcgcggccacgccgcccagcaggcgcagcgtgccttgcgccgtggccagcgccacgtacgcccccgccgacgccgtggagagcaggcccgccaccagggctgccagcgcgaggcacaccgccatcaggcccagagctgccgcaatggcgctccccccaagggccaggataaagcccagcgctgcaaggccgccgatggacagcatgagcgtgcccgccatgaccacagccagcgcgctaaagccaaaggtgcccgccgccgccagggcctggtggtgagtggatggcggtgtgtgtgtgtgtgtgggggggggggggnnnnnnnnnnnnnnnnnnnnnnnnnnnnnnnnnnnnnnnnnnnnctcggcatggagaccgcccgacctctgcacgctcatgacagcctcccgtgcacccgatcagctcgcagcacaggccaacccacccccctcctgcgcaccacccagccgagggccgtcctgggtcggagggcgtgggcgtgcctcatcaggaagtccaggtccttgggggcactgtcatccgagacctcagaggcacatgccgccagggcccgctgggtgtgctgaggaaggacagcccccgtgacacctggggggagatggtggtgtatgtggcgatcctggtccattaccactccttgccaggacagggtctcccttcccatgccagtcctggtccgccctgccacctgcaacgatgctgcgggaggtctcccatgccgcggacggagatatgagtatcgaacgagggtggtccagcgagcgggaagcgtgatcgacgctcgatctgtccattccaggtatgcttataggcagcgagtgctcgggaagcggactatgcgtgacccttccccgctgctacttctgatattgtaatgggtttgcagatttaataaagaagagtttaatctggtttgtacacaagtacctggctgtagccggaagggctccttcactcgtatgggtgctgggatgctgcctcgaaggcgcggagctaacgccggaggtccctgcttggatgcaaggtgatcaggggccaagactcgctccacttggctcctcacgcattaagaaagcagtgatgcatgattgacagctccgtctgagcgacagagtctgacgacgacataactgtgtgtcccgctcgtttgaaccttccataagctcgcacacacccagcttggggagttctggctccccttggatcccgcaagtcgcatggcgttccgtctgaggagtttcagggggattgcgacgtgcatcgccctcctcctcgccgttttctgggccccgctctgggtgtacgacctggcgggctcggtggtgaggctagcagggggatttctcgtcactaatgtgcggcagcagggaatccccgtgaacccaatcaaggcatcaatacgcaatgtcacgatggactttgatgaggtgcgcgcgatgtggcgatggtggacaagctaggcactgctgggtgcttcctgtagatctcaagctttggagactcaccacccactttccctccacagctctccaatctgatcaccgagttcctgcaaggccccgcggtcgaccctgcagtccagctgtcattccaagacttcctgtcacgacgagcagcgctgtgagtgtctgaggggctgggcattgcagccctctacgaaatggggagaaggctccttgtaggcagggcgctgaagggaaggttcctcatgaggtaagacgatcttgaagcgaatctcacaatgttgttgatgactgagtatgcttcctcactgtcccactgcagagcacacccacatctggagttcagcctggactggctcctcaccacctataagtttgtgtttcccttcctggtgagtatcaggctggaatggggcatgggaagggccagatggtgtggttttgcactgcaactccagggtccatgtcgcatgtctctccctttctatagcaagcgttccaccactgtgtacccctcaatccgtacagatcatcagcatggtagccaagctggccggtgggggcgagcgggacagggctggcatcgaggagcagcgcagcgatgacttggactccctgatttccatccggaccagcgcaaaaccgggcagtcccttggggccttccacccctctatcccagcagacgagtgcacagcatgcgcagttcgagcgggcttactcgaggctgaggagagagtccctgcgctcttagtgcatggagcagtgacgttcgagtagcaatgcgagcttgtagtgtcagcacacattaaaggggggagttttcaatgtcctcgccaatcattagcaagggtggctggatacctctgatgagtcagagggaaattacttgcgtgattgcgcatctcccaggactcgaatgcagcacgagggggcttgcaggggagaaggcacgacgaagaccagggtaaacatcgacactattcggagccacgagccgataaccatctacgcccttcactccatatatttttatatcctagattaatcgcagagttcaaatcgatccaaagcagcgatggcgggggcggctgaagtcggccctgggaagcaccttgacatggtacgtcctgcctgatggacaaaaaagtggatgccatcacttagtgctttgagcaccttgcacaatttgtactctttctcttcatttgcaggtggtggatatccaggagacgtgggatgagacgggggagagtgggcaggccgtcgtgaagaggtaccccatgccgcaagctgacggggcacagcccgacgctgccggacctggtgagcagtatgatgccgagggaagcgatgattcaggaagtggcgacgacttgaaagactttgacgctgtgctggaggagatggaggccctggagtgggatgagagccttggaactcctggcacctctgggcaaccagataccaggcagcctgatggcgcagccaaacaccaagaagctcccagtggaggggacaagggcacacagggcaaggtcaaaggcttgcgacgagggttcctgctgcccaagcctgctgtcccgctcaagccggcactgaaatcccagtctacggtgggagatgccaaggagcgagcagtgcaagagacgtcgacggcatcgccatcaagaccgtccaccagctcctccagcctggctttctctggcaccgtgagggagaggagtgccaaggagccagaaggctgccgagccgatgcacctgcatcagcctctcgtcatgccccaaatggacgagcaacggaggcttcaccagcgctagaacctcaggctcctcctcggatatctcgattcaagcaggcaatggccatgcgctgatgacggaactgaaaccatggagcttgtcagactgtgtttttgagggaaaggagcaggcttccgtttctggaaatttcccggctggaccctcacgtggcaatggaggaggataagcccacgactgtcacagcgtcgtgcgattcctgcatccctagcactgtaaatcctcatcaggcattacagttgtatacgtgttatatcgattgcatcaatccacctctttgggaggcatccgagtgtttcaccaggcatatgctggctcgcatggcttccgtgatgaggcgagtgacgaccaccgtgtcccaggtagcgtgtcgaggtgtcgtttggtgctcgatatcattcatccatgttgcattcgatcgttcgtgcaagcagtgggaggcctgaagatttccattccgctcctgccccccaggcctccccccgcctggcgggagcccagtgctgccgggtacgcccctccgctgcccttcccgcccccttttccagcctggtggctggaccctcccgatcccgggcatgcggtgcggttctgggccggtccttgcaccagggcgtgggagtgagggccgcagccacaccctctgctgttgagcctgccgaggagaccttctcctaccagaccgaggtgcgtggggttgggggtgagaggcggtgtgttgcccgggtggtgtgcagtctgtcccccctcttccagctccaatgtcctgcacgctttccatgcagacggaccggatcatggacatgatcgttaactccctctactccaaccgcgacgtgtttgtgcgtgagctggtgtccaacgcctcggacgccctggacaagatgaggtgcgccccggtgtggcgctgtgtgccgcctgggcctgatgatcgatgaacagacacggcctcgatggctgtagtctctgtggcatcgatggcagtttggtgaatccctcgcttggtctggccatgaacatcgcccaagcctgccacccagtatcgtacggtactgcttcgaccccacatgcaacccctgcttcccaggctgactgcgctgcagaaccaggacgagtacaagtctggggctgacctggagatcaggatcaaggtcgacaaggaggctggcaccctcaccatcgagtgcgttgggaacctggtgggggtggaggggaggccaggtgttatcgcatcgtgcccctccccttttggcacgatgtctcacagctggatttctcacagctggatgcactgtccccttgcgccttcgttccctcccaaagtcctcttcaactaccccaccccatgcagggactccggcattggcatgacccgcgaggagctgctgtcgtccctgggaaccatcgcccgctccgggaccaagaagttcatggaggcgatgcaggacaagcaggacgccaacctgattggccaggtacgacaggaggccaacggtggcgagggtggggagctttccgtgcggctgcaatgtggagcactgcagaggtctgggtgcctggtagcggcaggcgttctgcgttgctccctatttgccaccaccatctgtgaggtctcgcatccgccccgccgcacgtcgccgtgcagtttggcgtcggcttctactcggccttcctggtggccgacaaggtgaccgtgcagaccaagagcaacgccagcgaggaccagtggacctgggagggcgctgccggcgcccacagctacaaggtgtgtggaggagggatgtgtgtatctgtggatgagaataacggtcgctggtgcacctgcatgccctgccatgagccgcccagggagagatcagagcctgtggttcaatcgtgttacgtcccctttctcccaacacgtccgtcctcgctctatcctttgcaggtccgtagggacgctgaggtggacttgaagagggggacgcggatcacgcttcacctgaaggaggacgccaaggagtttgcggatgccgccaagatcgaaggtcaggaggtgatgggccagacagggtgcgaatggtcgggtgtggccccctgtggtgtgctacctcggtcgagacaaggctgttcttgtgcaaacgagtcgtgcactgcactgcctcgaggtgccaaagggcagggatgatcctttgcggtgattcatacacttctccacacatgctcatccccattccaccccgcctcgccaggcctgctgaagcagtactccgagttcatctccttccccatcaagctgtggaccaccagctttgtgaatgagcaggtgatggacgaggaggctaccaccaaggctcaggaggaggcagacaagaaggcggaggaggagggtaaggagaagaccaccatcgagccggtgttcaagaccgagcgccgggaggagcaggcctggaaggtaggttgggtagaaaggggggggggggcgaagggtggcccctgctgcaagcggccctggtgtgcattggagaacactcagtgtgtagggccagcacgcggggtctatcactgggcatgaataccgactggccggggctgtgccggggtggaaccgaatgcacctcggcttgcgctctccgaccagccctgcccacacgagagtgatgctcctgcttgcaggtccagaacgacagcaagccgctctggacccgatccgccaaggaggtgacgcgtgaggagcagaatgccttcttcaagaccaccttcaagtgagctgagtggtgcatgcgagttggggggtgctcgaacagaggaggaaagctggtctgccgggcagcgtctgggctgtgctggtcccgcagatgaggtgacgaccgcagggccactcacttcaggacggcagcacaggctgcatcccatgggcgtctagcacaggcctccctctcgtagccacatgggttttcaccctcatcctcctcatcccacctaccaacctgccaccactcgatgcagggagttcctggaccctgccgcagtctctcagttcaacgtggagggcaccctggagttctccggcctgctatacatcccaggtggggccaggagatgtagcccgtggctgacgcggtgcatcgagcctgacaaggctcgatgcaccagctgttctttgccagcaggggctgagctccgatctccaatccttttcccccggtaattacaggcatggctccatttgaccagcaaaacatgatgggcaagccccgtaacatccgcctctacgtcaagagggtgttcatctccggtgcgtggatgggttcagcctggggtggatgacttctgcaggaaggcagcctggagagcggcgtgtgcatgccatcgactgctgacaggggggtgacgaatgtgaaagcatgatctggccacctgaagcacatccgctgggcagtgaatctcccgctggttgctagagagttatcgcagtccctcccaaaaaagacacctccctcctcaaccagcccccccccnnnnnnnnnnnnnnnnnnnnnnnnnnnnnnnnnnnnnnnnnnnnnnnnnnnnnnnnagacgagtttgacgaggacctgctgccgcgctgggcgggcttcgtcaagggcgtggtggactcctcagacctgcccctcaacatctcgcgtgagatccttcaggagaaccgcatcgtgcgcgccatccgcaagcagctcgtcaagcgcacgctcgacatgctcaacgggcttgccgagaaggaggacaaggaggtggggtggggcaggggggttggtaggctgcgtggacaagggacagtgctcgacctgggtgagagacggtccaccagcatgctcgttgtgaagaggcgaccaagaccccctccccaccctcccccaatataaaacaggagtatggcaaggtgtgggagtcgtttggcaagtacctcaaggtgggcatcctggatgatgcctccaaccaggatgccttggcaaagctgctgcggtgagaggggacagtgaggtcgattggagggaaagtgcgaacaggccagctcgctggtctgagctgcaagggagtgaaggtcgtccagaggcggtgaagtggcctcgctgtcggttcctggacccgccaatcaccgattccgtgcgcgagcggccccccccccccccccccccaatcaggttcaagtcttccaacagcgaggaggggctcacctccattgcagactacgtctccaggatgaaggagggccagaagaacatctacttcctcattggtgagctaggatgtgtggaagggtgggatgctgatggaagacttgccctagccttgcttgtgaatatgctgggaagtgtcaggttcccgatgtgctccacccaaccggcatgcatggtgcttgggcatccacctcagcaatgtgtctccatctccccaatccctccccctccttgcagcttccagccctgacgcagccaagcatgcgcccttcgtagaggccctggtaagcatgattactttgttatggtgtggccatagatcagcctggacgcacgtggcatctggttttacggcagcgctttcctgcacatcaattacttttcctatcctcatgacgccttggatcttgtggtgggcacacactcttaccatgattatttctgtgcccacagacgagcaagggatacgaggtcctctacctgaccgagtctgttgacgagcttgtggtgctgaagatccaggtaagatgcagagtattcaccaggcaaaggaggaagagctgcgatgggactgtggcactcccagatgggagcagggaaggcacctcctcatcacctgcacaacctgtggctcgccgtggttactaactcagtgcgctgccgtgccacaggagtttgagggaaagacattcaccgatgtgacccgcgaggatctggagattgacgagagcgaggaggggaagaaggagagcgccgacgtcgaggccgagctcaaggacttgacctcttacgtcaagaaggtgatggggcgcagggtcgctggctggcatcgcaggcatgggcagctaccaagcgcctgtgcgcctagctgcccttgagtgtccatctccttcagcactcaaggagcagcactcaaggagcaggagtttcagattcgcaacctcacccaacagcatgcttctttgatcacccgcaggtcctgggcgacaaggtggagaaggtggtgccctccaagcgcctcaccgactcccccgccatcgtcgtgctctccaagtttggctggtccaccaacatggagcggatcgcacgcgcacaggtgagccgccacaccctctgttgtgtggtgatgacgtcttgggagccagggcggcggcggcgcctgtggccgcagagcggaccgcaagcttgtactcctgcgccagaccccctgcacaggcctcgcaggactgaggggctcccccgcttcccaccctgcaggccatgggcgatgcgcagcaggcagagtacatgcgcggacggcggatcctggagatcaaccccaatcaccccatcatccagtcgctgaaggagaaggtgggttttggggggctttgatctgggatgggagctgcgatgctggcaggggtagcttgtgtggttgtgcagatgtcccggccgctgtgcaagtgattgcttgcaacacaggattctcgtggacctggcgaccttgatatgattcacccaatcacaggtggcacagcccatgttcaccctcccttcccacctttggcaggtttcacttgatagtagggaagtgaaggagcagatccagctgctgtatgatgcggcatccttgtctggtgagtcttgctggcttgttgtggtctggagcaggctgcgttggggtgatctactatgccaggggaactcatctatccatcagatcccatcactcatgtctggctcgagctcacccccccaccccccgcatggccctggttctcccaggcggctatgacatcgactcgcccaaggactttgcggaccggatctacagcatgctggctggcaaggccggaacagcgcagaaagtggaggccgaggttgtctgaggtccctgacctgatcctttagcttttttcgctcatgctctgctgtcccgaggggcgagcagccccagcatatacatcaagcggggtcaatgtaacgagcgaggttctcaatgcgtggggcagcaggctgggcgcacgtcctgcgcaggtcagtggctcgcggatcctgtcacttgggggcgacggccgcgcggttggtggcgtcgctgacgccagacttgcgccagtccaccgccggcttgatcagctccatgcggacgcgatccttgttctgtgaggagtatggcgacaaggtgggggtgtcaggatgtagagcgtttgggctggaccgggacccatgtgaagtgtctttccttgcctgaacgcagcactgcctgtagccagggatccggtgccccaacaaagtggcacccctccccacctcacatactgagatcgcccactcacctcgaccacaaaggagaggagggaatcgataaggttgtcactgagcaggtggggctccagccccaggtcccttagcttggtgcacttggcattgtagtagtgctcctccgcctccacacgaggattcgggatgttcttcacctggaggggtgggagagcaggccgtgtctttggttggagaacatgtgcagcgcacacgaagccagctggaaaacggagtcataccggatcgcgagggcattggggagcatgccagccttcaagatcgcatgcacgcgaccaataagccatgcacatggcgtaggtctctgccgcaccgttgcagatcagactgtcctccgttgccaggcttgctgctgcatccagcaacacccacgcccaaataacagccagccaaacattcacaggtccccaccacaatctcacccccccctacctcgacgtcaattcccagcttcttcccctcctgtccgacgatgcgcgccaggtcgttgacgctgggagtgggagggatggtgagctcattgcaaccatttccgccacagcaatgccagagcgaacctcaccatcaccgtcccagcaaacacccgcgtgcagcaggccacatgcaagctcctgtgcccaaatgcctccacacactccctccacctgaactgctcggtgaactggttgaacacccgcatctcgccgcgcgcggcgggcttgtcgatggcgatctgaacgcaacggacctgagtacacagcagtggaatgagtgggcagtcgaggtttggacatcctgtacacatggccacaggcgagacacggggcgtggatgtggccgaacagtgtcggacgattcagcagggcccctgggcacgccatgggcgggatgcgggtgcgcccgaggccatgttcgacaagtgccttcctgcgccaatcactttcgcctcagaaaccgccgcggtcatttcccagcacccgtttgcagaccctgccgtgaactcacagtgtcgcgaatgtccaggtagccgcgggtctggccgcccttgccgtacacagtcagcggatgaccgacggcggcttggacgacaaatcggttcagggctggaggaaggagaacaggtacgaagggtgagcgattgatggaggtggggaggttcagctttacaactatctacgttgctggcgacgccgattgaaagtcccactgggtgttgcatgatgcatcgcaagatctttctgttcaagctctcaatcacaggcttccacacaccccatcccgatagtatctttcctcgcatactcacacagacacgcaccacccacctgtcccgaagatgccatcgtagtcgtagcggttgatcagggcagggtctgccgtggtctcctcggtgcgcaagccatacacgacaccctattggtgaatgcaggtcggggtttgtgagctcaagagtgggggggtagccattcagaagggaattttggcagggcagctgctgacccgcagcagacattaaactctgtcagcccaaccacatctgaactccctcccacaagcatgtcatcgcctgcaccaactcgcctggttgaggtctgtggctgccagcttccaggccttggtggcaaaatggatgttgtgggagtcgtgcactttggacaggtggtagaaggagcctccctgcggcaggagggtcgagggggccaaggcgctgatgaggcaccgagggccctgggcttgggatgcagcgtacaggtcggaatggccggccgtgccgtgccaacctctcactggacactcccagcactggtcttcctctttttcacccacctgctttgggtaaggcagcgtgtctgtccggccgttgtgggtgacggtgaggaagccctcctctgcagggcacgagggggggcatttgagagactgggatggagataagaccacgccatcagaccaccagcggccactgcagagcacagaatgcttccaccaatgtcctgcagccaagggtgggtgcatagcagcattacttgtacccgccgcctgccagaccccttctcccctgtccagccaaacacacttaccgatgtcgatgttgggggtaccatattcgcccatggtgccaagcttcaccaggtggcagtcggggttgaactcctgggtgaggggcggggatacagatcgtgagcaggaactcagccagtccgccaccaagcaccccacgattcccctgcagaggtgcagtggggaacaattcttgcccatgccccctcctgcagcctcacgccagtccccctctcactcccacccaggccgcaccttgatggcatacatcaggttgatggtgccgatcacgttgttgtgctgggtgtacaccgcatgctggcggtcaatcatggagtagggcgcggagcgctgctcgccaaagtgcaccacggcctcggggttgaaggactgcggattttgaggggcaaagtgcttgttgttgtacaggtggacacaggagagggcagggcacagcgattgccaaccatccctgcacgcccccgaggtcgaagccccactgggcagcgccacttgagatacccgtcaccctactcccctccccgcatcgcccctcgcatatttcccacccacccctcacacgacaaaaccagcaccttgaaggtctcggagaagaactcaaagtcacagaggtccccgacctgcaggtcgatgtgcttgccagacacctccgcccacttcctcacgcggtcgtggatggaggcgatgggcgtcagcgtgtccagtcccagctgcaggtcgtaggtacggcgcaccaggttgtcgacaatgcacacactgtagccgcgcgccgacaggtgcagtgccgtggcccaaccgcagtacccgtcgccgcctgttggaggaggtggtgagggaggtgggggggagcagcaatgcggctgatcaccagggccatccacggtcccatgtgggagctggtcagccctcccagcgtactcagattctggacccatgtgacgtccgagggccaagggcggctagtacaacacccggtacattagtgtgtgcacacaccgcgtccacccaccgatgatcatgacgcgggtgccggcgccgtttccctcatggaccttggagggggggggagcctcggccgcgatggccgagatctgtgggcagcgagcccgtggggcggctgcacgcagcccaaatccacgctgcgcgacgcggcagccaaatgtcgccttggcactctgcagggagcgcagccctggggctgcggaggggcgggaggaccaggacgcggattggatgccgggttggtgctggggagtgggcagcaggcaagggcggcatcgcgcacccacccttcatacccccaccttggacgcatgatctcacagaagcagatgcgccattgctccggaccacgccgcaggcacctgccgaatgggggacggaattcagggactttccagcatgtgatccggcaaacgagcacgggcacgagccggtgcgcgccatacctgggacgtttaggcttgccatcgtgtgatgcactggttaagattggagactgggtccactctgccctgggccgaccagggctatgccttgtcgcccaagatgcttgggcgtcccaccggatcagggcgtcgcgccagattccccttttcaaaactggccacgtgtggaacttgcagggcccgcggccccagatgctgtactgtcccggacggtgccggcgcccagttttacagcgggctgtccccttgtacgcccgcttgcagggccccattgcccacttccccccccttcacgcacacgtagcacagcccggcggcggcgcgggcgcaggctcccgccagcacctcctcggactccggcgtccaggccgccacgtcccccgccccgcgctgcgcctcccgccgcgcgcccaccagcgcggcgctcagagccgtgttgccctgcggcgccaccaccaggagcaacgcgccggggatcagcgcggagtgcacgctgcgcacggcgcgtacgacgccctccagcgcggcgcgctcgtcgtgcggtgccagcggcgatggagcttcggcgagtgacggcggctcggactccgctgttgccggctctgttgccgacgccggtgcaccgtctgccgcggctcctcgcccaccgtctgccaccgcctccggcgcaccgtctgccgtgaatccttgcccaccgtctgccgttgcctccggcgcatcgcccacccacccctccccaacgcggcgcaggcgcaggcgtagggcacgtgcgcagtccccgccccgggcgtcgcccgctgcgcggcgtgccgcggcgacctgcgacgcgtgcagcccacgcagctggccgaaaagaaagtgcggcacgccgggcttgcccgcctcgcgcgccagccgccgcgccgcctcgccgtcgtcgctggcgtcgacgccggcgccagcggcgcccatgaactgcctcaggctggcgcccgcgtccacaaaggtgcaggccctgcctgcagcgtgcagcgcgtcggccagccgcgcccggcgcgcgtccggggacgcgggcaggccgaagtctgggccgcgcgagaacttgagcagggccaggtccagcgcagcacgcgcgtcctccaccgggtcgtggcaatctgcgtggccgggtgatggcgagggtttggaatcaaggggggaagatggggtggtcaccaggaagcttgcggctcgaaggattcctccaggggccctggaatgccaccaggagatgtcagacgagcatgcacaattccagacggcccagccatgctgacctttgcatcctggcctgccgcgcggcccaggccctccttccctcccctcgaccatctcccctccccccgcaacaatccccgacgcccctccctacatccccccccctcccaatcacccttctggatggtgcgcttcaggaagcggctggccagaacacgcagcgccgacttggcggggggccgggggtgggggtagagcagggccgtgtcgatcacccgggcgtggaccatctgcacttgtttgcgggggacagggaggggcggtggcgtgatggcactagagcattgggttgcccggtgccggcgtagggtgcaggctgccctcctgggcatggcggtgggctggacctggacctgggtccaatcctcctctgttccctttcctgcggtccctacacacggcaccctcctcgattccctccccgcctgtcctgagcccctcccatccaccctccaccctcggtgcccactcccaccccccaaggcacgaaaagtacccctccaccccccccaaaaacaactcgccttgagcgcgtgcaggtcgttctccccgctgtgcgcgaccagcagcgtgtccgggcccagcaggcgcgccagctcagcgcgcgcatcctccaggcgcgtggtcacgccctccagcatggcaggcgtgatgccggagaaacgcgtgacgtggtccagcaccgggttgcgcggcgccaccaggcggtccagcagcagctcgccccccgaccccagcgcgaccacccgcgtcagctccaggccctcggccgtcaggcacatctcgcagtccagggccaccagctcgcgtggcggcgcggcgcctgcgatgggatgagggcatgcttgtgtgtgtgtggtggggaaaggaggggaagcaagcaggtggggagtgtgggcgcgggtgttggggagggcagcgcatgggcaggagcgaacttgagccgggtgcctgggagggggccatcctggcagggttgccgggcagtcgggcagccggctcttgggattggatgcggaaggagggccctccctccacaatcccttgctcctccacaatccggtgcccggcgcgagcacccatgccgccacgccaccctcccacgccgccgcgcccgccctcacccgcctcgggcgcgcacgtcgcgaggtagcccgccggcacggtcatcgcgccgccgccgccctctgccaggcgcggcagggggtagccattctcctccatctgctccagggtcagggcgtaggaggcgggggcggggagcgtgggcggccgcccccgcaatggcgggggcccctcccgtggggcgcgccgcgccagggtcagcagcgagtgcgcgctctgcccgggctccagcaccccgctccgcgcccggacctgcaccggggtccccagcagggtgcccagcgcgggcgggggggcctcggcgtccagcccgtgagccagcaggagcaccactcgggggaccagcgccttgttctgagggaggcacggtgtgtgtgtgtgtgtgtgtgtgtgtgtgtgtgaggggggcggggggctgggggtgccgcctcatcagggttgggggccgacaaggctggcgcgaggagcggcggcctgaatcacacgcaggcgaggcagggtgctggcatgacgcaggccgggagggcctgcctgagcgatcccctcccaaaacacctcccacttgccgacgcacctcgacagagcaccatcggggcttggtctcctccgccaggatccacaggatgagccgctgaatgtcttccagcgtcactggggagtgctcgggccgcagctccacccgggccaagctggctgggcctccggtgtcgttggcccgccctttcttggccttcttcggcttgcgggctggctccagctgctcaacctccaggccgtcatccagcagctcctcatagaagtagggcgccctgagagtggcacgttgcaggggcggcaggtatgacagactcccagcctcaagatgaatgccggagcatgctttgacacaccgtcggccggtgctccgcacaccaccccactgccccacacctgcaccgcttgccgctggaccagggcaaggcacattccggagtacctgccggcgagcgacgtaaagacgtctcggtattgggcacgtgagcattgtaaaccagagtaaagcatggatacctgtcgctgcctaccttccagctctccctcctccagttcctcaggcaccccgtgcgtgttgggcgtcatgctggtgcccagggccacgcgtcatcttcgttgcgtccccaacatcgcagtactatgggccatactcagcgtgcatggacgcttatgtcggtgcttgcctgactggcaccctgtgcacctcgcatgcaatgtttatacgagtgcccgagacagcgcgcgcgcgcaagcacgacatcgcgctattctcgggccctcaagcttacatccctggtgagagactcctgtcccttgacagaccagtgaacgtgcaaccatcctgcgttacatctttccaaattaattgcgtagttttgtgggtgcggtgtggcaaggtgcgaaatgccaatccccaaacctgctggaccaggtgccgcagaaccgatcggaccacacaacgataggcacatcgtggtctttctcggatccacccatgcgcgcattccccgtggaaaaggcaattccgatcaaggatgggaatcgtgctcggaaagacatcgggtccgattcagagtttcaaatgtgcgggactaacaccgcacgagccctggtctacaaggaggtgcgcgctgaaaagatcaccctcaagcaacttcaaggggtataaatgtacaaggatgagcgtttgccactggaaagtgcacggtgcctttctaaacccaggaggcctccaatagcttctgtgggctgcacaaaatgaagacggcactgaaagggtatgcgatgatcaaggttccaagtgctcctgagatctggcgacagtgatgaatcttccattgcatcaattatgggtggtccttcagtctgctttcatcattcctggtgtttgtcaggtgtgtcagtgcttaattgcagccgacgactcctgcagtcataccttctcctatcctaggtttgccccgtcctttggcttgcacctcatgtggcagagagacgcaggacaggactgatgcacgacttctggaccccaagatacagagagtgatcaggacaggctcgatctctagctctagcatgcaacccgctctataaactgacggtgacatgaccaacctagatctcctcctattctattcaacatcacaaagcgttcagtgaagactcaattcgtaagcaacaaccaaag

SEQ ID NO: 36955 - DNA, 61 bp, Chlorella protothecoides
caccccgaggccgtgggcaaggcatcgccagcaagcacccagagactccggaactgcggga

SEQ ID NO: 36956 - DNA, 77 bp, Chlorella protothecoides
ccttgttgaccaggctctgcacagggggggagggtctcgtgacatggagaggatgggaccggtgtggcctgcagtgc

SEQ ID NO: 36957 - DNA, 80 bp, Chlorella protothecoides
tgcagtacgagccgccggtggaggaggtggagtgcgaggccatgcaggtcgaggtcggcgtcggcgggggcgacgacgcc

SEQ ID NO: 36958 - DNA, 61 bp, Chlorella protothecoides
atcaacaagtccatgcccaccttataataaacccctgccattccaacatgtcattgtatgc

SEQ ID NO: 36959 - DNA, 206 bp, Chlorella protothecoides
ggaggaggactcgctgaacagcagccacccactgtccatcccacaaggcatggtgggggtgggctgagggaagggcttgggcagggttgccgcagcccttccagcctcaagcctgcaaggggtgcgggggattctcccaacgaatgacaggtacccaacccaaccccctcacacccttgcaggcgtcaacacttcggagaggatag

SEQ ID NO: 36960 - DNA, 77 bp, Chlorella protothecoides
caggcatacaggctgatggaacacaggccatagcgatcctccgccttagtgctggccatcgttctgggtgacgccat

SEQ ID NO: 36961 - DNA, 70 bp, Chlorella protothecoides
cttttttgcccgggaggcccgtcccacagcgtttggtggacccctgcttccccttcctttcctcccaccc

SEQ ID NO: 36962 - DNA, 69 bp, Chlorella protothecoides
cctgactggctggaagatctatcgttgaacccttggcacccgccacttctcatcatccttccgtcacca

SEQ ID NO: 36963 - DNA, 77 bp, Chlorella protothecoides
caccacaccggctgcgacccccaggctcgcgatgtggtggtcgaatctggtgcagctccgatggtttctgtgggccg

SEQ ID NO: 36964 - DNA, 81 bp, Chlorella protothecoides
ccctggcagacgatgcacgccaggtgtggcttgagggggggaagcaattctgaatgggcaagggttatgaggaagggagag

SEQ ID NO: 36965 - DNA, 61 bp, Chlorella protothecoides
aggcaattacctgtacgacaccgcgacatttctctgcgagcgtctggtcgctgaaacgcca

SEQ ID NO: 36966 - DNA, 61 bp, Chlorella protothecoides
agaagtccatcggcagcgtgtatgaggaggggtgtgtgtgtgttgggagtgtgtgcattgg

SEQ ID NO: 36967 - DNA, 125 bp, Chlorella protothecoides
cactccctctcgcgtgtcctgggagctccgaaaagggatccgtggcggcggcgggggctcactgtgcacgccaggtgcagccgcagccggtgtccgaaggcattccccccccgcgccagtatcct

SEQ ID NO: 36968 - DNA, 6480 bp, Chlorella protothecoides
  modified_base (1288)..(1297): a, c, t, g, unknown or other
gtgccgtagtcgttatcaatatgagctgaacgaatgtcgcaagtatctcccctaaactttaccatgtttccataccctgccgtcctcctggaccgcccaagcccgtgacccaccatgtagatgaacctgagacagcagtgacacttggagagcctatgttcatgcacgctgtaatctggacagttccatcagccagggatcccactttccatcatactgagcaggacgatcgccgtcgtcgcctgaggtgttcgaagccgctgggctcttgctcgcggggcggtagccagcggatgcagatcccgtcactgcgctacgccctggtgcacctaacctgccacgaagggacaggggcgcgcgggtctgcagtcggtggccgctcggggtgtcatagaagcgcgggttatggcagacgaggctccctgtcctgattgccctctcagaatcgatgctgagcctcaacctggtcagacaatgagcacgttgaggaatagcgagggcaggttgttacaatgcggcacacggtgcatgtgtatgcacctagccaggggcagagaactcgtacttccagggaccgctccctgtgcaagaggagacgggtctccttagcggacactcgggtgccagctaaaagaggacaaatgcagaaaggcaagcacttgagcaacagcggggaaattgaatggaagatgggaaacagaccctcgtgagcgagagctgtgcatgtcgaccaatgtctcgctgcaatggcagtgcgcgcgccagcgccctgggagaagggaaccccggcagaacgtgaacaccctcattctagatatagcgacgcctgacactgcaatagggccaggaccgtcaaaacccttggcacgcttccatactggcataatgcgcccgccggtcctgctccatccaaaaggagtttccaccgctggggatcggagagcgttctccgcgctccattcgcctggaagaatcgctccgcgtccgagcaatacgccccaatctgatcgttccaattattcggtcgctttcctctgatgagcggagggacagcattccgtgtgaatgtattggcgtagcgacatgaatactccatggtaactcttgggcacgccacgtcccaacacctgcagcatctggtgctttgacggagtttaaagagtacctacgtctcgtactgcaccagcacttgtaaggaagcacgtgcatctgcttgattggtgctgcactcatgatgatgaggacctgatcacttcagcaacatatgcggcgcacgagtcgaagatannnnnnnnnntcatacttgcacgatgtgcccgtgggtcccgctccgtcgaaaggagcttctaccgctgtggtgaggagagcgttttccgcgctccagtcgcctgcaaaaactgatccgcgtccaagcgacacgccccaatctgatcgttccaattactcgatcgctttcctttactgagcggagggacagcattcccatgtgaatggagggatatgtcgatatgaaaactatgtggggacgcttggggacgcccctccccaacacccctcgcatcaggtatatggacaaaattttgaagagcactttgtcccgcacaataccagcgctggtaaagaagcacgtgcagcttattgattggtgctgtactcgtgagaatgaagaccaggactgctacaaggtcttatgccctgtgcggaagtcgaagggcagcctttttgcctttaagccggttttttgagatatacacttgcctagacgctaatattgaagcacaggggaggatttcattcgaaagttcgattcatgcatgcagttgagtgatggcagatagaattgcgccgtgtcatatactgcttctagatgtgaaagtgcccatgcgctaaggtatcgcagggcttcttggtccataaagataaatctaatcacgcttgggatggattgcgatgtagacgacgctaaaaggaatgcgtatggaatctcatgcagctgtttaacgctcacattggtaaatgggcccaggaagtggagtcacgatgggcctgacacgatgggtcgtcctgaggaggtggtctttggcttgctctagcatgttgaccaggacagcggcgtcagggcgcgctcctggattaggaatgagacaagcctgtagtgtctccagccagctgggattctccctcacatgtggggcatccctgagcatggttgtcagccctggaaggtacatgagggaggatataggaggtaatggaccctccacagcaataaattcatagaatgggcaatgccacaacagcacccaatgactgagcatttccgcagtggccagaggatgataagggcaaatgatcaagtcagtgaactagctggaagtcgaagacacgatccaacagatgtgaattttatccatagctggatatcccccccaagcccctgctctcccaaaccaaccaattgcagagtggaatctgaaccacttgtcaattttcttcccgacgagaatctcgtagatcatgatgcccaactggaagacgtcagatttgatagtcagattttccatctccccgagcagttccggactggcataatagccattgatgctgcacagggaaagcaagcaagggatacaatggagtgaagcactacaaaacagcccttcctctatcagatgcagcacaggaccttgagaaaaaatcctgcaaaatggctcacttggtcatatggggctgcatatcccccatttcaaggcggagcccattgctgcgcatgggtgaagctgcaaggggaagagtcacaggtgtcagctcagcgagggcgccctggggactgctgaggatggtaaggtgtgtggtatatggctataactcgacatcgacacccgctggagtccacgccacaatgtgctctgcactgcaaccaagaattctccctttggatggtgctgcgcactgagacacatccctcatctcaccatagtccagccctgtgaaatacagtaatctgtcgtccccatcctttctcatcatcaccgtctcgagccgcaaattaaaatgcgcaacctgtgggttgtggaaatgtatgtgggccaactaaacggcaaagtctttcagcatgcgagccagggaatggccactaacaccattatcttcggcacccacaaaaccatcatcttctcacattgcgctggtgcatttcatgcaccatcgtggccatctcgagtgccacgtcaaggcgctttgtcgactcttttgggttgttcctgcaacgtagttgaggttaggggcccagggggagatttcaaatgcattgaatagagataaagttttcaaacccaatggcataccaactgtcagcaagactgttgcgaacgattacatgacctacttagccttggacaagctggacattagcgccctccatatctccctgtaaaccccatcttttcccccctttcctacgacaccttcttacctggaccatttccggcagttcgccaagttggtgtcgaacgtaaggacgcccgttggcacgctttggtattccacgatgccaataattggcattgcactaggcattccccgtactagaaggagcccatttaccattcttgctagcagcaacataggatctgtgttgcctccgctgtggtggaattctgctgtcatgagagacgtttggatagtaaatccttcccgcagaccgcacaggaactttccatgaagctgcagaggctttccaaggatacgccagtgctccatctgaaatgttggtgagtgatctcaagataatggggacgacagggcatgctcgaagcagcgagtccatcttaacaaaatagggatatgcagttgcacctacatgcaggagctccaccattctcaccagtggtgttatgtcatagcggggaatgcggagtgcatccacggtccggaagacctcctcaatggtcgtgttgtgcggcctcacctccccggggttttggggtgccattgtctccctggcgagcaagaaggcgttggctgaacatgagtcaaaagcatgaagattcatgtaaaaataatccttggagatttttgtgggagagctgcatatcatgccccagttgccccccacagcaccccctcccttacaagttccgagcggcctccagaagaaggccaacctgatggaatgcgaattcggagcctgccgaaggataatgacgacaacgctcagttgcagggaggctagcatgtgttcagcggatcgtgtgatttactgcggcatttcaaagtggggattccgggtctcaccttccatcacgacactaggagatcgaggcacttacaattttcctttcacttacaatgtatgtttgattcagaatacgggaatgtattgccgatctgtgtgcgactcggtcagaacatcggcgttcatgagatttatggaagcgatgttagctgaggctggtcgccctttccgattgagggattacgaacccttttcccgtgttctgagaccaccggaagcgtctcaatgctacataatatccgactagcctgatggggagagcacgcgtggctcgcatgtccttctttggccggcggcgcctgtggctcccggtgatttgcgattctcggcgatggcgtcacgttcctaaatcagaagatacgaacagcaagtcattagggttgtgtcctgactcaaatcttcaggagtgggtttgaaaaccattccagcgtaaagcaagcttctggcttgaaatcgagcaccctaggtggcccggcatggagcaggaaatctatgccttggcccgcacctgagatgccggccagcgcgggatgcaacaagtattgtatcacatgcacagcggaccctgggaccgagggacctctgcccctggctgaatttacatacatgcctccgatgctcaactgtaccgcctgatccttgccattccaatgggctgtttactgattgaccaactaaaggccacagaccgtgttgtggggccacctgctccgggaatctccaccctttcatctggcatccgtgctctgcgctgtgcctacgccgcctggcgcagtgcttgtaacccaagcccctcaccgtattgggggtcttgctccgtaacattcatactttaggtcatatacagcggtccacgttgtggggtctagtccgcccccacaacaacgcacaggatgtttcgcaattcagcgtgctggggtgttccaggctgtggacgtacacggcaggcacgccgtgaactttcgctcccacgctgggcgcagcctggaggagatgccggacagggcccgagtggaggtcaggcggagtttgcagaggggtgttgtgcccttgagggccgtggtgatttgaaaatggtcgcaatgtactaggcgtcttagcttgctagcttcctgccggcctgcactcaagatctgtgatgcctaccactgcatgactctcaccctcacaaccccactccctcccacctgcaggcgcgatgcgctgtgcccgacacctactactgaaagaaccctaacctataccaggctggatccttttcacaccatcctagaagtgacgcacggaagcgggaagctcgatttacaggggagtgtgtccagaggagaatggttgggagaataggggcagaatgcctcagaccaaggatgttcaggctctggtcttggaatgaaaaggcgggtgcaggtgaagtcacaaacgcagatggaaggaacgtgtcttgatcggatgccaatggatttttcgtaaggagcttcctagatgccaatatcagatccgtgaagccgcctgtcgttgatgaggtgcccagaatagggccatgtagtctgcagcttcgtttcctagctggcggcgcacatcggacccggcgctccgcgattctcgccgtcggactcgcatttctcactagattagttcagtaacagtactcgggactgggtcctgacatttcctgtccatccggtatgcaaaggaccttactatgccatgtgcagcttgacctacatactttccggtaagtattattgcagtctgactccgggttgtcttgttgccggactcgcaagggtgggaggacgcccgtggtgaggtgttagggccgaaaagtgggaaatgtgctgtgcgtgatgggcaaatgccaactttttcccgcgctatcctgcattgaacatgtcagcgcggggggtaacatcgtattttaggctgtgggccgacattcagccagatcctccttaacgcgtggctttcgagtgtcaaaatatctagtaaattgctcgaccggttatcatttcgagggtgaatgacgcgccggcgtaaaaatacccccaaatcgacgattaccccagaacagtgggacagattgtgagttgggcgatgttctgaagggatcaccctttcacatgcgaaataagaactatattcacgagcctgcgcctgagcgctcggcacgcaccctatcgtgc

SEQ ID NO: 36969 - DNA, 69 bp, Chlorella protothecoides
ctgtagtgttttgctgggcacgacatgccgttcatgggctatgccggcgggtccatccactcagggttt

SEQ ID NO: 36970 - DNA, 6838 bp, Chlorella protothecoides
  modified_base (298)..(307): a, c, t, g, unknown or other
  modified_base (555)..(564): a, c, t, g, unknown or other
  modified_base (1309)..(1318): a, c, t, g, unknown or other
  modified_base (1876)..(1885): a, c, t, g, unknown or other
  modified_base (2479)..(2488): a, c, t, g, unknown or other
  modified_base (2774)..(2783): a, c, t, g, unknown or other
  modified_base (3253)..(3336): a, c, t, g, unknown or other
  modified_base (3409)..(3418): a, c, t, g, unknown or other
  modified_base (3490)..(3499): a, c, t, g, unknown or other
  modified_base (3613)..(3711): a, c, t, g, unknown or other
  modified_base (3894)..(3903): a, c, t, g, unknown or other
  modified_base (5111)..(5120): a, c, t, g, unknown or other
  modified_base (5521)..(5530): a, c, t, g, unknown or other
  modified_base (5632)..(5641): a, c, t, g, unknown or other
  modified_base (6202)..(6211): a, c, t, g, unknown or other
  modified_base (6572)..(6581): a, c, t, g, unknown or other
aggaacatccatagctgttctgcatgcgccaaccattagaatctgaaggtttcagttgatctgcaataccaaatcctttctgtaagtcatgtggaacacggttgtcttgcaagataacgaaacttggaggaaaaccatccatttatagcagacctgcaccatcgaaagagctgtccagcgtttctgaagaatcccacaccagactatcttctgcatggctatggattgaagatgacattttcattgctgacagtaagctgaaaaaggattactacttcctgcccttgccacatcgacnnnnnnnnnncttcagtgctgacagtaagctgacaaagtattactacttcctgcccttgccacatcgaccccgggtggctaccagcgtggcagaaacccggctgacaactaaggacgtggcactgtccagcgaggcgaccattaggctttgaatttctccccaccagctcccgcctgttacagaataatgtcagatgctgaacccgctagctcgacaccggcaggaccccccacggaacctgcctccgtccccgtgcnnnnnnnnnnaaatttctccccaccagctcccgcctgttccagaataatgtcagatgctgaaccctctagctcgacaccggcaggagcccccacggaacctgcctccgtccccgtgcccggctctgccaccgaggccgagaatcagctggcccaacaatggtcgcagatgctgcagtaccagatgcagggcaaggccggcgccatgccattcacagggggtgtacccttcccgaacgtgcccttcatgcaggtgcagaaggggcttgcaaggaccggggatgctcgccaagggggaagccaagcctctggtcatgcattcccatgcacagccccccttacccccagtgcccctccacctccatgcagcccttcatgtacccgaacgcaatgatgtacaaccctgcgctgagcggcatgaacccctacacagcggccttcatggcgagcatggccgagggcgcagacccggccaaggccaccctgaccagcacaacggtgggttgctggccggggctgagtcaaggggcggtgtgaagtctcagaggattgcggaacgtacagacagatgggatgatgtggctgtgatggggaaggcgcagtcttgcgcaagtccagaccacagactgctttgctggcacggtgtcggcagcattgatacatcctccgtctcaatgcaggggtgttaatcccagcttcccatctatcaacccccctgctggccccctctcgcccaaagtggcactgctgcaacccnnnnnnnnnngcatcctctgtctcaatgcaggggtgttaatcccagctttccatctgtcaaaccctctgctggccctctctcgcccaaagtggcactgctgcaacccccttaccccgccccccgcgatggcgtcctgtccccaggctgaggcaaaggacgatgccgctgcggcagcggcggccccttcagggcccggcgagggcggctctgccgaggagggctccaggaagcgcgaggccgacgcctccgaggccgccgacgcgccgtccaagcgggccgcgctcgcgccggggcaggccggggacagcgccgctgcgctcccccccggggtcaagaccgggtcccaggccgccctgtccctcctggcgtcggcggcggccacaggtaaaccggggtcaaaggtccccggcttggctgccctccccggcctggccggcctgaacatgccgcccatgcccccgggggccatgggcctcgtccctggcgcggccgccggcgccgcggtcgccgccacgagtcccggcgcacagcacctggcggaggtgtggaacgcgctgaacgggcaannnnnnnnnncggggccatgggcctcgtccccggcgcggccaccggcgcctcggtcgccgcctcgagtcccggcgcacagcacctagcggaggtgtggaacgcgctgaacgggcaattctcgcagtcccccgcgctgccggagctgaagcgcacggggtcggcggaggcgctggaggcggagctggccgcggccgccggcgacgagcgcgagctcaagcgcctgcgccgcaagcagagcaaccgcgactcggcgcggcgcagccgtctgcgcaagcaggccgagtgcgaggagctgggcaagcgggtgaaggacctgatcgcggagaacggggagctgcgcgccgagcgtatcgcgctccgcgcccagatcgaggtcctggacgccaagctggccatgtcggtgagttttggttgcatggggggagggagggggggaggcaggggctcgtgcagaagggcacggcaccacctgggaagggatgacgtggggacagcggcgggccctggcgcaatgcgcgacggtgtgcatggccgcctgacccatctcttgatccttgtccccgatatgggtgccccctcatgatccctgcagagcgccttcannnnnnnnnnccctgacgcaatgcatgacggtgtgcgtggccgcctgacccatctcttgttccatgtccccgatatgggatccccctcatgatccctgcagagcgccttcaacctggcgctgggcgcgggggagctggagaagattcaggccgatgcccgggcgaagcaggcagccgaggcgaccaacgtggcggccgctattgcgcacgtgcgctggggcttcacgcatatcataaggaggggggggcggtcgtcagtgacagggtacactgcttgttcccacagcgtcgtcatnnnnnnnnnnaaccaacgtggcggccgctattgcgcaggtgcgctggggcttcacacatatcataaggagaggggggcggtcgtcggtgacagagtacactgcttgttcccacagcgtcgtcatgcatagtgtgcttccctggcgcagtggcaccctgtgcgcaatctgacctggcaaactcctctctgcgccccttaccggaacaggtgaacgcgctgacggcaaacagcaacgcggccgaccaggaggacgaggagggcgaggatcgggggcggggcggccctccctccgtgcctaccccagccagcgggccccagctcccaccggcggcggcggcgtcaggcgcgcaggcccaagggcacgctgcagcggctggggcgctgggcccccagagcacctcggcctagaatccagattgcatcaaagtttcgttttccctttcacgaccttggcccttcttgcccaattgcctcccagtnnnnnnnnnnnnnnnnnnnnnnnnnnnnnnnnnnnnnnnnnnnnnnnnnnnnnnnnnnnnnnnnnnnnnnnnnnnnnnnnnnnnggacctgactgtacgaacggatgccaaagatatccaggagaagtgattgaccagggcgttcagagtcttgggnnnnnnnnnncgacctgactgtacgaacggatgccaaaaaatccaggagaggtgattgaccagggcgttcagagtcttgggnnnnnnnnnngaagtttcgtttttttcccttcacgactttggcccttcttgcccaattgcctcccagtgggcgccccggactcatggtggccgggtgacgcgacagaacacacgtgcacacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacggtggccaatggaaagtcggaataactgaggtgcagaggggtgccacatcggcagtccatctcaactctggggcaggagtggcaggtggtacacgaaccatcctacttgatatcataaggaagcaatcatattccctccagagccttgtgtagcacgtcggcgtcggtcctgccgctnnnnnnnnnntactcgctctcataaggaagacagtacattccctccagagcctcgtgtagcacgtcggcgtcggtcctgccgctgcgggagcaccgcaattgaagccgggggtgcaggctcccacgatcgccaagcatggccgcggtacgcttcttgtttccccgtgtctgcttactaaagttctgcttgggcacggtgtgctgtcaatgtgcccacttccccttccctccccacagaacgtgcctgtcaatcccaaacctttcctgaatgacctgtccgggaggtccgtcatcgtgaagctaaaatggggcatggagtacaaaggtgggtaggaactcatgctggagaatgaaagcgaccgtgccgctggcgaggatagtgggatccgtggtgatgagccggtgtgtgcaaccctgctcataaggagtgcatcctggccgccctcccttgcaggtttcctcgtgtctactgacgcgtacatgaacctgcagcttgcaaacaccgaggaatacatcgatgggcagttcacagggaacttgggagaggtcctcatcaggtgagaggtgtttgaagaccggtgggaagagggagggtgacggtaatgttgtctggcgcttcaacacagcgtcctttaccctcccacaacccctcgcccgtcaaactccaggtgcaacaatgtgctgtacctcagaggcgcgccagacgaaatggaaacgtcctgatggactcgtcctcggtcgtgtgccctgactgtacccaacctgcctttccccttgacctctgctttctttgctcatgcttgcaacattcatgctcttaacaacagaattcgggagagaagtgataggccatcaggatggtatgggattcatagggtagaatcgcttcgcctgagggcaggagagattggttgaaaaacgtcggccagatgggcccagacaagaatgaaaggcgcgctaatcccaaaaggacgagcattgtggagggtctgaaggcaagagacctcctccaaagaataaaaacggagagtgtgtgcagctgggaagggtgcacaaatcatctcaagcatgtggcgctgtgctgtcttgtccaagtcgtgcagggagcaggccatccactggcatccgagatgcaagcatgagggaacaaggcaagtgtgtttgtagtctgcaaaattgcaggcagaagtctgcccccgtgaaacaattgtgaccgcnnnnnnnnnnagagatgcaagcatgagggaacaagccaagtgtgtttgtagtcggcaaaattgcaggcaggagtctgcccccgtgaaacaattgtgaccgcctctcactggctaggcgccagatcgtgcaacatggagaaactgaagctggagagataatcgcccacgcctcatgcttctgtactctccacgagctcgttaagcacctggagtggcgggagggtacaagggatgcgactgatccattgattcctactagatgtactaaatcggtcacatcacaagcctgttgcgcaaaagatagtaaatagtaaactcctgctcaagatggggatctccaagtctagagtcaccaaacatccccagtgcctccacactgctcaccagggcgacaacggtggcagtggcagnnnnnnnnnncagcacctggagtggagggagggcacaagggatgcgactgatccagtgattcctactgaatgtactaaattggtcacatcacaagcctgttgcgcaaaagannnnnnnnnncttggcgacgcagaaacaggtcaccacaagtgcgccactgaccgcggccaggaagtcatagcgctgcagcagctggtcgcatgacctctggaaggtgtgaatgaatcctgcgtccgttccggagtctcgtcggccggctctcgggaccacgcaactccgccgagaaacgggggcccgggtgtagccgctgaaagtaggtctccgaaagcatgtcggcatctgtgcacgaacaggcgccgacgacggcataaggccgagcatggtgctggtgcttgcctgcgacaagggtcgacgggaatctcgaggtggagcaacacgtgacagcagggcacatgaagaggggagggtgcaccgcatgggccctggagccaacaaggagccataattgacgtgccatggccgtcacccatggctctatcgcttgcgctccgcgtccgcgattcctggtctgccgtaccttgggagaggccccgttcctgcgttgcactctcgttcctcgggagtcaaagccccactcgagtgcaatattcacgagatcgaaggttacaattcggtgtgcannnnnnnnnnctcaaagctccactcgagtgaaatatttacgagatcgaaggttacaattcggtgtgcagtaaattttcctcgccctcctccacacgggattctccatatcttgcaggctccatgcagtttgaccccgggggtgggggcgccctgctcatcagggcagctcaccgcaggagggacgccgacggcttcccccggctcgcgccccgatccgctccagcgctttgaagcagggggcgtgccatgctcccgtggcacccaggggagggagggttgcccatcaagtttgggggccggctccccggccagctccgccgcgcccagcgaccaaggtattgcccctcacaccttgcgcgggcggtacagnnnnnnnnnngtgcccatcaagtttggggcccggctccccggccagctccgccgcgccgagcgaccaaggtactgcccctcacaccttgcgcgggcggtacagggccagcgcgcccgcgcccagcagcaggttcctgtggctgaactccagcgccaggaccggggtggccttggtgcgccaggcggccagcggcgccgggcccgggtcgcccggccgccccgcgccgccctccgcgccgccgtcccacagccgcacgcacgcgtccg

SEQ ID NO: 36971 - DNA, 61 bp, Chlorella protothecoides
ccctcacctgacgcgattccaccagaagggtgaagccagtgggaagctggcagggatggtg

SEQ ID NO: 36972 - DNA, 77 bp, Chlorella protothecoides
gacacagcccgagatgcatgcacccctttcggcatccccacccaccaccccctctcccacgcatcattttctccagc

SEQ ID NO: 36973 - DNA, 61 bp, Chlorella protothecoides
ccggaaatcgagctccggaaccgatgacggaaagtgatttattgggacatagcagttttgg

SEQ ID NO: 36974 - DNA, 83 bp, Chlorella protothecoides
caaactaccaagttgtattgatattgctgttccgtgaggctgtgcaggttaatccccctggagtgcgcgccccccgggataat

SEQ ID NO: 36975 - DNA, 150 bp, Chlorella protothecoides
tggcgcaggccagcagtgaagtcatggggggggcctgcccgcctcgcactgctcccaagtgtgcggcagtggcgcagtccaccctccgtcagcactggttcagcatcgcaggcatcacacccctcacatctcccctgttttgacccctct

SEQ ID NO: 36976 - DNA, 93 bp, Chlorella protothecoides
cctcttattcagccaccagcccaaacttaccagtgcggggccctgaactcgtttctcaccatatgcaggcctactggcccttccaccgcctgc

SEQ ID NO: 36977 - DNA, 115 bp, Chlorella protothecoides
gtgtgatgggccgggacatgggcaagtggcagccgcagacatcctgcgagcctgcctgatcctccctgcagagcgggtgtgcaccgggcgaaccatgggataccatctcagctca

SEQ ID NO: 36978 - DNA, 166 bp, Chlorella protothecoides
cacgggtagggatagggggtcccggtgggggtgagccttgctagacctgctgaacacttcccagacagcccgtgatatgtttacctggtctgtgctccttgcacaagggcgaaacccatgcttgacgtgcctcagtgccatccactcttctttgctgaaaagcatc

SEQ ID NO: 36979 - DNA, 110 bp, Chlorella protothecoides
ctcgggattgatcaggtcccccgtggcccggacacaccaccacctcatcctcatatccccccccccaccaccaccatcccccaatgcaggagcgcgacctgatccggttg

SEQ ID NO: 36980 - DNA, 103 bp, Chlorella protothecoides
agtcctcctaatttggcaaactccatatgggttggctatgcctcaaagtttgaagcctgtacttcacactgtcccctcagcttccactgagcctgtcctcaac

SEQ ID NO: 36981 - DNA, 61 bp, Chlorella protothecoides
tgataccttgagatgttgtggcagcgaaggggctcatatcatgacaatcgagcctgtgtgg

SEQ ID NO: 36982 - DNA, 106 bp, Chlorella protothecoides
gctgactgacgcctgggactgaacaggaaagtctggactcaaagtctcaagacatcctcagagagtctgggcacacatggcttgcccacctagccggccccggggc

SEQ ID NO: 36983 - DNA, 252 bp, Chlorella protothecoides
gtgctggagactgcggcgacgcggagtggggctgtggccgcgagcagtgggggcggggatccgggcagcgaccacggccgggacgccccgagcggcgcgcgggcggcgtcagatgggcgcccatctgacgccgtccagacgtcggtccggcgcccacccgcgcccgccgccggcgcccccggcggccccccaacccgccccgtggccgcgtcgctcctcatcgacacgatggggcactggagccccatcgtg

SEQ ID NO: 36984 - DNA, 61 bp, Chlorella protothecoides
cctgtaactgtatgcctgccacatggtgttacatggcttcttgaaggggatgggaggggga

SEQ ID NO: 36985 - DNA, 67 bp, Chlorella protothecoides
ccgccacttgcggaatgagcctgcatcagatgccttaaggagccagccggcatggagcgggggcgca

SEQ ID NO: 36986 - DNA, 119 bp, Chlorella protothecoides
ccccccccaggtcctcctcccatcgccaaaagccactcactaggtagcctgccaggccattgccgaccaggaggaagttgcccagaactaccaaccagatggggtgccggatagagttg

SEQ ID NO: 36987 - DNA, 127 bp, Chlorella protothecoides
tgccacctccaggcgattccagtaagacgcgaagatgtagtccttgaggattgtcgtcactgtgtcaagctcctctatactggcgccgcgcagaagaacggttacgccaagtggtcgggggcagccg

SEQ ID NO: 36988 - DNA, 79 bp, Chlorella protothecoides
agcaggggtggtgaaggagggtggtgagtgctgtgaaaggtgtttaaggcattcgaagaccccattgtaacaccggctg

SEQ ID NO: 36989 - DNA, 71 bp, Chlorella protothecoides
tcaatcagcccctcccagctgcgtgaaacccccgctcgcccccccttgctgcaggtgatccgcgaggggca

SEQ ID NO: 36990 - DNA, 67 bp, Chlorella protothecoides
tcgctgcaccttgtccttggcggccttctcctcatagggcttcttgtccgcctctgacagctccttc

SEQ ID NO: 36991 - DNA, 107 bp, Chlorella protothecoides
aggcgcacacgctgcacgtggccggggggtggggggtggttggggagggggaaatgaggagcagaggtgagggggggctgcaagtttggtctccacgacggcagggg

SEQ ID NO: 36992 - DNA, 93 bp, Chlorella protothecoides
gggaacctccaggaaactggcttgatgtccagccccaaccgcatgcttccaaaaggtccccgtccaaacagccatgcacaccaccttgatggg

SEQ ID NO: 36993 - DNA, 2224 bp, Chlorella protothecoides
  modified_base (188)..(295): a, c, t, g, unknown or other
  modified_base (738)..(747): a, c, t, g, unknown or other
  modified_base (1481)..(1490): a, c, t, g, unknown or other
  modified_base (1969)..(1978): a, c, t, g, unknown or other
gctctggccgcggccccgcggccgtcgggacctgtgcgaggggccccggccgctggctccaccatgcaggcgggcaccagggggcgaggtggcgccggagcctcgccggggtcgcgccacctcaacccgcacggcggcagccccccgcgccagcggcgagccagtgcggcggagtcagcgggctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcgggaggggacgtggcacgctgaggccacgccgcccgccacgccccgccgacgcccactggtccagtcgatggtcggggctgtatctgccatggcaacaaccacgccggcgctggcatccccttcatcaggcagtccctgcgtgagcagcgccctctcctcgcccgggaggaggagggagaggggggggcccatgtacgacgcggtgaaagcggagatgcgtgccgcgagggcccagcgcctctttgacagtaccgagcagtacatcgaggtgcacaaggcgttgatgaagcgggtgcggccgctctggccgctgcctgaaggctcagaccgtgtgcggcgggagatggagcaggagctgaagcgggcgcgaggggggcgctgaggctgcgagcgggtgcctgccagcggggccacggctggtgcctgcaagggacacnnnnnnnnnnagcgctgaggctgcgagctggcgcctgccagcgggggccacggctggtgcctgcaagggacacactcagcaccgaccggcgccgccagggtctgaagcctcacatcgatagcttctttcctgtgccccttcgccacaaaactcctgcgatgcacgatgaataagaaactcaaatcccaataggagcacggcagtgggtgcattctggtgttctccggtcgaggcagtaggtgtgtgaccaggctcggtcccatgatttgcctggggaaactggcctggcctcccattgcccacgtgcgacacggcggggattcggcgcataaacacagggaacaagccactcggatccgacactaatccaatcaaagcgccaaaggtgacaataccatgcatgcatggcacctctcatgacgtgcacgggtctcagggccgctcccgctgtgccgaccttggtgcacctaccttcgacgagaccatgcaaggcccggcttcggctggcacacccgcccgcctccataggctataaccatgtggagctcctggatgggctagtgcaggtggggaccggaatcaggggtggcgatcagtttactacacgcatgctgcccccgccacccctcattccgggctgccgacacccttgtcggcttgtagtgctgtgtcccccccgccccccagcagctgcccctgagccggcacgcaatctcgctttcacgcaggccatcaaccacgccnnnnnnnnnngagggtggcgatgagcctgctacacgcatgctgcccgcgccacccctcattccgggctgccgacaccctcgtcggcttgtagtacattgtcccccccgccctccagcagctgcccctgagccggcacgcaacctcgctttcacgcaggccatcaaccacgccatatcgaggacagacggcggcggtgggaatgagcacccgtcgcccgcccagccacggcgtcgcctctccttcggctcctccttcacctcggagctggccctggccagccacgacccggagcaccccccctccccccaccctccctcctccgacgccgcggtgagggcccacacccccagccttgacgcctatctagccctccctgtgtcggagtacgcgctgctggacccagactgggtcagctgggacgagtcccgcggcggctggtggctccgggtgcccctgctgggcctgctgggcctggacctgaccccccnnnnnnnnnnttgtggcggctggtggctccgggtgcccctgttgggcctgctgggcctggacctgaccccccagatgctcatcgttgccacgcctgaccccgctcggggcagcgtgaagctggacggaagctgcatgggcctgggcgtccccgccgtggacgacgcgctgcgcgtgcgcgtcgccgccacgctgtcctccggtggtgcgcgcgcggaggagggcgctcgcggccgcgcggggctggacgccggccg

SEQ ID NO: 36994 - DNA, 173 bp, Chlorella protothecoides
ggtttccctggagtagacaggacgggcacaccaatgcaaacctgcagctctcatctcgatggaagggagagtccaaacccctcccgatggtacacacagcagcactcaggcattataaacatctcccgacctctcctgattcgccaagatcgcgcaccttcatagcgagccac

SEQ ID NO: 36995 - DNA, 124 bp, Chlorella protothecoides
aatccctggctgggagggaggagccgggggcctcacgtctgcctgttgcgaggaggatcgccgtagtcctcccaggaccatcagcttgctcacgggtcggactctccagaggatgcatcctctg

SEQ ID NO: 36996 - DNA, 1868 bp, Chlorella protothecoides
  modified_base (623)..(632): a, c, t, g, unknown or other
  modified_base (717)..(726): a, c, t, g, unknown or other
  modified_base (1103)..(1112): a, c, t, g, unknown or other
  modified_base (1669)..(1678): a, c, t, g, unknown or other
cattccccccctccccttcacctactccaccccccaccccatcaagtgcgccgccaccaactcctaccccctctccaccgggctcagccccaccaagtcctgctccttctccacccggcatttccccaccctctccagggctggtgccctcgcctactccagctccctcccctgcagctccctccccatctccacagtaccaaccaccaccatctctatcatcccccactccatcggttttgcccccaccttcacccaccaagccctctccccctcctcccaccaagccttctcctccacctccatcgaattcccctcctcctcctccaaaggaggcctccgcatattcccccaagaatgcctcgccacctccgcacgagaaggccaccccacctcccaagaagtcttccctactcacactcagagaaaactgactcctgcacagaatcacaccatccactcatccccaacaggagtgcccatacctctctttaaagctctcatacactccatttcccttttctcgagtgtgctgtggctctcttagccgcttctacgcattgtcgcactacgcaccacgcgagtgggtcaccccgctggggtaaccgtctttcacttgcatnnnnnnnnnngcctccccatattcccccaagaaggcctcgccacctccgcacaagaaggccagaccacctcccaagaagtcttccctactcacannnnnnnnnntctctttataaagctctcatacactccatttccctttctcgagtgtgctatggctctcgtagccgcttctacgcattgtcgcaccacgcaccacgcgagtgggtcaacccgctggggtaaccgtctttcacttgcattttgaacatacttggataaaacacaacgcaaaagtctaccgtcatccagccttgacaattaaggattattcagcgctttagcaaggttcgagccccctcccttaagcaggacccacttggcatgaccctcgctgcggccaaccggggatgcaaatgcaccgcacgatgcagaacgatttcttaaactaccactgagacggtggagtaatgagtgcaaaggggggcgatagaacacacatnnnnnnnnnncaagacacaacgcacaagtctaccgtcatccagccttgacaaataaagattattcagcgctcgagcggggttcgagccccctcgcttcagcaggacccactgttgcccattggcatgaccctcgccgcggccaaccggggatgcaaatgcaccgcacgatgcagaacgttttcttaaattatcactgagacggtggagtaaggagtgcaaaggggggcgatagaacacacatcgggcgatgtccgctgtccccgtcgggccctcgtaggccctccggcgaccggagcgcgcgcggtttgcacggaggccacggagggctgccacgcagccgtacatcgaagtcggtacaagttctttgaatgcttccctccaccattctgcacacccttgggggtattgtacagggtaaagattattcaaattgctgtacattgctagacatgggatgtttttcgaccgcactcctccttggcgtgctcctcgctggcgcatgcgtgcgaaacgcacaggtggggtgacggtgtgttgcctcgcgtgaatggcggaggcttctcaannnnnnnnnngacactgatggacacctccgggcctccggactgctcgtttcggcctccgggtcgctatcggcccggagtgcgggcaagaggaaggctgccacgtacatcccaaactcggtatcctttcaagaccagtctgtactcccttggagtggttgtacagtcttgacactgagtgttctctgccctggctttgcca

SEQ ID NO: 36997 - DNA, 61 bp, Chlorella protothecoides
gcttgtgcgtgttgcctgtcgtacggcgggggaagatgctgggtcagaggaaaacaggcga

SEQ ID NO: 36998 - DNA, 63 bp, Chlorella protothecoides
cggcggccgaaacctcgcctgcacccaccatgccccaccacttgctccgccttgcagcccgcg

SEQ ID NO: 36999 - DNA, 61 bp, Chlorella protothecoides
tcaggctgggctgcgcttcaggctgggctgtgcttcaggctgggctgcgcttcaggctggg

SEQ ID NO: 37000 - DNA, 61 bp, Chlorella protothecoides
cccctccctctccccctcctccctcgcctcatcctccctcgcctcctccctcgcctcctcc

SEQ ID NO: 37001 - DNA, 81 bp, Chlorella protothecoides
gtgcagggtgctgcgtctgacagatatccagagccggggcgtatgcttcgaacgagtcgaagatatgccgctaccgggctt

SEQ ID NO: 37002 - DNA, 74 bp, Chlorella protothecoides
ctggcctcagccaccacactctcaacccactccccccatttttaccccctctcatcccacccaggtgctggagt

SEQ ID NO: 37003 - DNA, 75 bp, Chlorella protothecoides
gtttgaggtggtgatggctgtgacggcctgcaggagggggtcatggtataagggaggcatgaggcgcatggctca

SEQ ID NO: 37004 - DNA, 61 bp, Chlorella protothecoides
gaatgcgatgcccctggtcagccggctgaacgggagatcggcactggtagggcgtgggccg

SEQ ID NO: 37005 - DNA, 61 bp, Chlorella protothecoides
ttgttccgggagggcatatcagacaggtcatgggctgccacatcagacacatgaaagtttc

SEQ ID NO: 37006 - DNA, 78 bp, Chlorella protothecoides
ggcgtggatgcgtgggtttcaggctggcacagggtgctgaatcccggggtacggcggcatcatctgctgcaaggagca

SEQ ID NO: 37007 - DNA, 8000 bp, Chlorella protothecoides
  modified_base (324)..(333): a, c, t, g, unknown or other
  modified_base (490)..(551): a, c, t, g, unknown or other
  modified_base (953)..(962): a, c, t, g, unknown or other
  modified_base (1198)..(1207): a, c, t, g, unknown or other
  modified_base (1351)..(1360): a, c, t, g, unknown or other
  modified_base (2332)..(2341): a, c, t, g, unknown or other
  modified_base (2617)..(2626): a, c, t, g, unknown or other
  modified_base (2917)..(2926): a, c, t, g, unknown or other
  modified_base (3163)..(3172): a, c, t, g, unknown or other
  modified_base (3576)..(3585): a, c, t, g, unknown or other
  modified_base (4302)..(4311): a, c, t, g, unknown or other
  modified_base (4969)..(4978): a, c, t, g, unknown or other
  modified_base (5801)..(5810): a, c, t, g, unknown or other
  modified_base (5998)..(6007): a, c, t, g, unknown or other
  modified_base (6573)..(6582): a, c, t, g, unknown or other
  modified_base (6892)..(6901): a, c, t, g, unknown or other
  modified_base (7298)..(7307): a, c, t, g, unknown or other
  modified_base (7493)..(7502): a, c, t, g, unknown or other
cccatcgggcgagggcgccgcgctcgtcgtccccggtctctgcgcgggcgtcgcgtcgacgccgctcacaggcacgaagcgcgaggtggcggggagcgggccggcgccggcgccgttgccctggcgcgacagcagcgccaggggtgcgacagacgggccaggggccgccttgtcgcctgcagagggcggcgcgcccggcggcgcgctccgcacggtggcggcgttgtcggcggccgtggtggccgctgcggcgtcgagcactgggttgagatggggtcccgggcctacgccagtcgtcccctctgttgcgccgatgatgccggnnnnnnnnnncgcggcgtcgagcattggggtgagatggggccccggccctacgccactcgtcccctctgttgcgccgatgatgccgggatcggacgccagcgtccgacgaacaggggcgcgttccaaggggaggctcgacgtcgccagagctgccgcggcgcccgcnnnnnnnnnnnnnnnnnnnnnnnnnnnnnnnnnnnnnnnnnnnnnnnnnnnnnnnnnnnnnncggccgccttgccgtcgctggcctcggcgtcgcgcggcgaggcgcccgcgctgcccgggccggcggccgccgcgaagcgcagcgcctggcgcgcggcgtgggtggccaccaggtgcggcagctcggggcacgcgtctgcgcccgccacaaaggggtggtgcagcaggtcggcgggggaggggcgctgggtcggatcctgcggatgtttggttagtgggtgagggttacggagcaggtaacccccgcctgcgagccaggcctcgcgcgaggtcccatcgcacctcaccaactcggcacatcagaaaagggcagcgcgacgccacgaaaacccgccacccccagcaccacgcgcctttcggaggcactgccagacaaagtccttgaactctgtggagaagggannnnnnnnnngcgccagtaaaaccctccacccccagcaccacgcgccttgcggaggcactgccatacaaagtccttgaactctgtggagaagggaccctccagggaggggggctcatcccgcacgatcatgaagaggaggcggaaggatgacacctcgccccgcggcggctctccccgggccatctgcgcgttggagggatacttttgctgttcgcatgccggcgcagcaagctcagaggcagggnnnnnnnnnngccggccttgaagagttggtcgcggcggcgtagtggcgtacctggtatccaagctgcaggtgcatgtacaagcgcccagcccttccccttcctccgccccagacaaaacaatccgaccacgcgcccacctcgatggcggagatnnnnnnnnnncacaccgactggccggccttaaagagttggtcgcggcggcgtaggggcgtacctggtgtccaggttgcagtacaagcgcccagcccttgccctttctccgccccagacaaaataattcgaccacgcgcccacctcgatggcggagatgcccagggaccagatgtccgccgacatgttgtacccgccccgggcgtcatcgggcccacccggcacacccgagtgtcgctccggcgcctgctctatcacctccggcgccatccacagcgggctgcccacgaaggtgcgccgcttgtagcccaccgtgcccgacagctgggcgctgactccaaagtcgctgaccttgaccgcccccgcgctggacagcaggatgttggcggccttgatgtcgcggtgcatgcgggcctgggagtgcaggtaggccagggccttcagcaccccccgcagcacgtgggcgatgacgggctccggcaggccggcgacggctgccggagcggctgggtccggggggctggcctccggggatgcggtgggtggtgtgaccaggaggtcggccaccgacagggacatgagctccatgacgatgaggaggcgggaggagccggggaccacggcggaggcgtagtactgcgtgatgtgggggtggcggcagccgcgcagcgtgttgatctcctcctgcaggtcgccgatgtcctcctccctgttcatgtagggggacggggggtttgagcggcacacatgtcagcacgcggggcgcagggctggggtttgaggagtggttctccaacgatcaaacttgacctacacaagtgcgcctgccttgtcgcatgagcagcccacacagaccccgccagcaagcataggcattggaggtgccaagtcgccacccagatctgtgtgatactggaacgcccacactgccatgtgagagccctctatacagtaaccagcacagccactgcccagcccttgcgnnnnnnnnnngcaggccccgccagcaaccataggcattggaggggccaagtcgccaaccggatctgtgtgatacttgaacggccacactgccatgtgagagccctctatataacaaccagcacagccactgcccagcccttgcggagtcggctattccccagactcacaggtcctccaggtcgatgactttgactgccacatcgcgcccttccactgtgtccagcctggggggggcatggggaagagccatgcaaagttgggaagtcgctcgctctgatgctgcannnnnnnnnnatgtgtccagcctggggggaacatggggaagggccatgcagagttgggaagtcgctcgctctgatgctgcatgctggatgttgtacgaacgcggcaacccctcctcgctcaccccttccatacggtgccgaaggagccctgcccgatcttgtgcagcaattggtaccggtccaggacccctgtcattgcgaagggaggtgacacagatcggggcgtttgtattgcctctgcgaacctttggatatcgtggtaaacttgaaatctacagcttcggtgtggcgtggagttggnnnnnnnnnngctgcgaccctttgggtatcgtggtaaacttgagatctacagcttcggtgtggcgtggagttgggcaggatgctcgccggagctggacctcgaacacccgaccatgccaaatctgctgcctacagacatctctcaaaagccattgtttctcatgagtgttcgatcaaggcaggatggccctccagttctcgcaggttacccgtgctagggagttttggagatccgggactgcacagnnnnnnnnnnaaacaaggcaggatggttctccagttctcgcaggttacccgtgcaagggagttttggagatccgggactgcacagcacaccccgcatgggctggcgaaactcgattgaatgtcgaagggctggatcgcgtccccccccagcacgaagcccagcctacatgctggcggtactgtgaggaatgtcctgtgcatcctcatgttgtttcaactccgcgaccagcccaccaggccctccagaccaaccttgaacccgacctggccacgtctcaataagtcaagtctccgctggatttggagatcccctgatttgcagcagaccatgctgaaaatatcacaatagtatctacaatgatactatcgtcggtgacctgatcgccggtgcacggctcgggctgcaggtgggtnnnnnnnnnngctcgcagcagaccatgctgaaagtatcacactagtatctacaatgatactttcgtcggtgacctgattgccggtgcacggctcgggctgcaggtgggtcagggtgctctggtacatgccctgcctgtcgtggcgcaccctgccggccagtagcttcgtatctgcgttgtgcgatgcccagcttgggacagtggtgctcaatggattccacgtctccttctcccagtgagctgggccacgctgaccagggcctgtgatgcgtgaggtactgggacctgtcgacaaccagaccatgcctcctgggacccagctgccaagcccacccggcggtggcatgtgtcgtggtccctccacccggtcacggaggaagacgatgacctccccgcgccggctgggcccctccccagggacgggccatggcggggtggagccccttgcctcccagccggaccccaagcgggcgcgtccaggcagtgaagtgacgatcctggttggtggcgacgagaacagggccgtggaggagcccgccgccacgcgcgatgcgcagagcgatgtggaggagcccgaagtggctgaggaggagcaggttgagcaggcacaggtggaggtgagttcttggcatatccgagggcacaaggggtgtcgaagcggcctgcccttctggaatgggagcagctggcagggctaggagggcgaatggcatgccacacgggtgtnnnnnnnnnnaatgggcagagcgatgtggaggagcccgaggtggctgtggaggagcaggttgagcaagcacaggtggaggtgagttgtcggcatatccgagggcgcaaggggtgtcgaagcggcctgcccttctgagatgggagcagctggcagggccaggagggcgaatggcatgccacacgggtgtaggctcccttccacctgcaatgcctgggtcctgcagcctccaagacccctcttcctcaccggctctcgacaggctgaggcccccctgcccagcgggcaggccagggcgggccaggtggccaccatcacgctggtcaacttcatgtgccacgagcacctgaccatggactttgggcccaacgtcaccttcatttcggggtcaaacgggagcggcaagagcgcggcgctcaccgccctgcagtgctgcctgggtgcccgggcccgggacaccggcaggtgcggtgggcgtggctgtgggcatcgtttgtcggtgcacgcgcgctgcgggcttgcatgctgtagtgtgggatgccccgcgctctggtggcgggggccaggcctgaagccgggcggcgttctgtgcctgcctcaacgctctgaggaatgaggatgcatttctctctggggtgtcatgaatggaccaccgctgcccacaggccgnnnnnnnnnntgtggctgtgggcatcgtttggcgatgcacgcgcgctgcgggcttgcatgctgtggtgtgggatgccctgcgctctggtggcgggtgccaggcctgaagcccggtggcgttctgcgcctgcctcaacgctctgagggatgaggatgcattgctctggggtgccatgaatggaccaccgctgcccacaggccggcatgcagaccctcgccctcgcccgtcccaaccacatgcaggttcaagtcggtgcacggctttgtgaggcacggcatgccctacgccctcgtcagcgtcaccctctgcaatgaggggccagacgcctaccgtgccgaggagctggggcccagaatcacgatagagcggcgcatcaacagcagcactggtggccacatcaagatccgagacgcgcagggccgggaggtgggagggaaagggcggggtggtccgagggaggtttaaaggccctggtgcttgatttctttgtgcctggtctgtgctgggccgggagactcccacgtcccattgttgatccctcgagtgcccagactcaaccctgccccgtctgcatccaaacccttgcatgctcgatgcctgtgtcgtttgccaaccctgcccagcaatctccgccttctcgcgcgcagaggatgtctggcgcaaaggaggtgacagccctcatggaccacttctgcatcaacgcagccaaccccgtcgtcgtcctgacccaggacctggcgcgcgggtgggtgggcggtgtggagcgacgcgctgtgcgtgggtgcctgctagctcccgctgtgctggcggcgcagagtcaaggatccagacnnnnnnnnnncatgcgctgtgcgtgggtgcctgctggctcccgctctgctggcggcgcagagtcaaggatccagacggaggggtggaagtgcgccgtgccctgcacgctgcggcatgccctgtacgctgtgccctgccgcgcggccccctcgtttctcaccaaacgtttcgcccgccgcagttttgccgggcaggccnnnnnnnnnncgccgcacggccccctcgtttctcacggcacgcttcgcccgccgcagttttgccgggcaggccagcgagggggccaagttccagttctttgaggaggccatgcacttccaggagatcggggcgaacctgcgcctcgccaacgagcggctggagtgcatgctggccgccaacaagggtgacgaggctggcctgcaggtgtgaactggggctggggaagaggaggcggccagggcttgctgatgccggttgggacgtggagagcccaggccgggaatggacccgacacaatggtagggatactggcaggctgtccatcttgcagcacaggcttgccaccccaaccccatcagggtgccgaggccgatctgggggccaagaagtcacgcctggagctcctcaggggggtggaggcgtggcgcgctacccacgtgaaactggccaagggtctggtgtggaaagccgtggcagagacagaggcagacatccaggtgggcaaagcgtgctcagcatgcaggtatgggctcgatgtcgttactggtacagggtggtcatgcaagcggatctcnnnnnnnnnncagaggtatgggctcgacattattattggtacagggtggtcatgcaagcggatctcccagtcgctgtcttggaggagcactcggttgtcgaggggagtatcatgcaggagcatcggccattcaagcccaagcatcctcgacgctgcaccaggaggtggagcgggacctggcgaccacgttcccagagtcggccgagcaggcgcgcgccgacgccaaggccgcatgcgcccgaaaggacgaacttgatgtggcgatctcgcgggaggtgagatggacctacgtggcgccgctgtgtcagcgcagctttccnnnnnnnnnngcttgatgtggcgatctcgcgggaggtgagagggacacccgtggcgccgctgtgtcagcgcagctttccagtgggtacggtccttggattccctggctgatatcacgtcccgaccccgccgtcatgcaggaagccaaggtaaacggtctgaaggaggccatcgagggcgtcaccaagacagtgcaagcgctgcgcgccaagaaggcggcgggagtgcaggaggtgagcgtggggttagttcacactggagctgctgggtcatggcgttgggtggggggactccatgcgggaggcaggggcatgcatgctcccgggcgcaagctgtgcttgctgtaacacctgccgcccttgagccacgtggcagaagctctcgtggcagcttgtgggtatgtttttnnnnnnnnnntgggcgcaagctgtgcatgctgtgacacctgccgcccttgagccacgtgacagaggctctcgtggcagcttgtgggtatgtttagggggggggagggtggtttccgtcttgcttctgcccattcactgccactcccctgtccgtaagctcaataccattccccgctgcagctctcctccgcgaggnnnnnnnnnnttttcgtcttgcttctgcccactcattgccactcccctgtccgtaagctcaaaacattccccgctgcagctctcctccgcgagggcagacctgcggcgtctggagggcgaacttgcagacatgcgctccgagcaccagtccatggccgaggccatctcggaggtggatggccgcggcgcggccgagcagcgggtgagcgctgtgttctgtccacgagcctatgaaagcatggatggcactgtgtgtgtctgcgatccggccctgcgtccaaggccccccctgcctgtgggtggcgaatgatcgtgctccccggcggctgcggtcttctccacccatcattcccccaagtctccccaccctacgtccggcccccccaggcccgcctggagcggagtggagcggcggtgagggcggcggagctggaggcggaggcggcgtgcgcggccgtcgctacccaccgcctgtcgatgcaggagggcgcggcgcggcatgaggcgg

SEQ ID NO: 37008 - DNA, 73 bp, Chlorella protothecoides
ccatatgtgagatggcagcaggggagttgcagtctggatcagcggatctggtccttcaggcacctcggactct

SEQ ID NO: 37009 - DNA, 61 bp, Chlorella protothecoides
gtgcttgccggcaaccgctccggcatcgagatcagcagcatcgccaacggccgggtgctgg

SEQ ID NO: 37010 - DNA, 63 bp, Chlorella protothecoides
tccccagttggcagtgcccacgttggagttccctgcagaggtggcaccattgtatgaacgata

SEQ ID NO: 37011 - DNA, 111 bp, Chlorella protothecoides
gggagagggcaagaggactcagcggcgatcaatgagcactcaggatccctgggtactgatgtgaagaggcagtggggcctagcatcatacaggcaacaacacttgtcaact

SEQ ID NO: 37012 - DNA, 61 bp, Chlorella protothecoides
tgtgtcgtccacaggggatcctgctgttcgaggactggtcaggctgggggggggggcgagc

SEQ ID NO: 37013 - DNA, 61 bp, Chlorella protothecoides
tcgttagaacagtcacaggcgtcagccaggttaccatccttgattgccccccgtaagctcg

SEQ ID NO: 37014 - DNA, 65 bp, Chlorella protothecoides
ccgatcacgcccgcgacggctgccagcgccagctgcgcgttggagtctgccgccgccgcggcggc

SEQ ID NO: 37015 - DNA, 68 bp, Chlorella protothecoides
ccttggtcgctgcctgcatgagaatgagtgaatgtggagggggaagcaggagggcctgagtggggcca

SEQ ID NO: 37016 - DNA, 86 bp, Chlorella protothecoides
ggctgatggaggtttcgccggctgatggagtgtcgcctggcctctggaatcacctccccaattgtcccaccttcctccctccttca

SEQ ID NO: 37017 - DNA, 70 bp, Chlorella protothecoides
gggggggggggggggaaaaggggggggggggggggggcatagacctaaggaaggagcatggggtggattt

SEQ ID NO: 37018 - DNA, 77 bp, Chlorella protothecoides
tgatcacacccccgatgaccaggactgcagtggggccgagagcgggtgtgcatgtgagacccttgcagcctcagggt

SEQ ID NO: 37019 - DNA, 61 bp, Chlorella protothecoides
ctggaggtagttcagcgttgtcatcccatcgaatgccgcgtcgatgtggtccagcgagaac

SEQ ID NO: 37020 - DNA, 113 bp, Chlorella protothecoides
ccagggcgcccagcgacttcctgcgctcaaagggtggaggggatggagtgatgagcaccataaggaatccattcttctcgagacaaaggagcagaagccggctccagggcaat

SEQ ID NO: 37021 - DNA, 61 bp, Chlorella protothecoides
taggccggcgttggcagtggctggcaaggggcctcagcccgaggatctcaatcgagttttc

SEQ ID NO: 37022 - DNA, 98 bp, Chlorella protothecoides
ggctgaacccaccacagctcaaccgccctcggcccccacccccgcaggtcttccccggtgacacctcccaggagagactgtacgacagcaccgtggcc

SEQ ID NO: 37023 - DNA, 61 bp, Chlorella protothecoides
ggcatgggtgacgagagcaggcacactgagcgatcaagtgacaccatcagcagaccagccc

SEQ ID NO: 37024 - DNA, 61 bp, Chlorella protothecoides
ttgtgatggtcctggacgtggtggtacttgggatatttcagcttgggatgctttctagctt

SEQ ID NO: 37025 - DNA, 126 bp, Chlorella protothecoides
caacactgatgctgcccgagaatctactgggcgagcatacagggaaccatgccccgttccgcagcccaggaggagcacttactatgccatgcagaccggggcccctcatgaatgcgacgaccaggg

SEQ ID NO: 37026 - DNA, 61 bp, Chlorella protothecoides
taccacgcatcgagtattgccctgcagaggtgcagcaggcatacaggctgatggaacacag

SEQ ID NO: 37027 - DNA, 61 bp, Chlorella protothecoides
cgctctgtgtgggaaaggagggagaccgtgcccctgccggtgagatgcggggcgtgaagtg

SEQ ID NO: 37028 - DNA, 67 bp, Chlorella protothecoides
gctgggtgctgtgccgagggaggcgtgccgatctccacaccttttgcaaccgggtctgggctggcag

SEQ ID NO: 37029 - DNA, 1555 bp, Chlorella protothecoides
  modified_base (1429)..(1481): a, c, t, g, unknown or other
cacccctctccataacccccaacccaccccccaacacccccccaggcggccctcccgcccctgaccctgctggtgtgctgccacaatgcgcgggacgagcggtgcggggtgctgggccctcagctggccgcccgcctggaggagttgctgctgtacaggggttttgctgccgcgcagttccgggtgctcaaggtatcgcacgtcggccagcacatctacgccggcaacgtgatcgcctaccgccccgggcaccccggccacggcgactggtacggcggcgtgcacgccgagaacgcagaggcctggctgacggcctggctgggtacgctggcggagctggacggcggcgtgggcgacccggcgctgcgcccccactggcgcggcaggctgggcctgagcaaggaggagcagctggcggtgttcgaggcgggcaaggccctgtgtgctgggaagggcggcgcggacatcgaggagctgtgcgccgacgtggtacagacggtgcaggtgtgaggacctctcccctgcccccggccaggcgacgcggccttgcagccgtaggcatcttccgggacacacccatactcgatatcctgccttgaccaggtccttccaagccccctgactgttacaagcatgatactactagatgcaacaccatgtgttccttgacaagccaggttgtgctgcctcggcgcggcaccgcgaggcactgcatgcagattgaggccgcgcctgtcgtcagcatgcgcgcagcacaggaattgccgcgccgccgatgcgccttgccagtccttgcagtgcacgggcaggcacagagtgcggcgagtgaacgtaaggcccagggcgctcgactcgagcagcgggctgacctttgctcgcccacccccccaatccctcagccctgcacgtgcaggcggtgggcgcgctgcagtgcctgcactggcccctgcagctgctccgccttgtcgtacatgcccagcaggcccccagtgtgcacaaacaggacgcgacgctgggcccaggcggcggggtccgccgccacgtcagccagccagccgtgcagcgccttgcccgtgtacaccgggtccagaatgatgcctgccgaggaaagggagaatgtggggttcggagcggggtttagattgctgtgggcagcgtgccccttttgcgtggtgggtgggagcagggggcggtcccccctttaccctccctgcccatcgacgccgcgcaaggccgggacacgcagtgccatacgccaacgagggcgagcacctcgcccttctttccaatctaccacggcgcctcgcctgtcgcctgcgccgcgtcgagcaccgtggccagctcctcgtcggtgctgatgccgtacccgacgcccttggcctccgcaatcctgcaggatgggcgggcggggagggggggggggacggannnnnnnnnnnnnnnnnnnnnnnnnnnnnnnnnnnnnnnnnnnnnnnnnnnnntgggtggacaggggccactcatcgttgtgatggggggcacgacatggagtgtttctgctccctctccctcccca

SEQ ID NO: 37030 - DNA, 72 bp, Chlorella protothecoides
ccccggtataagcaccccgtgtgtcgtcccccacccgtgacttcccgctcacatcgcgttccgcagccacga

SEQ ID NO: 37031 - DNA, 125 bp, Chlorella protothecoides
tcacagtggtagtaccctctgcaaggcgattgtaccgcgaaggtcccttcctcacaaaagaatgacgtgtgccagcatacaacacgttctgctgtgtgccccgcaagcctgttgagctcatccaa

SEQ ID NO: 37032 - DNA, 156 bp, Chlorella protothecoides
cacctgcgcctcggcgacctcgtggccggcgcgctcgacgttgccgccgcgtcgccgcgccgcactttcttcgaggtcctgcgcgacacggcgaggtcggggctcgagcgggagcgcctggagtatctctgctccgcggaggggctggaagacctg

SEQ ID NO: 37033 - DNA, 67 bp, Chlorella protothecoides
catttgaggcacccgacatctagacagaggtcctgatgaccagcactgaccatcttgccttccatta

SEQ ID NO: 37034 - DNA, 262 bp, Chlorella protothecoides
atgccatggccgccctcgtggctcaggtgctttgagaaggggggagggggtaggggctccgcggttctcggggacgcaggacggcgtcaatgagtgcgggctctgcggcggccatgcccatactgggcgcccacgccgcctgcgcagcaggccccacacgccgacgtcaccccatgactccatccaagtcaccccactgcctcacgcaccggccccgccgccccctctacaaaaagggctgcgccgagatccggtggctggc

SEQ ID NO: 37035 - DNA, 66 bp, Chlorella protothecoides
ttcttgctctcgtcccagccgccgtgctgccgagccggcgacgtattggctgcacatgggatgggg

SEQ ID NO: 37036 - DNA, 61 bp, Chlorella protothecoides
acccctgacgggctggatcccagccgtcactgcagcacccgctgcggttcgcatgcctcag

SEQ ID NO: 37037 - DNA, 71 bp, Chlorella protothecoides
ggggttgacacaccactggtccgggctgggtgacaacgcctttgagaccaaaggctgcgccgctcccccca

SEQ ID NO: 37038 - DNA, 6319 bp, Chlorella protothecoides
  modified_base (793)..(802): a, c, t, g, unknown or other
  modified_base (1700)..(1709): a, c, t, g, unknown or other
  modified_base (2758)..(2767): a, c, t, g, unknown or other
  modified_base (3220)..(3229): a, c, t, g, unknown or other
  modified_base (3458)..(3467): a, c, t, g, unknown or other
  modified_base (3755)..(3764): a, c, t, g, unknown or other
  modified_base (5666)..(5675): a, c, t, g, unknown or other
  modified_base (6195)..(6204): a, c, t, g, unknown or other
gggggggggcatggtgagagggaggggaaaaaaactcaccatgaggatctccacggcggcgcacagaactgtggccatagtctgtgctttttaaagcagcgatcgcagtaggcatgcctaccacgcagctcgtcttccccggacattcctcccaggagggaatcctctgcagcagcatccctctcctcggccgcctcaccatcagcgtggcgccggcggcctcctgcgccagccgcagggaggtgagcagggaggcaggggcgatggcgtccacctccacgctgccgtccacctcggtttgacccaggtcagccatggccaggacgtgtacctcagcatcgggcccggggggtcccaggaaggacgccacctcgctccatgcgccaccctgtgcttgcagtgcggcacttggcgggcacgtgagtgcggtgccagccggaagccatgcacgcatcttgccggcccgagacgcaggtctgcctttctcatcattccaggccagctcgttgtgctccaggccgtcctaacacacacacacccaaaaaacatgaaaagcacgcacccggctgcccacggtgtagaagtagcggcggctgggggccaggtccccgagaaccacgctgtgcagtgcgcctgggtctagccagcctgtgctgttggcgggcgccccgcacatggcctccctggtgtaggtggtggagtcggcgggggcctcccggtcgagatactgggggtcggcgccccagcgaatgagcggccggtccaccggcccgctgacccacaggaccttgannnnnnnnnntcctccctggtgtaggtggtggagtccgcgggggcctcccggtcaagagagtggggtccggcgccccagcgaatgagcggctggcccaccggcccgctgacccacaggaccttgacctccgatggccgtccagtcagcgcgaggtgtacctgggtgggctccccagggtccaggggggctacggcccgcgaacgcgccgcaaacaccgggagggccaggccgtcgcgcaggaagtagaagcgctgcggctggcgcagattcagcaggcggaagctgcagggccgtggggagggttggtgtgagacggcatcatacattaaagtgtctggttggccggaaactgccactgaagccaggctgcaaggacgcattgccaggtgctggacccccaaggaaccctacctgagggtgccctccccacgctcaacgtagctggggacagcggccaggaatttatacttcaaaggcgccacagtccgtggatcgacgtcctcgggagcatacagagcgatcatgtcgtcgtagcgagggtctatcacgcccgagatgcggacctcgacccactccccggctacgtgcgggccactcgtgttcaggtccagcctcactgccgtttcccagaccaaactcgctgcagccacattgaccgcagatttcggatgtggggtcgtgggaagcccatggccgtcagtcaggggagtgtgacctctggccagacctccggccagggcacagaggagatggatcactttgaacaggtgaaggatcatgatcaggtccacctctaacagactgcagtcattctttcggcatttccatcagtagatgaaatgcagcaagcaaagtaagagaagcacaggtcctttctcctcgggtcccccttgtcgcgcttggagtnnnnnnnnnnaaacagactgcagtcattctttcgacatttccatcagtaaatgaaatgcagcaaccaaagtaagagaagcacaggtcctttttcctcgggtcccccttgtcgcgcttggagtccttcatgtcgccacgtcccgccacggcgacctcatccgctagcaccatgagccagttgcggggcctggcacatgccatgcgtctggactcgacgcaatgccagcgtccttgtgaaatagatacacaccaccgtcttactagcttttggaaccgcgagctctgcctgcacccctgattggtctggcactcttgggccatgcagtctgcagcgttcagggggactcgggtgcagcccttcgtggcatgcgctcctctcacccgtagcctgaataccagtcgtagagctgcacccaccccgatccgcgcgagcttgctggcgcctgcagcgcctatcactgttcgcgggtgggacgggtctgagtctggcacgcagaacctctccctcattgtggcggatccagagaccagcaagggcttggtgcaccgatacctcgtcactgtgcgacagaacatgagagcggtgcgtgtggctggggactgttgaacgcgtggctggctggtcctgtcgctggccgtgactgggttttctacctccctgggatccataatcattgtgcaatgggtcagagtcgcgcccaacgatgcaatcgtacccctgcgcagggtacagccagcaccctgacgcgtggggaggtgcgcggaggtggccgcaagccctacaagcagaagggcacgggcaatgcccgccgtgggagcactcgctcgcccctcattgtggggggcggcgtggcctttgggcccaaggtaggtgctctgtttgaaggggaagtatggtgggaagttttacccggccaggccatacacacacactgtacaaactagaattgagggctccaagctctgcggggagatggacctgtgtgataagatgcctggcgtggactctgcgggccacttcactctatcctctctcatcctgcacacccagccccgcgnnnnnnnnnngattgagggctccaagctctgtggggagatgaaccctgtgtgataagatgccctggcgtggactctgcggaccacttcactctaccctctctcatcctgcacacccagccccgcgactggaccatcggcatgaacaagaaggagaggcgcctggcgctggccaccgccctgcagtccgccgcacccgacatggtcgtggtggggagcgtcgccgaggcggtgcccgaggtgaagaccaagaacctggtcgccaagctggaaagcattggcgtcttccccatggtgcgcagagtggggtgggagccggccagcgggtgtgcgattgctcgtctttgtcgacgggccggtaactaggcagccctctcgtggatggcgagcggcgactgcgctcctgcgccagagcctgccctcaatcgcgagttatgcttgtctgacacccaacgactccatgcnnnnnnnnnngggccagcgcgtgtgcggttgctcgcctttgtcgacgggccggtaactaggcagccctctcgtggatggcgagcggcgactgcgctactgcgccagagcctgcctcaatcgtgagtcatgcttgtctgacacccaacgactccatgcgccactcattcttcggcactctgcaggaggagaaggtgcttcttgttgtggcggagcccaccgaggctgtggccctgagcgnnnnnnnnnncctcattcttcgggactctgcaggaggagaaggtgcttctcgttgtgtcggagcccaccgaggctgtggccctgagcgctcgcaatgtcgagaacctgtctgtcaacagaggtgtgtttgttggaggaccatggactcttggcccattcacacctggaccctgtcttccccactgtgccgctcgccgcctcgccacccgttcacccctcgctgccaaccccactttctccctgccactatttgtttatctgccacctactcccccccccccccccccccccccccccnnnnnnnnnnctcgccacccgttcaccctcgctgccaacctcactttctccctgccactactcgcgtatctgccccccactcccctccccccccactccctccccatccgtacagccgaggccgtccggatatacgacctcctgaacgcggacaggatcgtggtggaaagcagggcattggactttttgaatgcgcagtttgggctggatctgggcgaggaggagccggaggtggagggcgagctgtcccacaccgctgcctgatagcatggagatggggcctgtgtctgcgcctggtgggcttccttgctcccgtgtgggtacacattctggcaggacctggtgcgtgtgcgtgtaccctgcttgccaggaatcgcgagcgctatggcattgagagtttttttttggggggggggggagcacgggcaggaatgatgatggtcgtgagtctgggaatgtcagtggggtcgagggtgtgtcagtgtgcaggcgagcgacttctcgccgcaggtccgcccgcgccgcccggtcagtccttgagtcgcgtggcgcgtggcgtgctgcgcacgctctgcatcagcgggtgaaaggcgcggatgagaccctccgtcccggtcatgctccccgcccgcgacagcgtgggcgtcgcctcgcccctcaccgcggaagtgggggtgcgcaggccacctggggtctggccgcccacctgagggcgcaggtgggggggagggatcggctggggtgagcacacatgcggcggcggcggtccagtgagtccccggcaccagacccctgcccagcgctggcggccatcagagcacccctgtctctgcttcccgtcacacacaacccccccccacccccctctcctcagccaagtcacaagcgccgccgcacacgccagcccaccttttgcgcgtatcgcgccaggctcttgaggtcgcgggcaggcaggaggaaggcggccacgatgctctccacgccctcctgcagcaccgccaggttctcccgaaccagggtctggccggagaaggccaggtcggcgcgcctcttccgcgccagcgcgtcccgctccgcggccaggctgcccagccggctgcgcgcgtcggtcagcgcctgtcgcgggcggaaagcggggcgccgacgtcaggaggggtggggcggtcgtccgccccgaccagggacacccctgcacgccggccccctcccgaccgtccacacgcaggcacatccgatgcactcgccgcggctgttcgtcccctcatcgccaacacacccctcccacgctcccccgtgcgcacccgcgacccggcgtgggcctggtcccggatgatgcgcaggcggtacgcacggtacgcgcgctgcactgtgcgcgccgcgtccgacacgcgcttgtgctcgcgccagctggcggccatggtctcgcgcgaccgctcccccgctgccagccggcgctgcagcgcgcggcccagctcccgctcgcgcgccagggactcgtgggcggcgcgcagggccgacgcggcgtgcgcgctgtggtccgcggcctggaggatctccgcttccagcgcgtccacccgctgctgcagctccctgcgaatgggtgtgggaggaggcggggggtggggactaatggagtgagggaggctggtgccagggtcggggccctgacgcttctccaggtgggatcaagggagtcagtgatggaagtcgagtgtcctttcctgccaagtaggctgggcttcctactgatgacaatgcggctcctggaatggccgtggcaacccgatgcccaagagcaaacgcatggagacccggcagggtccagcaagtcatacaaccccaaccagccatcaccatgtacatgcatcccacctgccgtaagcctgcgacctctccagctctccctccagcnnnnnnnnnnaggtccagcaagtcatacaacccaaccagccaccaccatgtacatgcatcccacctgccgtatgcctgcgacctctccagctctccctccagcctgctgatggtgtccctcgcctcacattcggcccgcgccgcaccctcctgcgcagcgaaaatctcaccccttgccgcctccttctgtgcacgcagctcgccctcggccttgctctgcggcacgaggtgggcccttggggctgggcccttggggctgtgtccatgtgcttgctgttaacaggccgagtccacaacccactcgtaggtcccacatcagcccgtcctcaactagcaacaacaggctcgacgcctcttccccccctatttcatcgccgacctggagctccgccaactgctgctcgtgctgcaccgtcagcatgtcctgcagtcggcggctgcccgccagctgctgctcggcggtggccaggcgtgaggccaggccggccagctcggtctccaaggcccgctgggcctcggcggcggccgcnnnnnnnnnncgtctacaacccacccgtaggtccgacatcagcccgccctcaactagcaccaacaggctcgacgcccctccccctcccatttcaccgccgacctggagctccgccaactgctgct

SEQ ID NO: 37039 - DNA, 117 bp, Chlorella protothecoides
gacggcgcgctggcggcttcgacaggagtgtcacagccagaggacaccggattcatattcgatgcggcgtgtgcggcccgaatgacttccatcctctccgcctttgaggggacccac

SEQ ID NO: 37040 - DNA, 79 bp, Chlorella protothecoides
acaactacgtctccatcccctgcctagcccatgcattcaccctgcgcgctgcctgcagcccctccacggccccacgctc

SEQ ID NO: 37041 - DNA, 15298 bp, Chlorella protothecoides
  modified_base (248)..(257): a, c, t, g, unknown or other
  modified_base (1029)..(1038): a, c, t, g, unknown or other
  modified_base (1372)..(1381): a, c, t, g, unknown or other
  modified_base (2525)..(2534): a, c, t, g, unknown or other
  modified_base (3542)..(3551): a, c, t, g, unknown or other
  modified_base (5777)..(5786): a, c, t, g, unknown or other
  modified_base (7009)..(7018): a, c, t, g, unknown or other
  modified_base (8441)..(8450): a, c, t, g, unknown or other
  modified_base (13739)..(13748): a, c, t, g, unknown or other
  modified_base (15013)..(15022): a, c, t, g, unknown or other
cgccgaggcgggcggggcgcagggggccgaggggcggggcggcgagggccagctgcgctcctcggccccggccctcgccccggccacgcccgcggccaacctcaccaggtgggccaaggtggaaagggggagtgggggatactggagagcagcgaggttgtcgagattgggggcaaggctacgcgtgccggaagatgtcacagcggaatggacctctgtgtaccgcgccgaggcagagtgctgaggcnnnnnnnnnncgggactgggggcagggctacgcgtgccggaggatgtcacagcggagtggacctccgtgtaccgcgccgaggcagagtgctgaggcgtgttgcgtgcgccgatgcgccgcctgctcctgcccgtgccactcagtcccctgagtaacaagggccccccaatcacacacccactgcagccctgggcggacgtcggaggacccgtttgcggagtttgatctgccgccgggcatcgtccctgtccccgctcaggaccgggcgcccgtgcaccactcgtcgagcccactgtgagcccagcaatggccgagcggcgctgcactggatctggtcggggccatcctgaccctggaggcggcagtcgagttgctcctcagaggaatgcccccaccatgtcccacccgggaagctcagcgccaagtattcacccatctcccgcctgcgtattgtgtgctggccaggccttgctagaggtccctgagtacctcattcatacacacccttcagcatgcactcagcgctacagcggcatgcacgcctggacgttgaaacacgagccctgtcccagtcactgctccattccggcacgccggtaccgccgcacgctagactgccgctgggcctgccgcaagggggacgcggggggtgcctcctcccccatgtacccgtcctcttccgacaggtcaaggctcagtccctcacctgccttgccgatgcctggggagggacgcgcccgggtgccacctacgacaggcctgtcccgaggccggaatgtcannnnnnnnnnctccgacaggtcaaggctcagtccctcgcctgccttgccgatgcctcgggagggacgcgcccgggtgccacctgcgacaggcctgtcccgaggccggaatgtcaccgcgcccttgcccggagcagggagctgacggtctgcaggctgctgttgcggcccactcagctcgctccccgactgttccatggcccctccctcgtctgggagctggggtggggtgggcggggcaacctgtgggaggggatgtcgagagtgacaaactgcgccgcacatactccggcatctgtggtgatggcagccggcgtcaaggacctgtgctccctgtgtgactcannnnnnnnnnttcgaaagtgacaaactgcgccgcacatgctcctgcatctgtggtgatggcagccggagtcaaggacctgtgctccctgtgtgactcagcaatacaggtaccaggccgactgcagaccctcttcactccttttcccgctcacttgggttgtggcggactcggccagctgcgccacgccacctccaacctggatctcctggtcgaaagtgtaccgcatataccgctccggatgccgcacgtggtctggcacaatcgagggggccacggcctgtccctcatggtccaagagccgacccttcttcagggcggcggggaggggtcctgatcgttgctgtggaggggggcccagcctcgaggaagtgcccgccccttcacccccagcctcgtccactggagtcgacagggacggcagggaagggtcctccgccagcgggtcggcgacggcgtccactgcgctgaagtcctcctcgccatcctgcaagatttatcgggtagatgaggggtgagcacacacaacataacccagcagtctgatcgcacttgcccagatatccacaggctgctcaccacgactctgcagaaggcgtatgagggggcccgatctgggtcttcttctagaagctcctcgatacctgcatggggtggacatacttgaggcccgctggatattttcagcctgcacaacaggcatgcgtctgacataagcacgctcagcttaccttccaagccttgccgccgacgctcctccactttctcgtcctcatcatcgctgtgagtctctatccttccggccctgaatacaggctggagtgtcggcagccatggcttcgtagaggagcctgctccctccaggcccccgaacaccgcatcgagtctattttgcagggccttagcggtctccatttggcaaagggacttccgtgaaatgttttgtatgtgtaataagtgagatttcagttacaaaattccgaagtcggtgaacactgtccttctgctttgcatggcgcgctctcgggaggtggagatcgtcgcgcgcaagtgggaatttccagatctacctcgccgttttcccaacctataactttcattgttagagtagtctctgacttggttagtcgacacccccagatcctggcacttaagnnnnnnnnnncataaaattccgaagtcggtgaacactttccttctgctctgcatggcgcgctctcggaaggtggagatcgtcgcgcgctggtgggaatttccagatttacctcgacgttttcccagcctataactttcattgtgagagtagtctctgacttggtcagtcgacacccccagatcctggcacttaagatccaacttctagagaggatcacaaaagggactttcctatggagcatgtcacttgctgatcttgccaagctgctttgttagttgtctgactttgagtgctgcctggttgttttcgccttccccaagttgggatgcttgctggtacgcctcgagtgcctgcgacggggatggcataggtcacagtggggcacgtacacttgggctgtcccagtgtgcaatacaaataccttctcagcatagactcctctcttccaagcacatcccgtcctacctcctggcccttccctgctgcttctagagccagacccttccgaaagtagcctttatcccagtcaggccgtagactgatgcaggcctccgcatcagccaaggctttcgtgaccttgttaagattcagcagcgccgcgctccgattgctgtggtgatgttgggagagtcgccattcacatgtagggattgctatcggtatagaggaatcgctgaaacatacctgtagagcgtcgcgttcttgggatcagcctgcagtccgtgtgtgtataaggccgctgccttcaggtagtttcgtttcgcatactcctcgttgccccgagccttgtaagataccgtagcatcccccatggtcttgcacatgggtatgggtccgatggacaagcggtgcggtgacgggacctcgcggccgagcacccctccttggttggcagagcgccaatgagattccaagggtataatattactttttggttcgggacatgatggtcaaagggtgcaatttgcaggtcgatcgctgcaacattccttgtcatcgtctcgtccgctcggagtnnnnnnnnnngttccaagggtataatattacttttgggttagggacgtgatggtcaaagagtgcaatttgcaggtcgatcgctgcaacgttccttgtcatcgtctcgtccgctcggagttcgcgccctgcggtgattttcaaagccaagtgatctcgggcttcgcaccagtcaattcatactcacttccctagagaatcaattcaccactacattacaccagttgtcccatgaatacgacacccgcctgaagtcgagcaaagggcatagatgacggtccccatggaggtggagggacctgcctcaaagtccgtgacctgggggaggggtggctgagcgctggaatacagcccgagaagcaagtttaagcttgaatctttcatcaaccgcgcaggccgtcctccaagtatgacgatctgctgacacctgcgagcacccttgcccggacagagcccctgacccgggccacagcctcgtacaccctgcacgacgaccgattccagctgcagcagcgagtgtacgatcggcaattcgcccagctgtacttttaccgactcctgaagctgcgccccgccgtgtcagcctccgccaagaggcgctggccctcatgcacaggtgggtgggcactgcagcctgccgtacattcaagtgggcgacacagggctgatccccgctgaattcaatagctaggtagaggctgggcctccgggaggagtgttgccatccacccattccccccaccctttgaacccccctgcacacaccctccaccacgcagaggtgcgagtgatcgacgccgtggaggatgtggactgcgtgctggtgggcacgctgtacaaggagatgaagctgaagccgagcatcctggacgagtatgtcaaggacaagaccacccagcagcacctcggtatggcacctggcggggagctgggggccagcgccgggctggctcttggtcatgcaatggaatcgggatctggtttggaaaaagggatgtgtcgatagccctcctgccctgtcgttgccgtcaaccctgctctcgtccccctgatcaccctttcgccacgccgtccgccactctccacactttcccacacactgatacaggccgcacccgcttcacctcgcccgacgacaagctggtgctggaggatgagggagctcgcatcgtgctcaccgggccggtggtgcccaccgcctccctggtcacgggggtggtggcctcggtgcggggccgcatactgcccagcggcgagttctgcgtgtcggaaatatgctatgcggagctgggggcgcagcccgtggcacccccgcccctatccctgcattcccctggctcggggccacaggtcgcccgcgcccccgcaaggtgggacagtgctggagggtggtggcggggccagcggtggtgccaaggggcccgcagacagcttcgaagatggcatgcatgcggcgcggcttcaccccctcgcagagcgtccatgcccctgcccactccttgagcatcgaaagttcccaaaccacctcccacaaggccacacaccggcgtccacccccctctccaccccatcacaggtacatcgcgttgacctccgggctggggattggggatgcgggcgccgatccgctgccgctgcagctgatggtggactacctgacgggggcgctggggggcagggaggagcagaccctggcgtcgggggtggtgcgcatggtcatagccggcggcctgctggcctccagcgcagcgctggcgcgggcggggacctacgccgatgcgcgcacgcgtgagggcgcgctggcgggcctgcgcgacgccgacgcggcgctgagtcagctcgcggcggccctccccctggacgtgatgccgggggaggccgaccccgccaacgcatcgctgccgcagcaggcgctgcaccgcgcgctgctgccctgggccgcggccgccggcgagggcctggtgcgcgccagcaacccccacgagttcgacgtagagggcgtgcgtttcctgggcctgtcggggcagaacgtggacgacgtggtcaggtgtgtacttctgttctggggggggtgggggagggtgtagcacggtatgtgcctatggatgtgcttggggagtgctgaaagtggttggagcatgggcggggcagggtgaaggcctctttggtgaacggagctcagcggttgcatggaccgtagggcttctgtggcaccccatcgccgggcgggtgcattgnnnnnnnnnntctctttggtgaacggagctcggcggttgcatggaccatagggcttccgtggcaccccatcgccgggcgggtgcattggactgctgccctgtcagtcacatgcgacgctgcccgcgctctcatgaagcatcacccgcaccccttctcggcaggtacgcggagctggacgaccggacggaggtgctggagtggatgctgaggtggcggcacatggcgcccacctcgccagacacgctggccgcctaccccttccacgaccgcgaccccttcgtgctggacacctgcccccacgtcttcttcgcggggaaccagccggagttcgggacgcggatggtgacaggagaggcggggcagagggtgcgtgtcgtctccgtgccggccttctcggtctcgccatgcctggtgctggtgaatctcaacaccctggcctgccaccccatctactttaacgccgagtccatggacacatgattgttgtaacttcaagacgggaggggagaaaggcctgaggaatcagctcttgatgccaacctgggtgaaatgttgagtcaggatgaggtgttgagagacaacatctgtcctccagccacttcatatgcgaagacgaccccaccacggggtaacaagtgtgcacgagtccctgcgcattgcggcgccaatcgctcagctcggttcattttgtactccagagcactctaatattcgatgtcgatcgaggctggaaggtcaggaacctgggcatgtttgcaatgtcgagcaacggatgtggcacggcttcgcgcgctccgcccagaattttcaaattgcaccacgacatctcccccgaccatctgcgcaatagggtctcgcaatggaggcttctgtgaagttcgagtctgtcaaactacgtaatcaacctcgcatcgattatttgaccggcttcgacgcccctgttgctagttaacatgacttaagcgtgggggtctcgcgacctcggctgcgggtagcatgttctactccacacagattctgagtcggaagggtccgctcgcaacgatatggatcgcatcccatcttaacacccggctcaagagggcgcaggtggtcgacacgagcattgccggctccgtgggtgcgtatgtgccagcaggcgagggaggggtcttgtactgtggttcactcaacctccaccgtcgcgagtaccgccccggacagtcacacagctccccttgtgtctgcatgannnnnnnnnnctgtactgtggttcactcaacctcccccggcgcgaacaccgccccggaaagtcacacagctccccttgtgtctgcatgatctacctgaatcgtgcgttcgttcaagtgctcatcgtatgctcgtgcagactcggtgctgaaccctgaggcaccactggcattgcgcctctctggacagcttctgctgggcatcgttcgagtctacatccgaaaactccagttcctggagtctgacgccaaggaggctgtgacaggcttgcaagaggtactgcctgggtagcgaatgcacctttgggaggaatgccgacggcgatgcttgactgcgaggtcactgtgtcttgccaatagcacatatgcaccctggctcgcccccaccccacacacaatctcctttcatcacagctggagacgcatgcgcatgtggcagaggttcggggcgggggccgggcgcccgaggtggccatcaccctcccccctctggaggcactggacctgtttgaccccgaggcgctcttcacgctcggcggcacgctgtccaggacctcctcctctcgccgcacctcctcggccggcagcgcctcgctcatcaccgcagatgacgtgtcagaggtgtggggcccctccagccagggcggcgccggcggctggtacaacccggaggccacctttgagcaggtcatcccggacgatgagatggatcgccggttcagcatcgagctggagcgcctgaggtcccaggcggcggaggcgccgcgggccgacaaggccgcagacgccctctacgtcgaccagggcccagacgagaggggcggcggcgcctaccttcatggtgtgtttgcaggggggggggagtcatgggtggatgggcctgggagccacccccctcgtgggagctggggcatgcacaaacacaccaacacccacctccattcatgcacagggggtgacgagacgctcgacgccgcgccctctggcttcttcgacggcctgacgcccctgaagaccccaaccagcgggccgccctccttgccctcggccgggccggggtcggcgcccctcccggggatggagggcgagcaccccggaccgcatcgcctttcagacgtcctgcctcccctggacgggacgcccggcgcggatgcaggcggcgcgcaacctcacggccctcgcggcacgccgcccggcagccaggacaggccggcgcggcggggcgagggctcccacgcccacgcccgcctgcgcaggaagagggtgcagctggatgtggacgcctctggacgtccggccaccgagctgccaggtgggaggagctgctcttgagaagggacagacagtgttttggccttgtgggtcgttgccgggatgcctggaggccaggcttttgtgatgggggccggggttgcactctgcagcacccagcgcnnnnnnnnnnccctggaggccacgctttcgtgatgggtgccggggttgcactctgcagcacccagcgcgctgcaacctccgcgccaccctcacgacatgctccgcacgccgcacacgccgccgtcaaccgcgccgcccgctgcagccgcggagatgcgcgcgctgatgctggaccactcctccctcctcgccacgcggggaggctttgtggggaccggggcgatgacgactgtccacgaggtcagcaaagaaactgggtgtgtggccagggttggcccattgttctctgattctgcacccgaccatgagatcgacgtgcctcaggccccaaccacctctcgcagatcgacctgagcctggcggaccccgctgcgcctgggagcggctgccctggcctggcgccggccctgcaggccctatttgcccgagctctgtccacccaggcgccacgccaccatttcggtgccggaatgccgggcgacgcatggatgactcatgacgagctggccagcgagccggcggaggcgcgctggcccgatggcacccaggggccgatggagggggaggcaggccccacccagggctcccaacagctcgctgcctgggaggacgcaggcaaggcggcatcctggggtgtataccaggggcctgctccccgccgctggggtccattcgtgcagagcaggaacacctccccccacccaatctcaccaccctcgtgtgcaggggcccagggctacgaagctgacatgtggcaggacgacatgggagcggccagcctcacgcccgcatcgatgggagtcagagatgtaggcgaggggactgcagcagggattcttggcggagaccccgccctgcccccgctgctcgagtccgcccctggctccgccccaggtgaggtgtccctgttgacgacggtgttggggaatgctcgcaggccacatcagcaaaccctgccgcaacctcgacggcagccttcgatgctcacgtgcaacccacccaccccccactggccacaaaagtaggcacgagcggcaccagctccggcgccggccggcccgacggcttcaccgccaggacccaggccgtgctggagaccctgggcgcgcgcttcgcgaccccggacgtgggggccaagcgacgcaggggccgcgacgcctccgaccccggccaggccacgcagctgggcttctcggcgctggtggcaggcaggggccgcagcgaggccgcgcgctggttcttcgagctgctggtcctgcaggaccggggccacgtgcggttgacccaggagcaggcctacggcgagatcgccgtgcagcccggcatggccgccgtggcggcgggcgccgccgccggcaccccaggccggagaccgctgggaccgcggaacgcggcctgagcacgcgtggcctgagcacgcgcgggcggcgggcgcccgggggcgcgccccagactgacagcctgcgcactgacaccccgcagacctgaccagcccatgacacgttgtacgattgcccattgaattgccacctcccctgcccgtttgtgttgcagcccagatggccagggagccgcatccagtgtcagtcaggggtttgggaggggccgcgatgcctgcaacatcagacgtgcctcgacagaggccgagggcccgtgacggggcccctcccgggtcaaaaactggcccacatgctatctacccctcatcgcaatcttccggacgccgggtttaagagctggcaaatcgcaggacatgcacgctgcaggtcgacgtacaggaccgtgtccactcttcccatccctctaagtacgtgctcgaggtgcaagcaagcccgcatgccccacgcatgacctggttgcgggtactcacccccaatccccccacaacatcgcaggatcagccctctgcaatgccggtccaggtccagaacctgttcaagaaggccccggcccccatcaagaaggctgccaagaaggcggagggccaggtcaagtccaatgtgaagaaggtcgcgcgtaatgtgccctccccgaagcagctgcagaaggggctggccaagaacaccgggggttggctggggagcaacagctcctccaccaacctcagccaatggtgggtggcttggaagagtgcaatgaaacggcatgtaagcaaagcatgcacggactgggcccctggacagggggtcgaggagcggctgggttggctgctcagcaaaccggatgtgctgcatgtggtgtgccccctcctcgtcctcctcgtcctcctcgggcccaccagagtcccctcatcccacccaggtatggccccgaccgcgcgctgtacctgcctgacggcctactggaccgggacgaggtctcccccgtgctcaacggcaccctgcctggcgactacggctatgacccgctgggactggccaagaactccgagacgctggagaagtaccgcgccaacgagctgctgcacgcgcgctgggccatgctggccgcggccggggccatcatccccgagggcctggaggccaacggcgccaacatccacggcggcacctggttcgagacgggggcggagatgctcaacggcggcacgctcaactacttcgcggtgccctggggcatcgtgggcaacccactgcccctggcgggggccatcctcatcgagctggtcctgctcttccaggtggagaccttccgcggcaaaggtgcgaggaacggaggggggtgcctctggtgtcgtctgatggggaggtgcgtgcgatgaggggtgatctacttgtttgtactccatgtggcatggggggggggggaattcctgttgcttggcctgaggcaatgctgtcgacccggcttgtactgcgggcagacctcaacatgatgtttccatttcttgtttcaaataatcaaagtacagtcggtgtgtgccaacactctcacaatcagcaacatgccaggcgtttcgaccacccccacaccacacaggcactggcccccctggctactcccccggcgtgggtaagtttgagtcgtcggacctgcagggcctggaccccctctaccccggcggtccctttgaccccctgggcctggccgacgaccccgagacctttgccgagctgaaggtgaaggagatcaagaacgggcggctcgccatggtggccttcctcggctttgccgtgcaggcgggcgtgacgggcgagggtccgtttgccaactggtccaagcatgtggctgacccctttggctacaacctgctgaccatcctggcaggggaggaccgcctgccctccctctgagcaccttgtagcttacctccccatgcccccacgccgatgtcgtgcgcttgcttgcgctgatgaattgcagtccagagaacaaggtagaatggacgagctcgacacgaggcacgcaggggtgatgagctgggtcgacggctgccttgaagagacttggtgatggggaattccaatgggtcacagacggctgtcccagaggtggcccagttgacatggagcatgatagggtgcgtcagactagaaggagtcaagtttttacagaggagtgacagcaatggagatgatgtggaggagcaatggaggggaatagaccagcatgttggggttgtagtgagcagaggtgctgtggcagtccatggtgtgagcaggttgggtctcgagcctgcttcgaccatggagcggtgcccctggcgacactcaagctgggcccaagcacctggccgcgcttccttggcacctggcccggtcaacccacatttcgaaacaccagcactctcgaacctcctggatctaaatcccatatccaaagacctggcggatgcggtggaagatctggttggcccagccggcctgtgtcaggcccaccacgtcgtgctggccgaagcggtcgcagtcggggatgccggtctgaacgaggtgcagggtgacggctcccttctcccgctcctcgatgtcgatggtcacgcagctggtgtcgccctccgcccagttgctgaagcgccagtccatgacgatgcgggagggggcagtcagctcccggaacacgccctgcacgctgccgccaaacatggagagcgcgccgcccacacgtgcgtccagctcggcggggctctgggtgaaggccagcacacgccgcgcgtcggtgaagcactcgtagatgtcctgggccgaggcgtagaagcgctcggtcagcttgatgcggcggcggtcgcgcggcgcgcggccgctgccggaggcggccggggcatcggtggcggctggggcggctgaggtggcggcgggggcagcgccgcgggcagctgaagcagccccgttgtcggaggccgcctcgctgccgcccttggtcacggggccgcccgccctcagctccgacacgaactgggacatggcccggtataccacctggagcacacaagtggggaggtggaggacaggccgcagagtctcgtcggtgacctcgatcaatgccaggggtgcccagggatgaccagcgcagattaatgcacactcaagagctggaagatgggggtgaagactgcaagagtccccccaaactcccccccgccacccctcaacccaagaaactgaacaacagccccagaacgcaccggccggccatgcttcacaatgaggtccctgactgcctgccccgccttggactcctccttcaggctgaccaggacctccgggtcctcatcgtggttctcctcgctgatgtagggcagcttcagctcgcccttgaccttggcgccgtcgggcgcggtgccctcccaggccagcactgcctccagctcgtaggcgacaatgatcttggacttgcggttgttaacgatggcctcaccctccagctttttcagcttggtgatggtgacggcgggctggtcctcgggcaccagggactggcccaccagcagctccgtcagccgggtcttgctccagggcagggcatccctctcgaccctgcggtgtggggttgtgggggccaggcggtggtccggcgctgtacgggcattgatgatcgggggtgccaaacaggaggccctgatgccttcctggcggcctcaccagtgccagttgttgacgttgcgcccgtcctgccccaggtccttgaccagccagcgctcatcaccctccccgaacttggcctgtggcgcgggggaagggcgatggagcaattggtatggggagttggtagaaccaggtgatattttatcgttgccgtactcaacacaccatcctgcatcgagtgatcagtgccgactggactggccggacagtgccactgnnnnnnnnnngggtatggggagttggtagaaccaggtgatgttttatcgttgcagtacccaacacaccatcctgcatcgagtgatcagcgccgactggactggccggacagtgccactgtcgacgctctccacgccgatgatctccccaggcccaccatacccaccatgttggaggaaggagctcttgtgtatggaattaaatccgtgacatgggtgctggaggaggacgaggcccggcccatcgacctgtataggacctcaccgaagttgctagaccgcatgctgagcatgcggaggcagacggtcccggctggtattttcccccagcaggcagtgctggaacagcgggcgcctgcctacgcatcaatgcccaggtgagtttgcgagctctccacacccggagtgcatcaggctggcctcgccgttttctctgctccagcagcctgctgtcacttcccaggaacaccccaggctcacagtccatcacagcgggcatcacagcagctcatacacgttctgggggctgccgttcagcagcccctccctccccgcggccctcagctcgctcctgacctggaccagcagcctgcccagcatgttgttccccgtacccgtcaggccccgcccccagaagtagtcatgcggcgcgtcctcctgcagcggcgcgtcccccgtccccagcagcgccgcggcagcgtcggggtgggacgcgaacttggcgcgcaggacgtgcagcatgaccgccaccttggccctgtgccagtcggggcgcaccaggcgcggccgcgcgcgctgcgcggcgcgcgccagcgcggctgccgcctcgggcgagggcgccgcggcgatggcggcgcgcagggccgcggcggcctcgccggccacgcccgcgaacttctgggcctggtagtagtgctccgatgtgggccagaggcgcgccgagcttgcgtggggcgcggcgcctgcgaccccctcctccccctcgccgagagggcacacccactcgtccaggctggcggtcatgggcgcgcgggccggcgcagcgtggcgcagcaggtctgccgaggtcagcggcgcggcgggcaggcacaccgggtgtggcgagaagttgctcaggcaccccagcgcgtcccagcacttgtagaagaggcgcggggccgggggcgccgggccggccggggcctgcatcgtgggggcgggcgcgggagcggccgggaccgcatcgtccggctccgtcggtcggggtccctgctgcacctgctgctgctgcgccggcnnnnnnnnnnccgtcgtccggctccgtcggtcgaggcccctgctgcacctgctgctgctgcgccggccccgtctgcccctggccccgcccggggagctgggcggcgaggagagccgccgggccgccggagctgggcaggtagccctggcagaccacatcgggcccaaccggccgccactccacctccgccagctggagcgcctgggtcatctccacgaagcccagctcgcccaggggcgtgggagccagcacccccccaatcttcccggtgagggatgaggtgatg

SEQ ID NO: 37042 - DNA, 153 bp, Chlorella protothecoides
ggggtgtttgggggggaggggggttgctaaacgacaggagatgggaaaagtgacttcacaccgccagcacggcgaccacagggagctatgctgtagcgggaacgccacacggggggccccttcgaagcgatccagggacggtagcacgcaccg

SEQ ID NO: 37043 - DNA, 61 bp, Chlorella protothecoides
ttgctctgactagacaattgaaaggttgcgcaaggcaggcgtgccggtgttaaagtcctga

SEQ ID NO: 37044 - DNA, 79 bp, Chlorella protothecoides
gagagggaggcgcaggcgacagagcgtcggcgccgcgccctccaggctacggctgagaaggggatcgaggagcgggcgc

SEQ ID NO: 37045 - DNA, 68 bp, Chlorella protothecoides
cccatactcaacactggacccccccttctcctgcagagatcgcggccgccatccgtgccggccgcatc

SEQ ID NO: 37046 - DNA, 125 bp, Chlorella protothecoides
ttcaaggtgtggagcctggagcgggctgcagggcaaaaagggctttggcagggcaggcgacgagcaagcatgggggcccgtggatgcggtgttgggtcgttggcgaggcccatgccagcctcccc

SEQ ID NO: 37047 - DNA, 11409 bp, Chlorella protothecoides
  modified_base (1458)..(1472): a, c, t, g, unknown or other
  modified_base (1688)..(1697): a, c, t, g, unknown or other
  modified_base (1765)..(1774): a, c, t, g, unknown or other
  modified_base (1842)..(1953): a, c, t, g, unknown or other
  modified_base (2611)..(2620): a, c, t, g, unknown or other
  modified_base (3183)..(3192): a, c, t, g, unknown or other
  modified_base (4072)..(4081): a, c, t, g, unknown or other
  modified_base (4243)..(4252): a, c, t, g, unknown or other
  modified_base (5797)..(5806): a, c, t, g, unknown or other
  modified_base (6394)..(6403): a, c, t, g, unknown or other
  modified_base (7035)..(7044): a, c, t, g, unknown or other
  modified_base (7424)..(7433): a, c, t, g, unknown or other
  modified_base (8317)..(8326): a, c, t, g, unknown or other
  modified_base (8629)..(8638): a, c, t, g, unknown or other
  modified_base (9627)..(9636): a, c, t, g, unknown or other
  modified_base (9715)..(9724): a, c, t, g, unknown or other
  modified_base (10588)..(10597): a, c, t, g, unknown or other
gggccggggcgtagggggttggggggaggcttgtgtgcagctaatagtgcgggtggtctgaccgcgccgccagaggcgtgggcgaaagatgcagtgtctgcggatgccaaagcttgcagccaattgtgaaactctggtcacatgcctgtgctccacctccccctgcacctccgtatccctgccgctcacctagagccggggtcgagtcggtactgcctgccacgctctcctttcctccacttgttgctcatgcggccgatcaggagggtcccggagggcgacacctttccgtcgttgaacctgaagccctctgcaaggaggattcgtggtgtgagcatgagacgcatgtgctgagaaggggaaccaaaggcaaagctggaagaggtagcaggcagcctgctgcagagtccacccgaggccggcagagatcccccagcagtgcatggtgtccgccagcaaatacctatgagacctgaaccagcccagcaagcatgcgaggacaagggcatccacaagctcaaaccctgcacctgtgccgtgctcctcgggcgtggtggcgatcgcctgcttcgtcaccttgcggccaggcacgtcgaccaccaggatgtccctctgtgttgccaccaggatctttgtggggtcgttggtgggcacgatcgtcccggtcggctcatctgccttgatagtgaagtgttcgccagtctctggctggaagccatggatggttctgccatttatgtcctggagttggtgaggagattgaagagaggatatgttggcatgtggatcaaatgcactggtgagtagaacgcatggttgacttgcttggtgtcctctctgtgatccccggcggaccgccacacaaggaacatcgtcgtcaccgcattgggtcccactcgcacgctcggcgccatgcgagatccacgaaaccccaggtgccaaccgatggcattgacatctcaccgacggacagtctcgacacgaagataaactcaccacgaagtacagggtgttggtcttgccatcccagacgggggactcccccaggtcgcacctggcttccaaggcaagatcaacggtcacctcgtcctgggatgttgccatgctgcaaccgatggagatgcagtcgtggtagaagtgtcggaattcttcgatccgagactgccaccccatgactctattggccatccttgtgacacccatcggcagtgggtcgcagcacgcacctcacatccgctgatgggtgagctgagggtgtgacaaggaactgccgggccctgggaggacatattgcgaacctcatggaggttgggagaccactcggcatcatggaatgctgacatcgcggtgccaaccctgctcgaccggatggcggggggggtgccagggccgtggtcgagacaggccccacacccgactgacgggtgcgtccggccccagagctcgtgagcgacgctnnnnnnnnnnnnnnncaggaatctgagcttgacgctgtctgatgaatccgggagcaagaaggtggggcggtttagaaagcatggagctggaagcggtgattgctttgcacatgacctgggaagccgaccgatgccaaggtagctgttgtgcactttttcacccaggggaaccgcctcatgggccggtgggccagggggctgctaggtccatcgccctaaccctcacatgannnnnnnnnngtcatggtaccatggacgcctcggtggtccaggagatggaaggtgatgaggatctggcggtgtgcgtnnnnnnnnnnttcatgatgccatggacgcctcgatggtccaggagacggaaggtgatgaggatctggcggtgtgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgatgccaaggtagcttttgtgcacttttgcacccagaggaaccgcctcatggggcggtgggccagggggccggtgggccagggggccgctaggtccatcgccctaaccctcacatgatcttgcaggacgtatgctccgccggccctgccctttcccgccccctctagctccctcagcttccactcgcacgccctctgcaggtgctggacgacctgacgctggaggtcaagcgcggctccctgcacatgctcctgggcgccaatgggtgcggcaagtccaccttggtccgagccctggccggcctgctgcagcccgactcgggcaccatttccctggccacgccccacgcctttgtcttccagaacccagaccaccaggtggtcatgcccagcgtgggcgccgatgtggcctttgggctgggcaggcacgtgtgcactggaggggtggaggtctggggtactcgggtgttggaaggaggccagccatggctgttctcctgctgcctgcgcccttcagtaccgagctgtcagtcgtcacctctggggaagtacagacactcacaaacacccgcagacccctcccaaacacacacacacaacgttcaacattcccttaggtacccgggcctgacgcatgacgccgtggacaggctgacnnnnnnnnnnacattcaacattccctcaggtacccttacctgacgcatgacgccgtggacaggctgaccgcctcggctctggcggccgtggggttagagggcctgcaggcccgccccgtgtccagcctgtctggcgggcagaagcagcgcgtggccattgcgggggcgctggcggagcaggcggcggtcctgctcctggacgagctgaccacgttcctggacgtgggcgaccagcgcggcgtcctggactgtgtgcgggccgcggtggacgccggcggcggccgcggcgccgcgctctggatcacgcaccgcatggaggagctggactgggcggaccgggtgtctataatccggggcggcagggtagctttcacgggcacgcccgcgcaggccaggggccgcatggcggcatggggctgagcggggttggtttggggggttgtggccatcagaatgcaacgatcgttgccacgtgacattgggacctcagcatgtaatcggagatcgcggacccgctgtataagagcctggcacccccgagactctggcccactcctggcaatttaccgttcnnnnnnnnnncatgagagcctggcactcccgagcctctggcccactcctggcaatttaccgttcgtctcgcgcccaatcacggtttgaagtgcctggtctctgcaccgatgcactccccggcctatgacaagcaagacccaccaatagccaattctaatcattctagagcgcatgttgctattgatcatgacggtggacagggcatgtacgtgcagtgagacgagcgcaatgtcgacgggtgggtttctcccgatgaccgtgccaacggcgcagcgctgctcccttgccggcgtctaggacggacaggcgattctgacagtactttagcaagagaaataagtgcattaccagccttttggtttctccagcatggaggtagggaggaatgatcctgcggcctcccaagcccagtctgggggtgcaggggtgcactgcttaaacattgacacattttgcaagtccccactccactcgattcccgatatcactgtatttcccaacattcttggacttcaggtgacacggcataatttgcaagagctcatgcccaccatccgtgatgccatcgaccatgcctcctttgttgctgtggactgtgagatgactggcctgtttgactacgaacccaagccatggtacctggacgacatgcagacccgctatgaggatgtatgtggggtgtggtgaagggatgctgctgggtgtggttggtaagtgcattgctgcagccggcttgcatgctcttcctggctgctggctagcctgtgacccgtcaacctggacaaacctcgccgggcctgcctgtacacagttccttcctatcagatgtccatcctgagctcctgttcctgatagcatcgcatccgatgcccctgaaacaggtcgctgnnnnnnnnnnaaagggggaggaagaatggaggaaacaagcttgggatgaagggttgcagtaagttactgggcaactaggcttcactaaggctgggttggaaacctggcatgtgcatttactgcaccctgtatggcaccatctgaccactcaagagctggggtagatgctagnnnnnnnnnnatgggtgtggttggtgagtgcattgctgcagctggcttgcatgctcttcctggctgctggctggcctgtgacccgacaccttggacaaacctcgccgggcctgcctgtgcaccgttccttcctatcagatgtccatcctgagcaccgcatccgatgcccctgaaacaggtcgctgccaatgcacagaagtttgggctcatccagatcggcctggcggcctttgccccgagcctcacgggcctgggttgggttgccaagacattcaatttctacctcttcccatgcgcactggagggcactgaccgtcgcttcctgtcacaggcatgtggttgattgaagggggaggaagaatggaagaaacaagctcgggatgaagggtcgcggcaagttgctgggcaactaggcttcactaaggctgggctggaaacctggcatgtgcattcactgcaccctgtacggcaccatttgaccactcaagagctggggtagatgctagggctgtcctctccactcagggtgagccccagcttcagctcagtccgaccacccatcgctcacccttcccaggcctcctccctggaattcctgtctggctgtggctttgacttcaataaatgcattcgccagggcgtgccatacatgacaggtagggcgacttccttcaggctggagaggtagtccccaactattcccctgtgcaccgagtatggagctggcagccactgctggtgtcgactccagcatccccgcctgacccctgaccctcccctcccttgcactgtgcagctgtggccagagacgcgaggcttgcacgtgtggctcgagaggccagcgccgaggagcgtgcctcccagcagcccccgatccaactgacggcccagcgagacatcgacttcaaggaagacttcctcgcccgcgtcagggattggctggcggtgcgtcgcatgccgggttgaattgggtggggtctggttgcacgtgcatgatggcgtgccttggcgagggtctgaagcggtctgtgtagaggcaggttccatcagactccctagcacccgggccacaatctctgccgtaatgccatgcccaggcgctccgaatgtctgcttccccccaccttcaccatgatgtgcagtccgacacggaggaggcgctgctgctgcccagcagcaactctttccagcgagcggtgcaacaccaggagctgcggcggccccagtttggggcgcccgacccgcccggcttccatgtggaggtggtcaaggggcctagcggctacaaccagctgcggctggtcaaggcagacccggaggtagcggcggcggccagggctgccgcgacgtccaaggcgcaggctgacatccatgccgcggcaggtcagcgacgatgggtgaatgggcagaagttatagctttctggacttgcctgaatgggatcgtggaaactcttccttgctatgccagcgagaaccagagtgcagacccagcagcgcttctccccttcgccctgcacacactctcccatgcacacacaggcttcacggcggtnnnnnnnnnngaagcttcctggccttgcctgaatgggatcatggaaactcttcctttatatgccagcggggaccagagtgcagacccagcagcgctttccccttcgccctgcacacaccctcccatgcacacacaggcttcacggcggtgctggagatgctgaggggcgctggaaagcctgtggttggccacaacgccttcttcgacctggccttcatcctttcctccttcgccacccagctgccccccagcctccgggccttcaaggagctggtgcgcgcctggttccccgccggcttctgggacaccaagcacctcgcctgccagctccaggccgcgcagccagcggcagcgccggaggacacgagcctgggggcgctctatgccgatctggaggccagggccgcgggcggcgtggcaagtgatcccggtgaaggggggctcatccagaccgcgccgctacccaccgtgggccacagcgtcacgtttgatcgctacgacgtgagatgggagaggggggtgggtgttttgttcttggggggagagggttgccaggaagggtgtgatatggtgatgatgaagcagctctcgggggatnnnnnnnnnngagaggattgcaaggaagggtgtgacatggtgatgatgaagcagctctcgggggatgcttggcaagtcgggcctgacaaatttaccttacacaagtaggcccggcaaccccacccacccttcccaaggagccctctccgcgcaacactccctcactcacacacacgcctcgtagtttgcgggcgcctcgatgctggctcatgaggccggctacgacgccttcatgacgggcgcggtctttgcccgcctggccgtgctgctgggcggcgcagagacggtgcaggcggccctccccgccctggccgccttgagggggcgcctcaatgtcaccaggtggggggggcggtgcagggtggggcccgatgccccaagaccccgggtcgctgcactgatgcattccccatggggctctgcctgtgaacaggggggtggttgaacttgcatgcaaatttgtcttgccaatgggccacttgggtctgtggagtgagcgtcatttggaggttgcccatgtggtggctggaacgtatgcatgtccagcagtgaaatcatggattcctgcacgccaatcgtcccacagagagtcaattgtctgctcttttctgacctggtctgcgacactccagaatcaccccnnnnnnnnnntggtgcagggtggggcccgaagccccaggaccccaggtcgctgcactgatgcattgcccatggggctctgccagcggacaggggggtggttgaacttgcatggaaagtttgtctcgccaatgggcccttgggtctacggagcgagtgtcatttggaggttgcccatgtggtgattggaacgtctgcatgttcagtagtgaagtcatggattcctgcacgccaatcatcccacggaaagtcaattgtctgctcttctcaaacctggtctgcgacactccagaatcaccccccccgcctgctcaccctcgccaggtctgactacgcctacatcgatctggagggtcccgatcccgagcctaggcggcccaaagtgctgtggnnnnnnnnnngcctgctcacccttgccaggtctgactacgcctacatcaatctggagggtcccgaccccgagcctaggcggcccaaagtgctgtgggtgtctggattcgaggccggcagtctcaccggaggaagcctggcacggtgtgttgactggagactgggtttcactggttgtggtgtgcccttttgccgatggaaaccatgggtgcggtgggcatctggaggtcatcccgaggcgctcatgtgcggcgctgccattgctcgccaccggtgatacctctgtcatcaaaaactatctcaccacatcctccctccgcgacccaggcgagtgaatgcacatcagctgggatccactcgctcgacggtgctgcgcagcggctgcgatgcatttgtggaattgttcgagaccagcgacgtccaggtaggttggtcttacatggatgctggcggctgcggtccaaaagaggccaggtgtctcgtgtgggacacttgctcttagacctttggtgacattcctccactcagctgctgagaggcaaggctgcaaccccaggtctgacctgacatccaaacacaggaagctttgaggaagctgcagcagagcttgaagccctggcgggtcgacacctatgctgcctacgctgcacaccgggaaacacggctactggaggaggagaaggaatggaatgccgctggggcgagggtgggcagcaagcggccgcgcgagactgcaggcccatctccctcggagaagaaggaaagatccatgtgtgcagtcatgtgatgcagctgaagacagtaatcttagcagtttcctcccaaccacatcgatctgtcagcctggctcttgcgttgcacatgtgctcaaggtgtcaataactatgacttcatnnnnnnnnnntctcccaaccacatcaatctgtcagcctggctctttcgttgcacatttgctcaaggtgtcaataactatgacttcatagttgaggcgggaaactcattccggacgagatcccgagatcattttgcggaccgcgcgtgaaatacttacgcggcggtaacatcatctcctatcgacccatcacgcagcggaagctctcaagtgaaattcgccttaatttttagtaataacaccaaagataactatatcgtagcactatggcgcaccacacctcgccctcttccggtgtgggcaaggtcctcagcnnnnnnnnnngtgcggaccgcgcgtagaatatttacgcggcggtaacatcatcttctatcgacccatcacgcagcggaactctcgagtgaaattcgcctttgtttttagtattaacaccaaagataactaaatcgtagcactatggcgcaccacacctcaccctcttccggtgtgggcaaggtcctcagcggctgcgcgtcggctgtgggaagcggtgtatcgcgttgcttcaagggcaggaagaagtcccacgtcgtgaggagtaatagcggtacccaaattcatgtggaccaggctgccgcgttcggggagggagccctgcggtacaaccccttcgaggaggaagttaggtcccctcgtggctcacccccacacaaaggcttcacggctccgtcgcggaggaaggagacgactgtgcctcaggccaaggcctttggagaaggagcacttcagcagtggcactaggcgacggcatggaaagcgatcgagcagtagcttcctgctggccgccatggacctggccccaacatctccttacacatcgagtacaggcgtgtgtgatccccattttcaacagcagccctcagattttccatgtttatgaccctgtattcacctctggctgtctacgccgtccggttcaatgaaccagggagttctctaacaatttgttgttgcattcatgctttgtacattcccaacagaaatacagcatgacattggccaagccttgcaatcaagaaaacgggtgtagatggcaagcagtgcacaccgtaatgaaaggtgagattcagtgcacattgcacggagatgggagggtcgcattaccgggataaggagctatagcggcctctggacatccggctccatccagagcgcctctatttcttccagggttttccccttcgtctcgggcactgagaggtttcacggtgtgtgggaaaaagggatcagaatcacgaggtgtaggatgcatgctatcccatgagccatccgcnnnnnnnnnngagaaaaagggtgtagatggcaagcagtgcacaccgtattgaaaggtaagattcagtgcacattgcacggagatgggannnnnnnnnnctccagggttttcccctttgtctcgggcactgagagggttcacggcgtgtggaaagagggatcagaatcacgaggtgcaggatgcatgctatcccatgagccatccgctgtataaggcccacaatctttgcaagtgaggaagaatccggagcgggtgcccgcccactcaccgatgttgtagatggtgacgagagaagcaacgccgacgacggcaaacaccaggtacgtggctgcacagtgagtgtcttgtgctttcttgagcttcaaatgatcgtacagtcctggctgcaccgcaaatcgcaatcctctcgtcatgcagggcgccattgcggtgcacatgtgcactcaaacctgcgccacccaccgcgccccgctcattacctgacggcccgatgctctcgcgcacgctgggcagcgccaggctgacggcaaagttggaagaaaagttggtgagcgtggcgagcgccatcgcctggcccctgaccttgagtgggaatatctcgctgacgatgagccaggagatgggaccaaagctgacctgcggcacgcatgggcgagtggaggtgtgtgtgtctgtgttgaggcactcttggcaggatgggcgaggagtcaggggtcttggcaaagacttccgtctgttctgagacagccacctcgtgagagggggccaggggcacccgaggcccacgagcatgcgccctcacagcatgcccatgcatgtccacgacccctcggccttgcagcaaggcactggtccaccagacgcgcaccgtctggtgcctgccatgggcgtgatccccgcccttccatttcccatcaaacccctgaacccgccccgcttccacacacctgatagcagccgannnnnnnnnntggcacgcatgggcgagtggaggtgtgtgtctctgtgttgaggcattcttggcaggatgggcgaggagtcaggtgtcttggcaaagacttccgtctgttctgaggcagccaccccgtgagagggggccaggggcacccaaggcccacaagcatgcgccctcacagcacgcccatgcacgtccacgacccctcagccttgcagcaaggcgctggtccaccagacgcgcaccgtctggtgcctgccaagggcgcgatccccggccttccatttccaatcacacccctggacccaccccgcttccacacacctgatagcagccgacatagacgaggagggccgccaagttggtccaggccaccagccccgggtcaatgggcagcgccccccccgaagccagggccaggcagagcagggcccccaccagacccgacacgccccacaggaggagcgggcgccgtcccagtcggtccacggtggccacggccacgcctgtcatgacgagcttgaacaggcccaggcccagggatacgcccgtggcctggccactggactggaagcctgcggcctggaagatgctggcggcatagtagagcaccgagggctgccccgtgacctgctggaagagcatgagccccgcgccgatggccagcgggcggcggtaccgcggccgcgctagctcgcgcaggcccagggggtcggcgccggcacgggggctctccgcctcggtcgccgcctgcatgcccgccagctcgacggccacgctggcggcgctggcgttgcggccctgggtgcggtgcagtgccgcggcggc

SEQ ID NO: 37048 - DNA, 69 bp, Chlorella protothecoides
tacagtgtggggctggggctatgcctgagcgcgaccctcatcgcggcagtgccaggaccgatggccctg

SEQ ID NO: 37049 - DNA, 61 bp, Chlorella protothecoides
gggggagcgggagcggtacaccgcgtgcccagccaggctgcaggtcttcagcagcgggatg

SEQ ID NO: 37050 - DNA, 70 bp, Chlorella protothecoides
caagaggggcgatggctgatcctgcacacccaccgtcaccctacccaccctcctctcctgcagaggcatg

SEQ ID NO: 37051 - DNA, 91 bp, Chlorella protothecoides
tggtctcataaactcgggaagggtggtgttctggtaaattgttgacccatgggctccgaacctgggtgctggagggggtgcaatgtgaagt

SEQ ID NO: 37052 - DNA, 134 bp, Chlorella protothecoides
tcaccagctgggcgctgcacgcacagccctcgcaccctccacgcatgcaccaggcatggggctctgtcacccaggcagcccgcacctggcactgaatgatggcgtcgtggatgctctggccgcgcagcaccttg

SEQ ID NO: 37053 - DNA, 177 bp, Chlorella protothecoides
cagccccgccagggggtgccccggctccagcccgcgcagccagtcgaagatctcagccgcgcgctgcgtctgcccgcccttgtgcagctccttcagtaaggctgccaaagcgccggcgtccagcgcgtacaggccctgcaaggttttgatgggcgcgggggtgggatcaggctgtcg

SEQ ID NO: 37054 - DNA, 89 bp, Chlorella protothecoides
gggggagtacttcacggcggcacagttggcaaagaaggtggaagcaagggggcccacagtggcatcggtggtggtgaagatcgtcttca

SEQ ID NO: 37055 - DNA, 74 bp, Chlorella protothecoides
cgatgctgacagcaggtcgagggaggggggcctggagtcggacgacgacctacaggggtaggaaggctgggtgt

SEQ ID NO: 37056 - DNA, 115 bp, Chlorella protothecoides
gggttgaggggggctgtgaccatgccgtgaagcacgaagagcaggaattctgagcgcactctgaggacaaaggctccagtgccccgtcccgggccagggagttgggaccatgtcc

SEQ ID NO: 37057 - DNA, 61 bp, Chlorella protothecoides
caactttgggtactacacgctcatggcggcctccctggggtgcaggtgggcggagcacagc

SEQ ID NO: 37058 - DNA, 71 bp, Chlorella protothecoides
caacacagctgggccaccgtatcgcctagccactgcaaagtaacctgcatggtttgtggggctggatccac

SEQ ID NO: 37059 - DNA, 80 bp, Chlorella protothecoides
cgtggccaggggccgccaggcgtaggtgatcttgcctgaggagggtctcaagggtgggtcttggtgcttgctgacatgga

SEQ ID NO: 37060 - DNA, 6114 bp, Chlorella protothecoides
  modified_base (1137)..(1146): a, c, t, g, unknown or other
  modified_base (1472)..(1481): a, c, t, g, unknown or other
  modified_base (1932)..(2088): a, c, t, g, unknown or other
  modified_base (2163)..(2307): a, c, t, g, unknown or other
  modified_base (2508)..(2517): a, c, t, g, unknown or other
  modified_base (3667)..(3764): a, c, t, g, unknown or other
  modified_base (4415)..(4424): a, c, t, g, unknown or other
  modified_base (4821)..(4830): a, c, t, g, unknown or other
  modified_base (6037)..(6046): a, c, t, g, unknown or other
cggcgcggcgcgcgccgcgcgcgacgcggcctgccacgtcgtcgcgcggcgcctggtctgcggcgacctgcgcaccgcggtgtacgagcggctgtaccgcttccacgtgcaggccgcgcgcctgggcggcgtgctgcaggaggtggaccgcgtgctgggcacgctgtgcgccggcgcgcacgacgcgctgcccgcgctgctggcgcgtgcactctgcgccgagctgctggacgcgctggccttcgtgttgctggacggcgggccgctgcgcctgtttgtccccggcgacgtcgacgcgctggaggcagacctcaccgcactccaggccctgttccacgccgaggccgacggcctggagctggacgaggtggaaagcgcgtcggcgccgctctccgccatcctggacgccatggccctggacaccgacgtgctcatcgccaactacaagcaggtgcttgtcacgtggccctcgtgttcgtcggggtggggtggcgcgataatgggcgccggcctgccggcacgagatcgccctcccagtcccatccccccctctcccccccaactccctccacaggccctggcgctgccagcgcggccgctggcgacgacgcagcacggcgcggcgccggcccccgcgccggcgctggatccggacgtcctgctgcgtgtgctgtgccaccgcgcggagcacgccgcctccaagttcctcaagggcctcaagatcaacaagcggctgccgctcagcgcggtggggcaggcgggggaggtgctgcagaaggtcaagagcaagaccagcccgggcctcctccgcggcttcagcaccaagaagaagtgaggggcgagtgggggtacgatgcgagaacgcgggcgcaacacactgattgccccatcctggacaatcccgtgtgatccatgctacagtaaaaccgcacagaggagggcatgaagggtatcgtaaggaggggggaagaggcggcaagggatcagtacaggattcgtcagggggtgtggccgatggcggcgcacggcgcgtcgcatcgtggtactcgtcagggggtgagggggaggaaagcgcggccggtcccgctgcccacccggcccaaggggggcggaggggccccgccagtgcgcgcgctnnnnnnnnnntggttggtcccgccgcccacccagcccaagaagggcggaggggccccgccagtgcgcgcgctcagagcagcaacgactggcgcgggcgctcccggttcagcgcggccaggcgctgggacagcaggtcgtcgccaaaggcggcggagcaggccaggggctccagcgtgccgcgctgagtcagcagctgcgtccgcttggcgctttgcagcttggccacgtactcggaaaagtccttgacctgagcgtatatgtgtttggggggcggggtgaggcagggttgtaaatgcaggcccaagaccagaccagccctgcaaaggggtccaacnnnnnnnnnncgtgttgtgaggggggggtgaggctgggttgtgaatgcaggcccaggaccagaccagccctgcaaaggggtccaacagcggggccgaggctctaggcataggccgcagccgaggggtgaatgaaatgatgtagtctcgtaggagtgcgtcagctcctagcagcaccatccacctcatcattcccactccatccggctgtccctcctccgcccccctccctcgcactccacatcacacagagaatcagctcatctcaaaacgcaccttgcgagcgtagtcttgtcgcgcctctggatcgtgcaggatgtcagactgcccgtgctcaagcatgagcgccggcacgtcacgcagcgtgttgacgatcttgtcctcctggagggagagcgctgcatccccggtggacacatccctgcccttcaggaagtagatctgggtttgttgtgcggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacacgatacaaccacacgaaaccaccggcaactacagataaaaaactcacattgcccttgatgctggccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcttgtcccgtcgcaggcctacaattgagtattgtgggggtgggctacccaattgggaagtaatgttcgtgcagggcaggcgccaagcaagactggccacatgaatcgcgccatgaaacttccaaagtgcttcagggctgagatcacttcagatggggactctcactggctgcggccgtccgcctccctggcacaaagnnnnnnnnnnccaggtgcagggccagctggtacttggctgagaatgagcatggattgacgcccactgatcagcccaacctctccatctcagcacacgataccaccacacgaaaccaccggcagctgcagataacaaactcacattgcccttgatgctggccggcgcgtccaccagccaggctggctgggtgaaccgcaggcgcgacgcctccccgccctcctccatggtcgcggcctccaggatggggctcgtccggtggccctgcttgtcccgccgcaggcctacaattgagcattgtgggggtgggctacccaattggcaagtaatgttcgtgcagggcaggcgccaagcaggactggccccatgaatcgcgccatggaacttccaaagtgcttcagggcggagatcacttcagatggggactctcactagctgcggccgtccgcctccctggcacaaagacaccttccaatccccaacccttcacctccatcctcaactccctggctcacgtgtcacggtctccagcatgtgcctctgggcctccaccacctctgacagcgtgcgcgccccgaagtgcagccagtcctcgtgcttgtcatgcagggagccaaggtattcctcgctcacccccacctcctcggcccgggcccggtgccgtaggcgctggatgcaggtatcggggctggccttcaggtagatgaagccgttgggcgtcagcagcttgtcgttcccgatctccatattaaacctggcgcaaggtggtgtttgtgaggcggaagggaggcatgctgagtgccaggccagggggaaggatgggagtcagggcggccatgcggccttcctgtgaagatcacgctgctccctggacctagctcggcagaatctgccccaccagacagcagaaacccaaactcttgcatgcataggtgcccacattcctcctcccagatccccaccccaggctcctggccagaccatgtcagaactgcctgcgcaccaggagtcgtagatggagacctccatgtcttgcaggaacccgctctcgtgcatggccctcacaaagaccatgcggtcgctgaagatggaccgctccagcacccgtagcggcttgagcccgctcctggagtcccgctcctgatgagatatgggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaccgcccagaccctgcaccaaccccaggacgtctcatgacaaggccccaccatccccagccagtacagtcacatcctccccaaccatgccaggcacaccttttgcatgcgagtgagcaggacgtagtgctggaaggtgtaggcgtagcgctgggggtccttgtagaagcggtccagcaggttgacggggccctccccgccctctgctccagccaccgactgccactcctccacgggctcaggcaccacctcgatgatgtcctgcagctccagcgcctggtccgccatgatgttgaggaaggtggacttgcccgcgccgatgttgccctccacggccagggtcacgcgctgcgcgcgctccgcctccgcctgccaggtcagcgcgctcacgtgctccgccacagtgcggcggtggtgcgagttgcggatgcccaccacctcctgtggtttgtgtgtgcgcgcgtgttgaatctcggcccgaggcctggaaatgcgcacaaacagcatccgaggaatgggccacagatcatcggctgagggtgacgcagccacaccacgaacggattgatacactgaagctaggaagagtcagccttggggagggtcacaccatcacacattccgcacacccaagccagcacatggccannnnnnnnnnggaaagagtcagcctttggggagagtcacaccatcacatattccgcacacccaagccagcacatggccacgcaccgggccttcccgtccccacacgccacaggcagagcacccaggagacccacgcgcccacgactcacggcgaggaagcgctggagctcgtccttgctggcgcccaggctggtatggtagaggtcctgcagcgcagcgatgctgtcgatggcatgcgcggagagtagggcttcgtaggtgcgacccacgccccggagctggcggaggtcggaggaggagggtggcccgcgggagggtgccgagtctgggaccctgccggccccagccgtaatggcgaaccgtcggaggcatggaacgcgagacggaacggcccgctgggcggcggnnnnnnnnnnagaggcgtcggaggcatggagcgcgagacggaacggcccgctgggcggcggcagtcgtgcctagaacgggcaaagtagccagtggcatggctctagcagctcgtgagaacacagcggtcagtgctctggaatcagggcgggggagcagggacggtgagggcacctctgggaccatgagcaggcgaatcgaggaagcaaggcgtcatcggcagcgtcagccatgacccataaatacgtttaaggaacagactaacccgagcatggctgtgccaacatgccaaggacgctgtggcaaatgatctccaagcaccaggaagaagggtagaggtggagacggcctcacagcctatctcgatgccctggcatggtaaagtaggccgctttgaccaaattggcttttcaaaagggtattggaggcgtggaacacccacactctgtctctcttcgaacctgggcgccactgctgggggtccccggcaagtgtgggagcgagatttgggcctgctttctttggcctgcaggatgtcccaatctataagctcgctgagtgctacacagcaggggggtggggaccaccacccccctctttcggcgaccaagtagaatcgagtgcttgtagcccacatccttgggcacagctatgcaattctgaaccggagggtagggacgagcacggcagccatgagcgttgccacgtccaacgccttcgcgttgctggatgatgagggtaccgtggacgtgagtgccctggcggcccgcattcctgcggcccagaagcctgcaccaaagccggtggaggagacgaagccaggtgggtcccgtatccgggcggcgccatcgcgccacagcgcgccacgggggccgcctgatttgatcgcatcgcccgtgcccgatgcgcttcacagcctgccctgccctgttctgcgccatgccaaactccagattggccagcgcaggtcccggcagcgatgcagatgtggtcccgctttccagcccgttccgactccctcccccccctcatcctcagtggcccgcaccaacacccgcgaggcccctcgcggcggcggccgcggcggtttcggaggccgtggaccccgcgcccctcgcgccaacgaggagggcggcgccttcgacgccgagtctgcccccgccctgcgctccggcggcgccgggcgcgggcgtggcgggcgcggcgggcgtggccgcnnnnnnnnnncgatgtggtccccctttccagcccgctccgactccctccccccccctcatcctcagtggcccgcacca

SEQ ID NO: 37061 - DNA, 63 bp, Chlorella protothecoides
agggcaaatgccaagtgtgctgaggtgagttatgctcatgtgttcaggtttgtaagtctctgg

SEQ ID NO: 37062 - DNA, 67 bp, Chlorella protothecoides
ggaaccgtcctcctcgagcgtacccacccaatatgtcccctgctgcggccgtatccacgggtacggg

SEQ ID NO: 37063 - DNA, 77 bp, Chlorella protothecoides
tgtaatgacgattgctgtgagtttcgaaggtatatacatcctgactacgtgcagcagcccaatcagtggttcggtgc

SEQ ID NO: 37064 - DNA, 64 bp, Chlorella protothecoides
ggctcacagcgtgcatggcatgggggattactgcacagtgcggcatttaagaagtgatgttacc

SEQ ID NO: 37065 - DNA, 77 bp, Chlorella protothecoides
ccccccgccgggagatcctgcgtgccgatacacatacacacacacatacctcggcctgatcgagcttgcccagcctt

SEQ ID NO: 37066 - DNA, 61 bp, Chlorella protothecoides
tgggagaacaggggtgagtggctgggttgggagatgatgagcatggagtgatcgatgaaat

SEQ ID NO: 37067 - DNA, 65 bp, Chlorella protothecoides
gggccagggctgcgtcgagctcctgcatgaagggcggtggggggggggggggggggggggggggg

SEQ ID NO: 37068 - DNA, 81 bp, Chlorella protothecoides
ctgctgcccggccagctgcctctctgctgcgcaacgcacaaccacgcacccaccgcgcccaccttgctcctgtgattccgg

SEQ ID NO: 37069 - DNA, 102 bp, Chlorella protothecoides
gggggagcaaggggtcaggagggttgggatgtagtggggtgtactacagcaggatcgtttgatggcgacagcacagcaggtcgctgccacacgccgcaggca

SEQ ID NO: 37070 - DNA, 61 bp, Chlorella protothecoides
aatgcaagtgcagcggttacagctcgaagggagggtgcggctcggggcagcagagcgggag

SEQ ID NO: 37071 - DNA, 369 bp, Chlorella protothecoides
  modified_base (93)..(293): a, c, t, g, unknown or other
ccgggcacggagtggtacttctgcttaaccgcccccctcggagccccccccttaccccttcgccggcctcgcgcagatccacctcctgcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttctagcctgcaacgccttcaaactccagactcaaacgaggagtactgccattcctctggtccatagatctcgg

SEQ ID NO: 37072 - DNA, 64 bp, Chlorella protothecoides
ttgccgcggcagtgttgcacccaagcaccctatgtgccccccgcttccaagcccctttgcgctg

SEQ ID NO: 37073 - DNA, 132 bp, Chlorella protothecoides
ccaccaggtgctgcgcgtgggtgccacggatttccgcttcaaatccctgcccgagtccctctgcgacgtcatcacagttcccagtacaggtgcacaccgggacaacaccccctcccccgcgctctgtgccgc

SEQ ID NO: 37074 - DNA, 1098 bp, Chlorella protothecoides
  modified_base (84)..(93): a, c, t, g, unknown or other
  modified_base (398)..(407): a, c, t, g, unknown or other
  modified_base (468)..(477): a, c, t, g, unknown or other
  modified_base (782)..(791): a, c, t, g, unknown or other
gctcgctgcaggcatcctgaccccgtctcggtctcggcatgtaacattgcctcgggggcaggccagtacacatgtgtgtggggnnnnnnnnnncgcaggccccggcccggacgtgccggcggggcccctgggcggcttcctgctggctcgctggcgtgagtcggtggcacgcgagcgtctgcagcaccaccagcagcagtacgcccagaattgagtttgcttactggggatcccaacccgcgctcgctgcaggcatcctgaccccgtctcgatctcggcatgtaacattgccttgggggcaggccagtacacatgtgtgtggggtgaggggtcaggtgtcattctgggcgggggtcgcctacacccgtcggatgaggagcaagcatggcacgggggtnnnnnnnnnnagcacccgggagtgcggcacgctaggccgcccccgggaggcccacgcgcaacgccgccccnnnnnnnnnnaagcatgtgtggggccgagcggcgccacggaacgttgcactcgccgcaaatgtggctggaaaggagggcggcgcgcgggagtgcggcacgctaggccgtccccgggaggcccacgcgcaacgccgcccctccttcctcgaggggcgcgtcgtcagtggcacgaggcacggcgcggccccttgggcctcctgcggcggccaccaggcccgagatgagccccggcggggggcccgctgccgtcgtcgccccaccctcggcggacgcagcagggcttccctgcccctctcccggtctggcctcgggcnnnnnnnnnngccctcggcggacgcggcaggggtcccctgcccctctcccggtctggcctcgggcccgggcctggtggcggcctccacccacatgcgcacccgctccgccgcgccgcactcgtgccacttgagcagcgtgtgccggtgcaccgccttctggtcatcggtcaggtcccgggcccaggcctggaggtaggagaccagggcgcggggggagatgcccggggtcgcgtccagcacgccctccacctcgtcatacatggccgacacggaggccgggccgggcgcgctgcgcggcgccgcgccggcctccccg

SEQ ID NO: 37075 - DNA, 2876 bp, Chlorella protothecoides
  modified_base (687)..(696): a, c, t, g, unknown or other
  modified_base (1436)..(1445): a, c, t, g, unknown or other
  modified_base (1895)..(1904): a, c, t, g, unknown or other
  modified_base (2291)..(2300): a, c, t, g, unknown or other
  modified_base (2712)..(2721): a, c, t, g, unknown or other
cggcgctggcggccgccggcgccgccgtggccgcggtggacgccgtcatggaccgcgacagccccgtgcgcaacgccttctgcgcggtgcggccccctggacaccacgcggggccggcgggggcggtgcccagcgcgcgcgacccgcacgccaccaacggcttctgcctgttcaacaacctggccgtggccgcggcctacgcgcggtgcgtgtataggggccgcggcgtagcacgtgtggccctcctcgactttgacgtgcaccacggcaacggcacgggtgcgtggttgggcgtgtggcaggggcgggagatgtggagtgtggggtgggcgacattcagtgtgaaggggggcgaggaggtgtggccaataaaagggacctgggatcctgcaatgccatggtggtgcctctgtggcatcatgagtgaggcattggatccgggactcctgagccgtgtttggcctgcgtttccatgcacatttcgggcaggctggatccctccgcgctctccatgtcattcacaccgctgatggacccctcctgtccgctcccggctcatacgcagaggcgtgtgtggtgcgggcggcgccctcgctgcagagggtccccttctccacgccctactcggagggtgttcaggcgagggcggggagtgcgtgtgggttgggggcccgtgacgaaatgtgnnnnnnnnnncttgggcgtttggcaggggcgggggatgtggagggtggggtgggcgacgttcagtgtggaggggggcgaggaggtgtggccacaaaagggaggacctgggatcctgcaaagccgtggtggtgcctctgtggcatcacgaacgaggcattgcatccgggactcctgagccggatttggcctgcgcttccatgcacgcgccgggcaggctggatccctccgcgctctccgtgtcgttcacgccgccgatggtcccctcctgtccgctccctgcccatgcgcagaggcgtgtgtggtgcgggcggcgccctcgctgcagagggtcccgttctccacgccttactcagagggtgttcaggcgagggcggggagcttgtgtgggttgggggcccgtgacgaaatgtgactgggtcctgcatgggctgggtttggagggggcaggcatcggggagctgtgccccctggacacctgggtggggccctccctgacccagacctcccccctcctccctcgcagacattcccggtctacaagccgtggctggacgcggatgacaaggacaacatcttcttcgcgaggtgggacgtgggtgggggagaatggcaaggggggccttgcgatggcatgtgcagcggagcacaggcaggagggatgcccttttggcgctgctgtgggaaacccctccggacccttcggcatgcacccttggaccctgcagcgtccaagggtttgggcccaaggnnnnnnnnnntagggatgcccttttggcgcttctgtgggaaacccctccggacccttcagcatgcacatgcacgatcctgcagcgtccaagggtttgggcccaaggcggaaggcatgaacgcctacgtctacccagggtcgggcgccacgggggacaaccggatcgcagacgacgcagcccagagcgtggcaggtaggccgtgcaagggtggccaggggtgcacagggtcggcaggagccgcaaggaactgacgaggattgtgaggaacgcagttttgtgaaagcatctgggactgcaaccattatggggtgtgttagcacagtcccaagggcttgcagtgcacatgtggccagatgctgcattcgctggaccgcagagtgcgcagggccgccatcccgagtggctcctccagaggatgttgtcgcgacgccagggatggtgtgcatgtcactgcccccnnnnnnnnnncgtggaagcatctgggactgcaaccattgtggggtgtgtcaggacagtcccaagggcttgcagtgcatatgtggccagatgctgcattcgctggaccgcggagtgcgcagggtcgccatcctgagtggctcctccagaggatgttgtcacaatgccagggatggtgtgcatgtcactgccccctacgagccctgtgcaccatgcagttcagcaaagcctgtccatgaggcaccagctccctcgtcttgtcatgcaggcattgccgaggatccggatgccgagtttctgcccacaggtatggctccgaggaatgctgagacgttccccgggcgtgcagaggaatttacttgcatcaacatccgcacctctgtcgccggtgcacccccnnnnnnnnnnattccctgggtgtgcagagaaatttacttgcatcaccatccgcacctctgtcgccggtgcacccccgatcccacatgcaaaccatgccacactcctcccgcaggcgaggacagtgtgggagctgcgccgccctctgcaccccgcgtcatcgacgtggggattggcgggcccggcaccaaggtcgcgctctggcggcgttcctggcgcgacaagatcatccccgcgctcgtcaatttccgccccgacttcatcttcatctcggcaggttggggaggggttcccttggggaatgtgcatcgctaagcctagaatgctggggttttggggggcaggatcctcaccatatagggcgcgccaaggcgccagggggtgctcggctgagtggggtggggttctgccggcgtcatttgcnnnnnnnnnnaaatgtgcatcgttaagcatagaatgctggggttttgggggggcaagattctcaccatataggcgtgccaaggcgcaagggggtgcacggctgggtggggtggggttctgccggcgtcatttgcccccgcctgccctttcccggcctgctattcc

SEQ ID NO: 37076 - DNA, 113 bp, Chlorella protothecoides
catcccctgcggagcagggcagggtgggggccttgacagcagcgctggatggaggattgctctgcgctgctgtcctggcttgaggtctgccctcgcagtgcatcgcttgatgc

SEQ ID NO: 37077 - DNA, 61 bp, Chlorella protothecoides
gtgagaagagccgattgtaagacggcgacacgggcgtcagtgggagggcatacagtgcgcc

SEQ ID NO: 37078 - DNA, 88 bp, Chlorella protothecoides
gcgcgacccaggctccccctctcccttgccccacaaccgggaccccccccccctcccaaaatcgcaccctggccatcctggaagctga

SEQ ID NO: 37079 - DNA, 77 bp, Chlorella protothecoides
ttgtaatacagaatacttcaagctgcaaagccggtgagctgtacgtcatggaggcgacatgacagcagtccgggatt

SEQ ID NO: 37080 - DNA, 97 bp, Chlorella protothecoides
tttttttttttttttgggggggggggggtgagtcaagggcagctcgggtgagtgcggagaatgttaatcagtagaatcggccggggaggtgctggca

SEQ ID NO: 37081 - DNA, 69 bp, Chlorella protothecoides
tcacgctgcgcagccgcacacctcctgcactgactccatgcaccctggcgcagcgtgccagtaccactc

SEQ ID NO: 37082 - DNA, 123 bp, Chlorella protothecoides
gctaaatgagaatcaagggtgccaggggcaaagggaatgccgtggaacctctcttgatcacaccgccgtactgctgatgacccaggctcgccccttgtggacctgttcagttggccctatgag

SEQ ID NO: 37083 - DNA, 61 bp, Chlorella protothecoides
ggcggggccggaagacggcttggctgggggggtagggatataggatgggggtatcgagggc

SEQ ID NO: 37084 - DNA, 70 bp, Chlorella protothecoides
gagacgcgccctcgcccagtgcaccaagcccgtgtaccccaccccacccgccaaaacaaggccacacaca

SEQ ID NO: 37085 - DNA, 64 bp, Chlorella protothecoides
cgagcctggagctgagacagacctcagcaacgccggtcagtatgtaaagcccgaaccaatgcag

SEQ ID NO: 37086 - DNA, 87 bp, Chlorella protothecoides
gggtgtagaatggaaaaacacccactcataagcccaacgcccctctcgcgagttggacatacgtgaatatctcgctcccgggcaagg

SEQ ID NO: 37087 - DNA, 129 bp, Chlorella protothecoides
ccggcgaggggaaatagaggaggaaagagggggggcgggcgggcgcttcgagtctggatgaggttgtggcccgtcgcggggcgagcatattgcggccgcgctgcaataaagagcaaacgtcctgtggct

SEQ ID NO: 37088 - DNA, 67 bp, Chlorella protothecoides
agtggggggggacctgagcgccccgcctggccgactgccgggaggtgggagggcgggccccgccgca

SEQ ID NO: 37089 - DNA, 61 bp, Chlorella protothecoides
gttggtgaatacctccgatcacagtcttgggttcctcaccaggacccagctgcagggccta

SEQ ID NO: 37090 - DNA, 66 bp, Chlorella protothecoides
gcgccgcccccgcccccgggcgcacccgccggggacgcgccgcccccgcccccgggcgcacccgcc

SEQ ID NO: 37091 - DNA, 76 bp, Chlorella protothecoides
cacgcccttgcggtagaagatcatggccccacgcggcccgcgcagactcttgtgggtggtggtggtcaccacgtcg

SEQ ID NO: 37092 - DNA, 6060 bp, Chlorella protothecoides
  modified_base (132)..(141): a, c, t, g, unknown or other
  modified_base (540)..(549): a, c, t, g, unknown or other
  modified_base (653)..(662): a, c, t, g, unknown or other
  modified_base (717)..(726): a, c, t, g, unknown or other
  modified_base (1130)..(1139): a, c, t, g, unknown or other
  modified_base (1335)..(1373): a, c, t, g, unknown or other
  modified_base (1505)..(1514): a, c, t, g, unknown or other
  modified_base (1568)..(1577): a, c, t, g, unknown or other
  modified_base (1630)..(1707): a, c, t, g, unknown or other
  modified_base (2298)..(2307): a, c, t, g, unknown or other
  modified_base (2711)..(2720): a, c, t, g, unknown or other
  modified_base (3184)..(3193): a, c, t, g, unknown or other
  modified_base (3542)..(3551): a, c, t, g, unknown or other
  modified_base (3804)..(3813): a, c, t, g, unknown or other
  modified_base (4323)..(4332): a, c, t, g, unknown or other
  modified_base (4694)..(4703): a, c, t, g, unknown or other
  modified_base (5130)..(5139): a, c, t, g, unknown or other
gggggggtgccaagtgtgcgcgtgcgttgggggttggtcaaaggggtgggtctcacaagggcttcattcgatgcttgtggggcacctgcccgccgatgacggcaaacatccatgcatgtgcttttgctaggnnnnnnnnnntgcgcgtgtgttggggtttggtcaaaggggtgggtctcacaaggacatcattcgatgcttgtggggcacctgcctgccgatgacagcaaacatccatgcatgtgcttttgctagggaaggaacgatcagggatggcatgggacgacatcctgccctgccaccccaggggtcgtgcccctgcccactgtggtaataatactaatcagattgaccctcgtggcacgaatttttgcccaagccgtgccttgagcatgtacacttgtcgcctgcctgagcttctgaatgtcgacttcttgtgtctcaaaatcccaaacaatccgtgcaggatgtgcatggagccgagggtggtggaacgcgccagcatcttcgaggccagggtctacacgggacaggtacggnnnnnnnnnnttgcctcaaaaccccaaacaactcgtgcaggatgtgcatggagccgatggtggtggaacgcgccagcatctttgaggccagggtctacacgggacaggtacggnnnnnnnnnntgatcaagcatggcatgggacgatatcctgccctgccaccccaggggtcgtgccnnnnnnnnnncagcgaggtagacttgtccgtgcctcaattgtgctggagtttctgacaaggccatgggacccaaggcctccttcagaccatggctcgacatcaagggcccctcctccccctcactactactttccctcattgcagtggattccatcgcccttcaaggatgccaacatcctgctcaatgtcagggcgtttgatctggcagatgagcacagcaggtatgatgggtccagtgcaggcaggggcggttggcaaggggcatggcgctcaggtgcttgcctgcatacaagtctgctggcgtctggtgcccttgactgcatcgtccccctcggcttcaggcctcatcgttcccccttacacacacaccccaccccacccggtagcctgctggtcctgtttgagagtgaggnnnnnnnnnncttcccccctacacacacgccccaccccaccccgtagcctgctggtcctgtttgagagtgaggacctggacgtgtcggacccccggctccccaccgcggtttctcagcggcgcaccatcgatgtgctgccggggtctggcatccgattgcaagcgctgcccgccgggccagacggcatccccaggtgagcgcctgnnnnnnnnnnnnnnnnnnnnnnnnnnnnnnnnnnnnnnntgtggttgaatgaggtccatgtgtggcaaccctgacacaatcatgaatgtaaacggggaccatgtctgggtcagctcgtgttttgaggcaccactctttctccccccttgaacaggtccctggccgacattnnnnnnnnnngggtgtgtgtgttgggcatatgatgctcatattccaggggcgacgttgtccttnnnnnnnnnntgggtgtgcgttgggcatgtggtgctcatattccaggggcgacgttgtccttnnnnnnnnnnnnnnnnnnnnnnnnnnnnnnnnnnnnnnnnnnnnnnnnnnnnnnnnnnnnnnnnnnnnnnnnnnnnnncctgggtcagctcgtgtttccaggcaccactctttctcccccccttgaacaggtccctggccgacattcatcttgactttgacccgcacttcccttacgtcccctccgtgctcgtcagcttcctcctgaaggtgctctgcccctacctctacaatgtcatcatcaaggtgcgaggcacggcctagagggcggtgcatgcgctcgagaatcggagatcggggctatttagggttcttgaaaccgtggtggtccaggggcacccgggtgccagagggcgttacacagatgcacattcatgaacctcgtctcatccagggcccctgtgatgtctcacccatccccgctttgtactgcactcacagccttccaaggccatgaaagcacaggtctaccctctcagcacagggaccaccccttcaacccccgcaccccgcaggtcctggattctcaattcagtggcgatcagggctgtatgtacgaggagagggtcgcctcgcggcccgacctgtacaagtacctggaccaacgcctgcaggggttccagcccagcccggcagccagggcctgactgtttgcaagctcggtacagcnnnnnnnnnngttcagtggcgatcagggctgcatgtacgaggagagggtcgcctcgcgacccgacctgtacaagtacctggaccgacgcctgcaggggttccagcccagtccggcagccggggcctgactgtttgcaagctcggtacagcaggcctgcgagagggactgctctcacaagacggtgttccaccaccctcgtggtactacacaaagccccgggcgcagtaccagggctgcagaccttgtgatgctggacctcaccttccttgcccccacctgcgacccttcctgccgccaagaccaccgtcttccaccacgaaattgctctgtcccctgctttgcccactggcgccctccattccccagcacctgcacatgtcagcagggcacttcacaccacgctctgcaccttnnnnnnnnnngctgtcccctgctttgcccactggccccctccgttccccagcacctgcacttgtcaacagggcacttcacaccacgctctgcaccttccagcctcagccacgtgacccccgcttgatcttcctcttccaccccctccttgtctgcgccaggaccgttgatcagtgtacagatgcagaacatggggctctgcagtgaaagtttcatgtcagtgtgggcattggccccccctcccgcactcatctcgaatcaaggtgggggcacgggcatatgaatacaggctgctgcttgggtacacggccgcggtcgggcagtcttgttatgggatatccactttggcacaatccagaggacaaaccggcatgaggccctcaccgccgcttgccgcggccgccgagcttggcgaccccgccgcggccgccacgcttggagtgtccggcctggcggtggcgtcgctgctcctcannnnnnnnnncgagaccctcaccgccggccgccgcgtccgccgcgcttggcgaccccgccacggccgccgcgcttggagtggccggcctggcggtggcgtcgctgctcctcaacaaccttggcgcgccctgacttcttcctgcgctgcttgctgatgcgcatctgcgccgccgcctccgggtccaccaggttctgcgagaatgggagttgcgtggggcattcacccatatggtcaagctcaggagtggcacagggggtgagtggcaggatgatgccgcaggctaccccgcaagccgcttgatagaagccccggagggcggcgccacaacagcatgcacaaccccctctcgacacgtgcnnnnnnnnnnagatgatgccgcaggctaccccacaagccgcttgatagaagccccggagggtggcgccatgtcagcatgcacaaccccctctcgacacgtgctcttgcccctgccacgagcgatggccgtgtggatttgcatcctagtatccacaatcttctacatgatcgacccacacacaagtccgttcccccgcctgccagtgcaatagaacccttgtcctcctgccccccccccccagactcaccctcctcgcgtctgnnnnnnnnnnccacacaaggcccttcccccgcctgcctgtgcaatagcacccttgtcctcctgccccgccccccccagactcaccctcctcgcgtctgccgcgcggcgctgtgcgcgttgccgcgccagcccggcgcgcgcagcggcgtgcgccaggagcatccgctcggcgcccaccagcgcccgcaggtggtccagcacctcccgcgccaggccgactgtctcctccccgtcccccgtcgcccccggctcggtgatgcgcgccagcgggcgcagcaggatggggaggaaagggagcacgccctcggcgcccaggcgcgaggccaccgccgcaaggcagcgcagtgcggcctgccgtgccgtcgcgcgcgtgaacgcgcggtcgtcggccagcgccgccacgccacgcagcagcgccgccaggctcgtgtagccgtcgccgggtcgtgccgtgccggcggcagccgagccgccatgcgcgtcgccgttctcctcgccctcgtcgtcgctggaggccgcnnnnnnnnnnaggtcgtgctgtgccggcggcggccgaggcgccgtgcgcgtcgccgtcctcctcgccctcgtcgtcgctggaggccgcctcggcgccggacacggcctcggcctcggcctcggcgttgctgtcctcctccacgccgccgccctcgtcggcctcgacctcatcggacgtcgccaccgagctgccagcgacagcaagcagccccgcgcgcgccaggccgctgggcgcacgctttgccagccacagcgtggtgggcagccgaccggcagccgcgtcgtcctcgagcgcggcaggggccagcaagaccagcccacgcaccgcctgcttggccagcgcctcgtcggcgtgctcgccgtccagctgcnnnnnnnnnngtgaccagcccgcgcacagcctgcttggccagagcctcgtcggcgtgctcgccgtccagctgcgcgaggaaagcgcggcccagggcgcctgcggaccctgggctggggagcagggcgggcctcacgccgggggcggccaggccggccaggatcaggcgccccgcggcgcggcgcacccacaagtgggggtgctccagcgcgccgactgcggcggcccagctctcggccgcggcgggtgaggcgccaggctgcagcgcagccggcagctttgcgtgcaccttgcgatgcggtagtgggggaagagaagggtggggttggagtcgcaaggtaatatgctacatccggtgcatggcacctcactcgagagccaccccaatggcaacaaagaaaccatcgcactgcctcaccttctccaggaggaggaggnnnnnnnnnntcgccaggctgcagcgcagccggcagcttggcgtgcaccttgcgacgcggtagtggggggagagaagggtggggttgaggtcgcaaggtaatatgctacatccggtgcatgacacctcactcaagagccaccccaatggcaacaaagaaagcatcacactgcctcaccttctccaggaggaggagggcgtggtaggcttcctgccagccctccgcgcccttgccgtcccccgctgccaccaagcggcccaccaccggtagcagggccggcacccggccggcggccgcctcggcatcggcctcgaccagcacgcccgccagctgcagcgccgcacgcgtcagccttccgtcctccccggtcagccactgcaggcagaaatcggcagccgtggcgcggagggcagggcccgcgcgctggagcagcgtcagcagcgccgcgccggccctgccgcggcaggcgctggaggcatcggaaacgaggcgcgtgaccagggggaggagggcggtgtcagcccagcgcacaaccacctcgtccgggaacttcttcagcaccgtgcagatcatgtccagcgccgcgagcctggcaaggcggagagaggtgtgggggaagaaggaggaggggttggacagagggaaatgggttggtggaggtgagtgccgcaggggtgggtggaatgtggtccagggggaggtgatgacgtgtcgagggttgatcaagggcaggcgattgtgagggtgggcgccgcaggctgggcggctgctgatgggacgagatgtcggcacatgaggctgcgttcaggccactaccccgagtccacggcacgcaaatgcagcttcgcgcccgggggccaggctggcaatccatgggtatcatggaccccccctgctcgcccgcccccagccacccgtgccctcaaccccc

SEQ ID NO: 37093 - DNA, 154 bp, Chlorella protothecoides
gatgcatgtgtgttgcagggtactgcgtgcgggctggctggctgcggaggactgtgtgcatggtaacaacatgagttatatcccggcggccttccctcccccttacttgcaacaaaccttcctcctcgcatcaacttcaccaggcagtactgca

SEQ ID NO: 37094 - DNA, 75 bp, Chlorella protothecoides
cccccccccccccccccccccccccccgtcttaccaggcctcaccaagatggtcagcaagctgagcaaggagggg

SEQ ID NO: 37095 - DNA, 95 bp, Chlorella protothecoides
tgtgctgtgggtttggtggagtggggcggcggagcggggggctgcgggtggtgggatcttccctcggcaatgggagcgattggttctgtggctgg

SEQ ID NO: 37096 - DNA, 13136 bp, Chlorella protothecoides
  modified_base (115)..(200): a, c, t, g, unknown or other
  modified_base (391)..(622): a, c, t, g, unknown or other
  modified_base (675)..(684): a, c, t, g, unknown or other
  modified_base (1193)..(1202): a, c, t, g, unknown or other
  modified_base (2005)..(2014): a, c, t, g, unknown or other
  modified_base (3555)..(3564): a, c, t, g, unknown or other
  modified_base (3984)..(3993): a, c, t, g, unknown or other
  modified_base (4217)..(4226): a, c, t, g, unknown or other
  modified_base (4524)..(4533): a, c, t, g, unknown or other
  modified_base (4879)..(4888): a, c, t, g, unknown or other
  modified_base (6214)..(6223): a, c, t, g, unknown or other
  modified_base (7973)..(7982): a, c, t, g, unknown or other
  modified_base (8720)..(8729): a, c, t, g, unknown or other
  modified_base (9980)..(9989): a, c, t, g, unknown or other
  modified_base (10069)..(10078): a, c, t, g, unknown or other
  modified_base (10309)..(10318): a, c, t, g, unknown or other
  modified_base (11992)..(12001): a, c, t, g, unknown or other
  modified_base (12316)..(12325): a, c, t, g, unknown or other
  modified_base (12721)..(12730): a, c, t, g, unknown or other
ggggggaaggaggggggtgcggtgatggaacaggcatccgggtgtccgggagccccagccaccagaacaatctcaaagaggctgcatcaatactggctccgctggccccgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnaatccgatccacctgctccagggggagcgcccacgcccgccacccacactgcctgtcggcgcccgccgcagcagggtcggcgggcgcatggacggtgctgcagcggccactctcccccttgcccccccgcagcccctaagccacacatcccgcacaggggtgcaaagactcgagcctaggacctcgcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggggttgaggctccgggcgaatacactggaaggatgctgcgccaaccttcnnnnnnnnnngacccccccacagccccgaagccacacatcccgcacagggctgcaaagactcgagcctaggacctcgcaacttggcgcacctccagaccgatgctgcgggtgttggcccggcggccggtggccatcatgaccttgccgcagcgcaggctgtgctcctgcccgctgccgtcgcggtagtgcagcacgtaccgcccctccccctccttctcgatgctagtggggttgcactcggagtgcacatgaatgccacgcagctccaggttctccgccaccgccgagcggcactcgtcgtcaaacctgccagaatcagcgggggggggggttgaggctccgggcggatacactggaaggatgctgcgccaaccttcctggcagaggaaaactgtggtgttctgcgcgtgccagggcgagcacaggcagacccctccaccagcgcctgcgtgcctgggcaggcttctgcgcacagtcatcccagggcggcatgcgcgcggcagtgacccgcatgtgcnnnnnnnnnngcagggcaagcacgggcagacccctcaaccagcgcctgcgtgccagggcaggcatctgcgcacagccatcccagggtggcatgcgcgcggcagtgacccgcatgtgccaagcaccacaaaaatcaaccccaccgcatgccacatcgcccccacactgccactcacgctcggaggggcagcggcgctcggtacatgaggtgaacatcggcgcccagccccttgaagatgcccgcgaactcgacggcgatgtagcccccaccgatcacggcgatggaggtgtcggggtactcgtccagaaccagcgcctcgtcggaggtgatggcatgctcctgcgtgggtggtgaagggggggagggggcttcagggagagggggtgggcatttggcgtgcaggtgggctggctcggacgccgggatcgcattcaagggccgctgcgaggcacacgccgtgccgcccaagacaggaggaaaccccaccaaacccgccgcccgcccgacagaccttgccctccacggggatcttcacggcccgcccgcccgtggccaccaggatattggccgtcctcagccggcgcacggagccgtcggcggcccgaacctccactgtgtgcgggtccaggaccacaccacgcccctcgatctgctccacgccggcgttcttcaagatactggtgtacacgccgttcaggcgctgaatctccttgccctgccccggatgttgggggtgggaaggtgaacgcatgggcctgtttattttcccgatatgcatcggaaagggcggcgcgggggaagcggccaggtagnnnnnnnnnngcgcatgggcctgtttgtttgcccgatatgcatcgggaagggcggcgcgggggaagcggccaggtagacatccagggggcggcccccggccatccggtatgccaggccgtgtgcctcacggcgagtcggtgcgcgagcgcaggcacctgcagcgaggcatgcggcgccgccggtgcctgctacggagcattcagagccaggggcacacctcgccggcccaccttgcgggcgatgagctgcttgatgtccacagggggcgaggcggcgccccagccaaacccctgggcggcgcggaagccgtctgcgaactcggacctgcgggcgggcacgggcatggtgttcaggtgggcaggagggtgttcgaccctgggatcgcacgaccccaatgtctgccgtgcaaggttcatgtcgcaggcctgcccacactctgcgccgctcacgcatagaccaggagcttctttgggacgcatccgcggatcacgcatgtcccgccagcaccccccgtgctgtcatccgagacgaagccaaaggggagctcgatgacggccacctgtgaggcatccgggcgcggcaaaacaagtggagaccgggaggccggcgggtgcagcagcgggtgggaggagaataattccggggcagctcgtccatggcactcccccaccgtcacggaatttcgtgcgagtcagattaccttgcggccgtactttgacgcggccaagcgtgaggcgcgtacacctccagagcctgcaccgatggtgaccaggtcgtactcgaaaccatcctccccggcgtgatcagacatatttactggcctcttaaccgtctcccggggtgcgagaatgccctcaagatgccgcagcatgggcactgagtccgaattgtattggttgagggcgcctctggccgtagggcgggggttcagtttgtggtctgacaaattgccgacgataatccacgagggtcagtccgtccatgctgcctatggatcgcctcgtatgttcaatcaacttgttctaacgcataatacgttctaaagttttagatatgcctgatcgtcggtgtaagcggggttctttgtgccatccacacccagcactcccacctcggtgttgcacttcaactccccctggtaagcgcgggtgcctccgctggccctgatcacccatccaagcttccctcgagtgggtttacatgacgctgactgctgggccaaggacagcggggcagtcccattgggtcaatgaataccatcctggcatgaaaagtctcagtgagtgccctccatggtgctacacctgtcacacctggagctcatggaaagtaacgcatgacttgggtgattctaggcacgtgacatcatcagcgttaacaaatttgcaagtgaaacaaatggaggtgccatagctctaggtcccatcaggtgtgatgcaacatgtcattgtatcagaactatgccaggtgtatttttacgacccattttgtaaaggtataatgttggaataaataggtctctgacgtcatcctggacatcaccttgcttnnnnnnnnnnttaaaggtatattgtttggaataaataggtgtctgacgtcatcctggacatcaccttgctttgcaaatctggccatgtgtacagagtgggggcaggtaaagccggaggaggtggagaaggggagggagaagggaatggtggaggtgaggggggaggcgatgaggagggaggagatgatagggaatccctggagaagtccaatatcatctcacacacatgaacgatggccttccccaccgacttctagcctgaattttgcgcatgataggggcactttcggcgatggggttaatacagtgtgtgagggagcctgtggtcccgccctttccgctttttccgacagctcagtctctgcccccgacgccactcaggcgcatcgccacatccagtccggctcctaggcaaccgtggggactgttnnnnnnnnnncgtgagggagcctgtggtcccgcccttcccgattttccgacagctcagtctctggccccgacgcctctgaggcgcatcgccacatcaaatccggctcctaggcaaccgtggggactgttgtgacgtaaattactcaggaagggttacattgggtcgcgttgctgggtgtcatacggcctcaagcctgcagctatttggtttcgagaacaggctcagtccgaatnnnnnnnnnncattactcaggaagggttacattgggttgcgttgctgggtgtcatacggcctcaaccctgcagctgtttggtttcgagaacaggctcagtccgaatccgggtaccctcttgcccctttcagcataccggatcaagtccggaacggacgaatgctcgagaatgaaagtcttggggacgcaatggcgaggttggcggacgtcttagatcgatggatgcgctgcccccacatcgctgacgtcctccacctggacagaggcatgcccatctactggcttgaacgcatggccaggcgtatgannnnnnnnnnttgcccccatatcgctggcgtcctccacctcgacagagacatgcccatcaactggcttgaacgcatggccaggcgtatgaacatggcggtgctggacgatgagccgacgcgcctccagtattacgccatcaacctgcggggccctgtctatggatgggcctcatcccttttaagagggaatgccttcacaccagcagtgaccatgtgtgcggagtttgaaaggaaatttctggatttctttagacccatctactgccacaggcggggacgtgtggatctgtatcagctccagcagcggggtagcgtggcagaatatgcccgagagcaccagtccatcgtgtcgagnnnnnnnnnngatcagctccagcagtggggcagcggggcagaatctgcccgagagcaccagtccatcgtgtcgagcatcgaggacctgacgccagacgagtgccttgcgacattcacctcaggtctcaagccagagctgcagagggagaacagcgtgcactttgccagcagctatgaggaggccttggtgaaggcgcagtggcaggagcagaatacccgccgcagaagacagcgtaaccacacgctccctgcccaaaaggggcagcggtagggagactttagcgcaaagtgtcccgattgtgctagccgccacctccgactggccccgaaatcccagacagtgcggcctatggaccctgccttttgaatggagctgttgcagggagtccaccgcagcgtgggccacagtggactgcggcgcaacccaagcggacatgcagtgtaactggccaggagaagacatggacgtgtgacagttcgtttacacctgcggcgcctgccagcacaaggtttgcgttagagcctcatgcaggaccactccagcccctcccaacgctcattcgttccccggcagcaaatgcccctgagtatcatcaccggcctacctgacgcgccccgtagctataacgccgtccttgtctttgtcgtctgctgctccaggatgcagcattgcgagtccgccacaaagaagatcacagcgagggcgctggtcaagatgttcctcgattgcgtctgcaatctacccggctcacctggcattatggtcggcaactgcgacccttacttcaccattgggttctgggcccagctgtctggtgtgatgcacttgcatgactcatcatggtggtggagctcaatttggggctcagtgaaccccagccgccctttcgtttcagaaactctcactcggtctataagcaaatcatgtccaatctcgtttggaagtctggggtctggaatcctcacggccgtagagacgcttgtctgagcatgctcagctactcttcaaccggccagaaaccccacccgcaggagactctggactcgcatctgcaagatgaccgtctgacatgcacctacatggacacgaggaatctataggggctaaaacgtgatgcgttgaggaggttgagtcttcgagcttcccatgcgagggcctccctgcccagcacaggggaaggtctaactgcgtggcaccacactgtcccaagtgcgtgtttgccagtgctagggatcatgattgtatatatggcacatggtggagcacccaggggtagctgtgggcttcgctggctcaatgataggagcaggcatgaagcccaccctggccgaatcnnnnnnnnnnggcacagcacaggggaaggtgtaactgtgtggcaccacactgtcccaagtgcgtatttgccagtgctagggatcatgactgtatatatggcacatggtggcgcacccaggggcagctgtgggcttcgctggctcaatgatggcagcaggcatgaagcccaccctggccgaatccaattcttaatcggagttaaagaaagcgcgacaggagagggtgggaacgagatcctgtcgcgatggagggtgagcccgggcgtccatgttggtctcacgagcaaccccgtcccagattgactgttcttgtcgtatctcagcttggctgtgctccgtgctgacgaccatcatgctggcgacagctcccacagtgagtcactgggggataagtcccgaagcgtcccgtgcccccaccggtccaggcagggtccatgtggggaagtctaccccgttctccccaatatcacatgccttgattgtccaatgcctcccatgcagaccgcatttgggcaggtggctccaagcagggtctgcggcctgtcgggggcagcccggagggccagcgtcatcgcccgggccgagaacaacaagatccagaaggtgagcgaggagggtgtagatagcttctcaaggagactatcccgaacctccgatggtgagccgtatggggcttgcttgaattgctgcccttgccagttgcttggtgtccagtgcttgcgcctcgtgcttgcctccctgaaccccccccagcaatcctgcctctcccgccgacacttaacaagcctggcacaagccttcctcatctcgctcccttctcctcctcccgctccctcatacgagcaggtagaccgcatccagaagaatggcccgctgtacctgaactttgccagcgaccagtccctgacctacctggacggcacgctccctgccgacttcggcttcgacccccttggcctgtccgaccccgagggcgcggggggcttcgtcacccctgaatggctggcttacggcgaggtgtacaacggccgctgggccatgctgggcgcagcgggtgtgctgattccggacgtgctgtcccacgcgggcctgattccgcagaccccggaggagatcaagtggtggaagacgggggtcatcccgcccgcgggccagtacgacaagctttggctggacccctactccctcttctggatcgaggccattctgatgaacttcgtggagctgcggcggtaccaggactaccgcaacccggggtcaatgggccgccagtacttcctggggctggagggcggcttcaagggctccggcgagcccgcctaccccggcggccctttcttcaacccgcttggcttcggcaccaagagcgccgacgacctcaaggtctggaagaccaaggagctgcggaacgggcgcctggccatgatcgccatgctgggcttcgcggggcaggtgggcaggggttgatggtcatgggggaggagggaaagggtgaggttgtgggccgagcaaggagggctctggacgctctgctcgaggagccgggcgggggtgtctaaggcggcggctgtgcaggtgggatccacagctgagcacatggtactggcatgcacgaagtgacagcctcgcctgcttgaatgcccaccacgttcggttctctcctcccgccccgcaggctgttgcgacagaccgtggcccagtggagggcctgctcgcccacctcagcgatccctttggcaacaatgtcatcggcaacctgnnnnnnnnnntcccgcaggctgttgcaacagaccgtggcccagttgagggcctgctcgcccacctcagcgacccctttggcaacaatgtcatcggcaacctgtcccacttcctgcgctgagcatgcacctgcatccccctagtacaatggcagtaccgctgcagagaagaattcctggcgtgtaatcttcccccctccagacggtgccatgtgaatggggatccacccttcatggtcttcagccaagtgggaggtggccctcgttcaagtgtgccaaggggcaccaaccctctagagactgtcgcagaggcagcgcacgttgcacattctgttgcagaatctcacaggcttgggaaaagcctgctgcaccacaggcatcgaccaaccaccacccagaatcagcatcagaagagctggccgctggtggtggagcccaggccaagcggcaaagtgtggaagcgaaggacttgctggaggaggctgggatccactcccagcctcgaagtcatggccgccacctcggcctcgcccttgccctgacatctggtcagcagcagggctagctggcggctggtcagtcgacccctattcaaatcctctagctcggcggctcccagtcgcggccgtacgacctggtctgttgtctgctcctgcaaagcaggttggaatcaggcaaggaagggatgggaatctagtgctctttgtaccctacctatcattgtcatgcaggccatgggtgtggggagannnnnnnnnntgttggattcaggcaaggaaaggatgggagtctagcgctcgtgtaccctacctatgattgtcatgcaggccatgggtgtggggagagaagctaatatcaccagtgaagttcggctccctggtctgctgatcacgctgccatggagagcagcggaggcttgcaggccagaaggcatcgtccccacccctcagcacagacctgagaaaggctggtagtgtgctgtctgatgagcttacccagggcttccgcctgggaccccaccttctgggttgcatccagcgattccggcccaggctgtgcctcaagctgggcggccctgctctgttctgcagtactcggtttgacggcagggatcgatcgacgagtcaacttcacgtacaatttcactgcatgcaatctcgttggtgtgagattcacacgtaatgccaaggaatgcgactttctcgctgcgcacctgccctactaacgccttctgtggacggcagaggtaggttttcgacctcctccaccacacgccggcttcgagacgccgccctgctcagcctcgcacccatgacggcttacaaaaatcgattgcacgaagctggaatattgccgatccttatgtgtaacagatctctgggtgccgggcgagcaaagtgtcgcatagctcgcaagcttgtgctcttgtcacgcgttggggtcctggaatgcctcgattaacagtacagaaggaattatatttctgcagtggaccatagttcccaatactccaccatgcatgcctcacagccaatgcttgacggtcggggacccgcaagctaaccatgcgcgccgactagggaaatcaaggatactcttccgagaatcgccagtgtccacgcttctgagagtgcagcggacagcgttcacgtttacacctccaggtgaggacgcgagctctcccaggccattgaacatcccatggcacctgaggtctcagcattcgcatgccacaagaggccttagtccccaggcgctgcaggacacgtcctggctctgctgaaggcctgcccccgcctgacaattgcatgctcccccgccccagattccgcctgaacgacaatttccttgaaaacaaagctcacagctctgaggcgagtgtgctgttgttctcatcccctgtcacctcgccgctcttggcgatggtgaccttcttgctgggctgccccgattggctgcccagggcctcgatcttgtagaccacatccatgccctcaatcactgtggaannnnnnnnnntttgcatgctcccccgccccagattctgcctggacgacgttctccttggaaacaaagctcacagctctgaggcgagtgtnnnnnnnnnntgggaagcgggagaagagaagttgaggaccatgatgcctgcccttccaccatgcccttgcagcagcactctgacgcttccacatcaggtgctactctgcacaggctcgattcgctcatggactccaggcccatcgctcgtcagggagtggctgccccaaccccagcccgtcccccggcctacacgatccccttccctgcgctcacccctgccgaagacgacatggcggccnnnnnnnnnncgggtagcgggaggagaacttgagaaccatgctacctgcccttccaccatgcccttgcagcagcactctgacgcgtccacatcatgtgctactctgcacaggctcaactcgctcatggactccaggcccatcactcgtcaggaagtggctgccccaaccccagcccgtcccctggcctacacgatccccttccctgcactcacccctgccgaagacgacatggcggccgtccagccaagaggtcttcacggtggtgatgaagaactgggagccgttggagtcgcgccccgagtttgccatggagaggacacccggcccggtgtgcttgagcttgaagttctcatccgcaaacttgggaccgtagatggactcgccgccggtgccgtctccccgggtgaagtcgccgccctgcagcatgaactgggggatgatcctgcgcggtgggatggtgtgtgcggggctgtgaggggcggggcattgggtggagcggctgagtgatggaggttttcaggaggccatgtgactcattggtgacccagcccatggtgcgaggccagtggcgaggtgccaggttcccacctgtggaagtgactgccctggaaggtgagaggcttattggactgaccaatgcccttctcgcctgcagaacagtgggcacgggtgcggcgatgggtggggggatgtggctggacgggggatgcacatgccggacatcccgcccatgcagcgcaggcaggaagcacctgtggccagtgccctgaaattctccgcggttttggggacggtcttgccgtacagccccatcacgatcctgccggcaggggcgccatcgatctcgatgtcgaagaacacctggccgtcgaggcgatcaaggttgaagtcgaatgtgtacggggggccaacgactccgcaggacaactgcaggcacggcatctgaatggcacaccttgctagtgattttaggtccctttctctcggccagggcgcccgcgaccgcggccaggatcaccagcacggtcacgagggaacgggacgacatcctggtcatgcgggtcgcccgtggattatgaatcaggaagagcaatgggaatgatcggggttcgatgtgcgacgattgcgcaatgatctcaagtgttgggtcccccatccccggcatgacacctgccacggtgcacagcagcgcagcagcgcgatcctgcttgtgtcggacggggcatgaggatgctgttgcgggtcctgggggtttctcttcacccgctctgcaacattgtatgcattggttggaaagacataatttgcactgatcttctccgtgctgtcacgagagagagtggagcctgcgcctggtacgcgctgtctcgcgcccgcatatcccccagctgccccgcccgtcgtccccttcgcacgggaggcgccgctggtggacagcaccaagacgccgcctccgccacccggtgccaggagtcgcccgtgactgtcgacgccccggttatgccgctgcacgggggagccccggggctcgcctcagcgcactgcagctcgcctttcctcagcaacctggagtctttcaccgtccataccacccccatcatcgtgcatcaggtaggtcgcgacctccggtgcctgcccatgtggttgtcgctcgaccgtatccgtcccacacgtcgtccgctnnnnnnnnnnccgacccccggtgcctgcccatgtggtggtcgcgcgaccgtatccgtcccacacgtcgtccgctcccatgcaggcctgctgccaccccgcccaccccgctgggtaccccctggagggcctctggtgagtcaccgcgtgctcgcacctacctgcaaggggatcacgtggccacggtgctcggaggcagccgccatgggccatgtgcaggttcttgcagggcatcgcgcgttcctgctcagggcccgtgcacaatcccccggatttgcaggaaggcgtacgaggcgtggagcgcctacggcgctgaggtgccactcnnnnnnnnnngtgggccatgtgcaagttctcgcagggcatcgcgcgttcctgctcagggctcgtgcccatcccccggatttgcaggaaggcatacgaggcttggagcgcctacggcgctgaggtgccactcacgctgaacgtctctggcggccggcaagaggtgggtgctcggtgcttggtgtgtggcggcgagcaagcctgcgccgccgactggctggagggaggggtggtcgacccgcctgcggctgcctggagggcgccgcacccgcgcgccccatgcatcgccggcggaataggtagcacgccccctccttccttgcctgtgtgcgtcgccggcggcccctcactcccccaccatcacctccccttgggtacccacccgcccgcaggtggtccagagctacnnnnnnnnnncggtgcttggcggcgagcaggcctgcgccgccgattggctggagggacgggcggtcgacccgcctgcggctgcctcgagggcgccgcacccgcgcgttccatgcattgccggcggaataggtagcaaaccccctccttccttgcctgtgtgcatcgccggcggctcctcactcccccaccatcacctcccctcgggtaccccacccgcccgcaggtggtccagagctacgtgccgtacctgtctggcatccaggtcttccgcgcctcgcccgccccggacgcctcggtggggagcagcggagacagcgtcgcctcgggcgacctctccccggacagcgactgcgacgaggcgtgcgcgccgcagcacggcgggcaggccgcgccgcgggccgccgccggcggcgcg

SEQ ID NO: 37097 - DNA, 61 bp, Chlorella protothecoides
tcacctgtccctgctatgtcaagtatgttgtgaggaaacgcatgcacggaggtcgtcgtac

SEQ ID NO: 37098 - DNA, 73 bp, Chlorella protothecoides
ctccacctcccagccctccaccatcacccccgccaacacccccgccgccatctccacctcccagccctccacc

SEQ ID NO: 37099 - DNA, 2373 bp, Chlorella protothecoides
  modified_base (148)..(390): a, c, t, g, unknown or other
  modified_base (711)..(720): a, c, t, g, unknown or other
  modified_base (1419)..(1508): a, c, t, g, unknown or other
  modified_base (2046)..(2055): a, c, t, g, unknown or other
cgcgggcatggaggccgcggcgggcgaggggagcggtgagtggtgggggaggtggtcgtcaggggctggatcgtcgtgttgggcgcgtgtgtctgcgctgtgtgccgaccactccctgctgggtctggagctcgtcgtggaggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggaggaggatggtgcgcgtaggggtgccagccggcgtgcagtgtggcggcgggggagggggcggtgggaaagaccctcatcgcgtggaacctcacagaggtcccgaccccagacgggcgcgggcttgcacccagcgcctgccgtgcacatccccaacctcgcccccaaccccccatgcaatcgccagatgaggagggcgagggcctgctgagcggcgacgtgctggccgccgcggtgcacagcgtggacctggacagcgacggcttccccgggctggaaagcgcggcgccgcagctgtcgccgccccagcagcagccnnnnnnnnnntcccacgcgcaccatcgtcctcctcgtcctcgtcctcctcctccatcacgtcatcctccaggcccgacccctcctcccctgcgcagtcagggcgccaatgggatgggggtgagagggggtcctcacagcggggtctggaaggccgccgtgggacgagcgccggcccctctccctcggtttccatccagaacccccctccacgacgagctccagacccagcggggtctggaaggccgccgcgggacgagcgccggcccctctccctcggtttccatccagaacccccctccatgacgagctcaagacccagcagggagtggtcggcactctgcgtgcacacacacgcccaacacaacgatccagcccctgacgaccatcccccccaccactcaccgcttccctcgcccgccgcggcctccatgcccgcggtcagccagtccaggtcgccgccctcctccccctcgccacgcgcccccgcgcccggcgccgcgagtgccgcctcagcggcggcccgggcctgcgcccgcgtcaggcgcccgcccggcgcgccagcccccgcgcccccagacctggttccggcccctggggggctcctcgccccgacctccctcgaggccggtgcggagcgctcgtccctgacccgcggccagagaaagtcctccacctggtccagggtgaccatgggcaccacggacacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccgtggtcgcgcacccccgcgccctccgcgcccggcgcacggcacagccggaggttcagcggcgtgctcagcgtctccagcccggccgccagcgccccctggtcggccgtcgagccgccgccgccgcggcccagcgccgaccgcgccagccgcgcccaggaggaagaggccggcggcggggcgggggccgaggggcccaccgccagcttctcgctggcctccagggccgccagcgcgtggcgcaccagcgcccccaggtgcgtgccgccggagggatcggcggcaggaacggcggccgcgcaggcgcgctgccccgcgatcaggaactgggaccagcgcgccagcctggcgcccacgtcctgccccaggtccttgcctgattgcggtggtgcggagggaagaggtggcgggatgttcgggcccacaaagaaccttgcacccgcctctccaggccgcacccgcccgtccatccaccccccgcaagccgccacccattcccgtccaaccttgcaggtggcgccacagcgcgtccagnnnnnnnnnnggggcccacaaaggaccttgcacccgcctctccaggccgcgcccgcccgcccatccaccccccgcaagccgccccccattcccgtccgaccttgcaggtggcgccacagcgcgtccagcgccccgctgctcccaagctcgtaggtcgacaccgcctggtcctcgcccgaggccaggcgcgccagcaggccctccactgcgctcgcatcgggcagtgcggccgcgcagtcacgcaggcagcgcacggcctcggtctccgcgccgcgcggctcgccggcaaagcgctcgcggcgcaggcgcgcggcggcggccgcgttgc

SEQ ID NO: 37100 - DNA, 528 bp, Chlorella protothecoides
ggcgtgggcgaggcgctggccgcctcctgcctgccagccgtcgtggcgcagcgccgggcgctgctgtcgagggcggcccgcgccagggcgccgggcgccggggacggggcgggcgacggccgagggcaaggatttggcggtgcgacgccatcgtgtgaggcaggcctcgcgcccatgaccggcccaccgccagccgcgcccacccccctgccggctcccgacccccgcgcccggctgacggcgcaccgcatcctcctcaacgctcgctccctgtgcagcgcggactcggggacctcgcccggcgaacaggccgcgggggccgacgtggaagaagagtcattgccgcgcagccgcggggaggccgcgggccgcgatcgtcgctcgaaacggcggtccgcggccctgcggcgcgcgtgcttgggtctgtggaaccaggcggcgcccctgcaccgagggtcgtgggcgggcgccgggccgttcgaggcggccctggcgctgcgcgcggccggcggcgacgtggctccggcc

SEQ ID NO: 37101 - DNA, 10491 bp, Chlorella protothecoides
  modified_base (620)..(629): a, c, t, g, unknown or other
  modified_base (1418)..(1463): a, c, t, g, unknown or other
  modified_base (1885)..(1894): a, c, t, g, unknown or other
  modified_base (2096)..(2105): a, c, t, g, unknown or other
  modified_base (2178)..(2187): a, c, t, g, unknown or other
  modified_base (3756)..(3765): a, c, t, g, unknown or other
  modified_base (3862)..(3871): a, c, t, g, unknown or other
  modified_base (4129)..(4138): a, c, t, g, unknown or other
  modified_base (4917)..(4926): a, c, t, g, unknown or other
  modified_base (5006)..(5233): a, c, t, g, unknown or other
  modified_base (5440)..(5449): a, c, t, g, unknown or other
  modified_base (5714)..(5723): a, c, t, g, unknown or other
  modified_base (5889)..(5898): a, c, t, g, unknown or other
  modified_base (6188)..(6197): a, c, t, g, unknown or other
  modified_base (7475)..(7484): a, c, t, g, unknown or other
  modified_base (8455)..(8464): a, c, t, g, unknown or other
  modified_base (8709)..(8718): a, c, t, g, unknown or other
  modified_base (9169)..(9178): a, c, t, g, unknown or other
  modified_base (9691)..(9700): a, c, t, g, unknown or other
  modified_base (10427)..(10436): a, c, t, g, unknown or other
gctctacggcccgggcgtcgcccgcgacgcccggggcctgcttgccgtgctgggcggcgtagcgcgcggcgaggcggggggccctcccaacccgcgccggccgcacgcgccaggcgagtccagcgacagcctggaacacagcccggacgagggcggcgaggaggaggagatggtgctggtgaggagaagggggcggagtcccaggggagcggggtgccgatcagggtcgagctgacggcgccgtaagaggagcgggggaccgtgtggctgatctggagcacagggcggcgcagggactgctccatgccaaatgagaggctggccacggggccccaagggcccgcgccagtctacgcaactcaaccgcgccaacattcatgccccctaccccttcccccttcccctcaaccaacagggcgccatggacatggacgacgaggaggaaatcgcggccatcctgctgcgcctccaggacacccagctccagtcggcgccgtcggcggacgtgtcggccgccggcgcggcggacaaggacggcgccgtggccggcaggcggtacggcacccgtaccgccgcgggcctcaaggtcggccgccggtacaccgacctgctgggggagnnnnnnnnnnagcgccgtggccggcaggcgatacggcactcgtaccgccgcgggcctcaaggttggccgccggtacaccgacctgctgggggagtgacgtgcggggcgcagcagaaccccccgaaagtcctcagccctgtgagacaggcccagcgacgcactgggcccccgcaggctgcccaagagggagcctatcctcaagcccgagtgccagaccccaaggccgcctggcacttctgccggcccgcgcgaatgcaccagacagacggaaccgtacgacagttgacagtccacagcgccccatgcaggataacccctgctccaccagccctcgaggctggggttggacccctgtttcatgtagtgcactgtgcgggggaaccacgccccccccggcgtgaacccactcccccccgttgtccgacttttatgtataccccggggggctcatcacctttgggccgctcaggtctgcgccccgaccttgtaccatccaggagctccctcgacccccacttcgtccaatcgtgcgggtgtccctcttaagggccacccccaggctcttttcctggcgctcccatgccatagaacctcccacagcagccaccgagcagcagtattcagccgggcgcccctcccctcaggcgagcacgcccggcacatgccaagttcccctgctgtgcatctcctcaagcacttctccctcctggattcttatttttggtgcgctccccctgttgcaagcataccctctgcaagtagttgtacagcccaggggggggggggggggggggggggnnnnnnnnnnnnnnnnnnnnnnnnnnnnnnnnnnnnnnnnnnnnnntgcctctcaatctctgtgtatgtgccgccttcacggcagcctccttctgcccaagccttcagaccgtggggagcttgagggcggagaggaagagcgcctccacccccgcgccgcggcacagggatgccagctcccccataccctccccagcgacctcgcggaggggcaagggcaagcggcgcgtaaggccacccgcctcctccccccgcacggccatggcgctccagcgcagcgcgcgcagcgtggccgtgtatccctccagcgctgcaagggatccctccgcaacgatgacgccgggaaagcctggcttgctgaagcctccgatctgggggggcggggggtgatggggagagattatgagtgaggcaacagggagcaggatgagcttgggtggtggtcagtgttgcggcggcactgccaannnnnnnnnntgtgagtgaggcaacagggagcaggatgaggttggttggtggtcagtgttgcggcggcactgccaagggacggggcccattgggctttcaccaactcgccaaaccccaaggagagactgatgctcatgcttcgggatccactcgtcaccggaagccaaacacgcagggggtacacctcaagatttttggcttcctgcacgannnnnnnnnncccttcacactcctcgcatcagcttcaaccggattctcatccttctgttgttcagtggaggactgcagatctnnnnnnnnnncctcgccaaaccccaaggagagaccgatgctcatgcttcgggatccactcttcaccggaagccaagcacgcagggggcacacctcaagatttttggcttcctgcacgataactttccgcttggtcaggcttttgatatggtgaaaccagaagagccgacagcacatgggatccggagattccggcgccttcacaatcctcgcatcagcttcacccggattctcatcgttctgttgttcagtggaggactgcagatcttgggcagcggcgaccagggcagccacacaagccaaaagacacggaaggccttgtgaagcctctgccgtggtcttcaccactgcctgcagctcggcagtgacatccctacatgtcggtttgtgggacagaagattcgctttcatgtcgatgggttgtgcagatggatacaagcagtatggggtgcatgtctgaggcatgcactgtgtattacatacagtcgggcatgggcccctctcgttttctgacctgggggctgcactgtgcactgtgagggagggccactctctggggtatgcaatgggcagggagatgttcagactgatgggttctcctgatgcaaggacatcagggatgtggagggtggcccccagctcccccgccaatcccgtttttgactggaggacgagggcctgctcctcagcgggggtgaggaccaaggcaccagcctccgggtaacaagcctgcaaagcgaggagatcctctgccgcctcgctacaagagttcattcaagccattaagttatggtctgaactccgatcgcaagcgtggactccttgctcgacccatctgattgtggtggttccggcacaccgtgctccgcgtgacaaggctctgctccgctgagtgaatgggcttccggacgcggtaccagtagggttatcaaggcaaatgctgtcgcgagctcgaccccaatcgtttcgataacaagatcagcggaggaagggcctgtcagctggctggttcttgggccactttcccacggtcacctttcgcactcctgccgaccgaaaccccattccatcaagatggctctgcaggcatgccgagcgttgtccggcaagtcctcccgtttcacccctgcattctctgcccgatgcatgagccaggtggccaccaaacccgacagcattggggagctgccgcccttcgactacaagcctgcgccctatgtcggtcccagcaaggaggaggtcctcgccctgcgcaaggagcaccttagccctggtacgcggcgatctatggaaacttatgacatttttatgattgaaattgcttgcagctgggaattggacattgagacttatgagggttgcgggtcacgttttcccttgacctaccccccaacgccctcactccacagccatgctgtaccacttcaagaacccaggtgtgactggacgatttcttgtgatcagttcctgttgtacgatattggattgggcggctcgcaggaccctgtctttggcgtcccagtctgccgcgaatctcaccatgagccactcccaactccgcagtcatgatcacccacggnnnnnnnnnncatgggagatcatgacatttttaagattaacattgcttgcagctgggaattggactttgagacttctgagggttgcgggtcacgttttcccttgacnnnnnnnnnnacggctcgcaggaccctgtctttggcgttccagtctgccgcgcatctcaccatgagccattcccaactccgcagtcatgatcacccacggcaagatgcagtacctctttgacgagcggggccgccgctacctcgatgtgtgtgtccgaggtgtttggtaatggctgctactgtcgccacactgtggtacttaccgccactatcacattccgcaactgcctcttctgtttccagataccccttacaagcacatcccccnnnnnnnnnnggtgtccgaggtctttggtagtggctgctactgtcgccacactgtggtactcaccgccactatcacgttccgcagctgcctcttctgattccagataccccttacaagcacatcccccatgcttaccacgccaccaccaggcctttgccggcatcgtcactgtctcggtgggacactgccaccccgaggttaacaaggcggtgatcgagcagacggagcgcctgcagcacaccaccgtgatctacctgaacaaccagatcgccgagtatgccaaggagctgaccgaccgcatgccaggcaacctgaaggcgcgcaggggaggaaagggagggagtgacctgggacggtttctggtatataagaggtggtcagggcagggagcactgtggctcccatgcacattcagagtgcctggccttgcctctgccttgcccagcccagcccctgggtgtgtgacagcacccaccaccctcacccccacctccctctcattctcaaaccaccccgccgctcaggtggcctactttgtgaactcggggtcagaggcaaatgacatggccatcatgatggcccggctgtacaccgggcagtacgacatgatcgcgctgcgcaatgggtaccacggcctgacgggagccaccatgggactcatggggctccacacctggaaggccaacatcccgcacgtgaggcctgggggacgggtgggtgggcgccctcagagtggcttcgcgtgaggtgcccaggacctgcagggatgaggggagcatgccctgcannnnnnnnnncgacagtacccaccaccctcagccccccctccccctcattctcaaaccacccgccgctcaggtggcctactttgtgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgggcgcccttagattggcttcgcgtgaggtgcccagggcctgcagggatgaggggagcatgccctgcaagttttgggaagcttgtggctgtgtcgacccatcccgtcggtgcggctgggcatcaccccatcctgcctcggcgtggttctcggctgatcgccagagcggcatgcctgacacaatgtcccctccacctgcaggnnnnnnnnnnccgcgttggtgtggctgggcatcgccccatcctgcctcggcgaggctctcggctgatcgccggagcggccggcctgacacaatgtcccctccacctgcagggattcggcgtgcaccatgcactgaaccccgacccctaccgtggcgttttcggcaatgacggccccgcctacgccaggggtaggctggcaatggcagggctggcaggggcggggatgagggattgaacctgtatgctgcttgcaagtatgtgaccggggtccagnnnnnnnnnngatggcagggccggcaggggcggggatgaggaattgaacctgtacgctgcttgcaagtatgtgaccggggtccagcatactccgaggccaacccttggccccttttttccccctcgtacagatgtgacggacatcatccagagctcgaccccgggtcgcgtggccnnnnnnnnnnagccaagccttggtcccttcttttcccctcgtacagatgtgacggacattatccagagctcgaccccgggtcgcgtggccgggttcatctccgagaccatccagggggttggtggcgctgtgccgctggctgacgggtacctccccgaggtctacaaggtgtgtggggttatgcgaggcccctcaaactctgaaccatggagtggtcagatctgtagcagggaacggaggctgctgctgcgatgtggtgtctcattggtgctatgaaatcggtgctgagccagcatcctnnnnnnnnnntacctccccgaggtctacaaggtgagtggggttatgtgagggtcctcaaactcagaaccatggagtggtcagatctttagcagggaacggaggctgccgctgcgatgtggcgtctcattggggctatgaaatcggtgctgagccagcatcctcggccgttgcagctccacgaggctgcccaccgcgtcccgtttccatctgacggccacactcttaaattctaagccatgtccatcttcccatcctatcatccccagaccgttcgcgaggccggcggcatctgcatcgccgatgaagtccagaccggctttgggcgaaccggctccaactactgggtgagggcacactcagggggtgggtccctcatatacttgggcctaatccatggcttttgttccccctggctgttcttaatgcctggatctagcgtcgatggcagggccgcatgtcacctgccttcatctggactgctgcatggctctgcagacagttgcccctcccagcccccatggaaattagcagtttgagctcagcagcccaagtcctggccaagcagcccctcacccgctgtcccgcgccgtccatccaccctgcagggtttccagaacgctggggtgacccccgacatcgtgactatggccaagggcatcggcaacgggctgccgctgggcgcggtagtcacgactccggagatcgccgccaccctggcccagcgcctgcacttcaacacctacggcggcaaccccgtctgctccgctggcggccgcgcggtgagtgcccgggccggcgtggcagggtttggtagtggaggagccctggagccaatctcaccctctcactattcacattgctcaatccttcttgactttcaccaggtgctgcgtgtgatcgaccaggagggcatccaggccaaggccgccgacgtgggaggccacctgctgaagggcctgcgtggcctggccgccaagcatgacgtgatcggcgacgtgaggggcctgggcctgatgaccggcatggagctggtcaaggaccgcgccaccaaggtaatcattggaaatggaagttggaggtagcgtgtgtggcttggtgggaccgaggcagcttgggccccagcaggatcctggtcctgaggcttcagatttccctggacgcctgatgtgcatggtgtgttgggctgccggccgcaccagcccacgaccacctctccgacacccttgcgccccgcatgattgtcatgagattccctcgaaataccctaccctcccggtgctgacgacnnnnnnnnnntcacctctccgacacccttgcgccccgcctgattgtcatgaggttcccttgaaataccctaccctcccggtgctgacgactctgtctcccatcacacacactacctccttccgacactggtacaggagcccgccaaggaggagactgcctacgtatttgagcgctgcaaggacctgggcgtgctgcttggaaagggtggcctgcacggcaacgtcttccgtatcaagcctcccatgtgcatcaccaagcccgatgtcgactttctggtggccgccctggaccaggcgctgtccgagctgtgatcaggcctcggtggcgccacaagggtcattcaatccccgtgaaaccatttcccgcatgcaggctgcgcttcgacagcttggcaacctctctctgctgcatgccgcctcagcatggaggcctgcctgcctgcttgcacaatcctggtaccatgttacagacgaggagccgcaggtacaagggtgttcaggggatgcaaacagttggcatggatgctcaggcctcctcttcatccccatcggacgaggcttcgctcccgctccccgcactctcctcctcggcgtcttgcagccagctgaggaagggctgtgcctgtattttgtagtagcagggaaggagggggcatgttcgatacccaagcagacctgtccccgcctcggccctccaggcagctgcacgccaggctccgtccgcgaggcggctccactcctgccgaccaaagcaactcccctcctcctccattcaatctaccttgcggaggaagaccttctcgtcctcctcggccagggacttttccgccgcccactgcagtatggcctcctccgtcaggatgtcctcgtcgtacagtgccttgagcagctgcggggaagccggcgaggcgggagattggcatccataccctgtcaggcagggtcctcctgctcggagtaccgtttcctcggtgatctggnnnnnnnnnngcggcgaggcgggagagtggcgtccatgccctgtcaggcaggggcctcccgctcggagtaccgtttcctcggtgatctggagcccaacacccctgttccccctttcctcgcaaatcaacaacccccctcacccgtccaaggaggccccgcccagcctcccccacaacttcccacctgggcaaagatgtgggcgaacacgggcccatgctccccagtggcctcgtagtcgccctccgcggagcaannnnnnnnnnattccccctttcttcacggatcaacaaacccccttacccgtccaaggaggccccacccaacctcccccacaacttctcacctgggcaaagatgtgggcaaacacgggcccatgctcccccgtggcctcgtagtcgccctccgcggagcaaaactcctccagcgtgagcaggacctccacctggtcgtcctccgatcgcaggaacttctggagcagggccttccagcgccgcacctgcgcgctggcgcgctgcagcagctccaccaggccctcgcggctgcccgccccgggggcggaatgcgtgtatagctcccggtactctgcccggcagctggttggcgcgggcaggcacaggcccagcatcgtggtcagcatgtacctttggatgcggagagagggcatcgttgcttgcggggcaggcgggtgctggaatgacggtgagggccttgtannnnnnnnnntgtggagagggcatcgttgcttgcggggtaggcggggtgctggaatgacggtgagggccttgtacgatactcgggtgtggggaacagaggcttcgcgtactccctggtgcacactgcatgtgcacaggccaggctgccccaacccagatccccagccccatccagagcgatcctcaccgcgcgcagtcagcaaaggtccggtcctcggcgatcttgaggccgttgagctcgatgaccacgttgtcgtgcgcgatgctttccttgacgcagcgcaggaaggtctcccccacctcccgcttgaacatggggcccacagcctgcgccacctcggcgtcggtggtgccggcctcctgtgagaggcacgagtgtcgaagggtggctggcgaaggggtgcagtgggccgggaacgcatgcaccagactccacaagagtgggcaaaaccaggcgccaaatgcaaggcggttcctctcgcgaggagcacgtcgtgcccagccaaggtcccggtgacccccnnnnnnnnnncggcgcgagtgtggaagggtggctggcaaaggggtgcactgggccgggcacgcatgcaccagactccaccagagcgggcaaaaccaggcgccagatgcagggcggttcctctcgcaaggagcacctcgtgcccagccaaggtcccggtgaccccccctcctgtcattcctgcagctcccctcactaaatcacatccagccaaacacacgcgagtcttgggtcaccccccttcccccgagagtatgatcctgcgccccgccacccccacccaaggcctcacccccgcagcactgttgacttcgtcgtcggagctctcgccctcctcccccgcggcatggccgggggcggaggggaagagggagtgccgggcggagtccttgtcgtccgcccaggcgaagccagcgcccagaccgccgaccacatcctgaggggggcgtttgggggagtgggagagagggtctggtgtactgcttggtgccttgcgatggccgcacacctcccggcaagcacgaggcccctcaaactccctgtcagggcccttttctctaggaagaaagcaggccccgctcagtcacgcaccgtgtcgaagccgaccgcggtctcggggatgctgccggcggccagcgaggcggccgcggccacgagcgacggcggcggctggccgaagtcgtccgcctcgtcctcctctgccagctcaaagtctgcgcgcggggggtgggtgggtggnnnnnnnnnnacccttttccccaggaagaaagcacgccccgctcagtcacgcaccgtgtcgaagc

SEQ ID NO: 37102 - DNA, 63 bp, Chlorella protothecoides
cgccctcccaaccttgcagggcgtgtggctgagggactacaagccgatgaaggaccgggtgcc

SEQ ID NO: 37103 - DNA, 136 bp, Chlorella protothecoides
gaaaggccagcagagttggaggggtatgggcccagaacgttctcggccgggacctcatttgctgcacgccgcaagctggggagggggcgcaaacaggcagcccacgcccctttgcaacagcacggacgggtccagg

SEQ ID NO: 37104 - DNA, 61 bp, Chlorella protothecoides
tacgacaaaccttctcatctcacccttctttctgttgcggacagagctccctcctgctgaa

SEQ ID NO: 37105 - DNA, 61 bp, Chlorella protothecoides
gtcctcattgcctacctccacacacacacaaacacttgcacacgattcatccccctctgac

SEQ ID NO: 37106 - DNA, 61 bp, Chlorella protothecoides
ttggccgccccgttcacatcgcggttgacggcatgaactctgcaggccttgttgccgcacc

SEQ ID NO: 37107 - DNA, 6352 bp, Chlorella protothecoides
  modified_base (187)..(253): a, c, t, g, unknown or other
  modified_base (713)..(722): a, c, t, g, unknown or other
  modified_base (1111)..(1120): a, c, t, g, unknown or other
  modified_base (1396)..(1405): a, c, t, g, unknown or other
  modified_base (1494)..(1503): a, c, t, g, unknown or other
  modified_base (1580)..(1589): a, c, t, g, unknown or other
  modified_base (2345)..(2354): a, c, t, g, unknown or other
  modified_base (3531)..(3540): a, c, t, g, unknown or other
  modified_base (4047)..(4056): a, c, t, g, unknown or other
  modified_base (4472)..(4481): a, c, t, g, unknown or other
  modified_base (5174)..(5183): a, c, t, g, unknown or other
  modified_base (5850)..(5859): a, c, t, g, unknown or other
cggggcgagcggcgtggcccgcgccgtcgaggatgacgacccgtttgctgggatggactccgatgaccccgaggagggcggcgtggcctcccgcatccagatgtcccccagccagatgcaggacatgcaggctcgcctgcagcggctctccctcgcggagcccgggtggggcgcggacgacggcgcnnnnnnnnnnnnnnnnnnnnnnnnnnnnnnnnnnnnnnnnnnnnnnnnnnnnnnnnnnnnnnnnnnncccgaagtcggcgtcggggggtgggcgggcgcgcgccgggcctcgccggtggcgccgccaggaatcgaccccgccgggtccaactctgcagcggccggcgctgcgggcacccgaccccagcctccccccctgtcgcgggacagctccgctggcgccctggcccccctccccgcccgcctgctgcagctgcaccacctcagcctgggcctgctgcaggcgggccaggcgccgcatgacaccctgggcgcagcctccctggtgcaggtggccgggtgcctgctggggctgacgcgccagggcgctgccatcctcgccgtcctggagccgcagtcggcaggggcgctgcacgcgcgcatgtcccacctgcggcgctgacggttttcctttgcgacctcctggagggggcggggaggggggatacccgcgcctaaacagggcctgagggctcttttgctccctnnnnnnnnnngggggagaagggggatacccgcgcctgaaacagggcctgagggctcttttgctccctttgaagagcggcgtgtttgacaccggcagcactgattttccctccacaactcctgcttccttggcccttgcataacccacatttccagctgcccctttcattcaaggcgcggcgggtgagccccccgcagcccgccctgccagatcctactttgtcctcctttgctgcttcaccaaaagcactgcaaggtaccgccctgtgcatctttcacatgttcgctgttttgcaaggcggtatgcagtcagcagagtcagaactttcggtgtaggagggggctctggctgcggccaatcgctccgcagggcagagagagggcatgcaaggcgacccannnnnnnnnnccctcctttgctgcttcaccaaaagcgctgcaaggtaccgccctgtgcatctttcacgtgtttgctgttttgcaaggcggtgtgcagtcagcagagtcagaactttcggtgtgggagggggctctggctgcggccgatcgctcggcggggcagagagagggcatgcaaggcgacccacatggcgagctccgggggtctttcctgatttcgattgcagccagcagactgacccagtggaagaaggcccgaccggttgatgcagctgagctgtagcgnnnnnnnnnntcgggagtctttcctgatttcgattgcagcgagcagactgacccagtggaagaagggtccgaccggttgatgcagctgagctgtagtgnnnnnnnnnngcccaagcatgtgttcgtgggcgcgtgctcgcacagtccctctctggtagggcgtgtagcccccccgcccgcggccnnnnnnnnnnccccctactcccgccgcagcctgcatggcaggtttctcaggccgcccctgccctacccaagcatgtgttcgtgagcgtgtgctcgcacagtcccactctagtagggcgtgtagcccccccgcccgcggccgcggccacggccgcgcggcatgtacccgccccacatccagggcatcatgaagggcgggggcatcatgtagccgccggcgccgccgcgcccccgaccccgcccgcgcgcccgcatgcccgggacgttggtgcgcttggggttcaccttgagcgtccggccgcgcagctccgacccgtccagcaggcacgcggcggacacggcatccgcctccaggaactcgatataggcaaagcccttggggttgccggccttgtcggacaggatggtgacccggttgacggtgccgcagccctggaagtgggactggagctcctcgggcgtcgcagcgtagtccacactgccaacgtagacggagcgagagtcggcctcctccttgttcgcgtcggtgccgggggcggaggtgccaggaaccaggccggcatccttttgtgccttttcctggggcgggcagggggatgaggagggtgtttgtgggatgtgaatttggagcggcatgggcgggagggaatgccgtggcatggaaaggcatggcaaagcctcaccagccgggagccgcgcactgcttaagaacaccgatggcccctggtgcatcactttatcatcatacgtggctcgtcggcagcatnnnnnnnnnncttgtggggatgtgaatttggaacggcatgggcgggagggactgccgtggcatggaaaggcatggcaaagtcccaccagccgggagccgcgcactgttttaagaacaccgatggcccctggcgcatcacgttatcatcatacgtggctcgtcggcagcatgctggcatgactgcggcctcgcgcccatgttctgcccagcagccacggatgtccccacctgtatctccttgagcttggctgcttcccgctccatctcctccaggcgagccttcatcgactcgatgtcctgcggagcaaggactatcatggtatcatgccgccccagtgaaggcgacatgtggcgagacggtgggcacagcgcaaaacaacccccaccaccgcaaggggtgttctggccgcttacaccactcaattgctccacgtgcatacccatcacccgggcttacatccatctgatcctctcctagctgtccctccagctcgacatcgccgtccaggtcgacataggcgccttcctccgtcatcgaaaactgtcgggaggccggcagggggctcgttgtcgtaccgcacggccgaaaggttcttttcaggtacggggagaggtctgcagtgatttgggcgtgcatgagcttcttctgtgtcagcagaccgctcggcagggaagtggcccagggatccgtgttaagagagggagttcctggcgggaagctctcgtgagcgcgcgatctgcatgcacataaaaattcaagagccacggctcgacacgaggcccaatcccacccatgccgatggtttgaagcaggatatgccctcattgctgctattggatgtgaagggagaagcactgcccgctccagaagccatgtaggcgatcgctagttgggcggcatacctcaccgcacgccgggagtcgtcgggagtcatcgatgccatcatcgcccccgacctgtgcattctgcgatgagccagagggtccgacccatggcctcgggcccctcctgggtcccatcccaggattaggctcggggttgggaaggggtgcttatgtgcatagggtgtgtgcgatctggtctccgcaggtgggcagcgaaggagggggggaggtaacagtaccgctctgccggggccgcgcccattttggaccaagaacgtgatgcacgcacaccacaaagcacnnnnnnnnnnagaggggggggggaacagtaccgctctgccggggccccgcccattttggaccgagaacgtgatgcacgcacaccacaaagcacagtgtcagatgtccctgtcgcaatgtcaccaccaggtgtgcgagacacccgagggaggattgaggggggtggctggagaggtgcggcgcgggcgagccctgcgatgtgcccactgcggcaagcgcggggcgtccctgggatgccgcctggcctcctgccacagctcgttccacgtggcgtgcgcccaggccgcgggggcctccttcttcctgggcagcttccaggtggcatgcaaggcccatgccaggctgtttggcggggagcccagcgtgcccaagctcctggggtgagcgggggtggtggggtgcaggaaagggccctgcaagggtttgttgaccagctggggtgttagcttgagcccggccaccgtgtttctgtgggagatccagtccaatgcccccttcgccagcaagtcccgccctgnnnnnnnnnnacaggggtttgctgaccagctggggtgttggcttgagcctggccaccgtgtttctgtgggagatccagttcgatgcccccttcgccagcaagtcccgccctgcccccgcaggttgatgctggatgccgagacgatgcggcccatcgccagcccctccggcggcaagaagctgatggcctcccctcccctgcgcgcccagcgtttcccggggggaaagggcgaccgggccgcagggcgccgggctgaggtgctccaggcgcgggccgcgctccgtgcgtggcgcgaggaggaaaggtgggagtgaggtatggacgagtgtgaggtggcgttgcggagcggccaggggcaccccctcaccaaggtccgccgaccaaaagatgcagggccccgtccctcccagcaaccgcgctgccggnnnnnnnnnncgcggagcggccaggggcaccctctcaccaaggtccgccggccaagagatgcgggcccccgtccctcccagcaaccgcgctgccggatcgtctggtgctgaccaacgccccctccttctgtcgtgctgacccacaggcgccagcgggagctgtcgtcgtccgacgaggagcacctgcggtccagggaggcgcagcgggaagaaagggagatcgccagcctgcagcccgtcctcctgggcgccgagccccagggcgagggcgatggtctgtacacccgacccctgaccacgtttgctgatgtggcggggatggagggcgtgaaggccgcgctgcgcgagatggtgctcctccccctcctggccccccaggtcctgcaagacatgggcatctccgctccgaggcagggaagggagaaggcgggttgacctgagaggatgtgggtgagggtgaggggacggccggcttgctgtgctccgtggagcagtgcagggtatcgaggcaccaacgggggccatccccgtcctacgcctgaccaaaacttcagcagaatggggttgggcaggagacgccgtcccctctccttttgttagtgcattcaaggatccgtcgcccctggccgacaccctgcccatgtcatccactatgcctccctgtctatcctaccacccaggggcatactgctgcatggtcctnnnnnnnnnnatcgtggagcggtgtagggtatcgaggcgccaacgggggtcatccacgacctacgcctgaccgaaacttcagcagaatggggttgggcaagagacgccgtcccctctccttctgttaatgcattcaaggatccgtcgcccctggccgacacccctgcccatgtcatccgctatgcctccctgcctatcctgccacccaggggcatactgctgcatggtcctccagggacaggcaagaccctcatcgtcagggccctggcgggcgagtgcgctgcgtttgcggcctcgcgtgtctcgctcttcgtccgcagcggcgccgactgcctgggcaagttccatggggaggccgagcgcacgctgcgcctcctctttgacgaggtgaggcgctgtttgccgggagacggcaggcaactgcgcgaggagggtgggtgggatgactagtgccagaagcaggggatgcagggaggctgtgagtttccgagtatccctcactctcccccactcttcctctcgcccgctcgccatcgccccggcagccctcttcatcacccttccttgctccccaccgcagccctcttcagtgatcaccccctcctcaccagttccaggccccccttcactgcaggccgcacgccgtgcgccctccatcatcttcttcgacgaactgnnnnnnnnnngggcagccctcttcaacacccttacttgctcctcaccgcagccctctccagtaatcaacccctcctcaccaatctcaggccccccctcactgcaggccacacgccgcgcgccctccatcatcttcttcgacgaactggacgcgctggcgcccgcgcgcaccgcacgccacgactccccctccgaccagacatttgcctctgtggtttccaccgtgctctgcctcatggatggggtgggcaaccgcggcgcggtggttgtgattggcgccaccaactcgccagacagcctggacccggccctgcgccgccccggtcgcttcgaccgcgaggtggaagtcggcctgccatcttcgcgcgagcgcctcggcgtcctgcgtgcacacacccggcgctggccgcagccgccggaccccgagctgctggcccgcctggcggccgccacgcgcggctgggccggcgccgacctgcaagcgctggcggcggccgccgtcgt

SEQ ID NO: 37108 - DNA, 91 bp, Chlorella protothecoides
tcacccctatcccagggccctaggcttaccgaccagacagatcttggcccaggctgcaaagcttgccacctctcagccagggttccatggg

SEQ ID NO: 37109 - DNA, 6745 bp, Chlorella protothecoides
  modified_base (206)..(301): a, c, t, g, unknown or other
  modified_base (1631)..(1670): a, c, t, g, unknown or other
atggccccgcggcccagccgcgccgcgggcgtgcccgcgcgcggcgcggcgtagggcgccagctgggcgcccagcgtggccagcagggcgccgcgctcgcccagctcgcgcaggccgggggggaggtccaggcgcagcacgcgaccggcgtggtccacgcgcgccacgatggagggcacccagggcaccaggtgctccacaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgatgccccggtcacgccacgcaccgtcagcatgggctggccctggccggggtgcagggagtggacgctgcccagcgcctccccggtctcagcacaggtcaccgtgtagccgatcaggtcggggttggggggcgggggcggctggggaggggaccagggcttcggggctgggggggagggggagcgccgcctgcaagggaggggtttgagatgggtgcctgagtgccagccgggcaggtggggcgcatgcgaccagcatgccaccgagttatcgaaacttcatgtcaggtacaggtaaatgtgccagccaattcccagcccatgcgcacctgggacggtgatgatggtgacgtcgcccggggacggcctgcagggccgatgcgctgtggggatgcgcgaggggtgctcgccccaccagtgccctggagggacacagcaacagaggagtgcttctacaatggctccatccggcccgacccagcatctgcatccttttgtcttggctttgccagcaggcgacctcaccccaggctatgagaaggccaggggcggtatcgtcgccgcgcacggttgggaaggagcatgatcagattctagaggtcttagcaaggaatttgtgcaaaaattgctgccatgctcacgagcaaggtgcagagtcgtccttggaatggtttcgcgggcgcggagacccttgaaaccgatctgatagtacacacccacccggtcgccatgcaagatccaacactgtgctggtgagcatacaggggcacctcagaatgctatcggtataatcgaaacagcctgtatcgagaggcccgaggacccatggccggatctgcggccatgcccacctctgtggctcgccccctaaaggctttcacgacccttcagccccggcccacacgccgcacgagatgcgctccggagcggcccaccgccctgaatttttcagcaaagccccacctccgcttcagcaaaggtgcatgccgacggcatggctcgggtccgtgtgggccgacgggcgccctttttcgtggcctatgtgcactagtcaaggaaggatgccgcacgctcgtgaacccacatcctgcgcgcaggtgctagtgcacccgtgtcctccgatggcatatgcacccagaaatcccagctcctgagcgggacaggcagccacaaggacaccacacaggccatagaggacctgctcaccaagagcgacgagcatttcgcagagctgggcctggcgttcgagtggagcctggcgcccaacctggatgagctcaacgacctcttccagcgggtgtgaagggtctgggggggggggggggccnnnnnnnnnnnnnnnnnnnnnnnnnnnnnnnnnnnnnnnntgcgtctgagcgatcgatgggtttgttggagtccaacgatgcaattggccagcgatctactgggcgggattgtgcaggcgcccttcccaggcctcagcatgtggcctggacggcggccatgcagcctccacggcaccccgacgccgcacctcagcattcatgggctcgcggtgcgcaggtgggcttcccgcgccgcgacaaggccaagttcgccgaggcgctgagcaacacgcattgcacggtgtgggtgcgtgcaacccggaagtcgcgcatggcgcgggagggccagctgctcgcctttgcccgggcgaccagcgacaaggccctgaccgcgaccatttgggacgtggcggtgagtggttgccagggggaccttggtgttcctttggtgctgaaggaggggcggaagctgatacacgagggctgctgcggtgcacagcactgggctgctcctttggatggtactgtgcagaaactcgcatgcccagataagcagtcatttccctttcaacacgctcaccgtgccaggtcacgcccggctggcagcgcatcgggctgggcagggcgctggtggagcgcttactggaggcgctgacgtcgcagggcatccccaccatcaccctctacgccggtaggggttggctcgcgtcggcggcgtgggaattttgtgctgcctggggtggaaggcggggggccttggtgggactggtcaatggcatgggcgagctccttgcacagcacaaccttccctcccttccggtgcagagccgggggttgtgggcatgtatgagaagatgggcttcgtgtgcgacccccagggtgtgaagggcctcgcctttcagcagaaacgtgggcgatgacctcgacggaggggtgcttgcaggccagctcacagggttttggggcgggccctttttcatcaagtgtgcagcgccgtgctccaaggctgggacctgggccaggctgccctgttccaaccctctcgacagccgtgacctcatgcatgcgcggccaaggcgcggacatgctgcagtgccctggtctcctcctcctgcatgcagccgctgcgaagcctgggccatgccggcttgttgtcccttgaaattacaccatcgcactgtaataacagcagcaggagcagcagcatagataaaggagggtatctcgaggccagcgagccgcaaggcttagaaaatgttggtgtccttggcatctcaatgcctgaagcgcctcgcgcacatgcctcccagcacctcaggcgccctcctggacgggaaagcgctgcgcggcggctgccaggaaggcctcactgcgcgcggcgcactcggcccaccgcacccgcgcgtactcgaggtagtcaaagtccagcaggctccactgggcctgcaggaagcaccatgcaccccagtactggtggctggccagggcatacaggttggcctccgccacggcgtccgccaccgcgtccgccgagatctctgccggggcgacgccggcctccgccgccaggtaggcgcgcagaaaggcgccggcctcctcgtcgctggggtactgggtgtagtcgccgtcaaagccagcgtacctgcgttggggaaacttgaattgtaagagggcaccatagtcggtggcccctgcagtgcaggagcgcaatctgccccggggccggtggggtctgcccgtatcacgagacccgtcaatcctcaagccgtcaatcggcacgtggcgccaagcactgaagcctgtcctttgatgctcatccacctgtattcccgccgcttcttccctacattggtcctcctgtcccacgcgctcttcccccccccgagataaaaacaaacccaaacaaacttactcattgaagtggttgccccagtcgtagccgcgtggcgcccaatccacatactcaaagtcgatgaaggtcatgtcgttgcgggccgaggtggtggacacgggcgaggcagcggtggactcgccagccacggtcccggcagccaggaaagcgtcggagaccatcacgttcccggccagcaggtcgttgtgagccagcacggtgggcgagccgacggcggcgcatgccctctccacctgttgcacccggcggcgcaggtccgcaaggtcaaaggcctcaaactcagcttgtttctgtgggggatggacggaggggaggttgcgggcagagggaaggccccttgggcaacaccgaatcatggaagcataccatgcaccacaggactaaaatctgccctcgctgctccacgagagctggcgacgaaccctctccacaggcccagcacacagctgaattcagcgccggcgcgcccaccaccacttgcacctgggcgtccttgaaggtgaagccctctgtgatgtccagccactcatgtatacgtttgaaaggagtgttggtggtccgcggcccctgcggggtggagagggtgctcattcaggtggcaagattggggggctgggatcaatgcaagctacgccacatccttgcaagatcgtcagcacgaccacctggaattacacacacaaacacacgcacgggggcggggatgctgtggaatcgctgcagcgccacggcgatggctgcggcgatgcgtgagtccttgagctgggcgggggagaggcacttctgggggaggaaagcctccaatcgtccggaggtgaaggttcccaggacctggagggcagaaggcgagggtgaggtgcaacggtagggaccagattgtggagtgttggcccaatgcatgtgggatccttacgacaccccccggcctcagcaagccccacccacctctgtcccaaagccatgctgggataccagctgcatggtggctacttcatggtcacggttgatgaatcggtcggtgttcaggccatatagacggcacagcacaggttccaagctgccggtgggtgcagccttatacagtgcgttgctgatgcctccagtcactgtggtgacctgtgtgttatgtagaggtatgacagcctgtctatcaatcacggctggatgggaccgcagatcgcttaatcgggggccagcaccgcacctcgacatcggcgtcgctcagggatgcccactccggcagcaagcgacggcagatctctcgcacaccccgcatcagcccttcctgaggtaactgggagtccagggcgtaatcgacatggggcgtgatcgccatgttccccgcggagccccgggagtggctgggagagttgcaggccaggcaggacttcgtattctccacgcacacagacagcctggcgttcggcagcgaatggttgccgagtattatcttcgagatgctgttgcgaggttgtctgaatggggttaccaaagcccttttgcgagtgtctggccagctgacgatgaatcagatctgtagctagggcttgctgacgaggcaaagcgagtcatgccggcggggtttccagaccggacatcggggactaggtgttgttccagaatcaatgagatcagaccaaaagcaggtcaagaagggatgaagctttcttctcctaggcttggcctgagatcagactgagcatcctcctgctctccgccgcgaagtccaggggcttgatctccgccagcgcaaaccgctgccgctgctcaccgttgtactccctgcgacgaggcatgaggatgaagggatggacttgagcgtctgtacctgtagggataggtcaacactatattttctacattggatgaggctcccaccatcgcttgacttcgagcatgtacatacacctttccaccacctttcccactcactgtgcactggccttgacccgcagggcccagtccttccagctggcggccttgagcgtggccaggaagcgcgatggctcggcgtccttgagggcggccaggtcgtcggcagacatgcccagcagctcctgcgcctggtcattgaacacctgcacaaagcactccccgctctcatccaccaccttggcctgggaagtaggagtcgaggggagatgggaggggggtggatgccggctcgaagcgtgctcactgcaaagcacagcggccggtggtggccagacccctgcggcaagagccggacccccctgctccaatgcagccagccacaccaagatccagtctggcagggggctcagccaagtgtacctgcaggatgtaccgcctgaccatgctgggcagggtggtgccgctgtactcgcagtaccactggccggggccctgctccacgacctgcgagtcgggcacgggcgcatcgcggcgtggatagcaagggcaatggggtgtgcggcgccgcacccttcacctccacatacccattcctcttctctccctgcaccttgcgattgttctcggggttggcagcgtagtacaggctctggtccgggttgatgctggccaccgtggcggtggcggagctgaacaccggcttgaccccagcggaggtgggcccctgttcgcggatgtcggccagggacaacctggcgttggaggcggcctgggcaccgctacgcctgtgggcatatgaatgtttgttgggggggagtcagggtagggctgcaagcgaggaggagtgccttcacgacagggtgcggctttcaaagaacggcgaggcacggcaccgcccctgtgtgtacgaggctcatgccgcggatgcaagaagctgcgcccccttgtcagggcgctcggctcgcttcccaaccgccaccaccgggcaaaatccgagtccagcgccgccatccccatgccaatccccagcccctaacccagaatttctcaccccgctgcgccgctcaggccctctccgacgtgggtggtgggcgccgcgctgccctcgcccgcccaccaggcccgcagagcgtcggcctcaggcccagcggggtccacgctcaggacgctgcggtgcagggtcgacaccgacacaccgttgaaggccgacacgcggcaggcggagacagagaggacggggtgctgagcggctctgctttccagctcggcgcccaggccctcagccgtcggcccccacagcgtcagggtcaccgtcttcttgctatcaagggagggggggggggggggg

SEQ ID NO: 37110 - DNA, 61 bp, Chlorella protothecoides
cactcccacctgcgacgtcactacccctaacacacttcacatggcttctgtaccctgatgt

SEQ ID NO: 37111 - DNA, 61 bp, Chlorella protothecoides
agcggcgcccgctgacgaggatcgtggcggtgtggttggacggcacggcttcggggggaga

SEQ ID NO: 37112 - DNA, 61 bp, Chlorella protothecoides
gctgggttggaccggcttgcaggctcagggggagctccaggcaatgattcacgtgaaggtt

SEQ ID NO: 37113 - DNA, 61 bp, Chlorella protothecoides
ggaatgcacgactcacagggcaatacacccgtgcgattggagcacgaagccgatagccgtc

SEQ ID NO: 37114 - DNA, 61 bp, Chlorella protothecoides
acggagcagcagcagcggcagcaagtgcatgctaccccgtccaatgcacctcacctcctgg

SEQ ID NO: 37115 - DNA, 199 bp, Chlorella protothecoides
gggggtggggggtgggggggcgcaagacagtctgcaccctggaatgagctgcgcgggggcggccggccggcagatggcatgtgggccgcgtgggggcgcccctccaaggcgcgcagattgcttgacgtcgggcgtggagggcttcccgggccagaggcaagcctccgatctcctcccacagacgccgagcggtcggggg

SEQ ID NO: 37116 - DNA, 63 bp, Chlorella protothecoides
tctgcaccccacaggctgtggcatggtcccttgacgatctcccacctgagatgcattccagag

SEQ ID NO: 37117 - DNA, 80 bp, Chlorella protothecoides
gcaggcgcgggtctgggccaggacgtggcgctcatcaccgacggcaggttctccggcggctcccacggcttcgtgatcgg

SEQ ID NO: 37118 - DNA, 420 bp, Chlorella protothecoides
  modified_base (123)..(333): a, c, t, g, unknown or other
gcccgcatggacattatatgtaatagtataaggagcttctgatcttgttcgacacgagcgtcgctgacggcgtccttgtgtcgtcacccccgcactccgttctgcacctcgatacatggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtccgtaaatgtacgtcattgctgaattatgttgaagaggagctggggcgctcggcattctgctgcatgatgttggctggcagg

SEQ ID NO: 37119 - DNA, 67 bp, Chlorella protothecoides
tgtgctcgtcgaccaccaccaccctgcacatccgccacaggcgccgcaagaagcgtatccaaggccc

SEQ ID NO: 37120 - DNA, 102 bp, Chlorella protothecoides
gcctgttgtccccttcccaaaatcgtacacttgcgcgtatccccaactccatgccctgacaggctccccccaccaaataacaaacattccaggtttcctgta

SEQ ID NO: 37121 - DNA, 64 bp, Chlorella protothecoides
cggacgtcggccatgcatggccggggcaactagccactcgcgacccactcaccctataacaatg

SEQ ID NO: 37122 - DNA, 74 bp, Chlorella protothecoides
tcagcttccacaaggtacttgtagagtgcttcatgcttcgcatgcactccctcttccgcaatcagtttgatcct

SEQ ID NO: 37123 - DNA, 61 bp, Chlorella protothecoides
gcaagcgctctgtgtgaccctgcactgggcggcgctggtgtttggcgtgatcctgccgcag

SEQ ID NO: 37124 - DNA, 80 bp, Chlorella protothecoides
ctgagcaagatgttctatacctcaaaccttccacgttgaataccgactagagctgtactcactgcaccaggaatgcctga

SEQ ID NO: 37125 - DNA, 73 bp, Chlorella protothecoides
gcgagggacggcgcggcttcgacccagccaacggagtcgcagtgggccccgcccccacgcagcgcggcgctgg

SEQ ID NO: 37126 - DNA, 61 bp, Chlorella protothecoides
ccatagtatggagctctgccttcccgtagcacctgccggcccctccataacgaccacgctc

SEQ ID NO: 37127 - DNA, 118 bp, Chlorella protothecoides
ggctgggggtggtgcaggcgcaggtgcagaggcgccttcgatcggcgcatgcgtcgccagcagcggcgcactggcatcgtccccgccggcccccgagcgatcgtatctctgcagcgcg

SEQ ID NO: 37128 - DNA, 133 bp, Chlorella protothecoides
gggcggctgcttcccgccgtaaaaagtgccccggagatccggcctgcatgacgagtccccgccaagtctgttcaggggctggcctgctctgctcgtgacccctgatggcagcgcaccccgccggtcgggcggc

SEQ ID NO: 37129 - DNA, 61 bp, Chlorella protothecoides
cagcgcgaactcggtggcggccttgaagaaagcgtcctcgcgcggcccgaacgaccccgag

SEQ ID NO: 37130 - DNA, 155 bp, Chlorella protothecoides
gggtgcggcgatccgtcgggaaccggcgtgacagagaggctgaggcaaccgcgcgcaggcgccgcggggctggggtggcgccgcctggcgctgggtcgcaggggctgggtggccggccacccaaatccaagcaggccccgcacggcgacaagccc

SEQ ID NO: 37131 - DNA, 72 bp, Chlorella protothecoides
tctggtgaggggctgggagggtggggtaaaagtgagggggacttggggaggggtgtcttgcaagggcagagg

SEQ ID NO: 37132 - DNA, 67 bp, Chlorella protothecoides
cctctgccttacagagcgggtggaaaggtgacattgttaccgaagacgtgcggccggagccagaata

SEQ ID NO: 37133 - DNA, 61 bp, Chlorella protothecoides
gaataatgttcgttctgcgcgcaacatgcgggcgccatgcatgttctgggcgctagctcct

SEQ ID NO: 37134 - DNA, 192 bp, Chlorella protothecoides
gggggtccagggagtgaggtgccgcttgtggctgcggtctctgggttccaggagcctcgccttgctttggggggaagggaaccaggcctgcccgggccaagcagtctccagggacgggcctttgcggctgcactccccaccctctccacacctggcccccataccgccaggcagctggacgtgctggtgaac

SEQ ID NO: 37135 - DNA, 79 bp, Chlorella protothecoides
ggcctggacgtcagctgctacacctttggcacgccgcgcgtcggcaaccgcgcctttgccgacctgtacggcgggctgg

SEQ ID NO: 37136 - DNA, 61 bp, Chlorella protothecoides
ggccgctgtcatcactgccgctgccgttgccgctgctgctgctgctgctgctgctgtcctc

SEQ ID NO: 37137 - DNA, 123 bp, Chlorella protothecoides
cggcagggctgtctcacatgtgacttaaccccccggcaccttgaccacgtataccccttttacaccaaaaacaatgcacgtgcaacaccccccccaacctgcaaggatggcggtggggagtcc

SEQ ID NO: 37138 - DNA, 108 bp, Chlorella protothecoides
caacccttgcatctgctggggttcccacgctatgcagcctgggggccagcatgcagcggtcagcaccagccatgggtttcctcagagggatgatctgcagtgctcagt

SEQ ID NO: 37139 - DNA, 61 bp, Chlorella protothecoides
gcccccccatcaaccgctgcatgaccttccgacgcccacaggtgcctcagttgatagagat

SEQ ID NO: 37140 - DNA, 173 bp, Chlorella protothecoides
ggcgcagcgcagggcaatcagcttgacgccagcctcggccagggcagcgatggacttcgcgcatgttttaggagagtgtgcatgagtcagattaggtatgacaagttgacctagctgcttgactcatctacagggctgcaggcatgatcgaggcgcatgcctcaggtggcttc

SEQ ID NO: 37141 - DNA, 136 bp, Chlorella protothecoides
tttggtggcctccccaaacaccagcaattccgagagctgaaggcgggggcggaggtgggtgggggggtttggggacgaagcctgatcaccgatgatatggcagcccagattctggatggttggaggctagcaaggg

SEQ ID NO: 37142 - DNA, 4414 bp, Chlorella protothecoides
  modified_base (882)..(891): a, c, t, g, unknown or other
  modified_base (1172)..(1181): a, c, t, g, unknown or other
  modified_base (2323)..(2490): a, c, t, g, unknown or other
  modified_base (2571)..(2580): a, c, t, g, unknown or other
  modified_base (3303)..(3312): a, c, t, g, unknown or other
ccgccgtccccgccgcgctgccggcgctgcagcgccgcgcgctgcccacgctgggcgcgctgctgcgcgaccccggcgcgcacccagccctggtcctggacggcgcgctggacctggtagccctgctcctgcggccctcgggcgaggcggccgcgcgcgaggggcacgccacgctgtccctcccggtcctggccctcgccctgcgccacgatgatgccgaggtcttggcctccgcctgccagtacttcaggtgttaagggatggggagttgttgaagggtgtccctcgcgagcgtgggctggcacaggacctcgtgtgagatctgtggcgcagaagctgtcgtgagccagtgggggctgggcccgccctgaggcgactcgggaaccgaggatgccaggagggacggcgcatgcagtcactcgggcacggcaccgcatccctctcgatcattcgtgctcgcaggctgctggctgtgaacagtcacccgctccttcctctctgacacatagtaccccccatccacccgcagggcgctgctgcaggtgggggggggagccgcgctgagctggcaggcggagggcctggagggcagcctcgccccgcacctcgcgcaggcgctggtccgcctgctcgaccccgagctggaggagcgggcggcggcgggcgtgggccctctcatactggagctgctgcgctgcgcggaggccgagctggcgccgcacctgccgcgcctgctggcggcgctgggcgggcgcctggtccgggccgagacctcgctgctggtccagggcctggtcaccgtgctggccaccctggtgcacacaagggccgacagcctgctggcctgcctggccggcaccaccctcggtgggtgcatggatnnnnnnnnnnaagtgactgcatgcgcagtccctcctggcaccctcggttcccgagttgcctcagggcgggcccagccccactggctcacgacagcttctgccacacagatctcacacgaggtcctgtgccagcccacgctcgcgagggacacccttcgacaaccccccatcccttcacacctgaagtactggcaggcggaggccaggacctcggcgtcgtcgtggcgcagggccagggccaggaccgggggggacagcgcggcgtgcacctcgcgcgcggccgcctcgccnnnnnnnnnnagtttgggaaggtgcacagtggtggcccatgcgaggcccctgcaagacgaccaagcagcatactcgctctgacactgatcgcctcgtcgaggccaaacttgcactcccctcggtcccaacataccaccacacacagcgatgtcccacaccccacatacaggcagcgggcagccggctttacatgcctgcctgcagaagtgggtggggcgccagatcgagatgcgcacgccctacgacatccgcctgaccaccaccgcgctgggggcgctgctgctgcgccccggcgccgacctggacgccgtcgccgtgcgtggacggccgctggacgtggagggcggcatcctgacccgcgcccgggcggcgcagcgagcagagcgctggtcctcggttcccctgcgggccaagatcgtgcagctgctggtggatgcccacatcgaggccaccgcccaggatctgcaccgcgggggggccaccgacgacgacgacgacgacggggagtgggaggaggggtccgggtcggggtctgatgatgccggaggccggccatacaacggtgcggcccaggtgtttggtaggggaggaaaggggggcttgcgcatgctggattgaattcaaaggtgctgttgcggatccacacagccgctcgctgtgagacagggagccttgctgcggcctcagatccatgacagtctgcaaacctcccatgcatctttctcgtgcaggacctttatgccagtctcccacatcgcccctcccccccaatccctgctcaccaacccacctctttcccatcaggcctggaggacctgctggatctggagggggcggacgactttggcgaggggcagctggatgcggtggaggcggagcggaggaggaaggaccccctctcccagctggacctgcctgcacacatccgcggggtgctggggcagtacgccgcagcctcccccgacggcctgcgggcggccgccgcagagatgtcgcccatgcagcagcagacccttcaacagatactgatgtagagtgggacctggcccctgtgactgtatgctatatgtgtgaccgcgtgttttgagcgtgacaggctctgacccagggatatttgtcggtgccggaggcgatgcagttgcgcgcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtatcaggcgtggtggcctgtgcgaatgaggtgatactcatgctcgattccctctcgtagccgagccatgacccagatnnnnnnnnnnaatactgatgtagagtgggacctgggccctgtgactgtatgctgtatgtgtggccgcgtgttttgagcgtgacaggctatgacccagggatcttgtctgtgccggaggcgatgcagttgcgcgcgccggatcggcccacagcaggaacatttcgacacgcggacgtcaatgttgtgcagcttctccaggaaccctgtttcccctaccacctctgctgcatatcgacgatctatgctgttaacacctcgaacatcgttcctcctgaatgtatcaggcgtagtggcctgtgcgaatgaggtgacactcatgctcgactccctctcgtagccgagccatgacccagatgtcatcgagcgcgctgcatgcgtcaggcatttgtgtgttagcgcatcggccatcaaggctagaccctggcgcgcccatcagaggccttgctggctctcgctgcagggtgagtccagccggctggacagccccatgcctgcgatgatggtttggacaggactgtcattctacgtagcaagacagtgcaccaacaagccagatttttgtccccactttgcagcccaatgccagacgggctggcgtgctttttgctgcgctgtcaggtaggattgtcagactagagagtgtgccatgtacctagatctccctccacctgaagtctaaagtcataaccacgcttcagcgacacagtatttacacctgactctgcaccacgcnnnnnnnnnntcccacctgaagtctaaagttataaccacgcctcagcgatacagtatttacacctgactctgcaccacgccccaccccacctcaaacttttatgcagacacagactttctgcacgccctggacactgcacatctggccgtctcccagcgagggacgagccagccccaccccaatgccgcctgtcgcctagtgtcaccagacggccggctcctgtcccaggcagtcctccccgcccaggtatgagcgggttgcaagttcccaatgccctgcctcaattgcatgctgtgctgcactggggcgcttgcatgagagtcgctcagggtttgtatgggcagcccaccatctccgtggagccatgcggacgagtggtggtcctgcacacccttccccaccatcgatgccccccgcagggcatgcttccccccgagacagctgcgctggcggcggcggggtccgccgcacgtggcgcgacagccttcctcaacctggagccctgggaggaaagcgggattgctgcgctgcgcgcctcgggcatctcgcgcgtcgtgctgggactgcgccacccgctccccgctttctccggcgtcgccgtggcggcgttgcggggcgcgggcgtcgaggtggacatcctgggcgagacacaggtcgggccgggcgctgcaacaaacgggccgggcgccggcccccacgcccaggccgcggcggccgccggcgacgggcctgaggcgccggcggcggcggcgctgcgcgcgagcctgcacgccaacgaggacctggtgcaccgcgcggcgctgcgcctgccgctgagcctgctcaagtacgcgatgacgctggacggcaagatcgcggccagctcggggcacgcggcctggatcagcagcgccgcctcgcgccggctggtcatggaggagcgcgccgcctgcgacgccgtcgtcgtgggagggtgcacggttcggcgcgacaacccgcgcctgaccagccgcacggagggcaagcacaaccccgtgcgcatcgtcatgtcacgcaccatggacctgccagaggtgggagagcttctttcgttccagggtggggagggagggctgtgctgtgtgggagaccg

SEQ ID NO: 37143 - DNA, 74 bp, Chlorella protothecoides
cccaaccaccagcgtcccagaccggcgcaacggtgcaggtgcagtcctagccgctgcaccaactcagcatggca

SEQ ID NO: 37144 - DNA, 89 bp, Chlorella protothecoides
gccacggccttgctctccaggtggctcggccggcccttggcccgcgcctcggcttccgtccggctcgaagcagccgccggcgcctcggc

SEQ ID NO: 37145 - DNA, 61 bp, Chlorella protothecoides
gagcgacggtgccctgcgagcacggtggggtgggattgcatgaggtgctggggagggtcat

SEQ ID NO: 37146 - DNA, 61 bp, Chlorella protothecoides
cgccccgacatgcctgctggcctctgacagctgcatgtcatcgttctggggcatctctatc

SEQ ID NO: 37147 - DNA, 64 bp, Chlorella protothecoides
ttctgcagcaggacagcatgtcacaagtggactttggtagtgctgctgtggatgctgatcttca

SEQ ID NO: 37148 - DNA, 61 bp, Chlorella protothecoides
gattatctttataatatttctttattctttaaaatgtatttgaggatgggcctggatcagc

SEQ ID NO: 37149 - DNA, 125 bp, Chlorella protothecoides
gcaggtgacaaatccccatcttcccgggggcggctgggccatgacatgaaataccatcagtaaccatccctcgttccgcacaatcacacaggaaatccagcactgcagcagcagcggcggtcatc

SEQ ID NO: 37150 - DNA, 61 bp, Chlorella protothecoides
cgagaagccaaaggcggagtcgccctccacagccaccgtcgcgcggcccgggtcctgggtg

SEQ ID NO: 37151 - DNA, 418 bp, Chlorella protothecoides
  modified_base (125)..(286): a, c, t, g, unknown or other
gccgtgcggcatggagattgaaaatgaatgagtacactcggaagtgattcatcgagcccccatcacaacagaacccatactcatccgcgaccttgggacctcctcccatgcgctcacctcgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggacaggccgtaccgtgcaacctgctgcgtcgtctgtggggggaaggaggggaagaggggaagaggggatgagcaaggcgcgcccagcaggagggcccagcttcagtgtccgagcgcacacacgtatat

SEQ ID NO: 37152 - DNA, 61 bp, Chlorella protothecoides
cagcactcaccgataggtgccatcgcggcgattgtagtcttcgtcgctcatgacatacttc

SEQ ID NO: 37153 - DNA, 61 bp, Chlorella protothecoides
gccccagcccggaggattctcccagccccatccctgaggactccccaagccccagccctca

SEQ ID NO: 37154 - DNA, 61 bp, Chlorella protothecoides
cgcggagcgagcagcggtcgcgtactgtgctgccacatcgacaactgcatgagtgatggtg

SEQ ID NO: 37155 - DNA, 123 bp, Chlorella protothecoides
agggcatcaccaacatccagatcgtgagttgtgggtaggcctgccggtgggaccagggaaggagagatggcacctctgattgtgtgcagaggagcatgcttgcggtggatggtatggagttgc

SEQ ID NO: 37156 - DNA, 85 bp, Chlorella protothecoides
cagcgcccccgacctccaccctccaaaccaacccttccaaccagccagccagcacccccgcacctgcacaggctcgctgacccag

SEQ ID NO: 37157 - DNA, 89 bp, Chlorella protothecoides
gcagcactcaccgcggccagccagtcgcggggcacgaccatgttgaggatgaaggtggcctgggaggcggagacggtccccgaatactc

SEQ ID NO: 37158 - DNA, 75 bp, Chlorella protothecoides
ggtcgcacgagcgtttgatacccggcctccacccgagatccttagtctccgcaataagtgacacaatggggaagg

SEQ ID NO: 37159 - DNA, 88 bp, Chlorella protothecoides
agccctgcagaccgcccaacctccatcgcaacacgaccccacgcagggcctgctcttttccgtcctgtggcgcatgggccaggacttc

SEQ ID NO: 37160 - DNA, 61 bp, Chlorella protothecoides
cctccacatccctgggaggccagggtgctcacccgcctcagcatctcccgagcgccatcct

SEQ ID NO: 37161 - DNA, 99 bp, Chlorella protothecoides
ggggcacagggaaatgtgggccttgagaagcgtctgcttgggcagggctggatgaatgatacttggttctttttccatgagcagtgttgagggcacggg

SEQ ID NO: 37162 - DNA, 105 bp, Chlorella protothecoides
actacatacagatattctagcaatacttaattaagaaggatcgcgcggcgcgcaacgaaaggggtcccgtgatcagtccgggcaatcgttgcgtcgcgcccggct

SEQ ID NO: 37163 - DNA, 71 bp, Chlorella protothecoides
gcgcggcggccggggctggcgatggcgctgtggagacgccggggcccggggctggggtaggctggtcgggc

SEQ ID NO: 37164 - DNA, 102 bp, Chlorella protothecoides
gagccagagcaggctgagtacgagcaagtaaaagctctgggtggtggcgaggagggcgaggagacagcggtcgataagttgcgctccttcaaggagtggctg

SEQ ID NO: 37165 - DNA, 61 bp, Chlorella protothecoides
ccacctctcgttcacccccagcttggtgatgatgtcggtcatgatgacgttgttctcggcc

SEQ ID NO: 37166 - DNA, 61 bp, Chlorella protothecoides
cagcgacatgccgacagcaacaaatggtgcacccccctccatggcccattgcaggggcaac

SEQ ID NO: 37167 - DNA, 101 bp, Chlorella protothecoides
ctgcgacggcagccgccgccgccctcccggccggtacgggggatgccctgacctggcacgcgcgctttcttgccttggcggccaggctccaagccggcgag

SEQ ID NO: 37168 - DNA, 165 bp, Chlorella protothecoides
cgtgcaaggggccgggggagtggtggggcttgagcatgtctcacaggcactcgtgccctgcatgaatccttcgccgggagggccagtggcctgagtaaggagccagcaccctcacccacgtgcccggccccatccgcacgccatccttcccccaaagcgagtcag

SEQ ID NO: 37169 - DNA, 61 bp, Chlorella protothecoides
tggggtttgtgacaacaacaacaacaacaataacaacaacaacagtctcgcgtcttgcaca

SEQ ID NO: 37170 - DNA, 61 bp, Chlorella protothecoides
tgcatggctgtgacgtgcatgctctgtggtgccgttggttgcatggctgtgacgtgcatgc

SEQ ID NO: 37171 - DNA, 117 bp, Chlorella protothecoides
gggatgtgtggcgtaaaggtggagagcaagtaaagcatccatgccactggaccttgtgcgcggggagcccgagctgtacagacccttccccctgcatgtctcctgcatctctcccct

SEQ ID NO: 37172 - DNA, 80 bp, Chlorella protothecoides
gggcaaggcgggcttacactcggtcacaaacatggtaattatccctggataataatggtgggtcaggcagatgccgagga

SEQ ID NO: 37173 - DNA, 61 bp, Chlorella protothecoides
ctgaacctgccattgcagagcctcgaccactctcaaacacacacacgacgcacaggagtcc

SEQ ID NO: 37174 - DNA, 129 bp, Chlorella protothecoides
agaaccctggagataagcaggtgggtgggattcttgggaatgccagccggtgcctagcatggtccctgcttcccggccactgctgctactcaggatgtccatgccatgtcagcgcacgctccgatcatg

SEQ ID NO: 37175 - DNA, 98 bp, Chlorella protothecoides
tttggcgccgaggtgaggcggggcggcaggatggagggacatcgcgcctggaccctgcctgcctgcacgtgcggcgccctaccatgtcgtgaggcgtg

SEQ ID NO: 37176 - DNA, 114 bp, Chlorella protothecoides
gagggcctgaggtggaggtctggcatgggcaaaagacccggtatgcaggccccacaaccccatggtgatgcttgtagtcgcgcgtttgacaccccaaagtggctcaccggacgg

SEQ ID NO: 37177 - DNA, 66 bp, Chlorella protothecoides
cgtcttcgtctcctctctgtcgcccgtcttgtcctcctcctctctgtcgcccgtcttcttcctccc

SEQ ID NO: 37178 - DNA, 61 bp, Chlorella protothecoides
cgtgcaacctggcagaagagggggggggggggtcttccttgcacgtgtgtgggctggcggc

SEQ ID NO: 37179 - DNA, 114 bp, Chlorella protothecoides
ccagcgcgaccacgccgtagcccgcgccgacgtcgaccagcgtgccgcggcgctggccggcgccgcccaggctgcccaccagcgcctcggccagcgtgggtccgcgcaggggct

SEQ ID NO: 37180 - DNA, 72 bp, Chlorella protothecoides
agccggatcaacgtggaggcttagtgtcttcgccggtgagaagaccccatgacggcgagggacggggcagtg

SEQ ID NO: 37181 - DNA, 136 bp, Chlorella protothecoides
cggcgccgccagcgccacggtgcccgcgccacggttggagaaggaggagagcgcgccggcacgccccacggctgccaccgccaggacgttggcgcgctctgcggcatagctggcggggtactgcggctcggcgtcc

SEQ ID NO: 37182 - DNA, 61 bp, Chlorella protothecoides
tcgatcacccctcacatccatccccccttggcccctcctccgaaccgtaggcggtcacggg

SEQ ID NO: 37183 - DNA, 61 bp, Chlorella protothecoides
gatcctgtggcaaggaggagcggcagcgagtggttcaagtataaattttgcaaaaatcaag

SEQ ID NO: 37184 - DNA, 73 bp, Chlorella protothecoides
atggtgcagtgtgtttggtgcgacactcgaggggcctgcactctacgggggctgtcggaccagtcatggctgg

SEQ ID NO: 37185 - DNA, 61 bp, Chlorella protothecoides
tacgggggctgtcggaccagtcatggctggggaagggctgcatgcaggtgatccgctcgag

SEQ ID NO: 37186 - DNA, 94 bp, Chlorella protothecoides
gctcggtgcctgcaggtaagggttgatcttccagtccattacggatttcacaaaggccattggaggtggaggggcttccactgcaggcagtcgg

SEQ ID NO: 37187 - DNA, 115 bp, Chlorella protothecoides
cggctggcaggcaccggcattggccacggctctgcacaggttggcgacaaccgcctcgaaccccagctcctcccggcggtcctgccgtgtttgcaccaccatgtccgtaggcagg

SEQ ID NO: 37188 - DNA, 13642 bp, Chlorella protothecoides
ccaacccctgctctgctgccgcacccccttgaaccccgcccatgaccccgggtcggggctgggctggagcgagacaggccggggatcgggctccgcccgggcgggctgcgggatgggcgccggcgcgctgccctgcgccgcggcgccgttgagacgcgcagcgccgccggcctcttgcggagcggcggacggcgcggcggcgtgggtactcaggcctgcatgagtcacagggatctggacacgggcgcctgcaaacggcgcgacggcggacacggaggagcctgcgggtggcgcggcggcaggcacggaggcgcctgcaagcagcggtgcggcgggcacggaggagcctgcaaacggcgcgacggcggacacggtggagcctgcaagcagcggtgcggcgggcacggaggcgcctgcaggcggtgtggcaaagtgtgctggcggtactggtccaatgcccccgcgagggtcgcagcgcggggcctgcggccccgtcaggcccccattgggcagcgggcggcggggccgcggtggcaggcgtgcgggcggctcgcccccgctcggccatgccgtcgccggcagggctcccatggcgctctgcgccagtgacgaggggcaccgggggcccgccacccctggtgcatgcagagaggcggtgcagtccgccccgggtggctcttgcacagccgcacccgccctccacccttgccgtccagaagcgagtggtggaggggggccgccagcccttcgatgggggcccagcacgatgttcacgagggcgtcaaagtcagtgtcctgaagggtaaaaaggaggaggtacattgcttttccatttttgggggggggggggggagggcaggcatgtgaacggcacagggtccagaaggggggtgtcctgcaggccaggagattgatcggcaggccccccgccatggaatcatgctccgaggcccaactcaccacgcgcacggcgccgggcgggacgggggtgttgcactgtgggcagtttggggctctgcggcatcgggacgggggtgcagcctcatcagtgcgggcggggcatttgtggcatagtctcatcagtatgagcagggcggtaatggcgcagcttcagtcatattggcagggcgttgagggcgcagcctcacccacgtgggcgaggcgcctgtggctggtcacctgctagaacccacgcccacgacgtccctgcacccgtcgcgtaccccaccattcacacctgcccaggcattcctgtctcgaagcccagttgctccagcaagcggtgcagaagcgatgcatgcagctggtcaggacgaggggttgcatgtatccgcctggaggggcatgttagggggatgctcgaggcgggtgattcatgtggtggtggccggacaggaggttggtacactcacgatggcccatgagtacacagtccacctccaattctgcacgccaggccccacctccgcaatacgtgcagcgcatccgctccagcagcggattggcaggtacagccagaaacctgtccgggaactgaacggtggctgggatggcgctggcaggtgtgggcccggcggcgcgggtattccctgcccctgctcctgcagcgctggtattccctgcccctgctcctgcagcgctggtaatccctgcccctgctcccgcagcgctggtaatccctgcccctgctcctgcagcgctggtaatccctgcccccattccagctgcctggtctgccatgctccgttttccatgattggtaccacgacgggggggaggaggactgcagtacgacatccatcctgttcctgcaaagttaggaacggcacaaaataggctcaagcatggaggcctgcaatgggcagaccagagtggccactctgcagggcccggataggagacaagccgacaatggggacacaacaagaactgagaatctacaacatacaaacacacaacaccgctggagatggcgccatccaacctggagcaccgttcatcaggcgatgagtgacttgagggaagggcgagccggtgccattcgagctgcatgtcgcccgtggtctggacagcggaaatgtgtagtcatcattaaatcagtcacattatttgtgtgcagaacatgtcatgccatgaggaatcgacccgttggtagttctctctcagtgtgcttccgacatactcgcgtcctgcaaccagccaggcgcgcgtccaaagcaagttttgaagggggtggaaagcccgaagccctactcaaactattgaagaccagctgacaaaccttgccgtccccccgacaccaaccatttcccttgccaagatcattgcgtgccattgaataaagccagtactgcaaggcttcgagtgatttcttcggtcgcgtcagctcgcccataaatatgtcggcagtcgagtccaccctctgcgctgcaggtgcggctcgcacgaggccttcgccatcgctgtttcgatgatcgcttcgtatgaacagtgcagccctccatcagccgatcgagcctgcatgatgacccgggcggggtttgatggggccaaactctctctccaccacagatctgaaggaatcaattctgtgcgagagcgaggagcgcttcaccatgttccccatcaagtacccccaggtgcgtgagttggatggcatgtgtgacgtaaatgtttaaattgagacgagcgtgcgcgccgagcacgggcgcccttcccggaagaaggtgaggtcggtcccccaacgcctgaacatgtccgtttctcaggtttgggagatgtacaagaaggccgaggcatccttctggaccggtgagacggaagattcttggacctcacgggagctgaatattctacatccctcatgacccaggattaagtgcacatattaggatggcgcatttccactttgctcttgtcacccaccccgggattggtgtgcatccttcccttcccaacccccccatccacccccccgggcccccccccttcagctgaggaggtcgacctgggcagcgacatgcaggactgggagaagctgaacgagaacgagaagcacttcatctcccacattctcgccttcttcgccggggcggacggcatcgtcctagagaacctgggtgtccgcttcatgaaggaggttacgatcccagaggtgggagtggtttgagaaagaggaccatcctgccaggctgcagttatccttgcctgacgctgcatgcctggcgatgccaccttctcccagtgtttccctcagtcttgggaacttggcccctccacaatgctactcacctttcccttgcccccaccatcccaaaaaccaccacctggcaggcccgcgccttctacggcttccagatcgccatcgagaacatccacaacgagatgtacagcctgctgctggatgcgtacatcaaggacccgcggcagaaggacatgctgttccacgccaccgagacggtgccagtggtcaagaagaaggccgactgggcgctgaagtggatctcgagcgcggagcgattcgccgagcgcctggtcgcctttgcctgcgtggagggcatcttcttctccggctccttctgctccatctactgggtgaagaagcgggggctcatgccggggctgaccttctccaacgagctcatctcccgcgatgagggcctgcacaccgactttgcctgccttctatactcgtgagtggccaggctggcatggactgggatgattgggagggagtcccagcctgaacgccacgatggtgctctgaccagggtgcgggtgccgagcgcaaggggtctgtcacgtccatcgtttggcccacactgcatgctgaatttccttttgcccggcaccctgccccatgtcgtccctccccatgtcccaaaacacacaggctcctaaacgacaagctcagccaggagcgcatcgccgagatcgtgctggaggcggtctccatcgagaaggagttcatctgcgacgccctcccggtggacctcatcggcatgaatgccggtctcatggcacaggtggggctgcgtcctttggcattgggctgaccgtttgatgcagctgccgagcctgtgccttgcgtgataccccgcagacctggccgctggaagagtgcctagggcacgcctcctttgcttggtgtggaggaccggtccctgctgctctggatttggactcctgccttgagagaggtgctgtgtttgagcagccacctgggaaccacccttgagaagcctgccattgagcactcctcctctcaccaaacactgcttgcagtacattgagtttgtggcggatcgcctgctggtcgccctgggaagccccaagcactacaacaccaagaacccctttgactggatggagctcatctcgctccagtgcgtcggtggttctccggctgagttcctattatgggtttcgctggagtgtcaccctgcttggtgtggcattgcgcacaggtggtgaggccacatgcctgcccaggcacctgcaggagcgacctgcgtctgtgccagggctcccctcgaatcgacacccggtaaggtctcaccctcccaccacctcctaatccacaggggaaagaccaatttcttcgagaagcgagtgggcgactaccagaaggccaatgtgatggccactgtcaccaacgacggcagccacaccatgtcctttgacgaggacttttagaacgttttcctcggcgccggtgggctggaggcagctggctttagagaagttgggcacgagccaggcagcaacccgctcctgctcaacattgcctggcccctttaagccacaggccaatgcttctccctccccttctccagccaacccacagcccacgccactctcctttcctgctctgacacatcctcaccatgttgcgtcttccctctgtagctaccagctcccacccattccctgtgccaccccccactgactctggtgcatggcctccaagctgcacgcgctccgtgcctcgacaaagccatgtctgccatctctacgtccgatgttatacacagacaatgcggtggcgctcaagggtttgttgaagcgggtcagggagggtcatgctgctgcagcaggagcacaccatgcactcgaacttgtcaaagggctatgaggcgggtcctgttgtgtgtcaatgaattctgggggtcccttccgcaactttagcatgttctgaagcaagtcgctccagctcacgcggaggtgggtccagtactgccagatatccacccagcagctgcctgcaagataccagacagacaatgctacctatctggggcctgggagagcaggcatctgcccgctctggcactgctgcgggtggcctgctgagtgcagaacccaaccaacattcagacagtggcccaccacctcacctccttgacaaagtgttgttcaataggtgtaaactgacgtcaacgaggctgccttggactgcggcatgcagagcatgctcctgtccggtctctgggtctcgtactctgagtcaatgcagcatgtggggggaggatcgcgaactttggtaaccagagaggggcatccatctacggccacctttgaccttgattggtcgggaagaagggtgctttcccacacctgaagctcaccggcacaggagggagtcggcttgcagtcgggggccgcggcctttcctgtacaccgcctcagacactgctgagcccagctgcacatccagcttggcgtccttgtctgtagcccgtacaatgcagagtacagtactcagtggcattcaagagaatcctacttcaacacggctccacaccaagggtcttatcctccactgcaacattccctcacctccttgacacagaggatgggaggggctcaagcgtacaatgcagaggccattgggatgcaccagaaggtcgtaggcatttccttccacactcttgacgctactcaggtggtatcgagtgtaggtggtctccgcgtttgtgggaggagctcccaccgggagtgggtccgtcaactcgtacccttccagcatcgacatggtgcaaggatttcacattaaagagtgattatacatacgaaagacccattctcctcaaatgaaccgatgacatagactgttccaaggtccatccgggcaccatgcaaggacgggcttccagcgcccgcgcccgatcttcagagcaggttgtcaccgcgaggtccgcagtacaggaggatccctggacttacagctaccgtagtatcatctccgagcacaactatattccagcatggaagcgtgagcccacggagctcgagacatgtcgctgcgcctggcgcctggtgtcggtggcaggccggccagcctgcagcagcgatccggctcttcgctcgttccagcctcaagagctctgctcccggagagtaaatcctggtgtggaacatcacgaagtgcatggtctgccggatctcgtcagcgagagcacgcaaggaggcattggctagcaataagtctccatgcatcggccaacgattctagtgggccaacaggctccccagccccggaggacagccccccggccaccccttctacatccagccctttccaagaacccattcaagagagtggggcgcctgagccgaaaggttctcctcgctggtatcgtattgtagtggctgctgcaagcaaagtacgaggaaacctcctggcgctgctgctgacccatgcgcttgcagatgccgccatcttcctgctgcatcgtgcgagccatcgcctcaccaacgagggtatggatgatgggttgacgaggactgctgctctgttgccatgagagactgtactgggatatcataccctggccagctatcacatacttggagtgccgctgctcatgatggggccttcagtaccaagtgtccaaggcacaccactcccctccgctcttcatccccaccacagtggcattccgcttcatccctggactgtctgtgtctacagtactgaatccatggtatctcatcgtcgatcctgcaatcgccaatttccagacaggcgagtggccgcttccacatggcactgcggccgacaggcagtctacacttgactggctcgctgagttttcatcttcataaatgtatcacagttttcctggtctgatgacctcctattttgtccttggcaaaacattccgctggctcctcccctgacaacaccccactctccggctgtcacgcaggctaccaggccgtcaccctcgttgtgttcctgctttctttccccttcaacgtcttgttcaaaacatgggcagtggttgcgaccattctcctctgccagcgccaggccgacgatgcatcgacaggtgcgtcctggttctgtgctctgccgcgcgtgcgcatcttggttgggggtggccctcaggcaaagctaattcttgcacagcgcactgctcagtaaccacctgggctctgcaaggtgccacgattcaccacctccccagccgccgccttggtaatccaaccatgagcctgtggcactcctgcaggcggcagtgccacaggcaccgatggacccaatcccggcatcctggccgctgcaagaggcgcgctgcgcacgctgcgctccctgcgccccgacatcgcccgcctctggcgccccgtctttggcgtggagctgctggtcgccgcggcggtggtccccctgcagtttgcctccctcctggtcgtcaccctgcccctcaccctgcccctcatcctggacctccaggccgccacgccggcggtgatcttcgagggccagcgcggctgggccgcggtggtccgctcgcgggccctcatcaagcgcatccgctggtcgctggcggtgccgtttgtgatcaccgtggtcgcacagcggctggcccagaggggccgggaatgggtcctgggcaggctgccacccaggtgcgggggcggcaggggccaaggtctgaggctggcctgtctggctggggcgggccctgtgccctgaaggctgcacagcgctggaggagggtgccccggcagcccaccatgcagtcaacccacaccagcccctcaaaccctcgctagaatgcctgccattgcttcctccaggttctacaccgagctcgtggagatccccgtcgtcgtgtttctggctgggaccctgctctctctcctgctcatgaggtacgatgacgccccggggtgagggaatgacatccgtgcgttggagcacgctcgcctcagactgcatgactgtggggatggagatgggccaggggggctcagcaggcataatgccttgcctgaagcactgatgatggtgagccctgtgtctgccaagtactccccatgcagcttggcgcttgcctccccatgcctatcgcaccctacgccccacccacgcatcaggttgcaagacgtgttgccctacgttgcgtactttgagtccaaggcctcggaagaacttgagagcgatgggatggtggagaagcctggcccagagcagagccaggcgactgcctaaccctggacaggtatcagggttttgtctgaggctcccgcctggttctaggtgcaggcatgtgtcagcaattcctttcagctctcatatgttgaaacgtgcccgagctagggaagatatacagaggtatacaggccataacactgtcgagggaggcatcccagccacccatacttggccattatgcaacgacttggccggcattcacgatcgccccgtctgcattccctgtcaaaataaagtgagaggctggacaagggccaaccctcgtgtcaatactatcggatcagtacattacggtgaaatgcacaactcctggcgagtacgtgtataagatctgccccttcaaagtttcgggcagtgagttcggcagtccgccatgatcacgctgctgggatccccgctggtgctcagcgccgctacaactgtggtcaagaaagcatttgaggtcggctgagagagtgtggaggatactgggcactgcatgagcctttgccgcgatgcgcgcaggtccggttgacaggtggcatgtggtcacccccgaatgtacgttccgcatgtacaggccagtgtagcaacctccctgaaaggactcggtcaaaccattaatcagctgtacaagggggatacagaggtgagttgtaggccctgggggaggggcaggggttgatgtgatcagtggaacaagtgcgcatgcaagtccctggaggatccacggtgcatctataccaggggcggagcttgaattgcatggcgtcctcggccacaccatgccccataccaagctctctaccatcctagcgcagctcttggacctaaaaaccgagctcgagacaaaagtaaggatgctggcactgcccattgacatctttgcccgccacgtcacccaatccaacacggtgcgtctgcatgggggagcgcctggcagccctttgacaccttgccttttcagaatgcggcgagtaaatccttaatctcaccgttctatcaatccattaccattgcggaaactaccaaacctccctccaggcgctgcaagaggcggtgggggttgccataaaggtcctccatgacatcgatgccttccaagacctcctgacacagcaggaggtccagcaggtagggtggcggctggttactaccctacacatgcccagggacagtaaaggctggatggcatcgttgtggatctgctcctgcgatccttgaccttgcctatataatgcctcgccgacaatggacggccgcgccccgctcagcattctgagtgggcaatggtgcctgaaaagcagcctccagctccccattgttgggcacctttctccctcgcccctccccaggcacggcgctctgtggcactgcacgccgctgcaccgcgcgacgacaggctctcttcggtggcagtcaggcagcagcttcgaaaactgatccagtccctggatggggtgcttccctacttgaccctagccatcagcgccgtggggctcctttcctcggcaggtgggcatgcggggttgcagtgggaacggttttggcatgattcacaggcttttggcgggctgctgtgcattgccgttcatccgcctcagatacaatgcttcctgtttgtaagacctgcattcacggtttgaggtttttgccgcgttcatcctccgtgcacctgccacaacttgccactgggtgtttcaaccggtcagctcttgtactcacggctttgacccaatgctgaggtgtcaacattgtctggtgtgtttacaccccccttaccaccttcctcatggcgtcgggcatgcaggtgtccctgcggtatccccatcgaggtatgcacaggcctcccacagcctgctgagtcagcagcttcctggcgaggttgtgtactccctggaccaggtctggtaggggaagaaaccttgaggtgtctgcgcctgggcagcttgctctgttctttgctcgcccagagccttgacagcttgctgccatttcccgccgtgctttgcatgtatttcatggtaccgcaagcccttgctagccccctgcccctgcccaggtcgcctggtatcgccagtcttcgttgcggccccaggccggcgtgccgccacagatgagcgaggtcttcccgctgtgcacgctgagcctggtgcggggccaggcccccttctccttccagctcagcatccaacagggcctggacgatggcaggttccacgatgaggaggaaagcgcagagagcattgccctccaggtgatatgagtgcagggtgggggccaggctgtgggcaagttgcggtggcagcgccctggtgctcatttgttcactgcgcccggcgatgggtgcgaaacatcccatacagaccctgctattgtccataacctatgcaactcttggaaaacatgctcccacacactttgctaccattacgcgcctctgcttggaatgaaattgggacccttgcattctccaaccccaaacccctccctcacatggtctcgccggcctccctaggtgtcggatctctcctgggtggagtggggcagcagccagagtctgtcgcatgggagcgggcagttcaagccggccctcatcctgcacttcgatgccccttctagcgggaccaacaggcagggtgaggagacgtgcaccgccctgtgctgcttccctggaggcgtgtctctgcgcgtgccatgctggcgcgtgccacaggaaggtggaaatgtgcctgggaccccgatgcaaagtcctgcatccgcacaccttcaaccccccacaggcgcagcgcgtgctgccacctgctatgccatccagatccgggaccagctcgatgaggggtatgaggatgccgcttcgacatccggcgggtccccttctccgtcagcctcctccagctccagtggagagtctgcagtgaagggggcggaggaccctgcgggcctccctgggtccacgggagaccaggcccaggaatggggcactctgggctgcctcgagtatgtcatcaagctgtgcgcgctggaaagcagggaacaggcctgccacaccacgctgcaggtgtttgattcacatgcatgctgagggtctggccttgttggaaggtgggggagggccaggtctccttgttccttacctctgccaaaggtttcatggcccagcctggcaatccacggcggtactctgccatggcacccatggcatgatgccctgcttcaaacccctttctctaaacgctgcaggacgagcgcatccaactagggttccagaccggcacgtgccaggccccagccccgggcgcccggcccagcgcgcagagtccctggcaccccgccgtcgcgcccgtgcccgtctcggccgcccagaccccgccccaggacctgggggcgtcccagctggcctctgagctcggcaggcggctagccttcacgccgtcgcccgtgctgcagccgccgcggcggcgcagcgcggcgcgctccaggtcctcgctcagcaaggcgcggcaggcataggagcacgcgggaatcccaggggatcgtcgtggccgcacggtggcaggaggcctcctgctgcacagtcagatgcacacataccgtccgccttcctcactccgctcttcctgctcaaccactcgaaaagtactgccatgatctctcatgatattacagaacggcgaaggcccccgccatgccaatctcagaggggcgggaccgagcgcgcgttttggcgctcgagcaggggacaaatcaaatgcttgcggggggagggggagagcaattgagtacgatggggggtgccaaaataaatgggtggagaaaagaaggggtgcgctcgctgacggcgcaggaccagcagcacaagggggtggggagagtcacagggactggcctctttgctagtatcaatacgccatggtcacaaggaggggagggaaagtgggagggtgggtgagtgcggggagcgctcctggaagcgtcccacacatgccgagctcaggggaaggacagcgcctggtctgcgagggggctggcggcgggccccggcgccggcctggccacgatgttggccaggggcggctggtggggcggctgttgaggcggctgctgtgccggcgccccagccggttcactcccggagccgacgagcagcgcaggtggcgtagcccgtcgcagcgcgggctgcaggatggccagcagcccctcggggttgtccacatgtacccagtggcccgagtcggggaggtcgtgcacggcgtgcccagcggcgcggatgcgcgccacatcccccgcgctccagtggaaggcggagcgctcggcgcgcacgaagttgagttccaggccctggacgggggcgcggacaaagtcccagaggcaggtggtgcggtagctggcgtacatgctggcgatgccctccaggtcgtgcgcccagaccaggggcccgccggggtcggaggaggagagcgggcgcagcgccgatcccgcccaggcggccacgggcgcggagaagccggcgccgcgcagcgcggccacggcctccgcgcgcgagcgcagcggcagcggcatcgcgcgcagcgctgcgatgaggtccgcggggtggtccacgcgcgagcggcgcgccaggtccgggtggcccgcgtccaccccgtcctcgtggtccgccaggcgccccggcagcgcgtccagcgcccagacctgcaccggccggggcaggcgcccgccgtgccccgtcctggccgcaaactgctgactcatggccatgaccaccttggcgccgtaggagtggcccaccaggacctcggggaagaggcgcagcgcgctcagcaggcgcagcacgtcccccgccgccgaggccagcgtgtgcggggcctgcagcgcgcgcgacagcggcgcggactcgccgtggcagcgcaggtccaccagcaggacctgccaggccgggttccccgccagcaggcgcttggccagggagagcaggttgcgccgcgagcccaggatgccgtggaccagcaccagggtgggcggcgcgcggccgccgtgcgccgcggcgaaccgcgccgcgtcgccctggatcagctcgtgggccagctggggctgggggtcgcgcagcacgcgcttgccgttggggtaggcgggcgagggcggggggaagcgggggggagg

SEQ ID NO: 37189 - DNA, 73 bp, Chlorella protothecoides
ggttgatgcagcgtcgcgcccctcagcgacgcctggcgcgctgtgcaggctgcgtctcgcctgctgccggcag

SEQ ID NO: 37190 - DNA, 75 bp, Chlorella protothecoides
tggtgcaggtgccgcgggtagtcgagcatttgtgttctgggactcgcaaggcgccgattgctcattcggaagccc

SEQ ID NO: 37191 - DNA, 64 bp, Chlorella protothecoides
ggcgcgcagctcgtcgcgcgggtactcggcggcggggaagttggtctgcgccgcgtcgccgtgc

SEQ ID NO: 37192 - DNA, 80 bp, Chlorella protothecoides
gggtctggatgcgcccgcagtcccactgcgtgcgacatccttgtgggccacttcccggcgccctgaggctccgcccgtct

SEQ ID NO: 37193 - DNA, 231 bp, Chlorella protothecoides
ggggggggggggggtgttttggggggggggagcttcgaaacagtggcgtggtgaagtgcggggacggggtgaggaggaggagctccggggggggaggtttctgaggcgaggcgacgggcggaggcgtggagccgcacggtcatgccgcacggcgtgcacctccgtcaaaggcgccaggctgggcatctgtgtccagacatagccctgtccacacgccatgccctgcatacc

SEQ ID NO: 37194 - DNA, 65 bp, Chlorella protothecoides
cttccctacgactactactccctcccctactgccgtcccgagaaaatcatcagctctgccgaaaa

SEQ ID NO: 37195 - DNA, 71 bp, Chlorella protothecoides
ccccctccatcccccgccccgcacagggtggcggtgctggacggcggcctgcctgcctgggtggaggcggg

SEQ ID NO: 37196 - DNA, 162 bp, Chlorella protothecoides
gtctggggtccgcatggacaaggctccgaaacagtgacctgtggatgttctggcacatacctccggccagcgatcccaaagccgagccatcagccacgcccaaaacccccgggcatgcctgggcaccactgcccccacatccacccacatgcatggttcgct

SEQ ID NO: 37197 - DNA, 163 bp, Chlorella protothecoides
ggagctcctgttttgggtgggaggcaggggacggcagtcggttcgtcgcccagtgtcgtccggtgcccagcatgtgcaggtggtgcggccccagtgcctcggcggcagcgggtggcatgacatgggggcccactgcctgcggcaccaccaggcgcagcaccag

SEQ ID NO: 37198 - DNA, 69 bp, Chlorella protothecoides
ttgcaatgggccacaggtggagagaaccgttatggggtcgacacaatgcttgagagggatatgagcagc

SEQ ID NO: 37199 - DNA, 178 bp, Chlorella protothecoides
ccagctcgcgccgggtcgcgccgtgccggaaagcgaggcgctggaggtgcgtttggtgcacgtcgagggttggggctggcattggcgctgggtggagggcacggcatgggttttttgtctggcgccggcgtgaccctcgacatccttggctgtatactgcattggacaccagcaccac

SEQ ID NO: 37200 - DNA, 140 bp, Chlorella protothecoides
gcttcttgaggtcagtgttgcccagggccggacaacatcatgggtgggaggcgggcacgacgagcacgacgtgcacggcagtttgttgcccaggcgaggcacgcaccctccctgcacaccgcactgtcactcaaagggtg

SEQ ID NO: 37201 - DNA, 90 bp, Chlorella protothecoides
tgcggacactcagtcagtgctagagagagagggggcttggagattggggtgtcgacagcagtgcgggagcaatgaaggactccactgtca

SEQ ID NO: 37202 - DNA, 71 bp, Chlorella protothecoides
tctccggtgcgatgaggctggcctgctgtgagccagcgccgtcacgctgcgcagccgcacacctcctgcac

SEQ ID NO: 37203 - DNA, 61 bp, Chlorella protothecoides
gatgcccaggtgtgggctgtggattgggcgacatggctgtctgtgtgtgggaccctgccag

SEQ ID NO: 37204 - DNA, 61 bp, Chlorella protothecoides
atgggaagctgaggagaatggtaggctcgggtgcatggcatcagtggcttacagaattacc

SEQ ID NO: 37205 - DNA, 61 bp, Chlorella protothecoides
gcggcagctcggcagccatgctagcattgcctagctgtgtggtgacgggggcctgagtggg

SEQ ID NO: 37206 - DNA, 65 bp, Chlorella protothecoides
tagctgtgtggtgacgggggcctgagtgggaaggcacacggccagggcccggcggaggagcataa

SEQ ID NO: 37207 - DNA, 439 bp, Chlorella protothecoides
  modified_base (110)..(370): a, c, t, g, unknown or other
caaggtttgcgttagagcctcatgcaggactccagcccctcccaacgctcattcgtccccggaagcaaatgcccctgaatatcatcaccggcctacctgacgcgccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtctatgagcaaatcatgtccaatctcgtttggaagtgtggggtctggaatcctcacggccgtagaga

SEQ ID NO: 37208 - DNA, 165 bp, Chlorella protothecoides
ttcgttgcatgaacttgtcctgcagcttgttgtgtcctgattcagaacaggggtgttcagtcacatcaaatcagagggggggggcaggtcttgcggcagcaactttgattctgggcagaagggccctgggtcgaggggagaacgaggcaatggccagaagtgcaa

SEQ ID NO: 37209 - DNA, 80 bp, Chlorella protothecoides
cgtccatgaggatgtggttgccaggcatggttcttgagttgatgcacagccccaccagctccaatcgatgcagccactgg

SEQ ID NO: 37210 - DNA, 383 bp, Chlorella protothecoides
  modified_base (137)..(320): a, c, t, g, unknown or other
taagctgctagcaaccggcgcaagcccggttgaggggggaagggtattccgtgctttcacgggttgccctcgagccccctccctgtcagacctttacggctgtgtgtttgcactttacaaaggaacttccaggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggggagagggggtgggcgagggggaccgcactggcctcccgatcaggcagaggcggccat

SEQ ID NO: 37211 - DNA, 61 bp, Chlorella protothecoides
tcaagctccccctccctcaaacatggcaggggctgacgcgcccgcccgcctttgcgctggt

SEQ ID NO: 37212 - DNA, 465 bp, Chlorella protothecoides
  modified_base (90)..(315): a, c, t, g, unknown or other
ctgccaggcaggcgcaggcgcgaccaggcacgccctcgcagctcaggccccgacccctagcactcacgactgggcgaggagaaggcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacagtggagccaggtgggggctgggtggacgggctggtgggaagagcattcttaagggggttgagaaggggggtcgaaaacatgtgacctttgggtaagcagatcccctttcccccctcacatcccagtcagcacctcttggtgttgaa

SEQ ID NO: 37213 - DNA, 229 bp, Chlorella protothecoides
agcagcgaggtgatcttggagatgtctggcctgcgcctcgccgggtcgtcggccgtgttctccacgaacacgatctgagcggggaaagggaaggtggggggggggcaggccccttatcggtgagggggctgcctgggccttttccctgcccgtctggccacaggccagggtgactatcgcatgtcaatgcacatggaagaggcaatgctctgccctttctcccgtcaag

SEQ ID NO: 37214 - DNA, 67 bp, Chlorella protothecoides
tgttgagagtacggctcttgcgcgcgctaaactggtctcccttgtgagtgttcccagccactcaaat

SEQ ID NO: 37215 - DNA, 61 bp, Chlorella protothecoides
gggcgagtcgatccgcccctggacctcttcaccgccccgccgctgaggagcgacgccgact

SEQ ID NO: 37216 - DNA, 156 bp, Chlorella protothecoides
cacgcgtctgggcatccttgcgatccctcactccttcccccttcaacaaggactcagcccaccttcttgtgcaccatgtgcggcatcaccgctccggcccacatgggccctccctccaccccctgacggtggggcatggggtggttgggggcccca

SEQ ID NO: 37217 - DNA, 71 bp, Chlorella protothecoides
cagaccaagcagcgaaagctgagccgcatgggctctaagctgggaagccagaacacctcccggaagcatac

SEQ ID NO: 37218 - DNA, 69 bp, Chlorella protothecoides
tattttcaggaaccatcaaggtctgcccggctgtgttgggcgcctgagggtgtgctgtactccttgcag

SEQ ID NO: 37219 - DNA, 79 bp, Chlorella protothecoides
tcatgacctgtcccccaggcagcttgccacgcacttgtacacaagcaacacacacacacacaccctccctcctccttcc

SEQ ID NO: 37220 - DNA, 4665 bp, Chlorella protothecoides
  modified_base (146)..(155): a, c, t, g, unknown or other
  modified_base (529)..(538): a, c, t, g, unknown or other
  modified_base (732)..(741): a, c, t, g, unknown or other
  modified_base (880)..(889): a, c, t, g, unknown or other
  modified_base (967)..(1005): a, c, t, g, unknown or other
  modified_base (1162)..(1171): a, c, t, g, unknown or other
  modified_base (1379)..(1388): a, c, t, g, unknown or other
  modified_base (1575)..(1584): a, c, t, g, unknown or other
  modified_base (1850)..(1859): a, c, t, g, unknown or other
  modified_base (2080)..(2089): a, c, t, g, unknown or other
  modified_base (2814)..(2823): a, c, t, g, unknown or other
  modified_base (4239)..(4248): a, c, t, g, unknown or other
  modified_base (4363)..(4386): a, c, t, g, unknown or other
gggggggtaagggggggggcggggcaggtcacaagccaccgtcagtctcatgcgccagcgcaggcgtgacgtggccggcctcgattgggcgcgccctaatgctgcgctctggcacctggggcgcctggccaccctggcatatgctnnnnnnnnnncgtcagtctcatgcgccagcgcaggcctgacgtggccggccttgatcgggcgcgccctgatgctgcgctctggcatctggggcgcctggccaccctggcatatgctcgttccggcgcatcagactacacgcgctccgtgccagcccggcaagccgcttagcccactgtcacccaacctcgcctccttggttccccgcagtacggcaagcagctggtgcccgtgtcatcggaggaggagcggtacctcaagtatgcagtgtcgcgcggactcagcctgcttggtttcgtggacgcggccagcatcccccgccaccactacatgaaggcaggccgagggtttccatggtgcccagaagttacttgcggggaggagnnnnnnnnnntctccttggtacccggcagtacggcaagcagctggtgcccgtgtcgacggaggaggagcggtacctcaagtatgcagtgtcgcgcggactcagcctgcttggttttgtggacgcggccagcataccccgtcaccactacatgaaggcaggttgagggtttccgtggtgcccagaagttacttgcggggaggagnnnnnnnnnnggcagcacggcaccacctccgccatgccacgtgacgaagcgaggcacgccacccatgacccgcaccgccccaccctttggagatcccaacaccgccccctttgaccccccccttcccaaacacacacacacacacacannnnnnnnnnagcagcacggcaccacctccgccatgtcatgtgacgaagcgaggcatgccacccatgacccgcaccgccccacccttnnnnnnnnnnnnnnnnnnnnnnnnnnnnnnnnnnnnnnntgtgcctgcagcgcgcgccacgcccgcacacctcctactcaatgtcctgccctttgccgaggacgtgcgcgacttccggttccccggattcgaccggccggagcggaagccggggctgcgcgccgcccaggccgccctggatctggtccgggccggnnnnnnnnnngcggacaaggcctcccccaccgcactggcggcgctggcagcgctggccgcggccgcccacaagcgcgaccaggtggccatcgtgcgctacgtcccgcgtgccggcggcgccatccacgtctgcgccgccgcgcccgtgcctgcagcgcgcgccgcgcccgcccacctcctgctcaacgtcctgccctttgccgaggacgtgcgcgacnnnnnnnnnncttcgaccgcccggagcggcggccggggctgcgcgccaaccaggccgccctggatctggtccgggccggggccctgcaggagggtgagacgctcggatcggggtggtgtgcggccgcgtgaaggtgccacgcaccctgcggcatgcccgcggggccgggctggcctctgggcgtgccgctctgcctnnnnnnnnnngcgctcggatcggggtggtgtgcagccgcatgaaggtaccacacaccctgcggcatgcccgtggggcggggctggcctctgggcgtgccgctctgcctcctcctccctccggccatccggcggccggccacagacgctgtcaggcccggcccccatgtcccaggcttgagagccacggccccacggccccatacccttccctccttgagcagggccgcgggagcgactggtgcctgagcacgtggccaacccctcgctccacgccnnnnnnnnnnaccgtgtcccaggcttgagaggcacgcccccacggccccattcccttccctccttgagcaggcccgcgggagcgactggtgccggagcacgtggccaacccctcgctccacgccttcctgcgcctggtggccaacaaggcactgggcgtggagccgggggccgaccacggcccggatgcgctggtgggcgggaggtcgtcgtatggggtttgggaggaggnnnnnnnnnngctgggcgtggagccgggggccgacccgggcccggatgcgctggtgggcgggaggaggtcgtcgtatggggtttgggaggagggtgtccgctgggaagcgggggagctcagcagcctgatgctgctgccagacagtgtgtcgtccgccgcccagcccagccccgtcccccccggcgcctgcactcccctccctcccccattcccgcccacgccatcacaccacagaggtctgcgttggagcgggagggcctccctggctcggagcctgggctggcaaaggcatgcgcggagctgcgctccgccgccgggctgggcgggccgcgcagggccctgggcaggtcgcccagccagaggctgcgccctgagctggccatccaggacatgcacgcagcgctgggggaggaaggcgcggcgcagtccctggcggcgctgcggggcatgcaccgccacatcctggagctgatgcggggcagccccggggaccgggacgtcgacgcggtgagtggccgggccggtgtggagggggaaggctccggggcacggatccatgcgaccccggaatctggggccactagggggcccattctgggacgcagcagcatgggggccaccctgccctgtctccctgccaggctggaaacatcctcctctcacctcctcatccccgtccccctggaccccttcccattcgctccggtgcaggcggtggagtgcgcggcagccannnnnnnnnntccggggcacggaaccatgcgaccccggaatctggggccaacagggggcccattctgggacgcagcagtacggggtccaccctgctttgtctccctgcaaggctggaacatctccctgtcacttcctcatccccgtccccctgacccccttccctctcgctgcggtgcaggcggtggagtgcgcggcagccatgcgggaggcggcgagccagcacttccagcccgatgcctggaactccttcctgaaggatgcaaggaaagggtgagtgaggggggacagggcagggatgccggtccattggggtttcagcttccagggcctctttctgggaataccctcgcatgccaggctcaaggcagcaccccggggcgtgccctcctgcctggcccaccacccatgcgcctgacacccagtcccgcctgcggccccaggtttctgaacgaggcggggaagtcgcgctttctgacagacatgcaggaggcgggcctgacgcccctcgggcctgccaggggcggatccgagtccctgcgtgacagcctgggcacggagggctgaggcagggcgcctcggagggtcaatgcacatcctggcggggagctgggagcgccgtttggctcccccgagcaagccacgcgcgggaggaagcccagggtgaccttgacaggctctccatgcaagtgcatgcagtcccttggatggtgtgcgaggctcacccaaatcacatactgccgtggcccaacaagggccaccgagagtggcgtggggcccaggagcggcccggggtgttgccgtgaccctctgccttggaaaggtgcgtgccagagaccttcctgcttctcgttacctgaggggatccggctgtgccaagggcagtgtcctccacccatccttgcacactctccctacaactggatccacccatccaatatcatgcccagggcacctgctcacggggtacagctagtgggctgtggacgagagtgacccatctcacagttcctaggcacaatgaaacccgccaggagatgctcaccgtggattgcctgctcctcatcacccattgcagctgatggcgttacacagtcagaccggtgcgcacaaagacagtcacaacaggttgcttgcagaggcccatggacggtccagggtcaaaaggtggggcccacccacaggttacaaggaccttggtcgacgtggtggcacctgctactgtttcctcgtggagggggcgcccggctggcacgctggtgtcaggctgggcaggaagacaccggatgaggcaggcacagcgcgaggctgagggtccatgacaccggtgcaaacctcgtgtgtgatgcagactactgtcccctaccccgatatcgtgacggtattcgacaccggggagttgataaggcctgggtaggtcaccttgnnnnnnnnnnaacggtccagggtcaaaaggtcggggccacccacaggttacgaggaccttggtcaacgtggtggcacctgctactgtttcctcatggagggggcgcccggctggcacgctggtgnnnnnnnnnnnnnnnnnnnnnnnncactgtccctaacccaacatcgcgacggcgttcgacacgggcgagttgataaggcctgggtaggtcaccttgacataccacgtgtgagaatcatcagacgtgtgtttctctggtggagtggtctcgtatactgtcacatggtccacggcccagttgtacgttagactcccatcaacatacaccaacaccatttggaagctgtatgtcgaggtgatggtgaacttgatagtggaggacacagttttgtctatagccagggtcggtgttggcggaggaggc

SEQ ID NO: 37221 - DNA, 143 bp, Chlorella protothecoides
catgtgtctggagggcccttccaccgggcggtgtgcgagccatcctcgcctagttcaacacaccgctgccggcatgtgctccactccccccaataccacctcgaccctccccaggctcctcccccgccccaccctgcctgctg

SEQ ID NO: 37222 - DNA, 62 bp, Chlorella protothecoides
gccttccaggccccctgcagcctctctgcaggacggcttgttgtttctctcgacatcgccgg

SEQ ID NO: 37223 - DNA, 78 bp, Chlorella protothecoides
gccatcaatggttgtgcatgggctgctcatcaggtaaatctcacggacattgccatggccacgccactacgtcccctc

SEQ ID NO: 37224 - DNA, 61 bp, Chlorella protothecoides
cgacatgttttgcgtgtcggccgcggagccagaccggcagatgtagacagaatcggacagc

SEQ ID NO: 37225 - DNA, 113 bp, Chlorella protothecoides
cgcagtgcaggcgaacggtacttcgtcaaacgcgcatctggtcagattttggtaggtgcattcagctgagagcacgtgtgcatcatgaagccatgagcacccaactttgtgca

SEQ ID NO: 37226 - DNA, 61 bp, Chlorella protothecoides
tcctcatgcccaacgccccggtgagggcgtagagtgggcggtttgctgctggtggggatgg

SEQ ID NO: 37227 - DNA, 116 bp, Chlorella protothecoides
gcacacctgcgaccagtgcgaggagccaagccccgacgaggaggtggggcaacatgagatcacttctgagcgcctcacccagacctcgggcagtcaccgtagataagccaccatcg

SEQ ID NO: 37228 - DNA, 140 bp, Chlorella protothecoides
tccgcaatcctcctgccaaggcaagcgcccgcagctgcgtccaggcactcgttcaggcgctcctcgcctgaagcttggcctcctctacctcgcgcaccttctcccagggcgggaagaagtaggactcatcaaagtccacc

SEQ ID NO: 37229 - DNA, 140 bp, Chlorella protothecoides
gaacggaggcagcaatgataggagagggaatgccccttacgcacaatgctgtagctacaggctggtgatttcttgtctatcgcatgaagagaacgactgaaaatgtgcgatggttgcctgcaaagagtgccaagcagggt

SEQ ID NO: 37230 - DNA, 150 bp, Chlorella protothecoides
ttggcagaccgctgacgcacggcagtggggctggacccgcctaggtacctgcatgcagcgtgcatttgtgtgactagatagacgtaatggcctcaggccatgggcagtgtggcagctcttaccattgatcaccgagcccctccctggccc

SEQ ID NO: 37231 - DNA, 135 bp, Chlorella protothecoides
cgccgtgacgccattgcatggcgtgtctactctgccgagctcctggcgctgcgagggatgccccgaaacgaagctctcgatcatggagctcaacacactccatggccggtgcactgatagccttccctcacagac

SEQ ID NO: 37232 - DNA, 77 bp, Chlorella protothecoides
cgggctacgcctgggcggagtggctgcgcgagggagtcctggatcggatgggcgcggggtccggggcgctcaggctg

SEQ ID NO: 37233 - DNA, 73 bp, Chlorella protothecoides
aagagcgtgaaggctgtggttaccgaagacgccgcatgggtcactcgactggaaacgactggtgctgggaatg

SEQ ID NO: 37234 - DNA, 73 bp, Chlorella protothecoides
tgtgatgtcggatcgcgcccaggcttggcataggttgtgagctaggcgtttcgcgggacaaggtggcccagtg

SEQ ID NO: 37235 - DNA, 62 bp, Chlorella protothecoides
gcatcgccgcctgctgctgctgcatcgccgaatgctgctgctgggccagcgacgctgccggc

SEQ ID NO: 37236 - DNA, 3064 bp, Chlorella protothecoides
  modified_base (778)..(787): a, c, t, g, unknown or other
  modified_base (1839)..(1848): a, c, t, g, unknown or other
  modified_base (2739)..(2748): a, c, t, g, unknown or other
gcgcaggcccgcgtcagcgcggcggccatgacggccgccactcccgcatcgacctcgggcctgcgccgcgcggcgccgcgaccgccgccgccgccgcccagctcgtcggcctccagctcggcaaagacgcgggaggcggcgtgcgcaatctcgggggtggggtcgcccagcatgcccagcaggccggggaggaggtcggggaggtggcgccccaggtcgcgcccgggcaggctgtccagcaggcccacccaccccagcaggaactggcgcttgtgcgggtcttccacccccaggcaggccgccagctgcggcacaaaaggctccagccgccactgctccgcctcggccacgatgtctttgactaggttgttcaggaaggccgccgcgttctgcacccccgcgtcggcgtcggcgcagacgcgaaagagcgcgtcgaacacgtcggggaaggcggctaagaaagcggcgcgcgtggacttggccacgttgtacagcgcctccagtgcgtaataccgcacacgcgcgtcggggtcggtgaaggaggagaggatgggcgggaccaggcgtggcatcatggcctccgccaccacctcgccgtgcgcgccgggggcggaggccatgcccaccgccgaggcggcgaggcacagcaggccgcccttgcgcgcattggcctgcggggggcggggggagtgcaggtggattttcagtgcaagactgtgtgcatggagcatgtcagacgtacaagataccacctggcactgaaatggacggacagcannnnnnnnnngcggggtgagtgcaggtgggtttcagcgcaagactgtgagcatggagcatgtcagacaaacaggacaccacctggcactgaaatggacggacagcatcggccgcactgggagcagctgggtggtgctgattgaattcagacttcgtctgaaaacgtggcattgtcctgcccacgaacgctgcctgcaacactctcccacaactgcatgatctggggaagccgaccatcgcacatctccccaacctaaaagtatcatgcgcaccttggcagagagcgcatagttgatggccagcgtgtccagcaggtcagcaatcccctccctgtccccagccacggtctgggcccggaccatctgctccacctccagcgccgcgactttacgacgatcatagaactgagagcgcgtaatgtggggcagggaagcgtgaggtgtgctggatatcgtccaaaacggttggatctacgcaatctggctgtggcaggacgccgcaccacgaggtggccaccccaccccaccccacccagcctcgccaccttatcggcgatgttcttggtgatggcaggggggagcactgccatcccggcctctgtgccgatcatggcgtcggcactctggtcctgactggggggccgctagccgagctcacggaacggctcaggggggtatcctggcctggctagcctgtctcttccctcatcaggcctccaacacaccccgcgatggtgaatttacaagaacaaacacgttcacaggctggaatctgcactcgaatacgatgatggggatgcgccaggtttgtggtgcaacgggaggtttgcaacgggaggttgcccgtcatgcacagcatacacccttggtccgcccatccacgatagaccatactatccctgcctgttccacgatccactcccacctatgacttggaacctacttgcctttccacggcaccatttaccatgggatgcgaccccttcgcatgccaaccttcgaccaagggacccttgcccccctgggtataaatacccaccgacttacgttgtaacggccttannnnnnnnnngcgatggtgaatttataagaacaaacaggttcacaggctggaatctgcactcgaaaacgatgatgggcatgcgcatggccagttcgcgagatcgatcaacgaggggcggagtgggagggtggaagcctgggaggtgccaccgttgcctgccctcagcctcgcgtccctttgctttccctgcacccccaaacatcctcaaggacttgtcatataattacagtgcatgcccatgtgcgccctgtcaacttgcaggagcacatccgcggccatgccagacccgcccgcccaaccacggccatcacggcccattgaacaaggggggcgagcggtggtcctccgggtccacgtccagccggtccgacagcggctcgaagtaggcctcccgcgccgcgccgcggtgcgtcagctccgcccacttgaagcgcgcccagtcccaggcgccgatcacggcgtcgacccccgcccagaggaccgaggcggcgacgcccagcgcgggcgaggcccgctccgcccactcatcgcgcgccgccggcggtaggcactgcgtccagaccacaccgcccaccaccgccacgatgcctggtgggggagaaagggggcagagattgatcagggcgtcgaggggtgggggaggccatgcatgaagcgattgcagcaccttgctgatgggaaagactgggggcacagctggtcgatggcatacgatccccggcccccccttctccgacccggggctgacactattcactccgcacgctgcccgccacagcggcgctcacctttcccttctcagctcctcattcggcacctttcaaacaagcaaccccccttctcctcgagcaaggccctccaccgaaaactccttctcacccgtgatgagcaggacgaagnnnnnnnnnnaatgcctggtgggggagaaaggggggaaagattgatcagggcgtcgaggggtggggaaggccatggatgaagcgattgcagcaccttgccgacgggaaagattgggggcacaggtggtcgatggcatacgacccccgccccccccttctccgacccggggctgacactgttcactccgcccgctgcccgccacagcggcgctcacctttcccttctcagctcctcattcggcacctttcagacaagcaaccccccttctccgcgagcaaggccctccaccgaaatttccttctcacccgtgatgagcaggacgaag

SEQ ID NO: 37237 - DNA, 107 bp, Chlorella protothecoides
gcccttccagctcaccatcacgtccaccactgggcagacggtaagccccgggtaacaagggaggcccgcatgtggggtccgcctgcccctgtcggtgcatgcgcagc

SEQ ID NO: 37238 - DNA, 63 bp, Chlorella protothecoides
cgtcttgctctttctctatagtgcctcgggtgcttgagtgtctgcatgatcaactcgtccaaa

SEQ ID NO: 37239 - DNA, 66 bp, Chlorella protothecoides
gcatacatggacctgtcgagcggcatgttggagtatgtgtgtgtacttgaggtctatgcatatgcc

SEQ ID NO: 37240 - DNA, 74 bp, Chlorella protothecoides
tcctcggcgtgcgttctggggacccggcacactgcgtgggcgagtcacaggtggtgtggttcctttaggattcg

SEQ ID NO: 37241 - DNA, 73 bp, Chlorella protothecoides
ccccccccccccccccccccccccccatgtgccccacgcgcaaaacagcgagtggagaggcgctgctgcggcg

SEQ ID NO: 37242 - DNA, 164 bp, Chlorella protothecoides
ggccagggagaggcccgtcatctgcaaggttagggggtgggtggacggggtagggcaggaaggggttcaagtatgtgggtagatctggcaattaccaagaccatggctgccggcacaggcatgcgcccccgcatgccccatgagacccctggcgcaccatgtgc

SEQ ID NO: 37243 - DNA, 67 bp, Chlorella protothecoides
acttcttggcgggcggcggcaaatacttcttgggcgggggcggcggagacttctttgcaggcggggg

SEQ ID NO: 37244 - DNA, 1190 bp, Chlorella protothecoides
  modified_base (127)..(277): a, c, t, g, unknown or other
  modified_base (392)..(619): a, c, t, g, unknown or other
  modified_base (831)..(1063): a, c, t, g, unknown or other
tgtgaggtcctgcgtgcagccgggcttgtgggccaggccgtcccatccacacgtggccctgacccagccccctgcacagatctcgccttgtttctgagccgcctgtgtcgtgtgaccctctgctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaggcgacacaggacaacggtctggatgatcttttgcggtggatacagatattttaacaaaacaacgtataaaccttccattacctgcggagcagaatgtggctgcgggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatgatctgcacgacacatctctcccttcattgactgggtgtacattcacctcgactccaaaaggcaccatgaccgaggaaaagcaggcttgaaagaatatgtggaatgtcaggagccttacatgacatgtagcacgtccaagcaggggcaacacaactcccaatagagcagccgtccttcctcagtagcggaatgcggtggccagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagacagtgaaggggggacgtcggttcgatttagggagacagatcagcggggaccaggagctctttgtaatgaaacgatgataccgctgcgcatacagagtcaaaacacagcagtcctgcagccc

SEQ ID NO: 37245 - DNA, 133 bp, Chlorella protothecoides
tgctggggggcggacgggagtcgctgccaaaaggcatccctcccacatgggttccaaactgccgctcgtgactcttggccttgggaccgttttccaaccaccctcccagagggacagacttgtgtggacacct

SEQ ID NO: 37246 - DNA, 61 bp, Chlorella protothecoides
ccagctccaagacgcacataggttgcagaggcccctcacctccatctaggccagacgacaa

SEQ ID NO: 37247 - DNA, 456 bp, Chlorella protothecoides
  modified_base (160)..(289): a, c, t, g, unknown or other
ccgtccagccctccaccaggagctccggcgtgcgcagcgcgcgcggcgccacgcccgcgccaccgtcgcccgcgtcgtgcgcgagcagcagcctgtcggccagcgcgcccagcaggcccgcgggggggcctgccagcagcgtggccaggagcagggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggccacgagcagcgcgggaccgacccagagcgcggaggtgggcacgcccgcggcgcgcggcagggacaccacggccgccacggcaaagcgctcggtgagcaggagcaggcggcgcgtggtgagcgcggcggcgaccgcggcggcggcggcgccgccgtggtcctg

SEQ ID NO: 37248 - DNA, 64 bp, Chlorella protothecoides
gcggcatatcttcgactcgtgcgccgcatatgttcgcggataggggtggtgcgggagtgtcgga

SEQ ID NO: 37249 - DNA, 103 bp, Chlorella protothecoides
tggacaccccagggcactgcatgctggttcgcactcagaatactccgatcgattctcaacacagaccatcccaacgcacctgagggaaacctcctccctgacg

SEQ ID NO: 37250 - DNA, 61 bp, Chlorella protothecoides
gcaccagggcaatgacagcctcgggccccgtgctggacccgacctcggtcagctccgactc

SEQ ID NO: 37251 - DNA, 100 bp, Chlorella protothecoides
gtacccactgcctaaccgggatgcattgcacgcgatcccccaccccaccccaccccctcaccttgccatagtatgtggccccaaccaagcccagaccggc

SEQ ID NO: 37252 - DNA, 17126 bp, Chlorella protothecoides
  modified_base (494)..(503): a, c, t, g, unknown or other
  modified_base (971)..(980): a, c, t, g, unknown or other
  modified_base (1146)..(1169): a, c, t, g, unknown or other
  modified_base (2596)..(2605): a, c, t, g, unknown or other
  modified_base (3278)..(3287): a, c, t, g, unknown or other
  modified_base (3523)..(3532): a, c, t, g, unknown or other
  modified_base (4159)..(4168): a, c, t, g, unknown or other
  modified_base (4586)..(4595): a, c, t, g, unknown or other
  modified_base (4829)..(4838): a, c, t, g, unknown or other
  modified_base (5354)..(5363): a, c, t, g, unknown or other
  modified_base (5597)..(5606): a, c, t, g, unknown or other
  modified_base (5659)..(5668): a, c, t, g, unknown or other
  modified_base (5721)..(5730): a, c, t, g, unknown or other
  modified_base (6643)..(6652): a, c, t, g, unknown or other
  modified_base (7474)..(7483): a, c, t, g, unknown or other
  modified_base (9376)..(9385): a, c, t, g, unknown or other
  modified_base (10565)..(10574): a, c, t, g, unknown or other
  modified_base (14813)..(14822): a, c, t, g, unknown or other
  modified_base (15242)..(15251): a, c, t, g, unknown or other
  modified_base (16201)..(16210): a, c, t, g, unknown or other
cttccccccttcctccctcgcgtaccggtgtagtagacgatgaggggcgcgccgtcaaacctgcggtagctgaccacccctggcgtgcaccacgcctggttcttggggtcgcagcgcctctccttcaccaggcctgcaaagcgggttgggattgatgtccggcgctcagtgtcaagcagcctgcggcgatcactctctgactccacccagccatccgccggcccttggcagagtgcgcaggtgtccccagctcccatccctcacccctccaccgtacccttcttggtacacgtcttgccggggcgcaccgtcttggtgacggggtcgtactctgcggcacactcgtccccgcccataccctccaccacctccctgcagggtggcatgaggggaggggtttcgaaggagggggatgaggaggccgcatgggaggtgcatggacgcactggatgacagccccactgacagtccaggccctcaatgccagggaatgnnnnnnnnnngtgggaggtgcacggacgcactggatgacagccccgccgacagtccaggccctcaatgccagggaatgcacactctgtggtgcccctgtcacatcgcatcggctggagggcgaggcgcacggtctgtgcggtgcgcgaggcacgcttgcccgtccttccaagcaaggtacgcatgggcgcccccggctcccaagccccacgcaccgcatgtacccctccgcgtcgatctggaccaggggcaggtaccccagctcgcgcagggtctggaatatgccggccaggccctcgttccaggaatgccagatgttggacctgggtggaggtgacgtggagtgggcgggggcaggttggcgagcctgcgcatgacagcgggtgcgcaggcagggccgagcaggcctcttcaatgatccttgacatcgaattgaaagaggtgggcaacggagtctggggtcgggggcttggttggcnnnnnnnnnnctttcaatgatgctcgacatccaattgaacgaggtgggcgacggagtctggggtcgggggcttggttggcgacaaaggccagcaagaacccagagcaaccgtgctccctttgatcaccaccgcagctcctcatcgcatctggtaaacgggcaagccccctcactannnnnnnnnnnnnnnnnnnnnnnngcggacttggagcaggtacgccggcttctcgatccagcccttgcacaccggctgctcctcggccgccggcacatacgagacgttcatgtagtatctgcagggggtggtgtggaggttcaaggcaggttagataggcccagcgcccccgcacatcacgctccgcgcatcgcctgcctgccttcaggccctggaccgatctcagctgccctttccacccagcgctcacgtgaggatgccagtgacctcgcccttgatgaccagcttggtgggcaggtcaggggtggtggagttgccgctgatgtagtccacccaccgctccgcagggggctggaaacctgcgggatggagagggcggcaggggttggagggggcactggccggtgcccgccacggtcgacaccggttccaggtttggccctgaacaactgcaactggcatggcttgtcagatgaatccgaagacttgcaggtggctacgctgactgacaaggctgagaatcatgtccattgcagcaaggggccacgccctgcccatgcgagcaataccagctggggcgcacaccttccgggtagaagaagcgtagctctttccgtgtcagctgcacgttggagaagcggtagtagtgcttgaccatctgccccttggagtcgggcaccacttggacggtggcctctgacaccactccaggcgctggcttgccggccggagaccctgatgccgcctgctgagccccgacggcgcccgcgtggatctgggacagggcttcactggctggctgcaccttgccggcgatctgccgtgcctggctggcctcctgctgcgccccgctcctgctggcctggcggcctgcatctacagcctgctgttgagccccagtctgaggtatctgattggtcgcgacgccatctgaagccacgggcgccggcggtggctggatgtttcgaatgcgctccggctgacgggggggcgtccccgcctggacggctggagggatgcttccactgcccagggagctctctgtgacatgctgggccggtcgaagggtgtcgtagtcgaccgtggtgggcgtgtgccctgcacctgtgcatgccaacgggggggatccgggtgcggatgggcgcgacctcggcacacaccgggcagcaatggttggggcctctgccctcactggccaagatcctgatcgcaccggaatacttggaagtaggggcacttgccagtgcccagacgagcaggagcagccatgatgtgtacaggagaactttgcacgatcgtcgttgccagacccggacattcccttgcccgccaggctgcagggtggcactggatggtgagaagcgcagacaagctgctttccgaattattcttatatttaaagccaccatacccattgcgcacccgtggacgaacgaatctcgagggcctgnnnnnnnnnnatgagaagcgcagacaagctgctttctaaagcattcttaaatttaaagccaccatacccattgcgtacccgtggacgaacgaatctcgagggcctgtccattgtgcgccacgccttggtcgcctcggcagtacgcagtgaatcagaccatcaccatcatgggagctaaatttgacatcccatgaatgtctcgatgatggtggtaacgtacaggactgatgtgatgtcgcctcctccctgcatctgattgcatccagccggctcgacggccccctggtatgcgcgttggctcggagtgttgtattcgattcgggatttaacaagtgcttcccgccacgtctcccaggccgcatgcccgatacccgctattttgaccaaactcactgttacgggaagctcagtgtctgttcagctttcaacggtggtgcatctgaaggagtcggccaccttctgtagggtctcgccccctggcccctcaacagccgagatgggtgcctgcaaccgcatgctgtacaggcggccgttggccgtccccagcaccgtcaggtactgcctgtcccactccagctcggtgccggcatcgatctctctctgggacacggccagctggttgcgtgaggcgtaggaccgggctcgcagccttatgtcgtaatagatcctgccgtcgtcggcannnnnnnnnnggaggcgaaggaccgggcacgcagcctgatgtcgtaatagatcctgccgtcgtcggcagtgcgctccgtggcactcgtgatctcggcattccgcttcactcccagccgggtggacatgtactcctttttgaactgcagcgaggcggtggctgggatgggtgcactgtgggatgccacagtgcaactgctgggcaatgacaaagcaatgttggaccgcagaatcagagcaagcagcnnnnnnnnnnaatggctgggatgggtgcactgtgggatgccgcagtgcaactgctgggcaatgacaacggtatgttggaccgcagaatcagagcaagcagccagcacatgaccccaggcagtgcccacctgactcaggaggccctcggcagcatcctgggggctcttcaaatcagtcaccgccgtaaactttgtagaggtgggggagctcacgtccacaaacagggtctgctccacatcgtaagggttgcgatagaatacatcgttaccggatgtctgcgggggaggtgggacagcggtgtgacacttgtgagggtgctgacctgactggagaccatgggcttacaccatagatttagtccagcatgtagaggtgaacaattaaattggaggcagacccagcaggtcacccatgttgtcctcacacaccgtcacaaactgccatggagttggcactaggaagttgtagccatccaggatgtcctgatgacgcttgaaacctgtcaagtacagggattgctagggaaacatttaagtcgcatgcctcaagcaacgaccatagaaacacatcagctctgtataggatggccatcatgacgtaccaggtggtgaaggaagcttggacaggttctcgacgnnnnnnnnnntcaagtacagggattgctagggaaacatgaaagtcccatgccttgagcgacgaccatagaaacacatcagctctgtacaggatggccatcatgacgtaccaggcggtgaaggaagcttggacaggttctcgacggcgaaggctggtgacgctccaaacgctgcaagggccatgccgtagcccagaatggcccgccggcccattcgcagatcatgtgggatggggtgctcgctggagtcgggcgcctccgccatgcaacacaccataggacctgtatgtcgcattctgcccatattacatggctttgttggcagcttcctctgcatcgggcatgggtgcgggccatcatgaattgtgctgggtggtgtgcgtgcggagcccgcagccctcataacggtcgccattcctcacgcctggannnnnnnnnnacgctgggtggtgtgcgtgcggagcccgcagctttcataacggtcgccattcctcacgcctggatcatgccattgacagcgagtgacacgatgcaggctgttaggcagttgattgtacaatggtgtctcacggccgatccatatgcggaactggagcatgcacagcaggccagcgcgcttcgaacggcaagcagcagatgggattctgagaggtctgcatcacaccaatcttcnnnnnnnnnngatgtaggtgtctcaatggtttacacagcccgatccatatactggagcatgcacatcatgccagcgcgcttcgaacggcaagcaccagatggggttctgagaggtctgcatcacaccaatcttctgcccttgtcatggtacagctgccgtgcatgctacagcatcaagactggacgaggagtcgaagacgttgttaccttctcatacccatctgactcgctgctcggtgtgtttcaattcctatgttcacctctgggtagtaatgatttgtcatgcagtgctttaaaaaacgcagatggcatggagaagccctcacgtagcaactgtatatatatatgctacactttttgtcaaatggttgcaatgttttcccatgcacgttcagcaggagtcgttgatttctggcccccagccgtaatcttactgatatgcaagatggagtggtggggcgcagaaaattggactggcccttgcgttggctacagcatccactcagcatgtcctggaagcctcctnnnnnnnnnnaattcgattctgctcaccgcggtccagtaaaatccaccatagcaagacacagtggccgctccaccatgcacagcagtcggtgcactgtgatcaattacgccgccagacaaagcatagggagtgtgccctcatggcatccccagaaacttgtctatgggtgggtagctgcggcatgtacagtgaggcttgccagattctcgccggtgcgaggcttacagaacaatccaatacctnnnnnnnnnnagtatactcatctaagatctatgcatggcctgggcttgacatagtgcaaggcnnnnnnnnnntgtatactcatccaagagctacgcatggcctgggcttgacatagtgcaaggcnnnnnnnnnncagctgcggcatggatagtgaggctcgccgggttctcgcccgtgcgaggcttacagaacaatccaatacctttatatgcatgctcccgagcttcgatagttccagcactgggtctggagcaccatgggggggattacaaatccgaggggctcacgtaaaatttgttcgaacctcccggaggggtgtggccgaagagcggtatctaccactcgttggcaacaaccacatagaacaaccattctctgggattttgtaaggctgctatataatcggtgtgcacgacgaagtccactcttgtacgactcctgtcggcaaccatgactgcgactagccccctcaagacgaaggtcgccattattggcagcggccccgctgggcacaccgcagcaatctatgcagcacgagcaggtactgttttctggacaagcaaagtcccatggtcatgccggcaagtctgggtttccccggtgatctcaccgccagtgggtgtgcgaggcatgcggagtcagtgctccctttgctttcgagtttgcccaacctcattcattcaaatcgaccttttcctatgcagagctgcacccggtcatgctggagggctggatggccaacggtgtggcccccggaggccagctcaccaccaccaccgacctggagaacttcccgggtttcccggagggcatcctgggggtggagatcaccgacaagttcagggcgcagtcggagcgtttcggcaccaagatcttcagtgagaccgtgaacaaggtgtgtgcgaggggtcgcagggagcaccacaccgtgcctgtgtggcatgccgcatgcggcctgccctgctgctccatcgacgtggaccaggtgatttctctcacgagctcgcgccaactcatccccacaggtggacctgtccaggcggccnnnnnnnnnnccgcaggggggcaccacaccgtgcttgtgtggcatgccgcctgcggcctgccctgctgctcaatcgacgtggaccaggtaatttctctcacaagctcgcgccgactaatccccacaggtggacctgtccaggcggccctttgtcatcagcacggacgagcggcaggtcgtcgcggacgctgtgatcatcgccactggcgccgtcgcgcggcggctggagtttcctgggtccgaggagggcacggggtactggatgaagggcatctccgcctgcgccgtgtgcgacggcgccgcgcccatgttccgcaacgtccccatcgccgtcatcggcggcggcgactctggtcagtgcgaccgtgtgcggccttgggtggacaggaggaaggggaggggggctcggaagcagtgcaaaacggtgctgagaaggggtttgtcgaagcgcctgccgccgattgggtgatcttcccaagattcgtgctgagtcctcagctttgacggtggcactggcaggccgtacccctggtctgttggactgaccggcggcccgtcctcctcaccgcccctctccctcaccccctccctctcgtggctcttctctgtgcagccatggaggaggccaacttcctgaccaagtacggcagcaaggtgtacataattcaccgccgcgacgagttccgtgcctccaagatcatgcaggttggtggtggcagccgagtgtgtgtgtttgctggggtcgaggccttgccgtgttgcgttggtttggacaatgatacccttcatgtgccctgctttccgggcccccccccccccccccccccccccnnnnnnnnnnatattccgttggtttggacaacgatacccttcatgtgccctgctttcccgcaactctcccccctcgtcatcactcccattcactcgctccgtcccatcgcagaagcgcgtgctcgacaaccccaaaatcgaggtgctgttcaacagcgtggtcacagaggcctttgggaatgagaagggcaacctgggcggcctgaggctgaagaacacggtgacgggcgaagagtccagcatcgatgtgagcggcctcttcttcgccattggccacgaccctgccacaaagttcctggacggacaggttgtgtgtgtttgaaggggagtggagggaggtcagattgggtgtgcagagcgccggtgtgatatgtgtgtgctctggtcgagtctggggatgtttcccagcagcctgctggggtattccctgggaactcggctcgtttatgctgcctaatcatttgctgttcttgtgtccagttcttgtctggagcctttgtgtgcccggctgctgcactcatgcccaacgatgaacactacagctcccagcgcccagccctgctacccacccccaccccttctaactcgtctgacccctcgccccacactctgcagttggagctagacagtgagggatacatagtgactgccaatgagtccacggccacgtctgtggagggcgtatttgcggctggggatgtgcaggacaagaagtggcgacaggccattacggcggcaggcacaggtagcgtggagggtcaggcgggaggcacggggtggggatcgcaggcttgatggggagagagggcggcgcgctgcgcacatccagtcaagggccacctgaagagttccggcttgctccagaacacaagttggactgtctcttacagatctgagcggtcagtaggcccgctccacaccaccaagcaagtccattccacaccttgcacaggctgcatggcggctctggaggtggagcactttctcactgctcaccaggagtgagaaccttcaccgacgccacacagcccgcctctgatgcagcaacagcacctcccgaattgccctggggatgggccctcgcactgccagcactgccacgaactcagactgcgcttggaaaggttgtacactatgcacggggcccgggtcagcaatctcagcccaggaggatgggaatggaagcagcgcacgtgaggaatatactagtagaaatcggagagaggcaactagtgcagatctgctcacggcacgacggcggcatggcaagcgagtggggcggtcagtagtggatgcggtcggtcaactcggagtaggtcttccagggcaccaccgcctcctccctcaggtactgcttgatctttacgttcttgtcctcgtcggacgcgttgatctcggccaggaagtcggcatcctcgaactggccgtacttcttcacgtcgtcgtaggtggcgccgctgtgagagttttggggagggggaaatggttggtagggatccagccagggtcgagggcatgaattctgtccatcagccacaaacccgctgccgcaggtcacgcacagccacaccggcctcgagcttggccgcctggcttcctgggcttatctagtactccaactgctcccttcctctccatttcccctctcgctaactcactagtagatggcttcgacatgggcccacagactgctggcatagcacatggggcagggctctgcggaggtgtacagcacacagccttccagcacgtgagtccccaggttacgacaggcgttgcggatggccagcacctcgccgtgcctgcaatgtgaggggtggagaccgatttccatcgcggggcctcgccacctgggggcgtgcgccggagcacggtcgccgcgcatgcagcgcatcccgagtannnnnnnnnngagaccgattaccatcgcggggcctcgccacctgggggcatgcgccggagcaaggtcgccgcgcatgcagcgcatcccgagtatgagaggaaccatccacgcgacctacgcagtgggatcatggtcggccaggacgcctgcggtgaagagggggcgagcatgtgtggcaattgcgtcgggagggccgcgccgaaaccctcaggcccccaaacccactcacggttgtagccctcgcccacgatttctcccgtctccttgcgcacgaggactgctccaaaaactcctcctgtacgctcttcgatgcccgctttggcgctcaactcgatggcgcggcgcatgtactttgggtcgggatgttgcaccatcgctgcaatgtagggtaccgtgcgagctctcgatgtgggttcgggatggtgattcgacaataaattgtcaaagctcaagaaaggtgcagtatggggaacatccggaaattcagcagatctctgccaaacctcgtccggtcccctacaataccccgtactgaggggggaggacgggagggcgacttccagatatggtcggagcagacctcctgcatttatcctcatcgacacaccacaaggatcccagggagtcaatgacacactttctcatacctggcgacatggtacgcgcggcagccctggacatcccgcaccattcttcacagcctgcggcttgatctgcggctacccttaccgcctccctggctccattatttagcatatcatggtgacggtgctccaacccggcggtccttggaatcagttggccagcgcatcgtgagtttgagacatgggaggggggccgtgtcggaattgggcgtgccggaatgagcggcgcgagactgcgcctgagctgcgactccctcccaccaagcgcaggttcctgctgtctgccctggtttcggatctcctaatcctgcgcctcttcctctttgcggcctacatctttctcttcgcggcggcgctgacgggctacccccgattcccccggtggggctggcaaggtggggcacctacaaggcggtcacagcgccgggaggtgggagtgtggcaccctcccgggcaggggactgccctgccaagctcggtacccctatcaactcccacctttctcccgccccaacccccatccacagatgcgatatccgtggacnnnnnnnnnnctcacagcgccgggaggtgggagtgcggcaccctcccgggcaggtgactgccctgccaagctcagtacccatatcaactcccacctttctcccgccccaccccccatccacagatgcgatatccgtggacggcctggcctggtcctccaccatcatcgtcttccacggctacgcggtctggcggcacctgtgggacgagcgccccatccgcttcaggagcgaggacgaggagcagctgtggcgcctgttccaccgccgcagcggcatgtaccgcctggagatgagcgagtgcctgcgctatgggcgctgggcgcggtacgccgcgggcgacgtcatcgtgaccccgggcgccagccacctccgcctgcacctggtggtggagggcctggtggagctggaggtggaccacggcgcgggcaaggagcgggtgcttaacacgctgcactccggcaccattttcgactttggcgtggccaacgtcttcggcgtgtacattggcttcgagtgcgcgcaggacgtgggcttcacagcccgtgcaaaggtgggcatgtctttttatgtgttgtgtgtgtatgttgttgaggggggtgttgtggggggagaaagggatttcggatgcaggagaagggggtggcatactggccggaaggggactggttaagcgttgcgccgacccctgccgcccctccttcaccgcctcctctcaaccccacgaccctcaacccagaccgactgcctgctgtatgaatggtccatcgacgacctggaggtgtttgccagccggctgtcgccctctgtgcctgccttctggcgctcctttgtgctctgcgaggtggggctggagtatgcgggccgcgtccaccccgcccgcggcacgcgctccgccaacggcgagtgggagggccccgagtacgaggccggggcccgctcccgagacttcaccgagccgctgcgccccgaggagctgcccccgcgccgcggcctctggggcaccctgcgcgccgtcctgcgagtgttcgacccgctcccgcccgccggcctgcgccactgcagcacgcccatgagcggcgtcatggcgcgcaaccgcctggcggcggtggcggctgccaaggggctggagcagcgtgccacgctgcaggaggaggagcgggcgcaggacgacgtggaggccgccaaggcagtggccggcgtcaagtgacaagggggttcttttatcatgccctgttcagaggtcgctgtgaccctcttcatcgacccaggcggcgcacagcgggtctctttccagcagcgccgccttccttctccggtgacattgcatcccattgcacatgacctgctcccttgctcaccttcatcagtcaccaggccatgaactacctcccccacctctgctacgacccagatccctgtcctaccacccccctcctaccacccccctcctgccattgcatggcatgtagtatacagcagcgattgtggccctcgggccacacgtgcggcgtgagtgggccagcagcgcacatccagcgggtgaagtgttgtcggccatggccagagtgaggggaaagaaaggaacaggggggggggagtgcacgcacacagtgacacacagggtcccaagggggggatccaccaggggccctcaccccaccagccgcgggcaggcggggggagggcgcaaggggcgggccgctcctgggggaacggtcgggacggggcggggccccgctctcaaagcgtccgggggtgtgggtggggggaaggggccagcgtgcgccttgggcacaaagacccgtctggcagctggccccctcggacccctccccagagctcgggcgccggcgccccggcaatggggcagggggggcccattcgcgtcccatacggaaccaaaacttgggacgtcaagtatggagagaagacgatacgtcaggcagcaacgggtgcggggactggcgagtgggtctggggggcgagggacccgggagggggtgagggtcggaggggggagccttgcgacgcacgatcgcctcgaccggccccctcctgcctcgacaccaccctccatgccatcgcctcaggcccccttggcgggcttggggtcgggaatctcatgcgaccccagcgcggccgaccccgggaaggtggcgcaggcgggcgcgcaggccgtggcctcctcgccgccctctccgatctgggagcgccagtaggccgcggcgccctcgatgtggggcatggctgcggccacgaagttgggcgccagcccctccaccagcttgaggcagggggtgaggaagatgttgatgaacttgagctggccgcaggccacgggcgcggaggcgcggtcgcagacggcggtgacctccagccccagcgcgcgctccaggtcgccctgcttgtacatctcgtcgtggatcttgcgcccccacaccatgcagtggtgcagcggacgcgcggggttggagatgtcggcggtgtgcagcagcatctgcagcgccttgacccgcgcctcccccggccaggccaccaggtcgggccccagctcggccagcgtgtcggcaaagtcgtccagcgcggccgcgtggtaggccatgtcggtgcacagcaccatggcctccaccaggcgcaggaactcggcgcggtcctcaggcggcagccggcagatgaagtcgttctcagggcggcgcagcagctcgaaagccagcgcgacgtgcatcgactcgttcaccgacttgccgccgcactgcttggcgcagtctgcctcggtgcgcaccaggaaggcgttctgcacgcccgggtgccccaggtcgtgcaccgcgccggcgatcagcagcgccagctgctccagcggcgtcagcgccgcgccgtaggcgtccatggccagcatggcgcccagggcctgggtcacgtccgccgcgtgcgtggagttgtggtagggattggggcagtacgcgcgctccgcggcgcgcaggaaactgctcagccggtcctcggggatgggcagcgcctccagcacgccgcggcggcgcagcagctccatgcacaccgcgtgcaggggctcgccgccggtcagcttctccagcacgaacacgtcgaagcgctcccagtcctccatgcggtccagcatctcctgcagggtcaggcggcgcggggtcaccgcgccgcatgggcgggagggcggcgactgcagcacgggcttctgcggcgtgggtgaagggggcgaggggggtgagggagaggtttggaaaggttccacaggcccaacttgacgaaggcctgtgggcgtgaggcgaggccttggtggtccaacagccccgttgcgatgccgcccagcgcaccctgcacacaccttcccaccagtgtgcgcacatgcacgtgagaagaatatcctgcgagggtcgactgcgggtcggaaatcccattccccccaagaaaccccagccgcccgcccagccagcgcacactacctgggggcctgctgcgggcacatgcttgtacgtgaacgacctcaggtaggccctctgttcatcgtccagccacaccatctcgccgttgccgccctcactccgggccagccaggagtggagccggaggagggcaaactgctcctcagcatccaactcgtccttccgctacacgcaaggaaatcaaggggcgagcgtggtcggcgtgtgcatgcggagagccgcgtgagaagggttccggacccttccgagaccaaccttgaagtgttgcacgacattgaaggctttccgggcgatgggggtgtccaggaagcgcagcagaacggagccagacatggtcggaggatggaccctcaggagactacggccagcagtcgggttgccatttgggggggtaatagtgtggtgttgggctctacaaggccgttccggggtgacgcgttgcgagttccacactttcgagcgcggaacctggcagggggagctgagtcggaccaagtgtcggaggccggggagcagtgtaattcacggaggacgttgcagagctttcgagacggtaagggacgcggtctggtgatccttaagtagcgcgagcaggggaggatcacgtagagcctgaaaaattagcaagaggactttccaaattagaaagcacgaccagaagattttctgtattgatttctggggcaccacctccttcctgagcacaccgtccccattgctcttacctccgtgaggagagcgatatgtgggcatctttcgttgcatctcggannnnnnnnnntacctccttcttgagcacaccgtccccactgctcttacctccgtgaggagagcaatatgtgggcatctttcgttgcatctcggatcttattagcatctacctgcatgcagacttcagaaatgtagcgccgaggtgcaggttggcaccagcatgagctccgacgagcaggagaatgatcgcttcgatgtggacaacgactacgaaggtggcgaatttatcgagggcgaatatttctacaggaataagcgattcaagaagcagcaaaccgcagaggacaggatctatggcgtgtttgccgaatcaggtgtgggcagtggattgtggggatgaccagccattcgagcatgcatctcattcgactcccatgtccactgtttctcaatccgatccatacccccaatagatgatgaggaggacggnnnnnnnnnncggggatgaccagccagtcgagcatgcatctcattcgactcccctttccactgtttctcaatccgattcatacccccaatagatgatgaggaggacgggaggcgcacccggcgtagggagcaagggcgtgcctccaaagactactcacgcccagtggcttttgttggcggaggcgtggtccagcatgggcccgaggaagttgctgagaagccttcagaaggtgcgtggagttgggagtgagccagctgcagcaggacgctgtgctgatcgtggcagcgccaggtccaacatggtctttgcacggcatccgctcatcatgccaaccatttcgtctgtctgtctgcaggagaagatcgaccgcgtgggggtctgggtctaggtacagagccctcgaccatgggcggactggggctgggcgctgctccgcccttcgagggcggcggcctcggcttcgccagggccggtctggaggccgacccctcgatcagcaaccggccgcacggggcacctgcggacgacggtggcagcgaggacgacgatggcgtgctgcccgaggcctttgggcgccagctcgcggctgccgcccggcagagggccgctgctgctgctgcggcggcggcggccacgcaggctgcttcgtggcgagcgcctgcatcccggcccgggatcggcgggggggccgcccctgcccccgaggccaccgggacatttgagtcgcacacccgcggcatcggggccaagctgctgtccaagatgggctggcaggctggcaagggcctgggcagggacggcaaggtagggtatcgggggggccggggggatcaggctagtttttggtgagttgattgtgttttcttccacgccatcctatcatacagtccttgcagcgtgctccacttgcactcccactgggtgcatgcaacctctcgccccggctccccccaatcccnnnnnnnnnntatcccatcatacagtccttgcagcgtgctccacctgcactcccactgggtgcatccaacctctcgccccggctccccccaatccctgcccatcctcctcccgtcggcagggcatcgccaagccgctggaggcccagatgcgccccaagggcatgggcatgggcttcggcagccggcccgagcccaagctggtgcagccggagcccaatgcccaggctcacagcgcgggcccgtcggccgccaccgcatcgccaccccccggcgcggccacccccagcgccgaggcccgggcctggaagcggcgcgacgcggcggcgcgcgagcggcgcgccttccgcaccgcgcaggaggtgctggacgcgggcggcgcgcctcctgccaccctgctgtcccagcccgtgatcgacatgcgggggcggggcggcgcgcgcgtgctgcgcgacctggcgggcctggaggtggtggaggaccgcgatgggggcggcgagtccgcgaccctgggccccatgccggagctggcgcacaacctgcgcctgctggtcgagctggccgagtcaggcatccagcgcctggacgcgcgcctgcgcggcgagcaggactccgcgctcctgctgggccgggaagcggcgcggctggaggaggaggcgcgcgcggcggaggcgcgcgtccaggcgcaggccgcgctgctggacgcctgcgagcgcggggagcgggagacggatgctattgcgctggcgggcttgtacgccagcctgcgcaccgagctgcgagaggagtttgaggcgcgcgacgtcgcagcggttgcggcggcgcaggccgcgccgctgctggcgcggtgtctcgcaggctggagcccgctgggtgaccccgcgcgtggcgcggcggcgctggcgccctggcgcgccgcgcttgcgcc

SEQ ID NO: 37253 - DNA, 62 bp, Chlorella protothecoides
tcgcgaagtggcacgccggggccccagactatgtcaaggagctgcaccagtgagtggtgatt

SEQ ID NO: 37254 - DNA, 112 bp, Chlorella protothecoides
acatcgatcgtgtggctgaaaaccgtgggttctcacaccaggctcctcggggctcctcctcacaccgggccggccccccgcacggcccccagccccgcattccattagaaaa

SEQ ID NO: 37255 - DNA, 70 bp, Chlorella protothecoides
gcccagctgcatccaccagggggaggtatccgggatttttggggcctcctgggccgcggggagcacctcg

SEQ ID NO: 37256 - DNA, 65 bp, Chlorella protothecoides
aacaatgcccccaacaatgccccaaacaatcccctaaacaatgccccaaacaatgccccaaacaa

SEQ ID NO: 37257 - DNA, 114 bp, Chlorella protothecoides
gagatgcggtgggtggcgggagctgcctgcggtgcaggatgtgggagtgaagctggagaatggggcggtgtggtaggtggtgtgtggtgcatcactcagactgtgcctgggtgc

SEQ ID NO: 37258 - DNA, 74 bp, Chlorella protothecoides
tggtgcatcactcagactgtgcctgggtgcatttacagagtgcgatgccatgcgattcatccgcgccgcaccca

SEQ ID NO: 37259 - DNA, 19572 bp, Chlorella protothecoides
  modified_base (96)..(105): a, c, t, g, unknown or other
  modified_base (462)..(471): a, c, t, g, unknown or other
  modified_base (870)..(879): a, c, t, g, unknown or other
  modified_base (1322)..(1331): a, c, t, g, unknown or other
  modified_base (1872)..(1881): a, c, t, g, unknown or other
  modified_base (2539)..(2548): a, c, t, g, unknown or other
  modified_base (3303)..(3312): a, c, t, g, unknown or other
  modified_base (3409)..(3418): a, c, t, g, unknown or other
  modified_base (3501)..(3510): a, c, t, g, unknown or other
  modified_base (3818)..(3827): a, c, t, g, unknown or other
  modified_base (4169)..(4178): a, c, t, g, unknown or other
  modified_base (4355)..(4364): a, c, t, g, unknown or other
  modified_base (4913)..(4922): a, c, t, g, unknown or other
  modified_base (5463)..(5472): a, c, t, g, unknown or other
  modified_base (5738)..(5747): a, c, t, g, unknown or other
  modified_base (6314)..(6323): a, c, t, g, unknown or other
  modified_base (6382)..(6516): a, c, t, g, unknown or other
  modified_base (7253)..(7262): a, c, t, g, unknown or other
  modified_base (7615)..(7624): a, c, t, g, unknown or other
  modified_base (8113)..(8122): a, c, t, g, unknown or other
  modified_base (8267)..(8276): a, c, t, g, unknown or other
  modified_base (8389)..(8398): a, c, t, g, unknown or other
  modified_base (8687)..(8696): a, c, t, g, unknown or other
  modified_base (8852)..(8861): a, c, t, g, unknown or other
  modified_base (8926)..(8935): a, c, t, g, unknown or other
  modified_base (9109)..(9118): a, c, t, g, unknown or other
  modified_base (9818)..(9827): a, c, t, g, unknown or other
  modified_base (10101)..(10110): a, c, t, g, unknown or other
  modified_base (10505)..(10514): a, c, t, g, unknown or other
  modified_base (10805)..(10814): a, c, t, g, unknown or other
  modified_base (10942)..(10988): a, c, t, g, unknown or other
  modified_base (11537)..(11546): a, c, t, g, unknown or other
  modified_base (12217)..(12226): a, c, t, g, unknown or other
  modified_base (12453)..(12462): a, c, t, g, unknown or other
  modified_base (13125)..(13134): a, c, t, g, unknown or other
  modified_base (13304)..(13313): a, c, t, g, unknown or other
  modified_base (14946)..(14955): a, c, t, g, unknown or other
  modified_base (16011)..(16020): a, c, t, g, unknown or other
  modified_base (16330)..(16339): a, c, t, g, unknown or other
  modified_base (17032)..(17041): a, c, t, g, unknown or other
  modified_base (17433)..(17442): a, c, t, g, unknown or other
  modified_base (17664)..(17673): a, c, t, g, unknown or other
  modified_base (17852)..(17913): a, c, t, g, unknown or other
  modified_base (18205)..(18214): a, c, t, g, unknown or other
  modified_base (18276)..(18285): a, c, t, g, unknown or other
  modified_base (18364)..(18373): a, c, t, g, unknown or other
cgaccgcccggccgccctgcggcgcagcgctgagttcgtcaccactctgccctggtccggcggaaccggcccggcgatgcgcgcgggagcagggcnnnnnnnnnnctgtcggggccgagggcgcggcgccgggtccccgcccggcgcgccgcgcctctgcgccctccgccagccatctgcccagccgcttctcaagggaaagggggggaggtgcggcgccgccgcagccaggcgaccgcccggccgccctgcggcgcagcgccgagttcgtcaccaccctgccctggtccggcggggccggcccggcgatgcgcgcgggagcagggcgtggcttgcctgccgcgctcccggaggaggtgcctgcagggcgcaccggcgagccgggctccggtgccgctgctcaggcagggagcgctacggtggaggcccccgtcgtgccggtgtcaggacagctggcgcctnnnnnnnnnntcggcgagccgggctttggtgccgctgctcaggcagggagcgctatggtggaggcccctgtcgtgccggtgtcaggacagctggcgcctcggccccagcctgtgtctgccccgtcgggtccatccctcgaccctcctggggccgggcccagcgcagacgggcttcaaacaggagccggagggagccaggcgggtgcgatgcatgcacccccagccctaggcgtggaaccagggtcgtaccatgagctggggatgccggctgtggatgcaggagcagcgcagcctccggaatcagctggctttcgagcctctagtgcccaggccatcgtggaagacgctggaacgctgaagcctgttgccatgagccatggtgcgtgggggcggtttcgacatgcaaatnnnnnnnnnnggcgcagacgggcttcaaacaggaaccggagggagccaggcgggtgcgaggcatgcacctccagccctaggcgtggaaccagggtcgtaccatgagctggggatgccggcggtggaggcaggagcagcgcagtctccggaatcagctggctctcgagcctctagtgcccaggccatcgctgaagacgctggagcgctggagcctgttgccatgagccacggtgcgtgggggcggtttcgacatgcaaattatgctgcaaagcccattgaacggtggactgagcacgatggactccctcagtgccctcagatcaggtccttcgcacctccagatgcaggcacggagctgccggatgtggaggccagcggccatgccatggattcgccctcgctcctcccacccccgccaaccgagcctgacaccgagactatgcccgccgcagnnnnnnnnnngttgaacggttgactgagctcgatggcctccctcagtgccctcagatcaggtcctttgcacctccaggtgcaggcacggagctgccggatgtggaggccagcgaccatgccatagattcgccctcgctcctcccacccccgcccacccagcctgacaccgagactatgcccgccgcagacaacagggcgccagagggtgtgggcgaggccgagtttcatcctccctccccagcatgccaggcggccggaacaacctccgactcagcgatccccgggcagcaggccgcctcctccgccacgccagcgtcccagggctcgacttcccaagcgacacatgaccgcctggcggtgcccgccgctccctcccacacccacatgcccacaccagccgcggccgggcaatgcggcgccatggtggcctgtatgccgggggcagccacccccaccgcccttgccactccagcgggcggcacccccgggcaccctggcggcggcgcggatgccggcacgccggcctcggcagggttccacctggccgctnnnnnnnnnnaacatgaccgcctggcgtcgcccgccgctccctcccacacccacacgcccacaccagccgcggccgagcaatgcggcgccatggtggtctgcatgccgggggcggccaacaccaccgtcctcgccactccagcgggcggcaaccccgggcaccctggcggcggcgcgggtgccggcacaccggcctcggcagggttccacctggccgctgagctggcggcggtggcctccagcatgcatcgtggctccagtgcccgctccggatccgtgacctccggcgatggcaggatttcccccgcgaccttgacatggaacgtcaattgcggcccctccccgcaggattgggtgacacgcggcggcgccgcaacgcctctgctcgcaagtgcagcgggtgcagctgctacgcccgccagcgcagcttccatggtgcagaggccggaggtggacgggggctccatcccgagtgccggtgcactgaccagtggagttgggatgcaagacggggctgacccccctccgccgaccccgaccctccagttcacggccgaggtcgcccgcatgctgcaggcaaggaagaacttgtggcgattgttttggagaggatgtgctgtgaccgtgcgtgcaggcacggggcgggagggtgccatcacagtatggtnnnnnnnnnngacttgtggcgattgttttggaggggatgtgctgtgagcgagcgtgcaggcgcggggcgggagggtgccatcacagtatggtaccgggtaggcgacctccattcccttcctcaggcagcatgccaggctcattgcagcagcccaacccgacaacccctgcaggccctggaggcagccacccctgccaccctggcccgccggccgcacgatcggccggcccgctattccctggtcgccaccgggaccttgctggacatggagaggtgggtggggagcagagtttggcggcggtgtcggatcctgctgacgtggtgcttttgtgcgcttcgctgctttcccaatcagtggcgtcgcaaatctgccgggaaccggtctcagggttcagctgccctctctgttcttgcggtgcacccgctggcatgcctgcaaaactccacggtggcaatcccacaaattctgttgccacatgtgtacagctacgatgcgagcggagccaggcagggcgggaccagcccctcgccagccggggcggatcctgggacaaccggccagctggcggccagcggcggctcccgagaaccccaggccgtgcccaggcccgcaacctccccgacccctgacctagttgacgccgaggtcacggccctgcgtgaccaggcaagttgcattgtgccgaggctggctgtgcgaggctgccggaccccctcgagtcgatgttcgctcgggggcggcgtggccgcgcccagcctgccctnnnnnnnnnnggtttggcggcggtatcggatcctgctgacgtggtgctgttgtgcgctttgctgatttcctaatcggtggcgtcgcaaatctgccgggaaccggtcnnnnnnnnnnacgaggctggctgtgtgaggctgccgagaccccttgagtcgatgtttgctccggggcggcgtggccgcgcccagcctgccctnnnnnnnnnntcgcagcgctgaacccaaagtgcaacccatggaaggcccagctttcgtccccgtgcaccctgcgaacctacttccagcaggcacatccgccacctcggccgtcaggcagcgcagctgagcctggcaggccaccagcgcagcggagtggcggtcctccagctccgccaccgtctgctggtaggaagagagcagcgtcccggcctccaggccccaccgctcaagacgggccacctgtgggtgaggttgatgggtgtgtgcgtgcgcatgagggcagcggagggcaggctgggcgcggccacgccgccccnnnnnnnnnncgggatgtgcctgctggaagtaggtttgcagggtgcatagggataaaagctgggcctaccatgggttgcactttgggtttagcgctgcggctgatgcgtttcccgagccacgtgcctgcagaatcgagagctggaggcccaatgcagcgagggagccagggcagcagaggagcggatcctgaccctcgagcggcaggtgggcaaggggggctagagggcacgatgtgctgatgcagggctggattcaggcgtcccagggccagcggctggctgggccgatcccctgagggccgttctgagtggatgcggaggcgttcctgtcatcgatgcacgtcggtactnnnnnnnnnngggcatcccaggccagcggctgactgggccgatcccccgagggccgttctgagtggatgcggatgcgttcctgtcatcgatgcacgtcggtactcaccacactcctcacccacgggcagttggcaagcgcccagaccacggcggctgccacgcagcaggagctgcaggccctgcagnnnnnnnnnncatcccacgggcagttggcaagcgcccagagcacggcggccgccacgcagcaggagctgcaggccctgcaggtctcccaccaggtgcgagccagcgtggtgccgtttgcagtcagttttccctggctctggctcgctccttgcattcaccttttggggggcgttgcaagcatgcagccggccctgcgcgggagttcgggccttgaccatggctttgcggcatcctgcgcacaaactcccagcccgccctcctctcccccttgccaggctgagctggcaaacgagcgggcggcagctgccttgcagctgcagctgcgtgacacccagcacgacgccgagctgggcaaggtggggctcaggcggcagaggccgacacgcctggttgacttgcggcacgatggtgatgcctgtgggctcggggccatgtgtgtgccaaaggatctgcgtgcttggacggagccctctgatcaaaagccccgcccctccaccccgagcaagcaggtccgggctgctctggatcgcagcacctccgagctggccggggcgcggnnnnnnnnnnaggtcatgtgtgtgccaaaggatctacgtgcctggacggagccctctgatcaagccctgcccctccaccccgagcaatcaggtccgggctgctctggaccgcagcacctccgagctggccggggcgcgggagcggcaggaggcggcgctgcaccaggcggcgcttgcccgcgcggccagggaccgcgccagcgcggagaacgcgcgtcgggaggacgaggtggtgggcctgcgggtgcggctggaggggctggaggccagcctgggggagtaccgtgccgagaacgccaaggccgcggggatgaaggcgcggtacaaggccatcatcggcgagctggaggcgtcgctgggggccaaggagagggagaagagcgcgctggtggccatgtgcgacgagctgatgaccaccctggagcgagagcgccagcagctggcgcgccagcaggcgccgcgctgagaggtgccccggcttcctcgtccccgcaaggggacccccagcatacgccccggattgacagaaatataaatatatgacacatggnnnnnnnnnnggctggcgcgccagcaggcgccgcgctgagaagagccccagcttcctcgtccccgcaaggggacccccggcatacgccctggtttgacagaaatataaatatatgacacatgggtgcaacgtcctgcaagctttcggaggtgggaggggagatcaacacgatcgatgcatggcgctcgaggggggtccgcgtggcaaggaccatcaaaaacatcaggcggccggcggcccggccgcggcggggctggcgggggggctgcggccgcnnnnnnnnnnctaacgctcgaggagggtccgcgtggcggggaccatcacgaacatgaggcggccggcggcccggccacggcggggctggcgggggggctgcggccgctgcgctccgcctccagcgcccggcccagctgcgccagctcccgcgcgaacaccgccctttcctcctccagcgccgactcggcctcgcgccgcgcctgccgctcgccctccaactgtgccaccgtcagtgaagcgctgcgggttggcgcccccggcagcgtggactccggctgtttttagcggtggtggggttgaggggaggtgggggtgctgaatgtgagattgagcggagcaagggaggggaagggttgcagtaatgcgggcatgggaggccgatgcagtttcatgcaaggtcaagatgtgtggtgcaagggggagggtggccgagggcgaaggcctgccctggcctgcatccccacttgtctgcagaaatctcctccaacaccgaaatggagggcccttctccactccctcccaaccacaaggcctcacacaccttcaggaagggcagctcggcccccagcaggctgnnnnnnnnnncgccgccgtcagtgaagcgctgcgggggggcgcccccggcagcgtggactccggctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtaatgcggggatgggaggccggtggactttcatgcaaggtcaagatgtgtggtgcaagggggaggggtggccgaggacggaggcctgcacaggcctgcatccccacttgtctgcagaaacctcctccaacaccgaaatagagggcctttctccactccctcccaaccacaagccctcacacgcctttaggaagggcagctcggcccccagcaggctgtcctctggcgcggcgttgagcaccatggagtaggccggcagggtgaccatgctgacccaggccaggaggaagaaggcgacgacgagggagacccaccagggcaccaccgagccgaagccgaagaggtcgacctcgtcggtgaagaagcagccggagtggccaaactgccaggcgaagaagacggtggtcgagaagacgagggagcagaggaagatcaccatgcggatggcggcggtgagcaggcccgggccgcggaaccagcgccggcgccgccccatcacgttggcccgtccgccgcggcagcgatggcgcaccgccgccaccagactcacgttcacggccagggtcaaggcgccggccaggatgaggtacagcgaccccagccagcctggcgggatgtgcggaaagggcgaggagggatgatgagggatgggggactattgcctgcatcatggggtccaggcacggagaggccgaggctggacgtcgccgctggtgcagggcaacgcctcttgannnnnnnnnngcggccaggatgatgtacagcgaccccagccagcctggcggggtatgcggaaagggcgaggagggatggatgaggaatgggtgtctattgcgtgcatcatggggtccaggcacgaagaggccgaggctgggcatcgccgctggtgcagggcaacgcctcttgatgctgaagagggtggggagtcgggcaagccgacgccaggctcatccacgccacttgaattgtgaacaacccgggcagcctgatgcgctttcggctcagctgctctgacccccgccacgcatgcctaccttcattgaatccatccacgtcgccactccccaccccgctcctccatccccaatccccaatcnnnnnnnnnntgccaggcacatccacgccacttgaattggtaacaacccgggcagcctgatgcgctttcgactcagctgctctgaccccgccacgcatgcctacctcaattgaaaaccatccacgtcgccactcccgaccccgctcctccatccccaatccccaatcccctatccagaccgcaaggacttctcacctatgagccccgagacgaggatgaagactatgacgatgagccacatctcgatgctgatccccaccacgcgcgaggcatccagctccaggcagcgttgggacagggtgacaaagtcaaagggctgcatcacttcgtatgtcttcatgtatgacgctctgagtaccagagggggggatcattccgaggtcatgtgggggacaaccatcgcagcaggcccagtctgcccagtgcaggggccatggtatcggtacccgcacgcgtccccacccctcttgcacacgtgcctgaggagcaaaaagtcctnnnnnnnnnncgtaccagagggggatcattcagaggtcatgtgggggacaaccatcgcagcaggcgccagtcggccccgtgaaggggccatggcatcggtacacggacgcatcgccacccctcctgcacacgtgcctgaggagcaaaaagtcctnnnnnnnnnnggagagcgggaatggagggggcaggacggttgcggcctcaaacccagggcacggagcaaatcaggctggaggctgcacatcgtgtgcaccagagccgacacggatgccacacnnnnnnnnnntgtgcgtgaccatgttcggccagaaggcgtggaagaagcagtagaccacctccaggagccaggacgtgtggcctctgaccactgtgtccctggcgaaagggggaatggagggggcaggaccgtcgcggcctcaaacccagggcacggagcagatcaggctggaggctgcacatcatgtgcaccagagccgacacggatgccacaccacagcgggcaacaaagaaagacccaccctcctcatttcttcaagcgtatgctcacatctggccctcacccccctgcctcttannnnnnnnnncgttccattccgtccctccccaggccatttgaacccccctgccaccgacctgcgcctccattgccgcttcttggactgcatcagctgctgcaaggtctcacccagcgactggcggcgcagccgcggttcgcccggcggtggtgcgcctggtgatgnnnnnnnnnntgttccgtcccgtccctccccaggccattagaaaccccctgccaccgacctgcgcctccattgcnnnnnnnnnntgctcgatggcgatgcactcggtgcagtgcctggcggcgctgtgcccggcgccgtgcccggcgccgtgtcggcgtgccggaacgacgacagcggcgggcccacaggctgcccctcgacgtctgctgccgttcgcaaacccttgtccctgggcgtgccattccccagctgcagcnnnnnnnnnncgctcgatggcgatgcactcggtgcggtgcctggcggcgccgtgcccggtgccgtgcccggcgccgtgtcggcgtgccggaacgacaacagcggcgggcccccaggctgcccctcgacgtctgctgccgtctgtaaaccctcttccctgggcgtgccattccccagctgcagctccagcacgttctcagagccggcctggctggcggagctggaggaggggcgggccgtcgggactccaccaagccccgcctcgccctctgcaggcggttgatcggcgacacgggtgtctgcgacggcatgtggcacccccagccccgccacctccctccggaaggaggccagactctgctggcgacgcagggctgcgctgcgcagcaggtcgcctgtctgccagccgcgccactgccgcagccgccactcggccagcaggagcatgatcacggcgcagacgacgtggaagatggcgatgaggaagatccagaggtggatctgcgtggttttgtcatggggggtacattgggggagggttcggtggacggcgcagggggcagcaagggtgcgtctgggcgccccccattgtggcaaaggctgatgtggatggggtggctgtgcatgtgagggggccttcgatgcatgatttccaccattcgcctccctccctgcctccgctcgcatccatgtgcctgcattcctgtacgnnnnnnnnnnagggggtacgttgggggaggggttcggtggacggcgcagggggcagcaaaggtgcgtctgggcgccccccatcgtggcaaaggctgatgtggatgggtggctgtgcatgtgagggggctttcaatgcatgatttccgccattcgcccccctccatgcctccactcgcatccatgtgcctgcattcctgtacgcacatcgcccctgcggcccagtctgcagaccctcacccccagccccacgtacctggaccagggtggtggctgagatggcagnnnnnnnnnnatatgcagaccctcacccccagcccacgtgcctggaccagggtggtggctgagatggcagggacctggcccgcggggcagttcccggtgaggaagggcccctggcacttaaaggagttgacgttcgggaggatgtgctcgccggtggccgggtcgtcgctgttcacctggtccaggccaaaggtgtcatcttggagcaggcgtcgccgaccgggaggcagcttggacgaagcactggtgaggtggggacgaggacgattcaaatgggggttgtgcgggggggttgcgacaccgatggggggctgccagatggggaaagtcgtgacagggagaataaggcagggcggggtggcgggaggggcggcgaggcggggggatggcggcctcacctgcagnnnnnnnnnntgcggggtggttgcgacaccaatggggggctgccagatgggaaaggtcatgacagggagaaaaaagcagggcggggtggcgggtggagcggtgaggcggggggatggcggcctcacctgcagttccccatgccccatcacctgccgggctgcacgatctcgtctatcagggttcctgagtcatagagctcgcacatctgatgtgtggtgaggttcaggccattggacaggagctccatggtggagtagaatagctcgccgatgaagagctcctcgttgtccgtgtagcgcnnnnnnnnnncatcagggctcctgagtcatagagctcgcacatctgacgtgtggtgaggttcaggccattagacaggagctccatggtggagtagaacagctcgccaatgaagagctcctcgttgtccgtgtagcgcnnnnnnnnnnnnnnnnnnnnnnnnnnnnnnnnnnnnnnnnnnnnnnntggtttggcaggttggctgtcataccaagacagccactccacctgcccgcgaggccgtgcctcgtaagaaggtatggacaggcaggcacttgccggagggacatgccaccctgcccaacgcccagccatccatgtccttccacccaccagggtgggccctcgcggcaggatgcatgcatactccctccctcccccccccccattaacaggtggtgcgcatcgcacaaaccactcaccacgcaggtgctgctgttgatctcctcggtcctggtgatgtagttctccagggcatccgggtttgcacagtcgcagtacggatccgaggacgacgcgttgaagaggcagttgtggtccatctgggaagctcagagattggtttcgttgagtgtgtggagtcaggggtcaatgttgagaatggggaggcagagccgcatggcatcatgacaggtgaacatccggctgcggcgcccatgatggtgtcggcatccaagaaacggagtcagaaaccttccctccatcaaggcctgtgcacctgggcgcagagggagnnnnnnnnnnacgcccatgacggtgccggtatccaagaaacggagtcagacaccttcccgccaccaaggcctgtgcacctgggcgcagagggagaggtgcatggggctcaggcagcaggggcagccgttgacattctccagcagcgtccagcttgccaggccggggctgtaggtgactgtcaggaaagggggattggagacgtgctgctggaggggtgtgggtatggcatatccacgcaccctggttcatgaggactcaccgtgcagggaggtgtccagggtatgcaatggatccatagcctttcccctccacctccatacccctcaccgcatatcttcgtgaggctgccctggaggagggtgagaatgagcgacacaaaccccagaagggtcagctccaggatcagcttacgcagcccggtcttgagaccaggtcggttcttccggtccagcagtctgtcagcatagttgaccagctgtggttggttggggttgggggagcagggatgtgccagggtgagcgcatgatgtggaagggggggacagcacggggagtgtgtcgggatgcacagtcttgctcataccctggcagtcaaaagctccatgctgggaagacttctaccaagatggggcagagaccaaacaccatgcgcactccccggaaccccccccccccccccnnnnnnnnnntgtgagcgcatgatgtggaagggggggaaagctcggggagtctggcgggatgcacagtcttgctcatgccctggcagtcaaaagctccatgctgggaagactcccaccaacacggggctgagaccaaacaccaggcgcactccccgaaaccccccccctctctcccttttcaagttccacgcaagtacacaccaattcaaaagagacagagagaaccaggaagaagnnnnnnnnnntcccttttcaagtcccacgcaagtacataccaactcaaaagagacagagagaaccaggaagaagaggaacaccagggctatggtgaacgtaggggtctgtgcacgaggggtgagggagtgttaggagtgttccttgggggctaggggagtgtgcgcaggccagggggcagcacaccaccaggccgtatgctcaagcacatacacggactggggtttgccgagcagctcacctacctccaacaggctgtcactgaggccctcgatggtgtaggcattgctgccgcccccagtctgcgaggtgggatcgggtgagtggggaagggcggtgtgcctttccgacatgcctgcctcatgctcgtaggggagcgacccacagctaccctccggcaggacgcaggcagagcaaacgataatgctctaggggcatggtcagccgtgcaagaagacgatttcgccccagctcaccatgctgaagccctagcgggcgtctaccgcgtctccttcagctcggcctcatgccaagggcgagcccaggtggcaagctcctcgcgatcagctgcagtcctgagatggagcatcatacttcagatcactcatgtactgtcgcaggtgtgagcggtggcgaccgggaggatggccctcccgggattcgcgcctcggacnnnnnnnnnnggcatcatacctcagatcactcatgtactgccgatgtcgcaggtgtgagcggtggcgaccgcgacgatggccctcccgggattcgcgcctcggacctcagccgtgatcagaccacctggtgcagaatccacccccatccgtcttccctgccgcgcatgcaccggccatgnnnnnnnnnngcagcccacctagtgcagaatccaaccccatctgtcttccctgccgcgcatgcaccggccatgcaacggagtgccagtgtcgaccttcacaaaggattacaggggctggttggtggccaggccaaggcactgcacagtccacaaagcctgggagcacagcctcccactccaccacaggggggccaacctgcaatggctggcgccccctcatgcccgcacgcgccccctcagcgcgctgtccagcccccgtccacggccaggcaggcccccgtgatggcccccgcgtcgtcggtgcagaggtggcgcaccatggcgccaatctcctccgcgcggacaaagcgtttgatgggctggtcaacaagcaggacatcggagatgaccttctccacggggatgccccgcgtcgcggcctggttggccagctgcttctcgatcagctccgtcatgacgtacccggggcagaccgcgttgaccgtgacgccggaggtggccacctccagggccagggtcttggtgaaccccgccacgccgtgcttggcggcgttgtacgcactcttgaaggggctggccaccgtggcgtgcatggagcctgggtgggtggtgggtgggtggtgtggatattttgtaacaagggaggtgtctgagtcggcgggttggtgtagtcttctgatgcaggtgggggcctggacaggggagcatcagcccacaaacactttcaccccaaactgccccccccccccaacacacacacacacacacgaatacaacatccaagctgccccacgccggcacatgattggaacataccggtgttaacaatgcggccccagccctgctccagcatggccggcagcgcagccttggaggcgtggaagggggcgttcatgaccacctggacgatggcgtcccacttgtcctcgggaaagtcctggaccgaggacacgaactggatgccggcgttgtttaccaggatgtccagcttgccgtggcggtcctgcacctgcccgaccatgcgcctgcagaatgccgcgacggggtagggcaggggccggtcagaccaggggacccagttccggggcgccgcgcgacccacaccgggccacgcacctgatctcggctgcatccattaggtttgccgtttggtaggtgaccgagttcccggtctcctctgccagcgcatcggccttggccctcagctcagcttccgggagcaggccatgcatgatggtcgtcgcccccgcggccgatagcgtcttgatgatgccatagccaattccggtcgtagaacctgcacatttccagagggatgaacattgtctcagatcgtggaggggaagaggtgtcaggtacggggcgcggtgatcaagcggtgccagctctcacccgtaacgagagcgaccctgcccttcagcagggtggccagggacatggctgcacctcacactacaaaggttctaaaaactctgagcattcggttgtggctctgctgggtgggttgggactcggtgctagggtgaggtgctatttccattgcaaatgccgggaccaatagttttgctttgctgacggtgttgaaagatgcaaggtaccgccaattctcctgcggtacccaagatccatcgtattcggtcgnnnnnnnnnnattttgctttgctgacggtgttacaagatgcaaggtaccgccgattctcccagcggtacccaagatccatcgtattcggtcgctccaccttcctgtagcgccgatcggttattcgaacaccgacgcatgacggttaagcagccatcaagcgatataatgacccccaggcgcccttgattatacaggatggagagcgcaaagaaagtttccgtactccaccgagccccatagccagcgctgacaggggcggtacggatcgacgtgaagccgcatgggctggctcgttccccctccagagctcgagtcctgccctagacatgcattagaggtgtgcatattccgtggcggaacagtgcgctgcctcgcatccccgttgcgccttcccccggaccgcaggttcacctgccccgccaccgccacccccttccccgcagcgcttcgcacgagcctacatcgccgacttcaactcacagccagacctcgcccgctgtgtgggctgcgatccgggtgacatccgggacgtcactgcaaaactcctttgcaaatatttcgcggatggcagacggactccccggagtccacggcttcgccttcagttcacccacgactgcctgtaggttcgggtggccccatcctccccccaaaggccgtgcagtactttcgcgacccataaattcccctccatcacccccacaggtaccattcctgctccgatccggcctgcgagctttgccggcagagccagtacaggcggtgcaaccggacctttgccaggaagtatctgtcgggggatgtgctgaaggccacctgcaacgccaacatcaagtgggtttgtggggggatgggcaggagggaggttgtcctcgtcatggtgtcacacttgccccagagccaggtcgacctgcgaagcaggcgggcgagcatggcacctggggctgcgagatcagcccgtgagatcctccctgtgcccctctcgaccaaacagggtccaggtcatcgatgaggagaccgagcgtccggtgcatgatgtcagcctgctggccgggctggagctgnnnnnnnnnncggagtgtgtcctcgtcatggtttcacacttgccccagagccgaggtcgacctgcgaagcaggcgtgcgagcatggcacctggggctgcgagatcagcccttgagatcctccctgtgcccctcccgaccaaacagggtccaggtcattgatgaggagaccgagcgtccggtgcacgatgtcagcctgctggccgggctggagctgcaggtaaggggcccctgcccagggagtgtgcaccttggaccacccaagcgttaccagcacgcccctccctgtcaccccaccctggcctgcctcccctttgctgcnnnnnnnnnngcccaagcggtaccagcatgcccctccctgtcgccccaccctggcctgcctcccctttgctgcagttcttcgtcctggatggcaaggttgctgagctgcagggcagccttgagtccggcaccgatctggagtcctacatgctgctcttcaaccaccaggtgcctgtgcgctgctgcggcgcctgcgctgcaccagtcaggctgcttggccatgcaaaatcgttgccatcaacagggcgacacatgttccccaagcgaccccctcccaccccacaaaaattacacccaccatcactcccctgcagaatctcccgctcctcatggcgaggcagctgggcgccggctcggatggctttgtgcggctgcccctcagctcagcctccctggcgctgcctgacctggcggtgaccgggtcttcagaggccctgctcaaagggcagaagccgccgcttatcctagcagcccgggcggtggacgctgcggggaagatcgcggagcacattctccctgtcttctcggagggatttgtggtgcgttgtgtggagggtccaatccgggtggggggacctgaggcttctcgatgaagcgtctgggggagggcggagctgggatcacgtagcggggtggcccggctgcagactggcccgctgggggagagggtttggaggaggggcccctggccatgtcactgcannnnnnnnnncgtggcccggctgcagactggcccgggggggaagagggttgggaggaggggcccctggccatgtcactgcactcctcatgcacagcctgcactgctggtggactctcacaccatgacctgagctgagccctctgaaatgacgcctccctgcacccacaccacgatcaaccgcaggtggcaacccctcgggtgcggaccgccgccaagaacgacattccacattgcgaggacaatgtctgcaagatcaatgcgggtgaggagtctggaagggtgttgacaagctgtgcagcgtcgcaggacagcctgcctggtggggtgatgctggtgcagtgcgcaatccaggctcggcccagcacttgggcgtggcaggcgcgcgctcccagactgctgtnnnnnnnnnnatggacaagctgtgcagcatcgcaggacagcctgcctggttgggtgatgctggtgcagtgcgcagtccaggctcagccagcacttggacgtggcaggcgcgcgctcccagactgctgtcatggcattcttggctcagccactattccaccatttgccctgtgccgacccgccacaccagccttgcaatacccgcagtggggaatgcgacgcagaccaagctnnnnnnnnnnggccactgttccaccatttgccctgtgccgacccgcaacaccagctttgcaatgctcgcagtggggaatgcgacgcagaccaagctgaaggacctggcccgggctgccgcagatgcggggatcggcagctttgcgttccctttccacagcgtgaacaagggtgtggcggggtgtgggtnnnnnnnnnnnnnnnnnnnnnnnnnnnnnnnnnnnnnnnnnnnnnnnnnnnnnnnnnnnnnngtggagggagcctgagtgtgctcccctggacagccaatctcgattcttgtgttctctcatccctccagtccgggagctccaggctctcatggtgtgggcggaggagagcttggagcgctgtgacgccaccaagaagatcctgaagctgacaaaaggctgggaggaggctcgggagcatgtgttcaaggtgaaggctccgagtttgcggccgggagggcattgggatgtatttggccttggactgtagaaggcgccgggtccttgccaggatccggggtcacactgtgtctgnnnnnnnnnncatcgggcggctgttggggtgtctgtgtggcacgtagctgtggaggagggggtatggtgtcnnnnnnnnnncgccagcctggcaccttatcgacatcaaatccaccctgaaatgcacgatgcaccctcgctcacctgtcatgccgcaggnnnnnnnnnntgagtttgcggctgggagggcattgggatgtatgtggccttggactgtagtaggcgccgggtctttgccaggatccggggtcacactgtgtctgtgtgtggccagcgaacatccgggccctgccctcggccagcatttgacatggtacactgccaccagcctggcacttcatcgacatcaaatccaccctgaaatgcacgctgcaccctcgctcacctgtcatgccgcaggccgtggagagcgacacccggctgcggctttggagcagcctgccctcgggcagcctggtgggcctcctcttccctaccagcggcgccacgcccctgctggacagccccctgggtgagtcgatcgggcggctgtgggggtgtttgtgtggaacgtagctgtggaggagggggtatggtgtcatggttgctggactgatgtctttgcccaagccccccttgtccctgcccatgtaaaccactgcgtaatctccctcatactcccgggaccctgcaccgcagccctggtggaggagggccacgagcgcgaggaggcaggacccgtggtccgagccgtcatgctgggcaagggggagggcgaggtgtcgctcggcgcggtgcgggagctgctggcggaggcgcaggtgggacgtgttgggaagagggggttggttgcaggggatgtgttccgccgcaagccctcgtgcactgcgcgtggatcgaggaagggctccaggctgcggggctgcggcggggtgcaggacccccaggcagaaacacgcccgcatcagggcagccggccctccacccgcctcgcccgccccgttcctgaaccaggcctcctggtctcggcgcggccaccccggctggtccatgctgcccatggacagcgagagcttctccgcctcctgctcccgccacatctccatcgtcctcccgctgagcctgctggagggcgcggtgccgggcatcggcctgcccatgcccggcctgggcatgggggacgcgctgggcccggggccagaccccggcggcgccgccacggggctgagcatgtcgcagcgcctgtggcagctggacagcctgggcacgctccgctccgaggtgctgggcgcgcccccgcacgaccccggcgcggtgaccttccccggcatggcgcccccggcctacttccccgacccctttggcgcggcggcggccgccgccgccgcc

SEQ ID NO: 37260 - DNA, 1061 bp, Chlorella protothecoides
  modified_base (246)..(255): a, c, t, g, unknown or other
cggaggccgcttcgagggcggccggggcgggcgcggggctgcgccgcgccccgcccaccagggcgcctccatcaatgtggaggacactgccgccttcccatccctggcctgaagctggccgtgcgtgtgccgacccccggcttgcatgcccgcagcccggtgccgtcacctccccccccgcaggcaggcatggcgagtgtgctctggtgacacgtgtgtgtgcctgcgagcctcacagcgatgaannnnnnnnnnctgcgtgtgtcggaccctggcttgcatgccagcagcccggtgccgtcccctcccccccccggcaggcaggcatggcgagtgtgccctggtgacacgtgtgtgcctgcgagcctcacagcgatgaaagagcgttttcgagggagggcaggaaagggcagtgcaggggcagggctcagggggtgatcagcggctctgagggcgagcgggttgcgccacccgtgggaggcacggtcaggcgcttgctgatgccggcagcaccagtccgatcgtaggccagattgtacctgttgatcatctccgcggctgcgtgcggaggcgggggagggggtcatggttgaggcggcagcagtgtggtttggtttggaatggagggccacagcggggatctccgctcgatcctgagagcggaagcagacgctgtcccgcgtgcgtgccagcccgcccgagatccccaggccccatccaactcccgacgtgcctgctccggagcccttggtcaccgcggcagctagcaccatcatgagcacatcggcctcgcctgaaacttcctggcgcagggccgccaggtcgcccaaggctgggagccctgaagccagcgcggccgccccccgggcgacgtcggcatcgaagggcacctcccccgccgccatgcgctgcatcacgctgtgcacgctgcggacccgctccatcagcatgtccagcgcgctcagcgtgccgctcagctgcgcgctcactgcgagacagggtttcggtggtggtgtgggggtgagtggctaggggagggcagcgtacgggtgggcgggggg

SEQ ID NO: 37261 - DNA, 649 bp, Chlorella protothecoides
  modified_base (292)..(301): a, c, t, g, unknown or other
gaccctcaatcagccccctctcgaaccccaatcagcccccccttggaccccccctcccccccgctctcacccacctgcagcacgggcttgttcttggccagcgtctgcttgcccaggaacgaggccaggttgcgcagcagcgtgcgctcgctggtgcggatgacggcgtgcgagtccaggatcacgcgcacatacttgatggaggagcggacgaaagccgcggccagcgcacggtcgccccagccatccaccaccgccacatacacgtcctgctggttggcctcctgcgccnnnnnnnnnnggccgcggccagcgcgcggtcgccccagccgtccaccaccgccacgtacacgtcctgctggttggcctcctgcgccgcgcgctggacggtggtgtaggtgacgaaccaggggtagaggtcgggcgtgacgatgcgccgcagctccaccagcttcccgtccaggttggcgcgcgtgaggttgttgaagatgaaccccacgcggtccgccagcgccgggtcgggcacggggtagtccacgtcacgcgccaccgccgcctccagagcgtcggcgttgatggccgcgaacagcgcgcccgggtcggcgggcgtggacggcgtggccgcggcctgggcggcgcccgccggccg

SEQ ID NO: 37262 - DNA, 120 bp, Chlorella protothecoides
gctcatccggaatgttcacacgggcctgtgcagggaaggtgcgagggtattcttggacacaagatgcagtgctgggctcggccttgcaagacctggcgccgccggtacccagggctggcc

SEQ ID NO: 37263 - DNA, 126 bp, Chlorella protothecoides
acaggtcggccagcagggcgtcgcgggtgcccgagtccaggtgcgtgcggctggggtggttcggggggagaagggtggcgtgagccgaggcgcggtgggcctcacggcagcgtcagaggttgcagg

SEQ ID NO: 37264 - DNA, 61 bp, Chlorella protothecoides
ggttgtagggtttcgagagtgcaccgagaaaccctaccaaaccctatccgcgcggtattca

SEQ ID NO: 37265 - DNA, 80 bp, Chlorella protothecoides
gagggctgactggggcaagcggatcgtgtgcaaaagtgtgcagcatttaaagtacatcagatgtagtccctggtaatagt

SEQ ID NO: 37266 - DNA, 92 bp, Chlorella protothecoides
cccatcggcggccaccgagccataaatcgggcgaagcccatacctcacagtgtcccacgcgcacactctttgccgccatcccaaccatctgt

SEQ ID NO: 37267 - DNA, 61 bp, Chlorella protothecoides
ctgtgtcatgcacagtgatctatcccccccccccccctgcacaccgccatcctttcacctg

SEQ ID NO: 37268 - DNA, 61 bp, Chlorella protothecoides
cccgcgccgactcctgcccagcctacccccccgcccactcctgcccagcccacccccgcgc

SEQ ID NO: 37269 - DNA, 75 bp, Chlorella protothecoides
cgagctttcagccacatgtattaattccaattccaattcgtccttatttgcacagatttatgacacagagaccgt

SEQ ID NO: 37270 - DNA, 61 bp, Chlorella protothecoides
ctctgagggcagctccaggaatgtcatttcgacggtgcatgcgacctcttgatagtacgcc

SEQ ID NO: 37271 - DNA, 69 bp, Chlorella protothecoides
taggagcaaggggccacggccggcgctggctcggtccaattctgcagctgtgctggtagacagcaatct

SEQ ID NO: 37272 - DNA, 66 bp, Chlorella protothecoides
cgacctctcagatgatgtgcgcgtagcgcagataaactctccagactggagaatgcccaacggggg

SEQ ID NO: 37273 - DNA, 113 bp, Chlorella protothecoides
tgcgcccggctggcgacagccccactggcctcacactcctccccagcgcgaccagcgggcccccctccgacgcgccccgaccccaccaacctctgccttgatgatcttgcgcg

SEQ ID NO: 37274 - DNA, 79 bp, Chlorella protothecoides
caggaggggtggcggtggctcacaaggagctttacttcaacgctcctcgtcacctgttgcagcgggtgctctgcggggc

SEQ ID NO: 37275 - DNA, 82 bp, Chlorella protothecoides
ctacgagccacacaagaagatcgccatggaaatggcggtgtgatctgattttggtgagcgtaccgtgaaagtgcgcctgcct

SEQ ID NO: 37276 - DNA, 61 bp, Chlorella protothecoides
ctgtgtgatgagggggcccatggccgagtccactgagttggaggttccagcaggttccagg

SEQ ID NO: 37277 - DNA, 77 bp, Chlorella protothecoides
cgtcctcgtcgcgcctaccagacctgatgtagttttttttttggggggggaggggggtgatcaggcaagggcttggg

SEQ ID NO: 37278 - DNA, 73 bp, Chlorella protothecoides
cagtcgaagtgatctgggggcaatggcatgataacacgttgtcctgcaaacctctggtgaacatccacacaaa

SEQ ID NO: 37279 - DNA, 75 bp, Chlorella protothecoides
agagccaagacgcccacgcaggttgaaaggtcaaagcgcggcgccaacgctgcgccagcagattcgtcgacaccc

SEQ ID NO: 37280 - DNA, 61 bp, Chlorella protothecoides
gttggtgtcgagaagtgctggtggggcggaatgggagggtgttttcttcatggatatgcct

SEQ ID NO: 37281 - DNA, 104 bp, Chlorella protothecoides
ccctccctggtggtggtgggtcctacagcagtgcgtgggcagccttggcggcccactctccatccaactccctcccccaccaatcccccagatgccggtggtcg

SEQ ID NO: 37282 - DNA, 151 bp, Chlorella protothecoides
gaacatgggaggctcatttgtgtattcaaatctgcgctgtgtggcgcctgtcacagcccaactaaacccttgtcctcccaagcagggggcgacctcccggagggcagcacaatgcctggtctcctggctgggattggccgtggcgggtgac

SEQ ID NO: 37283 - DNA, 61 bp, Chlorella protothecoides
gtttcttggggtgtttctttggggtgtttgaatgagtgctgcagactgtccacctgttgtg

SEQ ID NO: 37284 - DNA, 61 bp, Chlorella protothecoides
gtacagctgacgcgcaaccctgctgaaagcggacatgacacccctccgaccgccaggccgc

SEQ ID NO: 37285 - DNA, 61 bp, Chlorella protothecoides
tcagttccgttgccagcagctcatcggcggggttgatctcacaggccacgcgccccttgag

SEQ ID NO: 37286 - DNA, 79 bp, Chlorella protothecoides
gagtcctcccttggtcctcctcgtctcgaacccccgccgctcagattcgcccccccgaaccccccgacaggtgttctgc

SEQ ID NO: 37287 - DNA, 63 bp, Chlorella protothecoides
tggggggggtgcaggcagggcagggaggggtgcgatgcctaggcagcaagctgttctggctgg

SEQ ID NO: 37288 - DNA, 104 bp, Chlorella protothecoides
gtgacatccatgagccacaccgcagccgcagagaggcatgcagtgggggacgcattccttctgttctcttcatgggcatccttgctgagacccccactcttttg

SEQ ID NO: 37289 - DNA, 75 bp, Chlorella protothecoides
agaacagaggggaaaggaaaaggcgcgactacaggtatggatgcgtttctgtgaagcctaagcaagggacgggca

SEQ ID NO: 37290 - DNA, 123 bp, Chlorella protothecoides
ccgcagggcccaacacccggaccagcgaggcggccatgggctggcgcgtcagggtcgccgccagggacctaggcgtggcctgtgcatgcgtgggggaaggaggaagaacatggggtacagcag

SEQ ID NO: 37291 - DNA, 63 bp, Chlorella protothecoides
ccacgagggtcaatctgattagtattattatcgcagtgggcaggggcacgacccctggggtgg

SEQ ID NO: 37292 - DNA, 61 bp, Chlorella protothecoides
gtcgctggcgttctccgggggctcgcgcacgtgctggggcacggcacgtttcaccctcatc

SEQ ID NO: 37293 - DNA, 61 bp, Chlorella protothecoides
agcaacagcctgtgggcgggagatatggccttaacacagcctggccctccaagcattgatg

SEQ ID NO: 37294 - DNA, 104 bp, Chlorella protothecoides
accccctgcacctctcacccctgtcccgtcattggcgtggctctccaccagcagccctgccccacgcctcgtcaaagacacctccccctacaccccaataaaag

SEQ ID NO: 37295 - DNA, 194 bp, Chlorella protothecoides
ccctcgtaaactgcaggtgggagggcagggtctggagggtatgaatcgcctgagaaaagcagccagtgatggcatgggtgcaggctttcacgccaccccctctttgtaggtgggcgacgaatcacagcgccacagtcaccctgccgtctatgacagccccccccattactcacctcaaagccgcctatgcttgt

SEQ ID NO: 37296 - DNA, 127 bp, Chlorella protothecoides
tggcgtctgcttgctcgtcgcgggcggcgccgccctccaccccatccttctggaccgccccgccacctaaaacctcgtcgtcgaggagcggcgcgctggatggcagccctgccgcggcctcgtacgc

SEQ ID NO: 37297 - DNA, 3271 bp, Chlorella protothecoides
  modified_base (112)..(121): a, c, t, g, unknown or other
  modified_base (696)..(705): a, c, t, g, unknown or other
  modified_base (2173)..(2182): a, c, t, g, unknown or other
  modified_base (2281)..(2290): a, c, t, g, unknown or other
  modified_base (2371)..(2380): a, c, t, g, unknown or other
  modified_base (2806)..(2815): a, c, t, g, unknown or other
  modified_base (2974)..(2983): a, c, t, g, unknown or other
  modified_base (3058)..(3067): a, c, t, g, unknown or other
ggccgcagcgctggcctggctgccggagccagcacgcctgcacctcaggtagaggatgtcggggatgggggggggtggttggagaaagaggagggggagctgagggtatgcnnnnnnnnnnacctggcgctgtgcagcgcgctgggagaggtgccgcgctgcctggccgcagcgctggcctggctgccggagcccgcacgcccgcacctcaggtagaggatgttggggatgggggggttggttggagaaagagaaagaggagggggagctgagggtatgcctcgtcgtcgcgcaggcatggttctcaggggccaccccgtgtcgaccggccaggcaccttgatctgttgccctctcatgcccctgcatcccccgaatccaccactcgtaacacaacccgagcctctctaggtccgcgctggaccagctggcggccgtgtccctggagctggtgctgcccacgctgagcgcgctgagcgaccacctggaggagggcgtgctggcgctgcacgcgcacggcgcatggcgcgccgaggcggccgatgtggtggagacatcggagcccatgcggcgcctgctgcagcgcgtcgcacacgccaggtgggtcctggctggatgtttccggaaggggaggagtgctgtaggggttttggggggaggcccggagaggggtgcctgtggatgcttccacctggcnnnnnnnnnntggaaggggaggagtgctgtaggggtttggggggagggccggggaggggtgcctgtggatgcttccacctggcgcccagccaaaggtgggcagcaggctgcctgggtgtacgtcccgcatggcaacggcgctgggccccatgcagagcatggaaacacccccaagcaagctcacccatgcacgccgccgcgcaggcaggagtacctgtcgcgcttcccggcgtccacgctgctgccgcccgccgcctccgcggcaagcaacccccagggatccgccccggcacccaccgtcccgcgcgcgctggcacagcgcctggccgcccgcctgctcaccgtgtatgtgcgccacgcgtccctgctgcgcccggtgagccacgcgggggcgctgcagctggccaaggacgcgggggagctggaggcggcggccgcgcagcagctggcgcccctggacgccctgcaggcgccggtcggccgcctccgcgccttccgaagggccctgttcatggacgcggcggcgctgggcgcgggtgcggcggcggcggcggctggcggtgggaaaggtgtcgcaggaggcaaggccgcggggccccaggccggggagctgccgccctcggtcgtcctgcacctcctgttctccagggcgccggccgccgtcgcctcgccccacgcacgccagggcctcactcctgcccaggcgaggaaaacggaatggtggatgagcgtgtcgcacagggcgcgcaagactggagtttggaggctgcttctatccacagagcttctccttccatgtgacaaactggccggcgtggccatccaggcaggctcccactccatcaccgtctctgaatgccatttctttcccccaaacaactctgcagtattccctgtggctggacgaccactcggaggcggaggcgctggcgttcatcgccgcggccgtgatggccggcgaggcggcgctgaagcagcgggggcagggcgaggatgccacgctcgcggccatgcgcatggtgctgcaagcgcacgcgccgccgacaggggcctgaggagggcagccgggatgactgattgctccagttgttaggtaatccgacccccggctttggtctggaagtgtggctgtcgcttacatggaaggcgtcatgcacttgacaagtttgtgtatgtgtctttgggaggatcaaagtgtccatagacagagggtggaggttctcagagatcgagcgtcgtggaacctgcaggaatcataccacatgaaaattattgccaggtatggcacagtgccttgatggcaaggcgcccttattggaagagggatagggtggggtgggaactaacccaacatcaggtaatgtaagtcaacgcgttcagacgtttcgtggtttgaatcggagagcaggagaggtgtatagttgtgtggtcagtgagccgtcgatcaatggctacctcctgtcgaagtcctacacccnnnnnnnnnncacgtttcctggtttgaatcggagaggaggagaggtgcatggttgtgtggtcagtgagccgtcgatcgatggctacctcctgtcgaagtcctacacccnnnnnnnnnntggccgtcccgtgccagcctgtcgagggcagagaagcgtgcggccagggcaggggcgcccaggctcgcactgctacccttnnnnnnnnnncgagggccagatactccctcaagcactgctgcagcacgtggaaggaatcatacacttccgccaggcacaaccccatgtcattcgtgcggccttcccgcgccagcctgtcgagggcagagaagcatgcggccagggtaggggcgcccaggctcgcactgctacccttcatttggtgggccagggctgcagccgcctccccatcgtgggacatgactgcctcctgcaggctcatgagcttcttgcggctgtcattcaggaacagatcgataatgccccgcacgaaaccagggtcgctggggtcctgcatggggccgctcgatcggaatgttgacttgggcatgtccggcatggtcaggggagcatgtcataacaatattcttgaagcacaaagacttaagtcccacctgcagggagagcaattcgcgnnnnnnnnnngatgccccgcacgaaaccagggtcgctgggatcctgcatggggacgctcgatcggaatgttgacttgggcaatgtccggcatggtcaggagagcatgtcgtaacaatattcttgaagcacaaggactcaagtcccacctgcagggagagcaattcgcgnnnnnnnnnntaaactggcgcatgaaactgggtaggaaaattgcctcggttctgcactgaacgatgttgggagatcgtgcttatnnnnnnnnnngaactggtcgttcaggatgccggcggtaatggcccgtgtgaggaattcttcgaggccctcagtcatgcaggcgcaacgcagcgtgcagtgattagggcaaactggcgcatgaagctgggtaggaaaattgcctcgggtctacactgaacgatgttgggagatcgtgcttataaggaagggacggcacgtgctgccataatccac

SEQ ID NO: 37298 - DNA, 197 bp, Chlorella protothecoides
agtgatgggctggtgcgtgacatgaggatgtaccctgaagtcagcaacccactccatgctgatcttggtccagagcaccctcgggagggtcgcagctgaccgatcagagtcccgccacgcgcccatgtcctgcccgctcgcaacctcaccttccgccgcctcccgtgcggtctgggatcgcacgcgcaccacccgct

SEQ ID NO: 37299 - DNA, 132 bp, Chlorella protothecoides
cgggatgagcctgctggtgaggctcctctggagcaccagcgcctgcaccgccaacacatctgtgcccctgccaggagtaaaggggtgcagagggtgagctgcaggctgggtccatcactgatttagatgcgc

SEQ ID NO: 37300 - DNA, 73 bp, Chlorella protothecoides
caatgcacccgcacgcaccggcgcgagggcggggtccagccccagctctcggaatgcgggttcggcagcatcg

SEQ ID NO: 37301 - DNA, 61 bp, Chlorella protothecoides
aggatgggctggcatggcgtggcgctggagagcgcaggtcgtgctcgtttcaatcgcactt

SEQ ID NO: 37302 - DNA, 71 bp, Chlorella protothecoides
cccccccccccccccccccccccccgctgctcccctgcagaccccgccacgacgccatgctccagcctgcc

SEQ ID NO: 37303 - DNA, 79 bp, Chlorella protothecoides
cactcccgcctgctctatcagcaagcgtgcgaagtgacccctccctgcccgcagcccatttgccgcccacccgcactga

SEQ ID NO: 37304 - DNA, 117 bp, Chlorella protothecoides
gtcgccttgggcgcctgtgacccctgcgaaatgtggccagagcgtgtaggactggcggatggcgcctatcagggctcgatagagcctgtagcaatgttctacacgcttccaactcac

SEQ ID NO: 37305 - DNA, 115 bp, Chlorella protothecoides
gcttttccaaaatgaaatgaagagatgatgatggattggccccttcctgcccatgcctgatgctgcattggagaccttcagagttggttgcctacttcagcaaagcatgtgaagc

SEQ ID NO: 37306 - DNA, 75 bp, Chlorella protothecoides
ggctggggtcgtgtaggttccctggtaatggctcccgtgcctccgtcgtcgctgcgagattcctgttggtggtcg

SEQ ID NO: 37307 - DNA, 61 bp, Chlorella protothecoides
agggacaccgggcgctcgttttgacggacttggtgccagagggtggactttgaacggcttg

SEQ ID NO: 37308 - DNA, 61 bp, Chlorella protothecoides
agcacccggcaggatctccagcttctctgcacccccctggcacccacaggcactcgaagtg

SEQ ID NO: 37309 - DNA, 147 bp, Chlorella protothecoides
ggttgctgggcgtcggtagagcgagcgtagtgtgtgtggggctgtcctgggattcgctgatcagcgctgtatgcctggccgcatcctccaggtcgacactcttcctgggcgggaccctcccccgcacatccctcccgcctcaaacac

SEQ ID NO: 37310 - DNA, 76 bp, Chlorella protothecoides
gggatgaagaagccacttgcacgggctgtcacaatgatacattgtgtaacgtggctgataaatggtgacgatggct

SEQ ID NO: 37311 - DNA, 61 bp, Chlorella protothecoides
tgtggcattggcatgttttgcaccggcaggggaatggtatgctgagggggggtcacgaagg

SEQ ID NO: 37312 - DNA, 61 bp, Chlorella protothecoides
caggaccaggtcgacggccctggcggggggtggcggaaggaggtgggatgcaggatggggc

SEQ ID NO: 37313 - DNA, 3325 bp, Chlorella protothecoides
  modified_base (1812)..(1821): a, c, t, g, unknown or other
  modified_base (2437)..(2446): a, c, t, g, unknown or other
cgtcgggggaggccatggctcccgcaccggacacgccggccccggcctcgtcgtagggcatgaccgccagcgcggagagcacgacgttggcagccagcgcggcggcgtcctcgggcgccgccaggcgcccgtgcgcgcgcgagaaggcggccaggcgcgcccaggccgcagcgttgtacagtcgcgcgccggagcgggtgaagatctgggtcaggcgcgcgtagtaggtggccatgcgcgcggcgcgggggcgggccgcgcccttgggtgccagcgccagcaggccctggatgtcctccacgctgcggaaggcctcggcccacagctccagctcgcaggcggcgcgcagctgctcgaaacgcatgtccatgtacagctcccaggaagtggaattggacaggtcggtgcggtgctgctggccctggtcgcggtacctgggttgttagggggtggggtgtgtgtgtgtgtttgtgggtgtgccggtacatgggggaggttggtatcaggcaggcgctggcacacaacatcaggccccggcggggcacgctctgcgccccattcccaacgcttacgttccccaaactcttcccccaccccccacccccaagcacccccactctgtctcacttgagcaggttggacaggtggttgcgcaggatgtcgcacaggcgccggaactcggtggagcgcttgtgtgccaggcagaaggcaaaggcgcggtccgcgcccgaggcgtagagcgcctccagccgcgagttgttgcgcagcacgtccagcacgttgcggtaggtctcccacaggaacttgaaccagggcgtgaccagttcgcggtccgtgcggtccgccgacttctcgcccgacacgtagctcagcatcatctcctcgggcgaggcatccgcctccaggtcggcaatgtcctccagcttggcctgggaatgggggggaggggtaggtgcctttatggaaagggttgctgaattgagacatgcattggaacggcaggagcaacagcttggagcaggggaggccaggaccttgcactcggcattgcagtcccccgcttccacacatcgaccccaccgctacccccctgccccccaccccaccccacacaggccctcacctgtgcggcctgctgtgcctgttcagcccgggcgctggcggtggtgatgaggtggtcgatgaccagctccagggaccccacgttcatgccctgcaccgtgttgcggtagttgatcagcgcatccttgcacttgcgccccgacttggtctccacgcacaggtcgatgtgcttgagcatgacctgatgatggggaggggttgaaggaggggggcggtggtgagaccttggaaggcatccccagaatgaacaccaaagctgggagttccaacatcggcggggtgcattagacgacggagtctcaacataatatcccagcccttcatgagatgctgaaaagccagccacacagagggcttcccacatcagaagaccggtggcccgacccggagccacccttctcgggccacacctgctccagcgccgtgttccagttgcgctggtggcgcttattggtgagcgtatcatgcagagtttggagggcattctgcttctggccgacctgcggggattgggaatgacgacggggggggaggggcacgctcatcaccggttgcgacgcgagtccagggcgctccgaggggcaatccaatgcccgcccatacgtcctgcatccccaaaacaggccattccattgcctctgagcgatcatcccgctccatgggcctcgactcaccccgatcagttcctcnnnnnnnnnncaaacaggccattccattgcctctgggcaatcatcccgctccctgggcctcgactcaccccgatcagttcctcagcacgcttcagactattctcaggtttcagggagaccccgcccccaccgcggaagcggttcgccatcctgcctgatgctgcctccggactggggagagggtgcgtgtgtttctgtccaggggcgagggtgcggggggccccaagtgcctgcctggattgaggcggcctcagttttggcgggttggagcgcgcatttcgattccgcgacaccctctcatgcaggaccagcagtggcaccgggatgtggccgggcacagacgcgacatcgcgcttggaaatcggagcaatgtaccattgtataggtttggcgcccatctagtttcacaagtgcgcttgaagacgacttgtggaccccttttcagagaacccttgttggctttccaccgatttctactggtggcaaaggtcttgcacaccaccatgctcgggggacaaaactataaaatgctctgatggcggggcatgacgtatctgcccttccttgaccatcctgggagcccacgcacttgggggacaatgcaggccaaacgctccgcagggagnnnnnnnnnnagtacctgcccttccctgaccatcctgggagcccacccacttgggtgacaatgcaggccaaacgctccgcagggagctcgctggtgaaacttcctcatgcaacctttctagcctaggctagtgaccaggctcaggcttcgtcccggcctccatctccggaatggcgacgcccgtcccctcgcagccgccgcgcccgcagcagctgccgcagccccatccgccggcgccacccccccagcgctgccccgcccccactcccctggtggacgccctgcatgcgcggggccagctgcgacacgagcttgccctccacatccccggccacaaggtgtgctttggtttgtgtaggagggggattgcagcgcatgcagggcggtggagaggggagcgatgtgttgggcagaggtcccctgcctcgcgccggacaggccgacacggcgaggctggcctgggccggccagcgcctatcgttcccactgccaccctccttccaggcctctcccccgcagcaccaccccaatcctccgctttcaaacctcatgcagcgcgggcggggcaccccgccggccctccggcgcctggtccctgcctcggcgctcgcgtttgacgtgaccgagctggccggcctggatgtgctttcctgcgcctccggccccatcgcggaagctcaaaggctggcagcggcgctgtggcgtgccgacgccacgcgcttcctggtctccggcagcaccggcggcgtgctggcggcggtgctgggcacctgcgccgccggggacacgctgctgctggcccgcaacgcgcaccagagcgcgctggcgggcgcggcgctggcgggggccacccccgcctggctcgcgccgagcctggacgcggcgctgg

SEQ ID NO: 37314 - DNA, 68 bp, Chlorella protothecoides
attgcccgttcgcccggaatcgcgttgaccgtatcttctattccagctcgccttgcggcgaccaagga

SEQ ID NO: 37315 - DNA, 90 bp, Chlorella protothecoides
cctcacctcctccggcatggtggcagggtccctagcggccctgaatgccagcgggcgctttgtggagatcagcaagcgcgacatctggag

SEQ ID NO: 37316 - DNA, 69 bp, Chlorella protothecoides
cgaacctgcgtattccgaggaaaccgaggcaaggtttcgggagaactcacattttcgactttcgactcc

SEQ ID NO: 37317 - DNA, 61 bp, Chlorella protothecoides
ccgggggcaggagttgagcacctgttacaatggggagaagggagcgctcaggggtgctgga

SEQ ID NO: 37318 - DNA, 61 bp, Chlorella protothecoides
cccgcctggccctgatggcctggagttccttgcgcagggccaactccctggccctgatggc

SEQ ID NO: 37319 - DNA, 71 bp, Chlorella protothecoides
agatccctctgccctccaacgacctgcctcaccgcatgatggcctccctgttttcaaacccaaccatcttt

SEQ ID NO: 37320 - DNA, 61 bp, Chlorella protothecoides
ttacgtaattgaggcacggcatatgatcggtcgaatgccgtatgcggtccctcgtacgccg

SEQ ID NO: 37321 - DNA, 61 bp, Chlorella protothecoides
tccaagaaacccgtgctgaagccccttctggcaacgcctcaccgcagtagacatggtcgca

SEQ ID NO: 37322 - DNA, 69 bp, Chlorella protothecoides
tatgctgtccaggaggctactgctggacctagtcatggtgctcacgcccagctagggacccctcgtcct

SEQ ID NO: 37323 - DNA, 61 bp, Chlorella protothecoides
agcagtagcgcatcccggcggcgcacaccacctgcgcgcccacccaggccgggcaggtcgg

SEQ ID NO: 37324 - DNA, 69 bp, Chlorella protothecoides
agatgctctgcgctaaatgtaacccacgttgctcatcaccaggctcgccctccatgcccgctccccagc

SEQ ID NO: 37325 - DNA, 61 bp, Chlorella protothecoides
cacacggggatggcctcgcttcaaataccagttacaggtgggggttctaatcacatcatga

SEQ ID NO: 37326 - DNA, 61 bp, Chlorella protothecoides
ggggcgaccaggggccgcccagctgggggggccacccacgacgccgcacccagcctcaccg

SEQ ID NO: 37327 - DNA, 160 bp, Chlorella protothecoides
ggtggggtgcacgccgccgcgccggtcctcagcccccagaccgtcggcgtcggcgtcggcgtcgccgccggcgtcgccctcgcagttgacgcactgcagcacgtattcccccgcccgcgcgtcctggcaggcccacatggtggagctgagctgcaggaac

SEQ ID NO: 37328 - DNA, 1270 bp, Chlorella protothecoides
  modified_base (856)..(865): a, c, t, g, unknown or other
ccccgcccccccctcgcgcgcacatgaaggcgaggtcacgcatgcgccgcagcgcgtcgtccgccgtcctttccagcaccacgcgctctatgttctggtggtccatgagcacgttgcgcagcacagagccctcagcccccggcgggaacaccagggcgcgctccacggtgagcacgtccggcgcggccgccaggtgggccggcaccacgtggggtgggtggtcaaagttgtagacgatgaccgtcgcccggcagttgcaccgcgtcatcagcgtctgagagggagtgggggtttgggggccgagggaatgggggggctgggtgctgaggggggcgaacctgacgagtgtggtccagcctggcggacggcagagtggcgagtgcggacggaaggtgcttccctcgctcacaaacatcccacaccagcgacaggcatggccctcggtcccaccaaccccccaccttgctcaccctgagggcgcgtgcatcctcgtggctgtgcacgaggaagttgggcagcgtccggccgattgcgcactgcgggagcaggcgggcgggcggggtgtgctgagccaccgaacatgggcggccggaggggcatgtgctcccgctgacccaacgagcgctgcggcacggcggcgaagagcctggcgccggccacgaatgcttccatggcccttcctccccctccacccgcccaaagacaccgtacaccaactgtcccgagaaacatgcgatcataaactccccccctgcattacatccagcctctacagaccggaatctggcccctcaaatcgactgccccttccgcccaagcgcggaacccccccaccccccaccccccatctgcccannnnnnnnnnggcctggcgccggccacacatgcttccatggcccttcctccccctccccccccgcccgaagacactgtacaccaaacgtcccgagaaacatacgatcatgaacctcccccctgcattacatccagcctctacagaccgggatctggccctccagatccactgccccttccgcccaagcgcggaaaccccccaaccccaatctgcccatcgctccacattgaaacaccagaggacgccccacctccacggccagggcccagacgtcgtccttgagcgccagcgcggcgccgatggggccgatgggccgccgggcgaaggagcgcggcgccgactcgatcgcgcgccgcacctgcgcggccgccgcgccgccaaaccgctgcacggggtcgcgccgagcctggccca

SEQ ID NO: 37329 - DNA, 61 bp, Chlorella protothecoides
cacgatgccggcgttgatgttgaacaggtcatcgcgcgtcatgccgggcttgcgcggcacg

SEQ ID NO: 37330 - DNA, 62 bp, Chlorella protothecoides
agctggacctgctcgtgaacagggctcaggtgtgtgttgtgtgtgggggtcatgttggaaag

SEQ ID NO: 37331 - DNA, 61 bp, Chlorella protothecoides
ctgcaccagcgcggcgcgccggccgaacccggggtcctccagctccgcgcagaggtaccag

SEQ ID NO: 37332 - DNA, 5533 bp, Chlorella protothecoides
  modified_base (931)..(940): a, c, t, g, unknown or other
  modified_base (1023)..(1179): a, c, t, g, unknown or other
  modified_base (1248)..(1257): a, c, t, g, unknown or other
  modified_base (1374)..(1452): a, c, t, g, unknown or other
  modified_base (2224)..(2233): a, c, t, g, unknown or other
  modified_base (2435)..(2444): a, c, t, g, unknown or other
  modified_base (2797)..(2806): a, c, t, g, unknown or other
  modified_base (3620)..(3629): a, c, t, g, unknown or other
  modified_base (4045)..(4054): a, c, t, g, unknown or other
  modified_base (4524)..(4533): a, c, t, g, unknown or other
  modified_base (4631)..(4640): a, c, t, g, unknown or other
  modified_base (5258)..(5267): a, c, t, g, unknown or other
ccccccccccccccccccccccaaaaaaatccatcagcgcaccagtgggaatcaaacaggaagaggcgcgcagcgccaaccaggttcagccccgccccgcccgccgtggtggacagcaggaacacgcggccgacgccgtggcggttgaaggcgtccaccatgtccacgcggcgggcggggtcggtggcgccgtccaggcgctggcagggccagccacgcgtcgtgcacagcgcgccgatcaggtcgagcgcggccgtggactgggacaccaccaccgcgcgctccccggggtccgccagcgccgccgccagcatggcgtccagcgccgccagcttgccagagtcggcggggcggggcgaggtgtcgggggtcgggcctgcgtccctgtcggggtcgggcgccaagtaggggtggttgcagatcttgcgcaggctggacagcaccgccagggcctggcgcagcgattacacagggattgtggagtggttggaagaatgaggggcatgggaggctgccatgtatcaaggactgtcacagggtgatgcagctgcgtcggcccgctgccacctgtgccgcgtcctccatcctcgcttttgcaagggtcctcaccacaatccctccccaacaaacacacacacacacacacacagcatgcaaaacaagaaacacactcacgcgtacctggtcccccggcccgttggagagcagggtgtggactgcggcggactggagcacgcggcggtactcccgcagctggagctcgctggggcggcagaacacgatgtagacggagagcgggggcaggaagcgcgcgttcacctccgccgtgcgtcgcagcatgaagcccgagatgcgcgacaccagctccctggtcgagtgtggcgccgtttgggggtgggtatgaggggctgatggtgggagggatggggtnnnnnnnnnncgcccgcggccacctgtgccgcgtcctccatccttgcttttacaagggtccccaccacaatccctccccaacaaacacacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccctgtgtgtgcaccagcctttggggggctctcctgggtggtacacccgcccgcagcgtgctcttnnnnnnnnnntgagtgtgtggccgtttgggggcgtgcatgaggggctgatggtgggagggatggggtgcagaaggggagggtggagctcccccaggcaggcctgccaacctggcctgccctgccccnnnnnnnnnnnnnnnnnnnnnnnnnnnnnnnnnnnnnnnnnnnnnnnnnnnnnnnnnnnnnnnnnnnnnnnnnnnnnnncacacagcctgcatggcatccttctacccaacctgtttgccctgcccaccagaccgcccgatcccaagccatgcagcgccccccttcccacccgccaggcacacgcacctggccctctccctgcccagcgccttgtcctcctccgtccccgcccggtcctgggcgcgggcgatgggcccgccaaacacgcgctcgaaggcggggaggtcccccagcacccccggccgcacgaagtcggccatggcgaagaactcgcgcggcgcgttctgcacgggcgtccccgtcagcaggacgcgggcggggcagcccagcgcacccagcgcggagatggtcttgctccccgccgccgccttcaggcggtgcccctcgtcgcacaccagcagctgcgcggcacccgccagcgcgcccgcgtgccgccgcgccagctcgtagctggtgatgagcagcgcgtgcgccgccccgtgcacgaaccccagcacctgctcggcctgggccggcccggccaccagcgagagcgggcgcaggcgctcggggcccagccagcgccgggcctccgcctcccagttgcgcaccagggtggtgggcgccaccacgatggccttggtcaccaggggtttggagccctgaggaggggggggagtcgaggagcggggggctgaggggagggcaccgggcagggtcaagggggcgagtattttgtgaggagcaagagtgggtggcagagaggaggtgtgagggcgatggtccagggaccacgggtgcacagcgcagnnnnnnnnnnggttgtgaggagcaagagtggggggcagagagggggtgtgagggcggtggtccagggaccacgggtgcacagcgcagctggtggacccagcggcggaggcgggccgtcccgtgccctagggtttccagccatgcagctgccgcccctgccagccagccccatgcctggacgagggacagccaccccactcgactccccgacnnnnnnnnnntgtgccccaggttcccagccatgcacctgctgcccctgccagccagccccatgcctggaccagggacagccaccccactcgactccccgaccaagcacctgtgggttctggcgcagcagggtccagagcagggtcaggacctgcagggtcttgcccagccccatctcgtccgccaggatggcgccccgctgacccggcggccccgacaccacgcactcgtagagaaagcgcacgccctccacctgtgaggaggggtcctggcagcaagggttcaaaaagggggtggcaggcgggcaaagcagtggccatgtccttggctgttatgtaccgacgacgtctgtccgtaacgtgtnnnnnnnnnngtctggcagcaagggttgaaaaagggggtggcaggcgggcaaggcagtggccatgtccttagctatcatgtaccgacgacgtctgtccgtaacgtgtcagctctgtcagtcccctgcaagctcgagtggcatgccccttttggagcacctggtgcgggcggaggtggcaggccaggtatgggtcgaccaccacaggccgtacgcccgaggcgccagactcctgggagcccatccactgctctctgggcacgagggaccgggagggagggttctggctacctgatgagctcaggccggcgcttctgggatgcatgcaaaggccgctgtcctcgtaggaagcgaaaacatgggcagatcctcgactcctgtggataaccaagccctgtgccacacatgtcgagacgcattgcgacaggttgctcaaccgcaaggcaccttcaggtcccacctgttcagcacgatggcagtttccgccatggggtcgtgcagccatgcaggggccttgcgcactgcagcatgctgcgcagcaaccccggccggtaccactggccgaaaagccgcccttcccttgagacccgtggaggatgtcgttgtgctggccgccttgggcagtggtgctacagcaccagctgatgggcctatgaatgctgtcccgctcctgtgacgccatgcacgccacttgaactatgtttggcgaccacgtcacacgagggatggcagagctttcctcatgcacatcgaattgaaccattcagttcctcgtaaaaaggaacagcaaccctttcgccccactctacctgaactcggctgcctnnnnnnnnnngcacacgagggatggcagagcttccctcatgcacatcaaattgaacccattcagtccctcgtgaaaaagaacagcaaccctctcgccccactctacctgaactcggctgcctccatgcggttctgcacctccagctcccagcccccgaggagcacagaggacccctcccccatgctgggcgggtcatacccacgcgccacagtctgcgtcacactcttcccactggggtcaaagagcgtggtcctgccaccggctcgcatctccagcactccatcggcccagctcttgtttttacgaagcttgccgggattgtgcttggtgtacagtctggggcagggcaggcgggggtgcacttgtagcatgattgttccccatgacgcatgtgcagccgtgctgaatgcatcccgcagcatgcnnnnnnnnnngagggcagacaggggtgcacttgcagcatgatggttccccatgacgcatgtgcagccgtgctgtatgcatcccgcagcatgcacccgctgccgccatgcgcactcacacattgaagtaataatgctcctctgacgcagaaacgggcttggggcccgcatcctcgcgggccgcgggaggaatgttgctcactgcgggtcggactgcaaggggggctttgaaagccttcctcttcagccccagagtcggcacgctggcaggtagcgcctgattttcattggaaatcgacatgctgcccaagagtgtcgaatcacggaagacaatgcgcatcatgacatgtgccggatcgcggacctgtcccgcagttattcgtgtgctcacagcatgcgcagcacgcctcacatccataccatggacctctttgtgttccttggcggtcactgccgtatttcacgaggtttcagcggatcannnnnnnnnnggggcttggggcctgcatcctcgcgggccgcgggaggaatgttggtcactgcgggtcggactgcaaagggggctttgaaagccttcctcttcagcccnnnnnnnnnncgttgaatgcgtttgcaaatccgctctggaaggcaccgcgtccatcttgtcaaccacacggcgcggccgacaccagggccggcgccacgtcggcgcaccgcagcgcgtccaggtcggcaaaccacagggcggcaccccgcgggcgcgggctcagcagcacgccgcgcggccccacccccctcagcaccgccagccgggtacggaggtctggggcccagacctccagcacccccttgcgtggcgcatagatgacggggacgctggaccctggggcgggccccctgaccccccccgccggccactccatccacgcggcctgggccgcgcggtagcccttgagcatgaccaccaccaggctcgtggccacgtcgatcagcagcacccgcccgaggctgtcgcaccccagcgcccactgcccactgtgcattggggaggggtggaggggcagcgtggcggcttgcatgcgggcatgggaaggcggcagacccaaacggaagaggcggagccgctgcctgccgcccggtctgggtgatgtgaatcttgccagcaacacggctcgctcgtactgccgccagcggccacgctttttgcagctgcaacgggccacccctcgcctcnnnnnnnnnnctgatgtgaatcttgccagcaacacggcccgctccgtgccgccgccagcggccacgctccttgcagctgcaacgggccacccctcgcctcctcctcaccctcacaccattccccctcaccagaacgaggcggccaggctgtgcaccacgcgcttggcatcccagacgtgcgtcagcgccacgacgcgtgtgccccggggcagcgccgcctcctcgcccgccgcgcccgccgcgcgcgccgtggcccgggccagggccgggggcagg

SEQ ID NO: 37333 - DNA, 79 bp, Chlorella protothecoides
agctcctgtagcgtgggagagcctggccgccctgctgccgttcacccatgctgttgttggccaaccccagacacgtggc

SEQ ID NO: 37334 - DNA, 76 bp, Chlorella protothecoides
acacgcacggtcgtgtgcacgttcaccctcatggtgaacagtgcgtgctcacacaaccccacgcgagttagcatca

SEQ ID NO: 37335 - DNA, 102 bp, Chlorella protothecoides
acctgtctggcgttcacccatccgttacacgactgttaggcaaccaccatgccccccctctctcagcgcacgaagatgtcctcgggcacctggggccccacc

SEQ ID NO: 37336 - DNA, 3953 bp, Chlorella protothecoides
  modified_base (257)..(266): a, c, t, g, unknown or other
  modified_base (348)..(357): a, c, t, g, unknown or other
  modified_base (440)..(449): a, c, t, g, unknown or other
  modified_base (1022)..(1031): a, c, t, g, unknown or other
  modified_base (2682)..(2691): a, c, t, g, unknown or other
  modified_base (3707)..(3716): a, c, t, g, unknown or other
  modified_base (3820)..(3829): a, c, t, g, unknown or other
ggttggtgtcgaccccagtgcggcggcgcagggcgtccaggccctgccgccaggcagaggggcgcctctccaccagcggcagcaccttgagcgccgggcgctgcgccgccaggtaggcgcgcatggaggagggtgtggagcggggggccgcactctcctccccgccgcctcccagcagcgagtcgcggaggacagccagcggcgtcgcgtcgcgcgcgccacgaccccgccgcacgcgctccatgaaggcggggaannnnnnnnnntagcgagtcgcggaggacggccagcggcgtcgcgtcgcgcgcgccgcgacgccgccgcacgcgctccatgaaggcggggaannnnnnnnnntcgcgggggtggtgggtcagtgggcgtgcgggggaggaggggcagagtttgtgggccgcagggccactctgtgccaccgacannnnnnnnnngtgccagtgcacgctgccctcccgccggaagtgggcgtgcagggcggcgcccgcgccggggtcgtcctttcccagcgcgccggccatgcacaggtacagccgccggagctgtcgcattcgtggccgcgggggtggtgggtcagggggtgtgcgggggaggaggggcagagtttgagggccgcagggccactctgtgccaccgacatcctgcaccccccgtcccctcgccaagccccctgcaaactcccccaaaccccaggccacgctttctcacccgcgtgcacacggtgtacagggtggccatgagcatactgaaggacaccgcccgccccgagaggtccccctcgccgccctccatggcctcggccgccgcgtccacaagcgccacgtaggcggactccatctgcagcagggcgggggtggcgcccgccagcggggtgcggccccgcagcacctcagcaagggccgtgcagcaagctgccatggcggcagccagcgtgcgcagcggactggcgtgttgcctgccaatgatggtgcggtggggtggcgtatgagttgtgtgtataatctccnnnnnnnnnnctgcggccccgcagcacctccgccagggccgtgcagcaggctgccatggcggcggccagcgtgcgcaacggaccggcgtgttgcctgccaatgatgatgcggtgcggtggcgtatgagttgtgtgtataatctccatctatacttgagggggggggctgaaaacagcgctcgcatcgtcaccggactggcagccgccttgaaacgcctacatgtcattgccacgtccggcagcgcgtcgtcacctctccaaccccctgaaacagtcctcatacttcccaaacttgggacccctcctcccctttccccaaataaacctgcctggtcaggcggcagtccatgcgtcccgtctgcagcgggtagaccaccatcatgaagctggaaagcgtgctcctcagtagcagagtggccaggtcaaagtggcgggaggggaagacgtgttggcggcggtacacgtcccactccagcttcgccgcggcctcccacttccacacgttggtcaccgccgcgccggtcacgcttgccgccgcgtacagcttgcagatgcagctgtgccacagaccctcgtcgatgcccaagcgggtgagcgtgtcctatggatagaagggagtgaagggaagggggggggggtgagcgtgtcctatggaaagaagggaatgaagggcaggggggtcgggggttgagcgtgcatgggtagatttgagtggaatatggggaatcttgggagtctttgggcaagtgcactgccagatacttctgtcgcaggtcatgctgcaggaacaaagcatactcagtctcatcccaagaaacctcaaagtctgtccccagtgccatgtcaaagcatggcagggacgccttccacgccccttccacttgcaaccctcatgtggctcagaacaaggaacaaacccactcccaccccggaacgggctttgaggaggccagaatccgggtcgatctcgtccgtcatctgatcgatggccacaatgaacgtctggcccagactcactaacccgcccgccagggagcctcgtatgacgttgcctgttgtgcgagcgggagctggggctgatagtcatttggcagcaaggagcccccgcgtccccgcgcctctgcacacacgcacgcacacacacaaaaagcgctgccaccacctgcagtctggggcaggaccagcatggccacgaggaggtttgtggagcagcagatgagggtataatacagccagtgcaccgggaatttccagtagggggccagcgtgtggtagtttgcggccaccgagaggccggtggtgaccaggttgatcagccagaacaggctgtacttcttgaagcggaagcgcaagatggttgctgccatgacataggcccctgacaggcacaacaccacagcagcctgaccatttttatttttggaagggggtgagaaagggggaatcagggggcatggggacgcaagcctagagcccaaggatcaggggttaaggaccaggccgtgtcattgacctggagctccacgccctgcgcctgaaagggaccgcatcaggcaggcacagcggcatgtacgtgtcctttcaaatgccgcgcacccgggtggtggtgttgttggtgctgcccccgttgatggccagcgctgcataggcgatgcccatcnnnnnnnnnntgtgtcccctcaaatgcctcgcacccgggtggtggtgttgtcggtgctgcccccgttaatggccagcgctgcataggcgatgcccatccccgccccgatgcccagtgtggaggacagcaggatgtccgtgcagacgctgaggacggaaagccctgcgcccatcgcaatcaacccccccacgtagtacagcagcagggagagggcgggggtggcgaccaccgggtccagggacagcgcgttccagaccttggcagggctgacggtggccatgatgaggagtgtccccgttcccagctgtgagggcaggggggcgcgcaacacggcaggtcgatgccctcgatactggacaatggttggtaacacatcgataacagcctcccttcacaaactacctggatgccgaccctcacaaacggcttctggaacacggcaggcagcctgagcgcgggacccatggtgactagggtagtggacccaccccggaattacgagggtgtacttgctaggctaaggcatactgatatccaatatataccgctacagtatcctgagcggctacaggctgtgaatgaacagtgcgatcacgttttcttaggaatgcatggtaatattcgaagcgatccagggcgatgccacgtaggaagggtgagggcgtctgcactgtctcgagggttgttctccgccaacaatggattcgttccatgtatcgaagatcacaactttgaagcatggtgatacacagcccaggtcgaagatcgtgatacgtcatggagcccctcgatagtccgtcacagggggagggaagcccctgccaccatgtaatgagagctgccgcggacagccgcccgagaaaggagtgagctggaaagtacaccatatcacattacaacaattacaccaacgaatcaaagacagctgctgaaagcacacactcctcgggcattcaccggcgttgtacgacgcaatggcggcgtacctcgtacctcgtgaagggacgaggggccgggacaagcgcnnnnnnnnnnttggaaattacaccatatcacattataacaattacacaaacgaatcaaagacagctgctggaagcacacactgctcgggcattcaccggcgttgtacgacgcannnnnnnnnntccggccttgctagaagggggcgtggcagggaaagacgaggttcacgtataaacagagacccatcactgcgaagatgcgcggggtaccttcaagggtgctcctagcctctgggttgctggttgt

SEQ ID NO: 37337 - DNA, 67 bp, Chlorella protothecoides
aggggtctgggcctgcagcgtctgcatgcctgggacattgaccggcccactcacgcatgctcaacct

SEQ ID NO: 37338 - DNA, 61 bp, Chlorella protothecoides
gaacgagggaagagaagcacaatacacattcgtcgacggatctggggaatcaggggtattg

SEQ ID NO: 37339 - DNA, 79 bp, Chlorella protothecoides
ccggtagcgacatatcttcgcatgtgttgcgttgacgaatatttcccacaatcaccgcagtatgtcgtcgtccaccgca

SEQ ID NO: 37340 - DNA, 8235 bp, Chlorella protothecoides
  modified_base (348)..(357): a, c, t, g, unknown or other
  modified_base (849)..(858): a, c, t, g, unknown or other
  modified_base (1042)..(1051): a, c, t, g, unknown or other
  modified_base (1459)..(1468): a, c, t, g, unknown or other
  modified_base (1552)..(1561): a, c, t, g, unknown or other
  modified_base (1666)..(1675): a, c, t, g, unknown or other
  modified_base (3984)..(3993): a, c, t, g, unknown or other
  modified_base (4425)..(4434): a, c, t, g, unknown or other
  modified_base (4556)..(4565): a, c, t, g, unknown or other
  modified_base (5744)..(5753): a, c, t, g, unknown or other
  modified_base (6597)..(6606): a, c, t, g, unknown or other
  modified_base (6985)..(7069): a, c, t, g, unknown or other
  modified_base (7247)..(7256): a, c, t, g, unknown or other
  modified_base (7367)..(7376): a, c, t, g, unknown or other
  modified_base (7632)..(7641): a, c, t, g, unknown or other
  modified_base (7766)..(7775): a, c, t, g, unknown or other
tgcaagtgtcgcactacattcattcacacaccccgccgcgttggtgtccagagcacgaggtggttggctcctcctgcgaaccctacgtttgtggcaggcgcttgccgcacctcaccctccacctccccctcggcaattccaccccaattgatctgtgcaataacacctccatgcattcacatgggacggggacaatttacaagatgtgtacagcgtattcaagagctggcaggctacagggagcgtcaagaaaaagagctgatggtcagccagggaggggaccccgcatggggggcggggggggattgcagccagggcccctcccaattgatcactgtgggggaggannnnnnnnnnacccgcatggggggcggggggattgcagccaggacccctcccaattgatcactgtgggggaggagtaaagagcagggcgggagtgctgcttccgcccgcggaatgtgtgcacggcttgggaggggcggggatgttgcccccgccaggacctagatggtttagtgtgggggttgtgctgtgtacgttttctgggggggggaggggggggctgggaggtgccagatgccgctgacttctgcagcgccagctgggctcccctgcgcccccttcccccatccatcaactgctgctgcctagaagccgtaaaccagggatatgatgtatgagatgagggtgaccaggatcaggatgatgaccagggccacggggccgcgctggtcgtcgtagcggacctgcaagaaagggatgtttgagaggctgtcgtgacaacctggaccagtagaatccacacgcttgtcgccagttacaaaggatacccgcctgcgtcaaagnnnnnnnnnnggaaagggatgtttgagaggctgtcgtgacaccctggaccagtagaatccacatgcttgtcgctagttacaaaggatacccgcctgcgtcaaagcaggcacgtgatgcactgctggaaacctcctccagaacatacagtccctgcagctgcatcgaacctcacaactcaccgtctcgcggcgcnnnnnnnnnnactgctggaaccctcctccagaacgtacagtccctgcagcagcaccgaacctcacaactcaccgtctcgcggcgcatgatctggatggtccgcttcttgtacatgtacagcgcgtacgccatgaagaggacggccaccggcgcgatgatggcgcctgacacctggtgaagggggtggaggaaggagcaatgaagggacacgttgaggaggaggcctcgggttgtggttgctcagggacagggcaagggggtcttgacacgatgcgatacgcgaatgtgcggcttcaaacccatcgatgcatccagtcccctgcccatcatcacaacactccctgcaagaggaacattccttccgccagacatctcccaaccctccctgaccttggaggcgaagcagcggccgtcggtnnnnnnnnnnccactccctgcaagaggaccattccttccgcccgacatctccaaaccctccccgaccttggaggcgaagcagcggccgtcggtnnnnnnnnnncgacacctggtgaaggaagtggaggaaggagcaatgaaggggcacgttgaggaagaggcttcgggttgcggtttctcagggacagggcaagggggtcttgacacnnnnnnnnnngcaggacgcctcggacccgccgctggcggaccccgccccagggacggagatggaggagccggagagcagggaaagcgcggtgagcatgaccaggactgagatctggagccaggccaggaaggtgcgctcgttggcgaagaaggtcttgggctcgacgcgcgtgcgcaccagcgcctgcacgcgccccgagcgcgtggccgccagggtcacggcatcctggccccccaggaccttgaggtcgcccgcggagcccagcaacgcccgcccagcctccaggtcgcgcgcgctgtcctccggcgtggaggaccccgtgttcttggccttgccgttcccggggccctgctccgaggaggaggagtggcgctgcagcgcgccggcgccgttgtcctcgccgccgccgctgttgccgtggtaggagcgcggcgtgagcatcatgggcacagcaaccagctgcgacacggggtagacggagggctgcggcgtggagccgggcccggtgaaggccgacggcggtggcgtgggaatgcgcgtgggatgtgccgcgccgtcgccaggccccgcgcacgtcgtcggcggcggcagcgcctcccccgccgcaaacacgggccaggtgggcatgcgcgcgtgcgcagcggagcccgacaagatgtcgtgctccgctgcgtctgcgtgtccagcctcctcgacggcccgctcgccactccctccaccaccagcgggagccggcggcacgggcgcctgccactctgcgccggcggtcgactggcccctggcttccgcgcctccacttcccaccgcccccttgaccccgggctgcagcaggacgggggcggtacggttgcgccgcgccaggcggcgcaggagcgaggccttgggcgcgagatccgggtcgggatcggcgtcgcggcgccggcccccgtcggcgctgggaaagagccaagaggcggcgtcccgcagcagcgcgtccgacttgtccgccagctcgtgccaggtggctggcgtcatgaggctggggttagcggcgtccggcaggaaccagtgcggcacgttctcggtcaggagctggaagaggacggcggtgccgtggatgtgcttgctgaacttgggcacggccaggagcttgccggacttcagcaggggggtgagccactccggggccttgcgctgcagcttcacctccaccaccacaaaggggaagttgacgatgtcggcgggggccaaggggcgggtaaggtcgcggcaccagtcgccccgcgcgcgcggcgcgcccgcctcccggatcatgcgcaggtcggagtccatggagatgcgcaccgccgccgagtcgctggcctggaaggcagtgcgctggtaggtggtccgcaaaaagggcccctgagcctcgcgcaccaggaacgcctggacgcgggccaggagggcggcgtcctcggcagggcgcgacccaccgacgtcttgccccgccagaaacgcggccacctcgccctgtaccagcctcgcgcgctccttggaggagaagtggtcggtccaggactcgcgatgtaccttctcctccacgaagatctcctggtcgggcgaggcggcggcgcgctcaccgtaccagcgcaggcgcaccgccgtggcgccgtcggcgcggcgcaggcgcgcgtggtacaccggcagctcctcggggttgtcaaagtacaccgaggtgaccgccgcggcgtcggcgacgtgcgcggcgccggccaggcagcgccgggcctccacgtcgccctcggtgaacttggcgcggtcgccgtagatgaggacggggaggtgcttgatcacctccgccttgaaggcgggcgcgtcgcaggcgcgcatccagaacttgcgcgtcacgcgcgtgaacttctggggcgccacccagcggccggaggggtaggccgtcagcgccgcgttgtgcgcgcggcagtggcgcagcagctcccaggcgtccgacagcgccaccaggatggcctccagcccgccgtggcccaccacgcactgctgcaggcaggccaggtacagccgcgtcccgctctccagcgagccctctgcgcccgtcaccaggtcagccaggtctggggtgcggggggattccaggggcaggatcagggggtgtgcatggatgggtgggcgcatgggtggggttgggtgtgtcgagagctggggtgctgccagcccccgatggccctgaaacagcccagcccgagacctgcaattcagtccgcagggggccccccaatagtacacacacgcaaccccccccttccccctctcccaatcaacacgcctgggcaggggtgacnnnnnnnnnnaagagctggggtactgccagccctcaatggccctgaaacagcccagcccgagccctgcaattcagtccgcaggggcccccctatagtacacacacgcaacccccccttccccctttcccaatcaacacgcctgggcaggggtgacggtcgtaggcggcggccagcttggcgcaggccgccacgttgtgccgcacgaatgcggtcagcgccacgtaggcctcccccgccgcctccaggcgccgctgcgtggcctgcagcgcctcggcagcgcggcgcgcctgctcggcgggcaggcccaccgtggtctgcagcgccgcgatggcgtccagcacccggttccacagcgcgtcgccctcggtggccaccaggcagcgcaggcgctccacctcatgtgccagcgaggaaaggaaggcgggggcggcggggcggggnnnnnnnnnngccgtcgcgaccctggtgggtgggtcgggggctcagcgcgcaggcacccagctgcgccaccaggcctgtgaagcggaggtaactgctctcatactggggaatgggctgcggggaaatgcggnnnnnnnnnnaccgtcgcgaccctggtgggtgggccgggggctcagcgcgcaggcccccagctgcgccaccaggcctgtgaagcgtaggtagctgctctcgtactggggaatgggctgcggggaaatgcgggtaagggagagggggaggggggttgaacagtggcgacgggaatgagacatgaggggatgcccatgaacagggaggggcagcaacacgcacgacggtccggaagccggatgaggccgacaccccaggcggcagacgcgggggcggcacgcccgatacgataggtatgtaggcattgcggcccgaggtgaagctctgggcgggggcgatggcccacagggggccccgtgacatgcccgcggccagctgcctccgggcgcgcagggccagccccccccccctgcggccggccacccctcgacacgccatgcccatcccggcacccaccgattcgccgagctggtcaaataacatggcagatgccatccttggaagggcactcgagcaggaatgacgcgcggtctcgccctcggacaccttgcccccagactctcgcaggcaagtccacggacagcggtcgaggggttgatcaaaagcccccactccactccctatgcgcttagcatgccctggggggggtgtaatgagggtaacgtcagccaaagcaacatgcagggcggggctcgtccctgccgaggggcggccagctctggtcccatgggcagcccccgtacctggtgcccgacatcaaaatcgccctgctcgtatcatgaggcgcagcaaagaaccagcatggaaattgggcatcgcatcgagcctgcagtctagttccagtctcattctcggggctgacgcgtggagccctggaaagtgtggagggacttgggcacggcccgtccaagagtgtgctcgccaggcacggctagggaagtgccgagacccccatgtgctcggcttacaccgacctacacagctggaaacagtgataacattcaacatcatttaaactcatgtagagcctggagttcacccagcgtgtcatggtcatccccctgtcggactggcgcgatgcgagggctggcaaacagagatcctgtgcatgcagctgcttcagcctgcggaatccatcatcttgcccaagaaacaactatcttcttgaaaattaggacccgaacggcatnnnnnnnnnntcgagggctggcaaacagagatcttgtgcatgcagctgcttcagcctgcggaagccatcatcttgcccaagaaacaactgtcttcttgaaaattaggacccgaacggcatggtctgggatttttccagcgtccgtggtcacctggaagtctcacttgcacagggcagagccggtggaggtgatgcatctctgccaataacctcggatggcaatgagccgccgatgcgatgcttgcatcgccctttaatgatggaattatttatttgaagacacaatatggcgagggaagtcgctgatcacgatgaacagcttgtctgctgtgagggcgtccgtggcaaagcccatggcttggtgcaagcttgcaccgtgctcagacccggagcaacggcgctcaaaatagtgtccaacatgatctcccataccatgcaaagtgattgctctgtatggctggagttggtgaggatggacgactgtcagatctatcagagtccaccaaggtcgcaagctccgtactcccgggaatggaatcatggcccccaagattccttgcggcactcccggcgatcgctgaactcgtgcaactaccgatagttgcgaatatccattgcaacacggcgaattactgtgcagtgaaagtgctcaggggcacgagttgggatcttgtggagcggaacagaggtctgctctgcttccagactggcgaatcgctgaatcgtcccgtcgtcagtgtgagtactgcctgccggagggcatcttcatgaaagtgaccctaccccagagcacaactttaactcatgcgcgacgttggaatcactgtgtagaacatccctatcaatcgcgtctnnnnnnnnnncagtcgtcccgtcgtcagtgagagagtactgcctgccggagggcatcttcatgaagtgaccctaccccagagcaaaacttcaactcatgcgcgacgttgaaatcgctgtgtagaacatccctatcaatcgcgtcttcggcctgccgcaacacattcgacagcgaactgccctgtggacccgcctagggaaccgagccccccgtgtccagaatcctgcgcagtggggctatgggagccatcagcccatttcgaatgtaaagggtagatgcgacgaggcctgccgggcctctgggctcccggcgcatcatcactggtccgctggatgcatgcgcccggtgcctccccaggcaaggaggcttgctgtattctgatctgaggnnnnnnnnnnnnnnnnnnnnnnnnnnnnnnnnnnnnnnnnnnnnnnnnnnnnnnnnnnnnnnnnnnnnnnnnnnnnnnnnnnnnnaggcaggcccacccgtcgagctcctccccggcgacgagggcgtcacaggtgcgacggcagggtgctcctgggaatactgcgtggcaggagtgggtattgcatgcctcctttcactgcgtcgcctccgtgcccgccaggccagctcaccgcccacccctgcccgcccttgtcccaccgnnnnnnnnnngtttcaatggaaatcgtcaattcgagttttcctgatgatcattgaagggcttgatgccgacatccccctggcctgacccgcagtcctcagcacctggctggagggctgggnnnnnnnnnnccgccgcagccctgtcctggctgcggcgccgaggcccgaatctccccacctcgacccggcaccgcctcctccgcacccgcaccgtgcgcgcgttcgacccagggcaggacaaggtcaggcgcgtcggcgcgacgacgctgctgccccccggcgctcgcctgctggtcccccgctccgagctcggatggggatgcggtgaggggtgcgcgtcgcaccggggcgacgccaagcaggaacggccagaccccaagcagcnnnnnnnnnnctggcagggtgctcctgggaagattgcgtggcaggagtgggtattgcatggctcctttcactgcgtcacctccgtgccagccaggccagctcatcgcccacccctgcccgcccttgtcccaccgnnnnnnnnnntggatggggatccggtgaggtgtgtgtgtcacaccggggcgacgccaagcaggagcggccagaccccaagcaggaacggccagaccccaagcagcaccccgagcgaggccccgcacgcccctcggcccccgcggccccacgcgccctgctggcggcgctgggccgcgccgttctgcacgtcgacccacgtttcgtggccgtgaacaagcccgcgggcttggccacgcagggcggccccggcatccgctggtgcctggccgacctcgcgcgcgcgcccggcgtgctgggcccccagccggcgctgccgtttgaccccggtgagctgcgcctggtgcaccgcctcgaccgcgggaccagcggcgtggtgctgctggcccggggtcagacggcggccgcctggctcagccgcgccatggcggcgggggcggccaaggcgcggggcgcggaggggggccgagcc

SEQ ID NO: 37341 - DNA, 73 bp, Chlorella protothecoides
cagccacagcagagctgccaaagagcatggggggtacactggtctggctgcatatgtgccgttcccttccatg

SEQ ID NO: 37342 - DNA, 68 bp, Chlorella protothecoides
gcgtcggtcctgccgctgcgggagcaccgcgattgaaaccgggggtgcaggctcccacgatcgccaag

SEQ ID NO: 37343 - DNA, 157 bp, Chlorella protothecoides
gaagacattgatctgtgaatcgagccaggttgcgaggagggttgaggaaggggggcaggggtggtgctacaggcgctgccagcgcgtgtcacagcagcacatccccaggggcggggcggagcccgcacgggctgcctctcctgggtgtcccacccac

SEQ ID NO: 37344 - DNA, 61 bp, Chlorella protothecoides
caccttcctgggcggggaggactttgacaatgcgctgctgagccacatcgtggaggagttc

SEQ ID NO: 37345 - DNA, 997 bp, Chlorella protothecoides
  modified_base (413)..(422): a, c, t, g, unknown or other
cgcgtgcccagcacgtaccccgcgccggcgccgcgggcggccgcccggccccagaacttgagcgtggggaccaggcgcggcgcggagccgggcgccgcgtcgggccgggcctccacgctggccagcgtcgagccgtcggcggagaaggccaggtgcgtcacacgcggcgggggcggctcggggcccgtcccagcctctgcgccgcccaggttgtggggcgacagctgcagccggtcgacgtgcgcgtccctggcggtggggagggtgtgatgggggtggtgctaatcattgtcgtgctctcggggtcagaaaggaaggcacttcctgacagtggcgcgcaggagcgggcgccaggggcagaggcgggagcagacgtgggggtggggtgcagggaggggctccgacccgctgcnnnnnnnnnntggggcgggagcggacgtgggggcggggtgcagggaggggctccgacccgctgccaaaaatcgcccagtccctcagattccttccgctgcctggacccccaacacacacacagcgacaacgacaacgacaacaaaacctctggctcaccgaaccaggtcgtagaactggacctgggagtggctgcccgccaccaccaggtgccccgtccctggctggagcagggcgggggcacgggcgcgttttcctgccggcacagggcgcaggcccatcaccgaggcctccaccttcatggtggccacgttgaccacgcgcagcgtgttgtccgcctggcgcagtgccaggcgcgccgcgtcggcggggcaggcgcagatgccgaccagcgcgccgcccaggcgcggcaggtaggtgcgccgcgcggaggcaaagtcccagaccaccagcaccgcctcgcgcccgccggagaagaggtaggtgccgtcggcgctgaaggccagcgcacccaccgcctgcgcgtgccagtgcacggtggccggctcgggcgccggcggcggcggtgcggcgcggcgcggcggcg

SEQ ID NO: 37346 - DNA, 79 bp, Chlorella protothecoides
ggacggacccctcgcgcggcagacggggtgcgcgggtgtgttctgtggtggtgcatgccgcggggatgagtggctgtgg

SEQ ID NO: 37347 - DNA, 147 bp, Chlorella protothecoides
aagaaccccgaccagtacgacgccttttacatcctcttcctgtggatgccgctgggtggcggcgccctcctcaccatcctggcgcagagactccccaatcacaccaagccgctgtggatgaagaggacgcaggctctggtgggccag

SEQ ID NO: 37348 - DNA, 61 bp, Chlorella protothecoides
cacccctcacccaacacaactacaaaagaacaggagtggcctgtgatcacggtgtagatct

SEQ ID NO: 37349 - DNA, 61 bp, Chlorella protothecoides
gcgctggaactccaggctctcgggcgtgaatgcgccgatgcgctcggagtgctccatgaag

SEQ ID NO: 37350 - DNA, 61 bp, Chlorella protothecoides
acactctggtacgccgctgcttcggtttggaagtcaacaatgttgtcgatgccgggcccta

SEQ ID NO: 37351 - DNA, 61 bp, Chlorella protothecoides
gttggggggtataatgtgggtgggtacgacagccgagtctcaggggcacacaccaaggggg

SEQ ID NO: 37352 - DNA, 61 bp, Chlorella protothecoides
gcggcgactggctgtgccccggcgtcagccgcttttgtggtgatggggtggtggtcgcaga

SEQ ID NO: 37353 - DNA, 61 bp, Chlorella protothecoides
ccgagggtgcgctgaaatgtgttgcggccgtcggcttcaaggtgcacgacgccaaatcgac

SEQ ID NO: 37354 - DNA, 89 bp, Chlorella protothecoides
gctgcggggcgaggggtcacctgcaagccaggggggggggggggggggggggtgccccttgcgataccaatcagcatgtttggtggggc

SEQ ID NO: 37355 - DNA, 76 bp, Chlorella protothecoides
ggcagatacttctgccgcctctggtcaggaggcagccctccttcctccttggacggcatcccggccttttgcaaag

SEQ ID NO: 37356 - DNA, 4823 bp, Chlorella protothecoides
  modified_base (625)..(668): a, c, t, g, unknown or other
  modified_base (1320)..(1329): a, c, t, g, unknown or other
  modified_base (2323)..(2332): a, c, t, g, unknown or other
  modified_base (2694)..(2703): a, c, t, g, unknown or other
  modified_base (3201)..(3210): a, c, t, g, unknown or other
  modified_base (3444)..(3453): a, c, t, g, unknown or other
  modified_base (3735)..(3744): a, c, t, g, unknown or other
  modified_base (4056)..(4065): a, c, t, g, unknown or other
catcgccgagcccgcgcatcgccagctgcgcgccagctgcacgcccaggtcggccgccgcctcgcgcgtcgccgcgtccgcctcgtcgctcagcgcgcggcacaacgcgcccagcaggccctcgctcgccgcaagcggcgcctgcgcggcgtccacgcccaggcaataacccaggagctgagccgccttgcgccgcacgcgcgcgtcggggtcgttgcgcagcatgcgcaccagcgtctgcgtgccggccgcgctttccagccaccagcgcatagccggctcgtggccgcggaccaggctggccagcgccagcagggccttggtccggcagtcggcgtcggcgtcggccagcagagccaccagccgctcagtcagcccgggcgccgccaggaagctggcctgcacctcggggttattctggacgcaggcagccgccacctccgccgcgcgccagcgcagccccggcgcggggctggccagcagctgagtcagcgtgggcaggccgccgatggtggccaggtcgcgggccgcgtcgatggactccacgatgtccagcagctcctccagcagccgctccgcgtcggagactgcggcgacagcggcgggggcggggggggggggcaannnnnnnnnnnnnnnnnnnnnnnnnnnnnnnnnnnnnnnnnnnntgtggtggaggagttggaaggcccagtcgcagaagccgcgctggcgtccgccacctcaggggatgagcctgagccgtccctctcagtccctgcaccggcatccgtcgcagtgtgtgcgtccaggacctccttgatctctgtcatgcgcttggccaggtcgatcatggagtcacgcatcgccgactccagcctggaggcatgggtgggcagggtatgaggtagagggctgctgcccaggtgctgggaggccctccctcccacggcagcaggtctgtatgaatcgaaaaaggtgccttaaagctgatgctgacacccaatttccctcagcccaacgcaccaggctcgctcagactcgggcaggggccgggcaggggccgtgccgtcctggtgggcaaggctccactcgaacagccctgcaacagtggcgcgatgaggtagtggccggcatgctggacacattagacatgtgattcaatgcagaaagtgagatgggtgcccgtcagacctcgctgcccaccgccaggtctcacctttccatattgtcatgtccgccatgtctggcgagaaacagcactctcaagcgcagctggcggccaggcaacaacgtaaacgtcttgagaggtgcttgattggatgtaggtatactgtcggnnnnnnnnnngagcgcagctggcagccaggcaacaaagtaaacgtcttgagatgtgcttgattggatgtaggtatactgtcggcacctcagggattgcaaacactctggacgtttctgcttcattcgcgaatgaaagtccctctaccaacgtcccctgctccgtcagctggtctgggtgactctttctcagtgcaccaagtgcgcagcattcttcagcaacattagacactggcatgcaatagcttgtgcctccctgattcatatgttttgccagcttggctcatgcattgcaccggcggagaggtagtggagagccagaactcgagacccagccgccccgcagagctcactccagcacgcccttgacatagatcttgcccttctccgtcaggcccagttccttgtaaaagcgctcgatctcctcctggtccccctccaccacgatgtcggtggtggactggtcatcggccgtcaccatcttcacccgcatctgctccgtcctgcatacgcgcgggacgaaggggtgtttctactgtcatggcgcgcagattctcgcctgcaagaatgctccatgcacaccatcctcgtggactaaaatgcctgtagacaatgctcacaggtccaaccgaacaggattttccttgccacctttcctcctttcaagcacctgaaagcattcttccagtagtaccatcccgcagccgggctggccaggaccagcgcataccaccagctgcctccccagggcgcggcgatggagagcaccagggaggtgctggccaggccaatggatgtgtaggccaccagcgacgcagcctggcctgatgaggtcgacagggtcgcatggtttcaggcgcatgcagcacagaatgactgtttcaaatacacgtaagccatagctctgcggaccacacagcgccttgtagagcacagatcgctttactgggcgcagccagagtgcaagctggcagtgctcatggaggctcctgcacacgcccgggannnnnnnnnnatttcaggcacatgcagcacagaacgactgtttccaatacacgtaagccatagctccgcggaccacacggcgtctcgtagaccacagatcgctttatcgggcgcagccagagtgcaagctggcagggctcatggaggctcctgcacacgcccgggaaagcacttgaccgagcaaagacacccataccccctcacctgcactggcacggtaattgccctcaaaggtgatgacctcgcccatgtccttgacctcgtagttgtagcgcatgaagtactccaggatctggcgggcccgcgcccctggggccatggcaccctctaccgccgggccgtccacctgaaacacctttcgcttcactgtgnnnnnnnnnnaggggccatggaaccctccaccgccgggccatccacctgaaacacctttcgcttcactgtggcgcggggggccctctttatgagggaccacagcccggggatggtgatcacgaagaggcccaggctcacgtagtagctgctggcggggggtgagccggagatcatctcctgggctgaggagggcggggccatggccagcatgagggccgtggagccccaggctcccagcggcaggcgcgatggcgccgaggaggcagcctccgagggatcagtgggttcgtcctgtgtgatggcccgtgcgagatgcctggcatgtcgggctggggccaggcgtgacgggccctgcatccgcttgcatgaatggacggcaggctgccatgggcgcagggagggccggctacatagcgactgcgttgtgtgcatggtgcaagacattgtcatggtgtttacggtgtcgaatgtcccctaggatggcggaagttggccttgggatgccannnnnnnnnncagggccggctacatagcgactgcgtcgtgtgcatggtgcaagacattgtcatggtatttacggtgtcgaatgtccccaaggatggcggaagttggccttgggatgccacatttccgcccttccatgcctttcgtaaggaatcatgcacgtggaccaaactgtgatgtgctgcaccgcacagtttcccctgaaacatgaaaacgttgcaagcagtcgatgcagcagtgtaacannnnnnnnnngaccgcacagcttcccctgaaacataaaaatgttgcaagcagtcgatgcagcagtgtaacacaacatcatgtcaaacagttgctgtggcttgtctttcattatggaccttgctgacacggcgtgtatttaggatcttgcgtgccaaaaccttgcccagttctggttctctctcctgctgctcgttgaaggatcctgatgtgagatatcatgcgagacgtccacactggcataatatgccgcacccccaatccatgatgtctcgctagaggatgcaatgcagnnnnnnnnnngggatctgagtgccaaaaccttgcccatttctggtcatcgctcctgctgctcgtttaaggatcctgatgtgagatgtcatgcgagaagtccacactggcatgatatgccgcacccccaatgcatgatgtctcgctagaggatgcaatgcagactttcgacagttcatccactcaactatgtgacggtcatctgcgctctgcgcgtctgctgagaggtcacggttatcccctggcagtggctctgtcgcggactgagcttcatacccactgctcagaaaacggccatcagaacgtggggccatttgtgtcctnnnnnnnnnnctccgctgagaggtcacggtcatcccctggcagtggctctgtcatggactgagcttcgtacccaccgcccagaaaacagccatcagaacgtggggccatttgtgtcctgaggcttgttccttacccttgctctcaaatcccgatcggagttcccttggaacccactcaagctcaggaccctccatcctggcatactgtgctgctcttttcagagggcaattgatatcgcactccaccacctccctcccactgaagcaggacagtgcatgcggcattgcccagaatacgtacttccagcatcctctggagattccaaagacaatactggtggtggccaagggtcaatggggtggcgactgcccgtcagatggccgaacaggcgagtatgccactttgcgcgccctctcgcgacagtaccaagccccgacagcgcgctggggtcgcacgatcgtcgagacacccctggctatccggaagtgccggcaacccacctgcgacccaacgagcgcacatatcgcccgtgatcacgcaggccccccgccagcctgcccccagttcaccgatggcgagggatgggtcctccttccagccttaggattgctatccagcagagtatacgccagatccagcgcctggacgacagccagatcaagtgagtgccagcctgccccggtgcattggctgggtcatggtcccatgcatgggctccgggggtcggggaccccacccgcacgggagccccacccccctttcccccc

SEQ ID NO: 37357 - DNA, 123 bp, Chlorella protothecoides
cgaggggtcaggggtcagggttgatgtatggacgagtcgagagtccggctatagcatggccgcgcagtgcggctccgagcccgaggctgctcagggctcgaggctgttgctgcggccccacca

SEQ ID NO: 37358 - DNA, 132 bp, Chlorella protothecoides
gtggcttacgctgagctggtgggtgctctgattggggtggcatggggggcgtggagggcctacggcgcatgcgtgcatgcctccagcacgacgatggcggcggacgtagcgcaagacggacgtgcatcctgt

SEQ ID NO: 37359 - DNA, 70 bp, Chlorella protothecoides
cggtagcaacccagctggaagccgcagggaagctgggattgggatcccgctccccatacctcaatcactt

SEQ ID NO: 37360 - DNA, 78 bp, Chlorella protothecoides
cccgaccagccggggccctgaggacaaacatctccactcctctctttgctcccttgccacgctgagcgcacctcccct

SEQ ID NO: 37361 - DNA, 61 bp, Chlorella protothecoides
cgtgttcacgctggacgacatgccgaactttgaggacgagaactcgtgcaaagtgtgcggc

SEQ ID NO: 37362 - DNA, 69 bp, Chlorella protothecoides
ggctgctgcggctgcagcacattgagccatgcggcaccctaaccctctcgtcattgcttcaacatggtg

SEQ ID NO: 37363 - DNA, 5888 bp, Chlorella protothecoides
  modified_base (734)..(743): a, c, t, g, unknown or other
  modified_base (868)..(877): a, c, t, g, unknown or other
  modified_base (967)..(976): a, c, t, g, unknown or other
  modified_base (1050)..(1059): a, c, t, g, unknown or other
  modified_base (1783)..(1816): a, c, t, g, unknown or other
  modified_base (2477)..(2486): a, c, t, g, unknown or other
  modified_base (2701)..(2710): a, c, t, g, unknown or other
  modified_base (4262)..(4304): a, c, t, g, unknown or other
  modified_base (4995)..(5004): a, c, t, g, unknown or other
  modified_base (5716)..(5725): a, c, t, g, unknown or other
tgagcaggctgccatgccccagtgtggcccaagaacacgatgtagcgcatgggtttattttaagagacgaatgtgggcctgccctggtgcaagatgagcttgtctccgagtggcccctccttgaacatctagcggtgccagggcggtggtccacctggcgcatatctcccgcgcgggtcttgatgacgaccctccgcagcacacccggtaataagtgtggccttggcgtctttctctcgagatcatggctgcttcaccttgatcatcgatatcacgacggggctggtgcaaccgcctgggtgatgtcccagacacactcccacgccaccccctgttccccttccggagtggatgcccggcgtccctggcgccctgattaggaaggcagaaaggggtgtaagatcatgaaattcgcgcgatacattcaaggactggagcacgactgtccgcctgagtgggcgggcaagtttttgaggtaggtcaggatatgcgcggggatatgctttgtggatgagatgggcccggttcgccgtccatcgccgaaccctcagctacgaaatgtgtcgtacaggtacaaggagttgaagaagctgctgaagcccctctcttccgagcagtctcaagaagttggcggaccggaagctggggagcaggcactcggtcccgctgccgagcatgacgaggaggtgttcttcagcaccttacgggctcagatgaaggtggtggacaggtannnnnnnnnncaaaataaacccatgccctacatcgcgttttggggccacactggggcatggcagcctgctcaggaccgtgcagtgggctattgatgacatccatccaagtcctccaagagcttttgcttactccnnnnnnnnnnggtctgcgtacaagcgatggtggaggaggtgaggcaggcggcatggaggcgcatgtgcatgcatggacatgcatacgcatgcccttcccnnnnnnnnnnagagttggggcagctacagcaatgtagccaagacaattcccacgtgaattgagaccagaatgcgatgtaatgtnnnnnnnnnnagtctgcgtacaagcgatggtggaggaggtcaggcaggcagcatggaggcgcatgtgcttgcatggacatgcatacgcatgcccttcccgagcagttgcgtgatcgctagtgcggcagccttgcatcgccccaccgcactccctgccagcatggtcgtcacccctgcctccacgtgcccgccccgcaggcagttccagaagcaagcctgggccaccatcaccgctttcgagcgctcccagttccgcagccccgccctctgcttcctctgcgtgtttcgatggaggactgctgacaaggtgggcgtccagagcgtgcctgggagggggacgggcatggaacaagcaccggtgctccagagcaggtgccaggctgctgtccttggcggcgtgcttggcttccagcctggcaaggagcaggggtgcctctgagcatgctcacatcgcagctcgcccctccgcgcaagtctgctccacccccactccccccaccctcccgggcacccgtccctgcgcccctgcagaactcccggctggctcagcaggcctattggtgcatgaaattcgccaaggccaacgccgtagcgctgcggaagatcctcaagaaacacgacaaggttgcccgcaacctgcgcggacgacagtttctgcaggcaagtcagcctcgctgcctttcctgccctgcagggcaggaccttgtgtgtgtgtgggggggggggggggggtnnnnnnnnnnnnnnnnnnnnnnnnnnnnnnnnnntcaatcggggtttctcaaccatgcataagccgttgtgggccggattcctagaaggagacgccagagcctaggatcagtgtccccaccatccccggcactcgagccagaccccggtctgcacggcaggccagatgacgggaacctgctgtgccgacgcccaccgtcccagctttgccactgtccctcgactctcgcaggagagctggcagccccgcgggaccgagggcgtgggcatcttcctgcactccccgctgctggatgagctcaaggccatccaggtgcgtggaccctctgtggacagggttgggtgtcggagtgcagcgtttcgctgggccatgcaggcgtggggtgtttggcgcctgcaaaccttgaagtttcgcgctgccgagccgccagcgagctggacctcccacccctccctgcccctctctcgcctgcacccccctccaggactggctgtatgagcagggccccaagcccgcggacactccggaggacgaggtgatgccgagcgccgtcggcacgctgagcttggacgaggaggaggcacgagaggagctggcggaggaggccgagcgcggggccgaaccgggcgcgcggcgcctcgaggcggtggccgacccgggcgcctcccccggcggcgtcgcggccgcctcgctgnnnnnnnnnntgggaaggcaaatgctcttaggaatataatcatgcacttaatgatagatttcttctttatggatgcccaataactcccaggggtccatgttaagtacaacacaagtcaagccaccccatcctgacaacagcttggtatgcataagagtactggagcctcagtggtggaaaaatttgatactgactccttggtacttggactgggcatgtcccttnnnnnnnnnncgggaagacaaatgctcttaggaatatactcatgcacttaatgatagatttcttcattatggatgcccaataactcccaggggtccatgttaagtacaacacaagtcaagccaccccatcctgacaacagcttggtatgtataagagtactggagcctcagtggtggaacaatttgatatcatccttggtacttggactgggcatgtccctttgtgcaacactttccattgtgacctgcctgtcacactgagttggtgcagccacagcaatgtagtcaagacaattctcatgtgaattgagaccagaatgcgatgtaatgtcatctcaaactaaatttggtgccaggagactccaaggtgagcagcaaggcggctgcaatgattccgggtacccttgttgttaacctgccatactgctggggaaacaacctcctgtgttgaggaattccccttcttcccctcaaaacccagctcggtatacctgcaatgggggtcatcaaggggctcatcccattgtggggctcctgaaagctgaccaccctttaaatatccggacgacagctgcgggcaacaacaatccaggcgcccacatgccgggcacgaacatttcccgcctttcccatcggaacacccgctccgccagatggtttcaaatcacggagccggcgccgcgaggagcccatacccccctggcaccctgctgtgacccagatattcgtatccagcattgcggaggccatcggtgacgagggtcgtctgcgcttccccggacccaccccgcccacaccgccggcccccacccacttgaactcggaccctgcccgtacccagatcgcccttcacatcgcttcaaataggcacagggtagtgatcgaagattgcgctggtgccagaggcacgacacggaagcacacacccgcgacaggtgactcagcggtcgaattgcggagtgcttcgagagatgcagggcatgtcgcccaccatggcgggggctccggctcctggcttgccaccagttaccatgactgtggagtactccgcgatgcctcgccgtccccctgacacgtcgcacagcaccccccgcacaggcatctgttggtagccatggcccaacccggtcgcttcccggcgaagctctcgcccatgtttgcgccgggtcccaaggtgtgtgcgccagggggctggttgggcggtgccgcgtccaccatggggaggccccgtaccgactcccatcaccgcccacgcaggtggaggaggtcagtgccgcaggccgcgcccaccacaccctcccgggccgcacactcgctgcactggcggagccctcggggtgcaacacctcccccatgccagcccccacacccgactatgaaggggagcaccccctctgcaatggtgggcctggcgcggcggggcttgtgagggggacgactgcactggcatggcatctggcgactgctcaagctcacgggtgcagtgttgcatcaatcacgggaaccctcgttttacccccccctttctcctgcgcacatcccccccccccccctccccccannnnnnnnnnnnnnnnnnnnnnnnnnnnnnnnnnnnnnnnnnncccacagcggtgagtgcctcagccacgctgatgagcacccagcgctccccgctgcggccgcgcaaccgtgccggggacgaaacgcccacaagccccttgctccccggagctgccgccgcgcccgtccggaccagcatggactttgaggccgccgaggcgctggcctggctggccaacggcaagcagaccgccgcgcaggcagggccggacggcgccgtgggcgtcgagcagcggcagcccgaccccgcctccacgccggcctgggagggggcggggcccgggggcgcactgggaagggtggatggccagggcatgcccggcgtgccccaccgccgcctctcctacgaggacgacgcccgcaagcgcatgggtgagggttggggggctgagttcatggagatgttgaatgccaggtatgctcgtggagtggcaatgtcccaggaaattcctcacagatttgagccactctggttccatggcgtctcactgacacctctatacacgggcaggatccatggcggagcccagcatgggcgaggatggcggggacgcccggtgtcccaagacctacagcctggtgagctgggcagggtggctttcactgtagttgatgttggaatttgacctcctagtgtccaagcatggcatttggtaacccccttgggtcctctgacccatcagggtctccatnnnnnnnnnnctggaatctgacctcccagtgtccaagcatggcgtttggcaacccctttgggtcctctgacccatcagggtctccatccccagaagctcacgcctgggcccctcccaccaccgcagtcgtcgcgcgtcggccaggccgcactttccatcctggagtacgtcaccattcacgaggtctcctaccgctcggccggcatgcggggcgtgccggagcgcgtgctcaggtataaaacgtggcgcactgtggatacaaaagggggggaggaggggtcggtcgccgatcgaggccgcgccgtggtcacccagatcccacccctcccacccactctgccccgccgcacacactctgaccccaatcctcgttgcccccccccctctccctccttctcctcccccctgccaggcaagagtttgggaacaaccccgacacctccaaggcgctgcgctgcctggtcaccgagggggagctgcagcgggagggacgcggcgggaggaaggaccccttcagctacacggtgagtttaccgcgggcacctgcctgtggctcgacgcttggagccgcgggttccccttcctcagcgctggcctcactgctccaaatctcaccccccctgcgcagctcactgcgcatccccggcccgcctgctcggacgcgggcgcggggcggggcgacgacaccgggcccgcgccccgcgcgctgcgctccggcgggnnnnnnnnnntgcgcagctcaccgcgcacccccggcccgcctcctcggatgcgggcgcggggcggggcgacgacaccggccccgcgccccgcgcgctgcgctccggcgggcaggactcgggcgcggatgccggcgtggtgagccgggcgcctcggggacccgagctcgggccg

SEQ ID NO: 37364 - DNA, 61 bp, Chlorella protothecoides
ccgctgcctgacctgcgcttattggcaggggttccccacttaaacacacacacacacacac

SEQ ID NO: 37365 - DNA, 61 bp, Chlorella protothecoides
gccccacccccagaagtctgtgccaaagccgtcgacacggctgatctgctgctggctgatg

SEQ ID NO: 37366 - DNA, 71 bp, Chlorella protothecoides
cccgcccccatcatccatgcctatacccgcgagacccaccccaaccgttgaacatagaccatcaagctcct

SEQ ID NO: 37367 - DNA, 149 bp, Chlorella protothecoides
gtcctgaccactgggccccaagaacagggcaaaaatgatacgtggtcctgcccccaatgggcacccagtccctgccatgccaacagcacctcgaggagggctgcatccgcggggtccagggggacgcttccctccgggatggcatagcg

SEQ ID NO: 37368 - DNA, 73 bp, Chlorella protothecoides
tcctgtatggcagctgggacctgcccgtctcctcggtgcacgtgggcgtggacgacgtgctgcgcttcctgcc

SEQ ID NO: 37369 - DNA, 99 bp, Chlorella protothecoides
ccaaatcaacggcatctcgacaacgacactcggcgcgcacggaaatggcctgaggaactgagtttcagatctgagatggcatccccaagcacgctcttt

SEQ ID NO: 37370 - DNA, 61 bp, Chlorella protothecoides
aaagaatgcctggggcagcacttgcacacagatacacagcatctgcgcacccacgccacat

SEQ ID NO: 37371 - DNA, 62 bp, Chlorella protothecoides
gtcctggcgcgcaagcgccgcgcctgagggggtccgttggggtgagcctgaagaaggcggcg

SEQ ID NO: 37372 - DNA, 109 bp, Chlorella protothecoides
gccctgcggggtggggctgggtgctgccataaatgtctgcgcgggggcgcgactcgatgatgattcgcaagcagggcaccgcatcctcgttcctaccgttgtggtcact

SEQ ID NO: 37373 - DNA, 168 bp, Chlorella protothecoides
cagagtgagatgctggggtgctgactgccttgtgatcgagggagcatgctgagcaccctcctcaggtcccaacacccaaagtaaggcaaccgcgcgctgggtcaaggcacggcctggcgcatgcaacaggttgacatggccatgctggccacgcgcgaccccacctcg

SEQ ID NO: 37374 - DNA, 70 bp, Chlorella protothecoides
tggttgcctgcaaagagtgccaagcagggtgaacgcccgtaaagcaaaaagagggggcaaccgagaatcg

SEQ ID NO: 37375 - DNA, 91 bp, Chlorella protothecoides
tgcagaactgaggaggactgggagctgtcctgaaccagatactgctcactggcaatgcatgagcgtgtcagcttgccggcaaggctgctgc

SEQ ID NO: 37376 - DNA, 74 bp, Chlorella protothecoides
tcagcgtcaccgcaggtacattgggggatgcggggtcgaggtcgacacaggaggcaagcgagcagaggcggggc

SEQ ID NO: 37377 - DNA, 357 bp, Chlorella protothecoides
  modified_base (113)..(280): a, c, t, g, unknown or other
atggacctcgtgaacctccgtcaaagacatacacaaagttcatgcacgcatctcgatcgcgcgcgccttgctcggatagtgtcggtcataaatgccgaatggtacattgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcgaccccacaaccttggcctatcgtctggcagctcagttggtagcgtcggtgcgcaatggacatggctcgcat

SEQ ID NO: 37378 - DNA, 72 bp, Chlorella protothecoides
cgcatcctcctgagcgccctccagggactcctccaggagctgcttggcctgggcatcaggtgtgaaagggcg

SEQ ID NO: 37379 - DNA, 61 bp, Chlorella protothecoides
aatgggggtgcaggccagggcatgtcggcagtccagcctgggctggctcatgaccggtgtc

SEQ ID NO: 37380 - DNA, 61 bp, Chlorella protothecoides
ctggaccggcatttgggagcgatcggaggcgtgcaggagtctggcggcacccctttcccaa

SEQ ID NO: 37381 - DNA, 73 bp, Chlorella protothecoides
ggcgcagggccgatggcagaggactaggaattaggatggtaagagtccctcagcaccctgcagtctgacatgc

SEQ ID NO: 37382 - DNA, 1504 bp, Chlorella protothecoides
  modified_base (168)..(279): a, c, t, g, unknown or other
  modified_base (1188)..(1197): a, c, t, g, unknown or other
ccgcgacgcgacgcctcccatcgacccgccagccgccaccctcgcggacgagctgcacgaggtcacggtgaccgcagcggccgacgtgctccgcgcgctggacgccacaggggggcgcgtggagctggtgctggaggggtcggagggggaggaggacggcgagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccgcgtggcgggccatggcggaggagctgcgcgcgtccaccgccgccctgtcctcctcctcctccggcgacgaatgggaggggacagccgggtcgggtagcgacgcagaggccgggcgggagggtgggcctagcgccggcgccggcgccggcgctgccgcgcctggccccgcgcatgccggcgcgtcctggtcgaccctgcagcgcgccacctggtccacaaacgtcctgcaggcgtatcgaggtgagggggaggcggggagggtgcaacgcagggggggcctggactggggggaagaggtcaaaacaggcgggaggctgtgtgcacacctccagttccagttgcctcttgacacctcctggggactggtgcacggttggacggtgcagctgcaaatgtggtggcccccgcccagcccccgcccctgctgcctgggcggagcggagagggtagacgtactcagggaggccagcccgcgcctgggttcttctgctcaacaagcacacctcccgtcagcgtgcacatctaccacactcccgcccacacccctgccattcaccccaggccaccgcaatgcccagacggtcaagggcgtgagtttcctggggccggacgatgagtgggtgctgtcgggcagcgacgacggccacatcttcatctgggagcgggagggaggcaagctggtggcgctgctagaggtgcggtgaggggggggggggccctctgtcttgatgaatggggctgtttgctttgcacatgtgctgttgtcgagtgggagcatggggcccccgtcctggagcctgaacatcgagatttcggggacgaggagacccctgcgcacggccttcccacccccttccccccaatgactgctactgcgcagggcgaccgccacatcgtcaattnnnnnnnnnnaccctacgcacggccttccccacccccctccccccccatgactgctgctgcgcagggcgaccgccacatcgtcaattgcctggccccccacccgacgctcccccatgtcctggcctccagcggcatcgactcggatgtcaaggtgtggggtgtgcaggcgggcgaacccgccgccctcggcgccgccgccagcatcctcatggcgcgcaacgccgaggagcaggggtcgcgctactcccgctcctacatggtgtccgcccaggtcctgcagtccatgatgcgccaggcggcggcgggggagggcggg

SEQ ID NO: 37383 - DNA, 115 bp, Chlorella protothecoides
cctgtgtttttggtcgggcggggggaggggaatcgttgcttggcgctgatcggcctccaggcccaccgtgccgtgccggctgctgcaccccacgtaccctgactggggtgacaag

SEQ ID NO: 37384 - DNA, 116 bp, Chlorella protothecoides
agcttcatctcgttgtacagtgcatcgattagcaagactcgtgacgagccccactacctacgagcgcatcagtgctcagcaggaacccatcatgcaggcttgacccttcctgcctc

SEQ ID NO: 37385 - DNA, 74 bp, Chlorella protothecoides
agcatctaggggaaggatgcgcagcatccatattagcaatgcgattcatgggcagtcccagagcagcaggtaag

SEQ ID NO: 37386 - DNA, 62 bp, Chlorella protothecoides
gagtgtgaatgaatcgcaaggtccagatcgatcccatggcgcaccggatggtgtggtcatac

SEQ ID NO: 37387 - DNA, 61 bp, Chlorella protothecoides
ttgggccattatttcggcacatatatcacaccaaacaatccaattaaggtctgggccgtcg

SEQ ID NO: 37388 - DNA, 61 bp, Chlorella protothecoides
ccctgccgcccgcgctcaggcggacgacacgttgaaccaggatcgcatgccctcgtcgtag

SEQ ID NO: 37389 - DNA, 23387 bp, Chlorella protothecoides
  modified_base (3023)..(3094): a, c, t, g, unknown or other
  modified_base (3550)..(3559): a, c, t, g, unknown or other
  modified_base (3908)..(3917): a, c, t, g, unknown or other
  modified_base (4048)..(4057): a, c, t, g, unknown or other
  modified_base (4172)..(4181): a, c, t, g, unknown or other
  modified_base (4356)..(4365): a, c, t, g, unknown or other
  modified_base (4976)..(4985): a, c, t, g, unknown or other
  modified_base (5785)..(5794): a, c, t, g, unknown or other
  modified_base (7475)..(7484): a, c, t, g, unknown or other
  modified_base (8164)..(8173): a, c, t, g, unknown or other
  modified_base (8813)..(8822): a, c, t, g, unknown or other
  modified_base (9064)..(9073): a, c, t, g, unknown or other
  modified_base (9713)..(9722): a, c, t, g, unknown or other
  modified_base (10028)..(10037): a, c, t, g, unknown or other
  modified_base (11114)..(11123): a, c, t, g, unknown or other
  modified_base (12114)..(12123): a, c, t, g, unknown or other
  modified_base (12351)..(12360): a, c, t, g, unknown or other
  modified_base (13236)..(13245): a, c, t, g, unknown or other
  modified_base (14414)..(14423): a, c, t, g, unknown or other
  modified_base (15488)..(15497): a, c, t, g, unknown or other
  modified_base (15723)..(15732): a, c, t, g, unknown or other
  modified_base (16511)..(16520): a, c, t, g, unknown or other
  modified_base (17075)..(17149): a, c, t, g, unknown or other
  modified_base (17877)..(17886): a, c, t, g, unknown or other
  modified_base (18650)..(18659): a, c, t, g, unknown or other
  modified_base (18903)..(18912): a, c, t, g, unknown or other
  modified_base (19175)..(19184): a, c, t, g, unknown or other
  modified_base (19514)..(19523): a, c, t, g, unknown or other
  modified_base (19714)..(19723): a, c, t, g, unknown or other
  modified_base (21093)..(21102): a, c, t, g, unknown or other
  modified_base (22376)..(22385): a, c, t, g, unknown or other
  modified_base (22955)..(22964): a, c, t, g, unknown or other
  modified_base (23185)..(23194): a, c, t, g, unknown or other
gatgcgcgcgcgcgggcctgggcgcgcgagctggtcgaggaggcggagtacgagcggtacgacgtgacgggtgcgacgcgcgaggtgcagcagcgcgcgcggcgccccggtgccgccgcggctccccgcggttcccgcgcgcacgcagacccgggggcgctgaccgccaaggaggtctacggctccatcctgggcgcgctaggcgcctgcgtggcgggccaggagggcgtggccgacctggcgcgctgcggctcctgggacaacccggccaagcccctgctcttcagcgcatgcgggggctggagcgagacgcggtggcacgtcggcggcgcggctgcgccccccaggtgctgacgaggaaggggctgacgaggaagggggggggttcaagtccagtgtgtgtgtgtggtgtgttgtggggaggggggcagcctctgccgatgcgtgagtgcaggagacctggtctttgtgagggcgtcgctgcctccctcctgctcgcctgctgtcgctggctcgtggcaccggcatctgagcaccggccccccagatttacaccccgcgtccctccacaaaacacgcgcaggatcctggaggtgagctccgacctgttttcgccgcgggcagtggcgctggaggaggtcggggcgcggccgccgctgcccctgttccactgacggcgccacgcatggcacgttgcatgcttctccccccaccccgtaccaaaaaagctgtcctctgcatcggagcccagtccggatgccggccatttgtaccccatcctcggcgggggtgcactcgcctgtgcaccccctccctgccacacttgacacgagggcccttgtatggggcggtcaaaacacgccccacccccaggtctagcaaacccctggccggccacccctcccttcctgacgtacacatcgttttgacggtgctcgcacccgtttgcccctccctgcctttgcgtgtgggggtgaccctccccacgggggcgccctccaccccttgcccgagccctctccgcatgccagactgccccgctcacagcgagcccagcagggcgtggtttttatcttgcgcaatggagccatgtaagcagcccatccaggagtcggagcgtgggtgtccgctcgccggcgcatcaggcacgcttctggaacacgagcatgtagttgttggcgggcatctccagccgcgccagcaggcccagaccctgctcttcggcccgcgcctcgacctcctccacgtcgcggtaaccccacgcggggtcggtgccgcgcaggtaggcgtcgaaggccgcgttggaggcgggctccagcctgccgcccacgcggaaggggccgtagatcatcagcaggccccgcggcgacaggttgcgccccgagccgctcagcagacccagcgtggcctcccaggcggtgatgtgcgtcatgttgacgcacagcaccgcctccaggggggggaggtcctcgggcaggggccagggctcgggctgggacacgtccaggaccaggggagggagcaccgccgggctgtcggaggcccacgaccgcatgctgcggaaccgggagaagggacggggccgcgcgcggcgtgatcagcatgtgtggaagcccagttgatcgaaaatgccttgataacaactgtcatgtgcgggctgttcgggggttcgtactccagcccccgcaaggattcctctcatacctgtccaggcagctggcgtcgcggtcggtcggaagccagcgcacgttgggcagctgtgggctcaagcatgcagcatggtatcccgagcccgacgccacctccagcaaggtgtatggggtggtcttcttcccaaggtgcgtcctcagaacagccccgatgtgtggagcattcctgtgtgtgtaggggaggggggatgtcggaagatggccccatggagaacaatgtgatgcatcgtaacccatagatccgatgccattgcatgttacaatgtactcttaagaccgggctaccagacagcgcggacctctccgtgggcgttgtgccttgcgaagaggccgctcccggccgggcaggatggtgcggtggtgagaatgccattacagcttcaagggagctggcgcggacgcgctatgcctatatcctgtctgcaagaatgtaattttccctgaagtgaaccccatgcatgtgtcaaagatggtttggcatcgaccttgatctggggcccctggcagattctcggagacgtccagggcgcgaagatccgccacatcctgcgcgggcaagtgctggcccggacgcatgccaggatgcaaaccctcttgcacgacccaggcccaccaacatgctgttgttgcttttgtgacctgttggactgctataacaggtgtcccgggccgccaacacctcggcgccggggaagtacttgtctgaagcgcactcagcttgccctttaaaacccctcagggcaactgccaacacgctagaggctctggttggacgcagtggtgcagcaaacaacctttgtatagtataactctgggtttcgctcaaagttcaagcatacgggaagggtagcggcgcgctgtgccaatatgtccagctcgagggtagtgagacgctctcgagagctgcgctccagattcgtaaggcaagtgtggaagggacatcagatgtgtactttgctttgtaaggggcgcaggcgatggcgccctcccctacccccgggtgagcgttgcctgtggggtgccagcagctcacgccttgctccgagcactcccctcccttcattgcggtgcaggtggttgaccaacgatgaccccaggttcccctaccaccctgagtctgctgtacggcccagcgtcatcaagagccgcggcatggagatccttcagaacccagtgtataacaaggtacaatgaagatgtttccgcatgggtcagtgtcccagcgcatgcaagggggtcattcgcaaaagggtctggatgggcggccccagctcatacagttgccggcatgcgagcatcgatctccatcccccnnnnnnnnnnnnnnnnnnnnnnnnnnnnnnnnnnnnnnnnnnnnnnnnnnnnnnnnnnnnnnnnnnnnnnnnggagcgggagaggcttggcctccgcggcctgctgccgccctctgtcctgcctgtccaacgccaggtcagcacgtaatgttggtgtgtgcacccgcaggaagtgtctgaaggatgctgtgtatccctgccagctgcagtcctgctccccacggcatgccagccatgggtttccagcgcaggggcccctgccactgcctgcacctcgtcaagttctcccttccaccctcgcctgcagctgtcacggaccatggacagatactggcatggatctgacttcatcgacccttcccaggtctgttcctagtgtgagattcaccttcccttttggcccctgcttgcggggcaaggaggttgacgccccaacgcatgctgtggcaaggctggctgtggctcgtcggactgcaggtcacagtccagattaagagtcatccagtcaacaccccaccacctgccagnnnnnnnnnngtgttcctattgtgagactcaccttccctctcagcccctgcttgcggggagaaggaggttgacgccccaacgcatgatgtggcaagggtggctgtggctcgtcgcactgcaggtcacagtccagaccaaggatcatccagtcaacacccccccacctgccaggtggactctgggggcgttacccacgagcacacccggaaatggctggtactgagtgatctccaggtgcgccccaggatgtgcagcatgcacgcagggcgagcttgggaggtactgggcatgctggcagccgtacatcggctcacctggatgctgattgttcctcccttccctcctgcaaccaggatcnnnnnnnnnntgtctcacctggatgccgatcgttcctcccttccctcctgcaaccaggatcgcaatgagacactcttctacaagtgcctgatggataactttgtcgagatggcaccggtaagtttgactccaggatagtcnnnnnnnnnntaggtggtatgtcttggacggggaaggcctctggctcatgacatgatgaaagggtcgtgagcactgctatgctgggcagtgacatgccctgggatgcaggtgcctggaagggcannnnnnnnnngactcgaatgtgccgattagggtgccgcccgcccatgagagcacagagtagggacctgcagggccctgtaggctcctgtggggcgtgaaggagggcgcccggttgccatcacctaatcgccgcctcaaacccctgcagatcatctacacccccacggtcggctgggcctgcatgnnnnnnnnnnaactcgaatgtgccgattagggtgccgtctgcccgtgagagcacagagtagggacctgcagtgccctgtaggctcctgaggggcatgaaggagggcgtctgattgccatcacctcatcgccgcctcaaaaccctgcagattatttacacccccacggtcggctgggcctgcatgaactaccacaagctgtaccgccgcccacgaggcatgtacttctcggccgccgacaagggcatgatggtgcgttgcttcttggaggtggtatgtttggggcggggaaggcctctggctcataacatgatgaaagggtcgtgagcactgctatactgggcagtgacgtgccctgggatgcaggtgcctggaagggcagcttgtgttgggggctcgggaggtgtgcagggatcagggccctcctccaccaacccctcactctctcgtctgcgcagtcaaccatggtccacaactggccccacgatcacgtggacgccatcgtggtcaccgatggctcccggatcctgggcctcggtgggtgatgtgacacagggagtgggtgtgtctatatcgtggctcccagacgacagggaaaatactcccgaatggcgtgctgggannnnnnnnnnctatcgtggctcccagacgactgggaaaatactcccgaatggcgtgctgggagccaggcagggtcccaggccagccacgagtcggctctttttggtctcatgttctatctgaaggccttggcgagtgtattcaggttctgggttacccccacacctcagcaagtgtgggccatcgccccaaccaaatgtctcctgcacccccctccccccccccttctcttctctcacatgaaaccaacaggcgacctgggctgcaacgggctgggcattcccatcggcaagctggacctgtacgtcgcggcgggggggttccaccccagccgcgtgctgccctgcgtcatcgatgtgggcaccaacaacgaggccctgcgctgcgaccagtggtacatgggcctgaagcagccgcgcctggcgggcgacgcctactaccagctggtggacgagttcgtgcaggcggtgatggggcgctggccgcacgccgtgctccagttcgaggactttgcgctagagcacgccggcccactgctcaagcgctaccgcgaccaccacaccgtcttcaacgacgatatccaggcacgctgcggtcgtggggcccggggagggggtggggaggggggggagagaaattccccaagggcgggtgccatgatctccgcatgccgctcacattccagccctccaccctctgaggcgctcacctgacccatccgattctggtcaaagctggacaaactccgcatcccaactctcctaccgccactaccccaaaccccacctaccagggcaccgcctgcgtcgcnnnnnnnnnnagggggggagggggggggagaagtcccccaagggcaggtgccatgatctccgcgcgacgctcacatcccagccctccaccctctggggcacccacctaacccatccgattctggtcaaggctggacaaactccgcagcccgactctcctatcgccactaccccacccccccacctaccagggcaccgcctgcgtcgcgctctccggcttgtacggcgcactgcgcgtgctgggcaagtcccacgccgacctcaccgcccagcgcatcctggtggtgggcgcaggcagcgcgggcatgggcgtggtgaccatgattgccaagggcatgcaggcgcacggcctgacgcccgaggcggccgccgccaacttccacgtcatcgacgaccggggtctgatcaccacggcgcgcgagtgcctgccgccgcacgtcgtgcgctttgcacgttctgacgagcagagcacgggtggggtgattgatggtggtgttgtatgtgtggggagtggcggagagggaacggaagaaggggggggtagtaagggggccaagcgccctgagggtgcttcatttcttgagggaggtgcaattcatgcctctgcagctcagcgtgagtcccgcagcaaccgaccaccaggaggcgtgctggcaccctgccgccctcgctgtacgttctctgcgtacagacatgcctcccgctctccctcttcggcacacacacagagggtgagagcctggtggagtgcatcacgcgcgtccgcccgacggtactgatcgggctggccggcgcggggcggctgttcacgccgccggtgctccagacgctggccgcgtactgcgaccgccccatcatctttcccatgtccaaccccaccgcgcgcatggagtgcactcatgaggaggccatccgctacacaaacggccgcgccgtgtttgccgcagggtcgcccgagccgcccgtggtgtggcacggagtcaccaaggtcccctcccaggccaacaacatgtacatcttcccgggcgtcgccttgggcgcgctgctggcgcgggcgggcacggtcagcgacgccatgctcatggcggcagccgaggccctggccgccgagaccaggcccgaggagctggagctgggcatggtgttccccaacatggacaggataaggtgagaggttggtggtgttgctgttatgtgtttgggggggggagggaaaggagtgaacatccccaagggagaatgggctgtgcatgggtgtctcaatggtgcaccatggcgatggccggcggttcggcagggcaggttattagaaaatggagtttgcctggctgagcacttcccgcccccatcctggcacagggacatctcggtggcggtggctacgggggtcatcaaggcggcagacggcttgatccagaacaagaagctgctggaggccatcgatgccgggccagaggagctaaaggccttcatccacaaccacatgtatggatttttaagggggctgtggggcattgtggggcttagggaaggtggtagaatggcagcgtggtttccccttcctgtcgatactagcattccctcctctagacgagagtgggggcttcacatgcgtcccctgagatcatgcatctccagttgacctccgcaacccagctctgtgccctcagcttctccagattgagagaggcnnnnnnnnnnttccaattcacctccgcaacccagctctttgccctcagcttctccagattgagagaggcatgtccgacacctctccccacaggttccatcccgagtacacaaaccttgtgtacaagggttgaggcaccttggagttggcacacatgttcttcttcccacagcagactacctgaagcgagtcgatctaggttcaagggccatcgttcaagcctttggcgctggcagccagcaggtccacagtcgctatccaattctgtttgcctttggctgggtctgctcagctcacacttgatcgcccacacggttcctcgtctgtgtaattcgcatcagccgctcataattttccagtcagggagtgaaagcaggctcgacatgttgaaagtggtagtgaccgtgccctctgcctgccggagccaacagctgcaagcatgaacttactaccgatgcatggtgatctcggcgcgcgcaaacagtcggcacaattccttcatcgtaaagtatcaatggacaagggtctcccaggccgatgtccttgtgcaaaatgataaacaatctgatacagaacaacaccacataatggcactcggggcctccgccctcatcgatgcatgatgtgtgcaccgtgagaactggttggctttaatactatcccggggatccgatgtctggattcagacgannnnnnnnnncgtgcaaaattataaacaaactgatatagaacaagaccacgtaatggcacttgggggctctgtcctcatcggtgcatgatgtgtgcaccgtgagaacggggtgcctttaatactaacccggggatccgatgtctggattcagacgaccgggatcgcagaatgcgacagcatttggcctatccttcgctgctgatcgggacaccgacaaaggaagtgcccctcccatccacaacccgtgagcttgacagtgctggtggcggtcacaggagtcaccctgtagggtctcccatgccaggtgcatgctatctccgtgcatgccgtctttctcggaggctgaagggcttgcaagcaccatcacaggaacgagaggctgagcctggcagagcagcgccgggcactgcctgtgcacgcccacctgaaggaaatcttgtacctgctggaaaaacatgcgacaacggtcgtggtgggggagacaggaagcggtaaaacgactcaaataccccagtatctccatgaagcaggtgccggtgcgcgcttgggaatgtgggttgtgacttcagggggccattggatttggtatggaggtgtcgcgggaagccaatggcctcgacaggatgccacgcccttgctagtacatacnnnnnnnnnncctccatgaagcaggtgccgatgcgcgcttgtgaatgtgggttgtgacttcatggggccattggatgtggtatggaggtgttggtagaagccaatggcctcaacaggatgccacgcccttgctagtacatactcggctgcaatgcaatatcatctcaaggccctcgctgcctccaccaagcgtgtcactcccccaaccatccaggttggacggccgggggcaagatgattgcttgcacgcannnnnnnnnngctcgggtgagcgaggagatggggtgcagcctgggccgcgaggtcggctatgccatccgatttgaggacagaaccgagaaggtgaggggtggatgctgcggatgatgtggacgctgtctcggtagggtgcagcatgatgagaggagcagggaatggagtcacaggcaatgttgctggaaagcagtgccgattgctcgtcgtgcatgatggcaatggactggagtgggggggggtagctggtcactctgcctgccacatggtttgtcctcagtcgagagaagactgtgcaggccccatcgctggtccctttatcggctatactgcgtcggcccaaccactgaaccctaaaccctcgtgcacacaccgcagggcagaacgtgcatcaagttctgcaccgatggtgtcctgctgcgtgagatgatgtccgaccccctgctgacggactacaggtgagaaggcggggccgtgattatgattggtaaaactgttcacaggtgcaaagctctgtgctttccatggaggttgggttggctggccatctgcgtgtcgtttgtacaagtagaagaggaacctttctggagttaaccccaccacccccgtgcttcctccgcagtgtcatcatggtggatgaggcacatgnnnnnnnnnnctacaagtagaacaggaacctttctggagttaaccccactacccccgtgcttcctctgcagtgtcatcatggtggatgaggcacatgagcgcagcctggcaacagaccttctgctcgggcttctcaaggtacccatcagaggagtgcttgatgcccattcctggccatgcccagaccttgtggtgttgtgctgggacacacaatcagcatgcacactcgtcatgggcagcgtcttgtccccatcaacttccattaacacacctttgtgaactgttgccgcagaaaattcaacgacagaggccagannnnnnnnnnctgctgggacacacagtcagcatgcacacttgtcatgggcagcgtcttgtccccatcaatttccattaacacaccctcgtgaactgtcgccgcagaaaattcaacgacagaggccagaccttcgcataatcatctcctcggcgaccatcgaggcggagcgcatggcagcgtgaggagatgttgttggcatgggtcgttgggtgtgcagctgagtggcactggattcctgggaccatgcccagagcaccactgctcgggagcgacgccgtggtttctcaccgtcacacatgcaggttcttcagggctcccactgctgccagcaagccacggggccaccccttgcagcactctgaggcaggcgccgatcagttctcggggaaccctgccctgctcagcgtggagggcagggcccaccatgtccaggtgcgaggaaagggccagagtggatgaggggggggtgtcaagcgctcacaggcatccaggactggcgccacgcatctcacctgcgtgcagagtaccagagcctggacgtggggtgaagcatgggcaggaagccagaccccctgcttggccgtgtccccgcctgagaccctaccagctcgcacggcgttgctcttttcaaaccgcattccccccttgtgcaccctgccccaggtgcactacctggacgaaccctgctcagattacctggcagcggctgtggaggcggcgctgcaggtgcatcgccaggagctgccgggcgacatcctcatcttcctcacgggccaggacgagtgccaggcggcggtgcgcctgctcgaggaagaaagccagaaatcgggccacaggagcggccagctgaggttgcaggtgcgcgggcaagccctcggcgatgtgcgtggagagagggggcgcattcctgctgagtggggcgggatgcttgagccatgatggatggagtgtgcgactgggccagccgcctcggcatcatgcatgcatgcctgcaaacgtgatacactctcccacaccgaccctgctgttccctcacattgagccacgcgcccactccccaccaggcgatgccgctgtatgccgggnnnnnnnnnncccggcagcctcggcgccatgcatgcatgcctgcaaacgtgattcactctcccacaccggccctgctggtccctcacattgagccgcgcgcccacaccccaccaggcgatgccgctgtatgccgggctgccggccgcccagcagctggaagccctgagcccagccccacgaggggtacgcaaggtgagcaagggtgaagccttggtacagatggtggggcttgttaggggaggggcgtggcgggtggctgcatgatgacaatgcaaaatctcaaatgggaagcaaggatgcaatccggtttggacagacagctgccctggccgcccgcacttcttgccagcctgcgcatggatgtccatcaagtgggcacctcacacccgcggccacgggcaagccccccccctcctacaggccatcgtggcgacaaacatcgcggagacgtcgctgacgctggagggggtggtgtacgtcatagactcctgcttcgccaagcagcgcgcctacaacccgctcacgggcctgcagagcgtcctcatcacgcccatcagccgcgcctcctccgcccagcgagccgggcgggcgggtcgggtcaggcccggccacgctttccggctgtgcaccgaggctgggtgggaggcgctgcccgcagccacggtgccggagatgcagcgctgcgacctggctggggctgtcctgcagctcaaggccctggtgggcaggggttgtgagatcctgggacaggagagggagggacctggatgacaggctcgggagtgagggtggcagggcttcatggtccttgggaacaaggggaccccacttccatctgagctccttcttatggtggcaaccccttctgtcattttgcttcttaagcaggggcatggtcggttacacggtagcaagacgcaggcgaggcaaggatcacacgtacccattcaagccatctgccttgcacctaacagggcattgacaacatcatgcggttcgnnnnnnnnnnctatccaagatgctcctggagggctgcagccgaggctgtgttcaggtataccatcgagcctaggcatcggtcgtgagccacccacagtggtccaagggggccgtaccagcaatcagctgacgtgtcaattctaaaccctgagctccatgcagcagcaagaactcgtctccacgctggaattctttgccgcttccttgttgattgcaggagatgctcaccattgtggcnnnnnnnnnntggttacgcggtagtaagacgcagacgaggcaaggatcccacatacccattcacgccatctgccttgcacccaacagggcattgacaacatcatgcggttcgagtggctggcaccgccgccgccagagaccatgattcgagcgctggagagcctgcatgcccttggggcgctaggcttggatgcaaaggtgactggcttggggtggcgactggtggtatggcaggcatgccaatgcctagcaggtagtcctccagctccttcttccgaggcctctaagtatcctcaatccctcctccatgcgctgcagttgacagcgcccctggggaaccacatggctgccatgcccctagaccccttcttgtccaagatgctcctggagggctgcagtcgaggctgtgttcaggtatagcattgagcttaggcatcggtcgtgagccatccacagtggtccaagggagccgaaccagcaatcagctgacgtgtcaaccctgcaccctcagctccatgcagcagcaaaaactcgtctccacgctggaatttttcgtcgcttccttattgattgcaggagatgctcaccattgtggccatgctgtctgtggagagtgtctgggcacccgggaacaaggtggaggtggatgaggcaaaagcaaggtgaggtgctttgtgcaatgtagggaaaggcctgcggactggagtatgtaaggcactcctcgtgtttgaccaacagcaccaatgtcaagcttcctgcatgcagattacgcgatatctttaccaatcctgctcatgcccagcctccatgcattgtgctcaaccctcaacccccccaccccctctaaattcatgcagatttggggtggcggagggggacctccccnnnnnnnnnnggcaatgtagggcaaggcctgcggactggtgtatgtaagacactgctaatgtttggccaacagcaccaatgccaagcttcctgcatgcagattacacgatatcgtcaccaatcctgctcatgcccaccctccatgcattgtgctcaaccgtcaacccccccaccccctttaaattcatgtagatttggggtggcggagggggacctccccagcttcttgaacatctggaaggcctggctagctcgtgtgcgggacaagcgctggtcgtacaagaactacgttagccaccgctccatgcttcgagcaggtcggtggcaagggttgctctctgccatggcagtctgttggtgtgtcatacccatctcagatctgcctcctggcaacccctcaaaacatggatgccatgcctgcacaccctccgcatcagcctccctcactcaagcatccatgttgccacgccattctatcctggctgcagccgacattcgtttccagctggagtcgcacctgaagagggcaggcctggactggaggtccacagccttgggtcctggggcacagggcgacgcagcgtcagggctgctgactgttcgcaaggcctgtgctgctgggctgttcatgcaggcggcccgactcacagaggaactcgtccttgataaagcaggtgggatttgtgctttgttgtgcgtcgtgctttgtctcctctggggaaaaggtgtgtgtattcatgtatccggacgagaagagagtgggccagacgatgtgccgcctgtgcccatccggcctgattgcgacaagcgtgcacagtgtcaagtatcagccctctcacctcgaccagatgctcgagatgcgggtgccagcgtgtaccgcctggtccgatctggcgggggcgaggcggctgccgcgaagctgcgcatacatcattccagcgtcctgttccgttgtcggccatcctgggtctgcttctacggcgcagagcagaataacactgggtggtgcgcagagggagaaaggggggtgggggggtaaagggggggggggcattgcagtgttctgtgccctctgctgatggctctccgacgactgccaggaatttattgcatcccaccttctcacatctcattgttcattcccactgattaacatgccaggtatgagatgagggacannnnnnnnnnggtggtaggggggggggcccattgcagtgttctgcgccctctgctgatggctctccgacgactgacaggagtttattacattcccaccttctcacatctcattgtccattcccaccaattaacatgccaggtatgagatgagggacatcgccgtcatagaaccagactggttaacagaactggcaccacacatgtatgccatggtccatgcgcaccgacactgacagacatgtcacctgaaatctagagactgatagggtcatggcttacagtcgcatgttcaggttttgtattaggattctcacggctcatcgaaggtgtgaacaatgacaccaagttgcctccaaacctgaccgccgcacgcccaacagcacgaaacccgtgggctatgtttcgcatcctgtgttccttgagcatccctcgagcatagacaaccaccaaaaaaccacaaaatattacttaacaatctcatcaggagggtggcgagcccgtctcaacccccgctgcactctccgtgatgctggcccgtgctcagcggctcgcggctgcgggccagcctgcgtacagtctccttagacagagctgcgcagcatccacggccgcagctggagaggcatcctcctctggacggtcgccaaacctggagtttgctcgcagtcgcgccagccacgcgaaggagctctccgagctccgcaaggcttgggctgcggacttggctgtgcagcaggcgaagaagcaggcggcgcgagatgctgagaggtgggatgggacatgtggcgatgaagagggtggctggctgagcgtcttgatcagctgatatcattcaccccagtgcaagcaccatgggccacatcccccatcatgcagggccgccagggaagctcgccaggcacggcggtcaggagtggatgtagccgataagcaggcgagggagtctgcagcccagcaggcgctcgcagccgccaaggcggccaaggtgcggtgctggtgatggacactcgatgctcgagtgttgctggcatccgcagagtgcatttgatgctgggtgcagtgcagtgcgtttcnnnnnnnnnntgtgttggtacggactctgacagagcatggaccccctcacccactggctggccgcagatagaggagaagaaggcccgagcgcatcgacagctcctccgcgaggacatcatcaagtttgcgcgggaagaaaggtgcagtggcatttgcctgtgtggggctgcggtctggcctgagcttgtggtgaatctagatgtcgaaatgtcagcagcgcacgcagactgtacannnnnnnnnncatggggctccggtctggcctgagcttgtggtgaacctagatgttgaaatgtcagcagcgcacgcagactgtacagggagcagaagctgggttgaaaaacccatgagcggcacccactaggcatacacaggagggtccacgacgctcgcattctcaaaactgtgcagggcggccggcttgctggaggccagcaggaactggattgcccccgagaccctggaggccaggatcgactatgctctcgagcacccggtcccactcgtggctccccccactccaccgcattgagcacagcatgggtcgcagggcagcaggctcgaggatgaggcccgtggatggggctgaggacatggggctgtggcatctggcctcgtcggcgccgggtcggcccagccgaccgatgggtctacggggggaccctccccccatcgcctaggcggccttgctcttgggaatgatgactctggacccggccaggttggtggtcaccccgcccttcaccagccgcctctcctcagtgatgccctgtgcggcgaatcgtggggttttgggggtgagaccgcatgcgctcccgtcctgcactcatgtaatggcagagcgccggcacaggagctaccccctgaatggcgttgggagagagcggcatgttcaagagcctaggcacgcatgtctgaacctcttgcgctcgcctcgcgcctgctcgccaaccccaccccccacctgctccacgagcggcgccctcagggcggcggccatggcctgcctcacgcccgcggcgnnnnnnnnnngctcttgcgcccgcctcgcgcctgctcgccatccccaccccgcacctgctccacgagcggcgccctcagggcagcggccatggcctgcctcacgcccgcggcgtacgcagccgggtccgccctctccttctggctggggaagtaggtgggcaggacctggatggtggcccggttcaggggctgggccagcaggcggtagacatggagtggggtggagggcacaatgccccaggccgggttgaaggcgcggtgcgggtaggccaggaggatggggcagaccgggtgcccgctggcaaacgcgccgcgcctgaacttgagcaggcactgcgcggccttggtggtggcctctggggccatgaccagcatgggggcgctgtgaggggggtgaggaggatgggggaggggcgtcgcaggtgcacttggcaggggtgttgagcaggatgggggaggggcgccgcaggtgcacttggtaggggtgttgcatgcgggaccaggcagggaggcacgcccttgccccttcagatattgaattccccctttccacccagccccttnnnnnnnnnnnnnnnnnnnnnnnnnnnnnnnnnnnnnnnnnnnnnnnnnnnnnnnnnnnnnnnnnnnnnnnnnnncacggcgtcccccttgacggtgtgcgcgttggcgtggtcggagctgccgcgccgctccacgaagagccattgcatcgcgcgcgcaaaggcgccgatgaagggcaggttggcgacgccggccttggccacgccggagagcgggatgagggacaccaggagcaccgggtccacgtaggacaggtggttgaagatcacgatcgcgcggctggcctgtgagagaggtagggggggagtggaggggaggggggggaatggggcatgagctagaagtgaatccagtaccagtagggcctccgagggcaggaactcttgccaacaactgctgctgcctggtacaggcggggggggctttcgaaggcagaaggccgttgcttcactacaatgtatgtgagaagaacttcagagcggccatgtggatcctgcatgaaaccgaccgaccccacctttgcctgcttcaggtgctgccgccccgtcactttcacattgaagaagcccgagaggaagagggccacgtggcagagcacctggatccacgactgcacgacggcgtggcgcacgccgtggccgccctttcctcctccggggagcagagccatgagcgcagccatcacgatgtagccggtgaccaccgtcaccaggagcaggagcgtctggaaatggagaatggaagcaggggttcaggacaggggccgagcagcaggggcaccccctgcatctgaccatgcagnnnnnnnnnncggaagcatgggctcgggacagggggcgagcaacaggggcaccccctgcatctgaccatgcagtgatgctgaaacaacccatgtccatccactcaaccctgcccagcacgcactcggaggaggaccaccgggaacatgaggatcagcttggcagcctcctgaggagtgatggggctgtcggtgtcgatgaagggcgaccccgccgccagttcctccaggtctgggacgtgcggcgggttgggggccgacagcggcagcggggaggcggcggggtctgaccctgccgcgccaccgacatgccggccagcacggggagtgctcggggacttgtctctcttttgcggcgtgcccgcagctgtttgtgacgcctcccgccgccctgccgttggccgcagtcctacatcggcttgggacgtcgtttccggggcctctggtgggtgcaggccctccagctcggcgggaagaggctcccgctcttcatcgctgctggtggaggaggtgtcgatgtccagcggccgactgatgctcagcacacgctgtacctccaccctacggggcggaggtgcctgctgctcacgcccttgggacttggatccggagcgcagcggtcgggcgattgccttgaacacgcccttgatgcccattcgatgagccccggggttgtgagtgaggttccaggcaccaatggtagctagatcactgggcacgatagtctcgtgaagcccggctggttaattgatgagcagatttgcgttcacctgccnnnnnnnnnnaaggttccaggcaccaatggcagccagatcactgggcacgatggtctcgtgaagcccggctggtaaattgatgagcagatttgcgttcacctgcccgacatctctttgcgtgtgatgctgtgtaggacgcgtattaataccgagttgttatgagggcctgctgcagtggcggcattgcgtgagtctcgtttcgccgacgcgcaggagggggacctacctccgtttgccggtgcctctggggatnnnnnnnnnngccgagttgttatgagttcctgctgcagtggcagcattgcgtgagtctcgttttgccgacgcgcaggagggggatctacctccgtttgccggtgcctctggggatgctgctcggaatctgagtgctagactgcaacaggaacagaaggggatctggtgcgcctttcccggttgcagggatgcaaaaaccgatcttatgaatccagatcgaccaacacatggcaacatgcagcatatctcttgaagtctgcagcgcagatcggnnnnnnnnnnaatctggtgcgcctttcccgcttgcagggatgcaaaaaccgatcttatggagccagatcgaccaacacatggcaacatgcggaatatctcttgaagtctgcagcgcagatcggttacggtcaggaaccaagaagcactgccagtctttgaaatcgaccatctgccttgtcttctcccccattagcactgggccataggtttctcgattttagagttcgtgcaaatgctgtaatggtagatgagcttatggtgtactgcaatgttccaagtacgttggctcataatatggccagagtatcttgagcaccatccatgtcgcaagaggcatannnnnnnnnncgcttatggtgtactgcaatgtttcaagaacgttggctcataatatggccagagtattttgagcaccatccatgtcgcaagaggcatactttgacaatcaggggaaagaggaacgaataacatatttctcttcattttcaagttggaaggtggccgtcctacgagacgactcctgtcaacccaacatcatnnnnnnnnnngacatatttctcttcatctcaagttggaaggtggccgtccaacgagacgactcctgtcaacccaacatcatcataacgatggccacgacacgaagatttctgtccctcgccctcgtgatcgctcgatcgccttcgactcaaccattccccaatcccccatttcgactgatcaatgctagcaaccaccgttaggtgttttgcaccacttggcattcgcctcagcgcacggtacggaacggggcggggccggagttgctgtttctgtgccggctaaagtagggctccctccccgaccattcccacatgcccccaaccaggaatcctagttcattatacgctcggatagacgtgcggaccatggcttccggaaaggtttcagtccaggaggcagcaaagctttcggaggagggaaagtacacgtacctggacgtgaggtgcgcatcctcaacacctgcatggaggcttgcatgtcccggtgccgcgatagaaacatttcaatatctttcgctgcatccatgccctcgagcaggaccgagaaggagttcgcagcgagccaccccaagggtgccagcaacatccaatgggctttcgcaggggacagcgggttcacccccaaccccgactttgtgtcagaggtgctgtggggctccatgttgggctcctgtcgaggacgaaccaatgctctcctgggcaaattcagtttgtctggacaccgcatgggctgtgcagcatgccagtgggcattgggaggccatgtgtacatgcatgccttaccaaggagccacacaagctccatgcgtgaccacgatccgcacccaccctccttcctgaccttcaaccccaccgcctgcccaggtgaaggccgcgtatgaaaacctggacacccccctcctcatcgcctgccaggcggggcggcgctctgccgcggccgccgcggccctggaagcggcggggtacacccagctcaaggacgtggagggcggcttcggggcctggaccgctgccggactgccgaccgagtcgtgaaggggcctggtggtcgagacgtgcagaggccgggcgacggcttctaggcctcgaggatggcgggggggcagtagagccatacttcctggtgcacagcagggcccttctggagttgcatactgactgtttgcatggtctgatacacagtgctgccaacgcggaattatgtatgggtgcaagcggctggatggagcttgctgcgagagccagtctgctgtcgagggctgtgaggtgcttggcgggtaccctacaaaaggtgctgcgccctggacagcacgggaatcacagggccgccgcctctacatcgtccgcagtgtgggcctccgcgcgccggcgcgcggcgnnnnnnnnnngtatggtatgggtgcaaggggctggatggagctcgctgccagagccagtctgctgtcgagggctgtgaggtgcatggcgggtagcctacaaaaggatgctgcgacctggtcagcacgggaatcacagggccgccgcctccacatcgtccgcggtgtgggcctccgcgcgccggcgcgcggcgctccgtgcgcaccgccccaggaagtccagcgccttggcgtaggcggcatcggagcggtcggtgggcttgcaggcggagatgtggtcgtgggaggggagcacgaagaattcgccgtaccccggataggcgctctccagcggcaccaccagcgtcttgatgtaggccacccgcgtcggcttgccctcgccaaaggaaagcacggccaggccgccgcggcggtgcattccacgcaccgcagcgttcacgtcctccaggtgcagctcgctggtcttcagatgcgccacggcgcccgcggggaagccgcccacgtaccgcagctgccagcccaggtccgccaggcgcgagccggagtggggcacagcgtagctcaccaggcctagcgtgttgcaagccagcctgagcgattggaaagagggaagggaagaggggagggtgaggagttctgggtcatgctgggggtgggggatgggcagggggcgtggcgacattgagcgggacctgtgggaatggaggttggggcgcacttccggtctgcagctgggcaggccggcgggcggcagcccaccttgtgtggtgccatctctctggcaccactgctcagtggggggtggggatcgcatgatgtagcatcctcgagtcaccccacagccgctaggcggcgcaccactgccgtccaccccacgcagatcccccccatgcccttccccctcctcccgcccgccgcacccccccacaggaaacacactacacactcccccaacccccctcattacttgtgccaggcgtgcccgttctccttggcctgggcttgcgccaggagctccttgaccagcacgccgcccatggagtggcagacaaataccgtggggcgcgcccccacgccggcgtccaagagcatgcccgccagctgggccacggtgtgctcgaagggcagcgactcgccctgcgattgtaaagggtgggtgtagtaggttggtcacggagatatgtcaaggtggctgacgctgccggtgcgagcgtcgcagggtccaggggagttggtggtcctgacacccacgcaaccgctccagctcagcgtgggcagcatcgcgnnnnnnnnnngaaagggtgggtggagcaggttagtcacggagatgtgtcgaggtggctgacgctgccggagcgagcgacgcagggtccaggggaggtggtggtcctgacgcccacgcgccgctccagctcagcgtgggcagcatcgcgatccctccctccccccccccaagggcccctcacctcccacccactggcaggagcagcatactccacggtcagcaggcgcgcctccggcagctcctcggacagccaggccgcgggccagcaggcgtggtgctcaaacgcggcgccctgcagaggtggggagggaggggggagggtcatgacagacggggagcgtgggggacgagtacgagtgtgcaggggattgcagggacccggtgaaaccccgctcccaccccgctcaccttgcccgggcgcggtgagccctcctggcgccacgtggcaaaggcgccgccccggatgccgtggacgaagaccacgtccatcagcggcgtccctggcaggtgttgcgtgcagggagggggaaggtagggtgcgcgaccccaagcacatgtgatgagcccctgaccgggaggnnnnnnnnnnggtccctggcaggtgttgcgtgcagggggagggggaggtagtgtgtgcggccccagcacatgtgatgagcccctgaccgggaggggcagtcgtcaatgaccccgcacaagccctccatcatcagtgcatccctccctcacaccacacatcataagagtgcaccccccgcccaagtacacaaaaaacacgaccccgggctcaccagggcccgtggcgtcccnnnnnnnnnngcgccacacatcataagagtgcaccccccgccaaagtacacaaaagacacgcccccgggctcaccagggcccgtggcgtcccggccgcaccgcgccagcacggcgtggtgctcggcgccggggacaaacaggtgcatgccgtcgcgcaggacgaggcggcgctcgccgcgcgcccccgccccgcccgccgcgc

SEQ ID NO: 37390 - DNA, 70 bp, Chlorella protothecoides
gggcattgctgcagtgcagggtgccctcccttgcccacttacctcacgcagggcggcatggttgagggtg

SEQ ID NO: 37391 - DNA, 95 bp, Chlorella protothecoides
tgatgctcatccaatcgcgggggctgggcaaccctgtagatgaatgactccatgatgcgccgcatcacgacccccttcacttcccgcacggtcgc

SEQ ID NO: 37392 - DNA, 67 bp, Chlorella protothecoides
gatgagccagctgctgggactctgggtgagcaggggtgcggggagggagtggggtaagggaacagca

SEQ ID NO: 37393 - DNA, 1962 bp, Chlorella protothecoides
  modified_base (214)..(223): a, c, t, g, unknown or other
  modified_base (638)..(647): a, c, t, g, unknown or other
  modified_base (1123)..(1132): a, c, t, g, unknown or other
  modified_base (1494)..(1503): a, c, t, g, unknown or other
  modified_base (1587)..(1608): a, c, t, g, unknown or other
tgagagtgggagtgcttggagtgggagtgcgaagacgggcgccggtcggtgcggcgacggctgacagaggcgccgtgactccgcccacgtgcatggggtggatccagcctaccccgctctcgtgccgtcgcaccactggatgactgaaatgctctccacacccttccccagccgtccctggcaatgagccctcgacgcacactcataccacctnnnnnnnnnncaagacgggcgccggtcggtgcggcgatggctgacagaggcgccgtgactccgcccatgtgcatggggtggatccagcctacccagctctcgtgccattgcaccgctgcatgactgaaatgttctccacacccttccccagccgtccctggcgatgagccctcgacgcacactcataccacctccagggccccatccctgcgaccctcacaccctccctccaacccaaaacccacatcccgcagccgcgacaaagatctggtcgatgtcctgcacgtccaggatgagggacatgcagtcctcgatcatgatgcgtgcagccagcagcggctcctgatccaggcgccggcgccgggatcgcgccggcgcgcccggcccggcctctgcgccctcctccgcgacacccggcccgccgnnnnnnnnnnggccagcagcggctcctggtccaggcgccggcgccggggtcgcgccggcgcgcccggcccggcctccgcgccctcctccgcgacacccggcccgccgcccagctccatcagggggcgcgggcggcggatgttggagaagggcacgcggcccagaccgtccaggtgcacgaatgccacctggtcggcgctcagcttctccgtgggtgccagctcgcgcactgcggtgtgtgcgtggggggatccaggtgggcggcggcgcgggaggaatgggatggtgggcttgctcgagactctgaccgacggcgggtgaggtcgagcagagaacatgcagcaacactccacccctcctggtgtaaacacaacactcagacgacttctggaccccttccatgatcatctggtgccaccccctggcccagtcctcgatctcacccacttccccccgccccaccacaggccatcacccaccagactcnnnnnnnnnnagatcatctggtgccaccccctgccccagtcctcgatctcacccacctccccccaccccaccacaggccatcacccaccagactctggggcaaagaagcgccggttcttgcggttgtagtacttgtagacaaagccctggaagtagtagtcctcaacatagggtgggccctgctgcaggccccgccactgcacgcagggagggatggggatgtgagtggcaatgcgtggaggtcggccacgaggatggccccccctgctgggcaaggtaccggcttgtcgcatcggctgcctgctgggccgagcaccgatggcccgggcatccagtcgccaggttcctgcaccactccgagccgcccaccgnnnnnnnnnnctggaggtcggccgcgaggatggcccctcctgctgggcaaggtaccggctagccgcatcggctgcctgctgggccgagcaccgnnnnnnnnnnnnnnnnnnnnnncggccgagcgcgaggtcctgggcccgatcctctcccgtgctgcggctgcgccgacctgtggatgggcagggggaaggcgtggtggtcggatgatctgtgaaacagcctgggccacatgcaagggctggctcgcacaggcatgccagcaagtgaatcactcccagaccacggtgtcctcaatctccgccatgagacaccccacagttcctatgaccccacctgtcagcgagggtgaggccctgcaggcgctgcgcgatcccgggctgctgcgggcccgggccctggggcccagcgccggcggcggcaggcctggcgaggatggccggcgcgcccgggcgcccgggtcggggcccc

SEQ ID NO: 37394 - DNA, 126 bp, Chlorella protothecoides
gactgaaaggcaacggcagggaggccacttccccgcccattggggctcgtcctgcacaaccccttcaccatgcaaatcccagtctatcgcaggcctagacattggcaccctgcaaacaccccccca

SEQ ID NO: 37395 - DNA, 61 bp, Chlorella protothecoides
cgttcggtccagggcaccatagtcccgcccaggcaatcccctggcagggaccacggcatgc

SEQ ID NO: 37396 - DNA, 4178 bp, Chlorella protothecoides
  modified_base (126)..(135): a, c, t, g, unknown or other
  modified_base (529)..(538): a, c, t, g, unknown or other
  modified_base (954)..(963): a, c, t, g, unknown or other
  modified_base (1789)..(1798): a, c, t, g, unknown or other
  modified_base (2968)..(2977): a, c, t, g, unknown or other
  modified_base (3830)..(3839): a, c, t, g, unknown or other
tcgggcaggagcacggcgtccaggagcagaaccggggtcccgcaagcctcgccctgctcaatcacgctcgctccagtcaccaggccctccaccgcggtggcgccctccccggggccctcggcgaannnnnnnnnntgggcggctgacgtccttcccggctgccagcgcgtcgagcgcgtcggggatgtccagggagctcgtgccggccagcttcttcagctggtcgggcaggagcacggcgtccaggagcagagccggggtcccgcaagcctcgccctgctcaaccacgctcgcgccagtcaccaggccttccaccgtggtggcgccctccccggggccctcggcgaactcgaaggtggccttgtagcctgccagggcggtatggacggggacgtagagggcgtcgccagtcgcgttcaggtcgggcgtggccaccacatggtacagcaccaccgagttgatctggaaagggggcatgggaatggacgaggggggaatgggggggtggagagaacaggctgtgagatgnnnnnnnnnntggggacgtaaagggcgtcgcccgttgcgttcaggtcgggcgtggccaccacgtggtacagcaccactgagttgatctggaaagggggaatggggagggacgagggggaatggggggggtggagagaacaggctgtgagatgggatgcctgggtgcggggcgggggcaggcgccatgggcgagagaagatttgaagggttgaaacagctgatcaacggaagcaagaagggccatgtggggcagagggagctcgcggtgtagggggtgggcgctctcgcataccatggcccacatcaacagtgccccctggggctgcccctttgcccatccagccaacgagaccttcgcaccaacttctttaggtggcggtcctgggtggcattcttcatggcactggtgatggtgctgaaacccannnnnnnnnngccgcggcgcagccggccatgaggccgcgcgagtaggcgccggcgtccacgccgcgctcgcgccaggcgtagaccccgtctgacacgcccaggcccaccactcccgtctccgaggcgtgggtgatgaagtacgcgtcctcgccgccgtgccccgcgccgcggcggttgactccgcgcacgccctccgccaccttctccgggtgcgggatggagaaggcggaggcggccaccgacatctggctcttcaggttgtaccgagggtccatcatggaggacaggtgcaccgtgagcgggaccagtacgcgctcgggggagcctggccgggaagggggggagtggagagcggggaggagggatggttggggtggggggcgatggaagggtgcagggtgtgctcatggggtgagcaggcactgcacaaagggtccaggggcaggaggggcagggaaggagaggaggcccacccatgaccgcatggcaggcacggcgtctcccgcgcaatggaacatacgtgcacaaccacgacccctacctattgcctgggtcacgtggtcacggcccagccactcggcacatgggaacgtccagctgtcgccctctgggcccaccaccacgatcctctccaggaaccagccagagctggcacccgcctcttcatctgcaaggggacaaggatggggagggacaggtgaagacaccgactgtgcccggtggctgtacgccaggtcccacgacttgcaccgcaactgattcaaagttccgccgggctccaccagcacccgacgcatcaacccccacccacatgcacacctgccgcatccagggnnnnnnnnnnggagctggcacccgcctcctcatctgcaaggggacagggatggggagggacaggtgaaaacaccgactgtgcccggtagctgtacgccaggtcccacgacttgcaaccgcaactgattcaaagttccgccgggatccaccagcacccgacgcatcacccctcacccacatgcacacctgccgcatccagggggagctggcgaatcagcaccctgttcagctggccaaggtggggggcctgcaccacataggtcttgcgggaggagctctcaaaccccatggtggagccgtcactgccaatcaggtacggctccgactcgccatctgcaggagggggggtgggcggggttgggggtcgtgtgccagcagccatccgaatgcagccgctgaccctcagggagagccctgcgtggccttgctccccgggtcactgcagcccaaagggtcagtacattccccacccctccctcgtctggtcctcaccttcaccaaatagctggaggagggcgggagtgggcgtgcctgcgccacgcacgctgcccgtgacgatctggatgtggtaggagccttctggacgattcgcttccttccctgccaggctgtgctggagcctcgggagtggtacctgggccgagatcgtctcgcgcgcttggcgtgcctgccagtcgggcttcgccaaggcaggagcgtccagctgtgccaggtccgcggctggcctcgccaggatccgcaggctcgagagcaggccctgtcgtatcctgagcacgctcctcagagccatggccgtggagggtgtggcgtgtcaggtgctcatcgcccccaaggtgggaacagggaggggcccttggcccgcaagcctgctcctcaccactcctggcggagcgacacgagcaagacgagggcgcacacagcgagtgccggtcccctgtacatcagttgtgcccccacgccccagtccatggtgatcgtgggtgcagatccaagtgctggggttgtctcgcacacccgcgaatgtcgcgccttgacgggccggggtcgattccccggcactcttcatccgcagctgtgtgagtcgttatttgttacaggaatatggttggcaccaaaccgcaaaggggttgtgttgaaaaagtcgcgctgtaaatttgtgcctttttggacccacccactnnnnnnnnnnagcactctatccgcagctgtttgagtcgttacttgttacaggaatatggttggcaccaaaacgcaaaggggttgtgttgaaaaactcgcgctataaatttgtgcctttttggacccacccactcgtcaagcaccgggagtcgacccacgtccgcgcccacaccatgctacgcgtttccgcagccctgctgctcgtctgcctggccgggcctcacgtcttggccactgcagaggtaagaagatgggtgcactctgcttcttcgggttatgggctcacttgcgttgactctgaccagttcggtacgactcggttagcttgaaccgggcacgtccgacaggtcttacttggggtcacgctggcccccaccctttcttgatttggaccatctagcgtgcgaacatcttctccagttaacccaattgacttgttgactgcctcgggatgtgcctggcgctgcccctcggaggtcagccccgtccggagtacttcgccgtccggctggcagctcagtcgcagtcggacacggacccaccacccttcctcccgcccgcgcggtccccgcaggtcacatgttccatcacgagtgagctgaaggatagcttcggggctgaggacggcactgccgccagcctcgtgctgtcaagcaccctgctgggccaggtgtctgagctgcccagcgggaccaccctcctggtgcccagccggcaaggtgcggggttctgcaccctttcttccatggggggtcaggcttatttggaagacctgacctccatgtcatggccatggcaatggcagggtgagaacctgagaatgtgcattcatggggtccggtccagcttccgccaaacacagnnnnnnnnnntcctttcttccatggggggcaaggcttaattggaagacctgccctccatctcatggccatggcaatggcagggtgagaccctgcgcatgtgcattcagggggtccggtccagcttccgccaaacacagcccgccaacccttcaccccgccctgccccgcacagcctggctggagttcttccatggcctgggtttcagcaccatcaccagtgccatgagaaatgccacccaggaccgccacctaaagaagctggtgcgaaggccttgtttgctggatgggcaaaggggcagtcccagggggcactgttggtgtgggccatggtatgcgagagcgcccacc

SEQ ID NO: 37397 - DNA, 77 bp, Chlorella protothecoides
gtcccttaaaacatggaagggaccctggaagttactttgaaatctctgaagtttgcatgcaagctgatgcgagcctc

SEQ ID NO: 37398 - DNA, 61 bp, Chlorella protothecoides
cagcagcgccacctgctcctgcagcccacgcaggttctgcagcagcgcctccacctccgcg

SEQ ID NO: 37399 - DNA, 9252 bp, Chlorella protothecoides
  modified_base (400)..(409): a, c, t, g, unknown or other
  modified_base (851)..(860): a, c, t, g, unknown or other
  modified_base (1765)..(1774): a, c, t, g, unknown or other
  modified_base (1834)..(1843): a, c, t, g, unknown or other
  modified_base (4521)..(4530): a, c, t, g, unknown or other
  modified_base (5628)..(5637): a, c, t, g, unknown or other
  modified_base (6617)..(6626): a, c, t, g, unknown or other
  modified_base (6874)..(6883): a, c, t, g, unknown or other
  modified_base (7362)..(7371): a, c, t, g, unknown or other
  modified_base (7802)..(7811): a, c, t, g, unknown or other
  modified_base (8351)..(8360): a, c, t, g, unknown or other
  modified_base (8690)..(8699): a, c, t, g, unknown or other
gccagcgcgtcgcgcgcctcctgcgcggggtcggcgcccggcacggccccgccgtgcgcggtgcgccacttcttcagcgccgcggcgcgggccaggtcggagccgggcttgcgccccgccctgacgccgcccgaccgcccgtactgccccgcggtgtggaagttgccgggcagcttccccgtggccgccgcggccgcttggcccttgtgcaccacgcgctcgtccagccagcgcaccaccgccgcctggttgtggcaggaaaggggggctacgacgtggaaaacgccctgcgtggagtagtcgtagtgcccgtcccgcgtctccttctcctcccctggggggttgggtgggggaaggggacaagccgctgttgggcatcatgcagacgcaggggtatgtnnnnnnnnnnttccttctcctcccctgtggggggtgtgggggaaagggacaagccgcagttgggcatcatgcagacgcaggggtatgtgccggacctgacctgcatcctgtgacaggctgactgacattccaccctgcctgatgtatgccccatgcggcctgccggccggcccaaagcaatctcctccgtgcaagcctccctgcaacaacaggactcacaaaccccagaacaccaccaacagacacacccaccaacatggacacccaccagagatggcaatgtgctccttgccaaagacgtccaccaggaaccagcacatggcgtggcgcccatcgtccagctccgtccgctcgtgccttttgtattttttttgttggggagggaaagagtgaaaagggctcagtgctgtctgtggagagttctcataccaggtgcgcagtgggggcaaggnnnnnnnnnnagtggttttttgggggggggagagtgaaaagggcttagtgctgtctgtggagagctctcataccaggtgcgcagtgggggcaaggagcacacgcgccgacccctccaaatgaggcccctccacccccctttacacacgcccgtgcaaccacctgtaggccacaaaggtgggcaggcggatggaggaggggtcggtgggcacctcatcctgtaccaggtccaggtggtagccggcgcgcagctggctggccgccatcacgtcctccagccagcgcttgacgtcctgcttgttgtgcccgtacagacccgggaacccaggctggttgctgtagatgtagtgcgcgtcgccctggtcctcgcccaccgccgccaggtgctccagccccgtggcgtccaccaggaaaaacttgatctggtagacgtggcccccggtcttgcgcccgcccttgttggacacgtgctcgcggcgttcagagtaggacacgaacacagcgccgccgccggcgggggggggggcaggctcatccccgttgcctggcttggagggggccttgtgcttgggcgggggccccttgccgggggagggagggccgggggccgcctcgtcgggcgcggagtcatctaccatcatgggggcgggctctgcttcggacgacatgggccgctggcgtgatgagtggctagtggctggcctgggtcctgccgcccggcaacgatggggcctattggcttgcggccttgggggagccctccttcaggaacacaaacgcctttttgtagtcgggacgcctggcggtgggagggccaggggcaggcacaccgctgagcgctttccggagcgcagcgaaagtctgcgtggcctctaccttccacaaggtcatgcccagggccgtcgctccaggagtnnnnnnnnnngccgggacagaggtgaacaaaccttgtttgccttgggggtggtgcggaacacgagctccnnnnnnnnnngagtctgcgtggcctctattttccacagggtcatgcccagggccgtcgctccaggagtgatcaactcaaaactcacccactcctcgcacctgtaaaacccggccttgccgtgcttcttgcggcccaggtagttgcaggtgttgaccttctccaccgacaggccgtataccttctccaggtgttccttgatctcggcctggcaagggaggggtgcacgcacccgatgacagagccggagaaaggcatactgggggcgacatggacgcccaccgggacaggggtgaacacaccttgttcgccttgggggtggtgcggaacacgagctccttcacggtgccggtagtctcgtagatggcttgctgcgccttggacagcgggtagagcttaagcgtcagattggggagtgcggcctgcaggcgtcgccatgacatcgtgtctcgcccgccacagttgcactcgctgcccaattggtcttccttggatgttatctgtgcccatgcaatcaatgaatcgcggattaattcttcatcgggccaggtgcagctccggcacctgaatggaattgcgcctggtggtagtttctacttgcagcaaggcaagcccgtgctgggaccgtgtgtcgtggtcgctgtgccatgcagtgggcctacctctctgaagagtacgccgcacagttcttgtgaatctagaaagtaattctgctgtagggctcttggatcggagtggcagtgggtggtgtgacgccatggctgcggacctggagtctggcctgctgcagagcatcgatgaggctggttccatccaagacaccggcgcctatgccgagtcacacagtgtcgatcacatggccctggtcggagtgatgaagagtctgctagcggccgagcttattctggtcgaggtaaggacagaggtgtcctggagtggcatccttgttgggtttagatgagtaggcggatggtacttgtgagtgttctccagagagggtgttattcacctcacggtagattcaatgggcgtgtctgtaacagcacgtcacctcgattctgtactggcaagggtctttgtgcctctccccaccagtgctgctgcactctgccagcactccatgcccttggcccgtttgtcccgtttgcaggatatcgatcactcacgcctggccctcaccgaggaggcgaggctgtacctggaggcaggttcgcccgaggcgcaggtcttcaacgccattcctgagtctggcatctcactggccgatctcaaggtagctagcgtttgtaggttcgcagacaggttttgcccatgggcaaatggattggacaccaggtcgtcagcaccctttcgcaagcgcgcactgcctcaccctttcaagcaacatgtctggtgcctggttgatcctcctgtcccaaccccatgccacccccaaaccactcctggtcaggccaagctcgatggcaccgtgggcgacgtgggtttcaagcaggccatgcaacagcgatgggtcgccatcagcaaggagggcggggcgcccctcgtcatgcgcaaggtgcccaccatccaggatgccgtgcagacggcgctggtggcagtggaccgggggcaggtgggtgcaaggatgggggcccaggccaaggggtggggggcaaggggatcaaggttcttgccagggaaaggcatggcttctgtatagcatgactacctggcttaatttgtacctcagacttcccctccaagatctctggacaggatactgaggtggccgccgccactgtggcagccctgaagaagcggaagctgctcacgacagaggcctggaagacgtaccgcctgaccaagggtattaaatttgcgcggcagcgtgtcaaggaagccaccgatctcacggccgacatgcttgccaagtaggtggttggcttggagtgtggggagagattggcagctgtgccccctctgtgtggcttagtgagctgatgtgtgacagtggttcagcatgtgccatgcacgtgtggggtcactgatacgctttgcagttgtgccgtttttgtgtcatgatgcgtcatctgggtggagggcccactccagcgccattccccctagcaggggaacatggagggatgcacccttcaaggcctacaactttgacgccctgggtctagcgccccctagtggccacctgcaccccctcctcaaggtgaggaggatggagtttatttgtagtggtgcttctggttccgatcctcagaagtattatgcctctttgctgcctgcctcgggttggcacatgctgccaggcgattatagtcgatggcagcaaatttagcttgccatggtgaagctgtgtgcctctacctttgcaaaatgcctcttcatcacgtgacctacagctgccaacccacctgtgatccctgcacaacccattcccgatgcactcccggcccaggtgcgcaccgccttccgcaagatctttgtgtccatgggcttcgaggagatgcccaccaacaactacgtggagtcgtccttctggaactttgacgcgctgttccagccgcagcagcaccccgcccgcgatgcccacgacaccttcttcctcacctgtgagcggggcttgagggtttgagggggtggtgaggtgggcgctcaatgcagtgtctcagggtcgcctgcttcctcatgcctccctnnnnnnnnnnggaggggttggtgaggtgggcgcttaatgcagtgattcagggtcgcctgcttcctcatgcctccctcctgagggcttgctaagtgccccacaccatcatacatcccctcaacttctcaccctcccgtaattttctgcccgctccccgctcccgaatctcacacaccatcccctccccccgctgctcccctgcaggccccgccacgacgccatgctccagcctgccccaggactacctggagcgggtgcgggagacacaccagacggggggctggggctccaccggctacgggtacgcctggcaggaggccgaggcggagaagaacctgctgcgcacgcacacgacggcggtgtcttcccgcatgctgtaccgcctggcgcaaaacggcttccgccccgccaagtacttctccatcgatcgcgtgttccggaacgaggcggtggaccgcacccacctcgccgagttccaccagatcgaaggggtggtggcgggggtggggctgacactgggcgacctcatcggcacattgaccgagttcttcgcgcgtctgggcctgcccaccctgcgcttcaagcccgcctacaacccctacaccgagcccagcatggagatcttcaggtggggtcgggaagagtggagaggccaggagggtgcgcaagggggtccaggggtgcttgcggggtgcccacacgcagggcctgtcccatggtcgtgaccgtgcgaccccttgtcgccgcccaccccacacactgacatgacaaacacgcacctcgcacccgagcagttactccgagcagctgggcaagtggatcgaagtgggcaactcgggcatgtttcggccggagatgctacggcccatgggactcccagaggacgtgaacgtcattgcctggggcctgtccctggagaggtgacttttggttggacggggacgagaagagcactgggtgggactgggacgggtcgatccgagacatggaggaggccccggctgcgatcagcggcgagcctgccaaatctcgccgacttgcaccacagcttgggccttggcagcgcgagacctcacgtcacgtcagcgtcaggggtcttcacctcccnnnnnnnnnntccagaggacgtgaacgtcatcgcctggggcctgtccctggaaaggtgggttttggttggacggggacgagaagagcactgggtgggactgggacgggtcgatccgagagatggaggaggcgccggctgcgagcagcggcgagcctgccaaatctctccgacttgcaccacagcctgggcctgggcagcgcgagacctcacatcacgtcagcgtcaggggtcttcacctccctccaccccttcctgctgtacccccccccccttttgacaggcccaccatgatcctgtacggcatcgacaacatccgggacctgttcggccacaaggtggcgctgtccatggtcaagcggaatcccctctgtcgactgggcctctgagggcgtgtacacagagtcgctcagtagtgcttactcgttgccagacgtgtgtgagcagcattgttgaagcttgtcggggtgtgcccgagctggtgtcacaagtatacagagcagcaacggcacaggaagcagagcactccttggaacctgtgcgaaatccagggagttcagctgggctgggactgagtacccattcagggcaggccttgtaggctggctgctgttgcacagccgtggctgactcaaagccgctaggcaacgccgggctcgtgcccctgctgcacattggcagggtcgcccgccggatccattggccgaggcagcaggaccttggactcgctggaaacggggagggcaacggttgcggcgttcttgagcaggtctaggtggtctggggagacgggaaaggtcttctccagcacgcccaccactgccggcagaccgccatccatgtacactgccgcgatcaccgcctcaaaggtctccgccagcatgtttggcgagggcccgcccgtgtctgagcacagggaaggacgggaaggggcagtggttcaggaggcgcgagtgatggcgagacgatgacgacatcagcctgtgtgggannnnnnnnnnagaaggacgggaaggggcagtggttgaggaggcgcaagtgatggggagacgatgacgacatcagcctgtgtgggagcgtcccacattcatcctggtcaacaccctggggtgagcctggagcgccagcgtcgatcacgcaacgcagcctgcctcgaaggctcctctttccctctcccccatcagtcctcctgtgctcatgcatccagcgtgctcaggatcatgccttgcacacgacatgcaaacccacnnnnnnnnnnccacgtaacgcagcctgccttgaaggctcctccttccctctcccccatcagtccccctgcactcatgcatccagcgtgctcagggtcatgccttgcacacgacatgcaaacccacctcgcgtgttccgcgacatgatgacataggacgccaggtctacctgccgcgccgactgctggaaggcggcgcgcgaaaccagggtggcacgcagccggtccagcacacccaggggcgtggcggtcaggctgccctgcaccgcccccagcacctgctctgtcagcaccagctgcagcaccgcatcgcccagccacgccagggtccggttgttggtggctgctgcggcgcactgctgcgtcaggctcaggcgcagcaggtaccggttcttaaaggtgtacctgccgaggtgcgcgcatgggcccaagggttgtagagttggcgcaggagggggggttgttcgtgcctctcacaatgtcagggattnnnnnnnnnnccgcgcatgggcccaagggttgtaaaattggcgcaggagggggggtttgttcgtgcctctcacaatgtcagggatttggcatgagagtcgctgccgacctcgtggcaaacatgcccctcgatgagcccacactacactgcatcaactaaacacccaacctctcccaagcacaccgccacccaaccacacagagctatgttactcacccgagcttgccctggagggtttcatactccttgggcgtgggctcacgagggggctccagcgccacatctgtgaaggtgattgccctggccaccagactcacctggaggccatgcgagcaggtgagggagtgaccgctgtacattgttggccaggcgtgtcatcgatgcttggtcgtcaaaccatgcctgcaccgggccaccttcttggcttggccattattcgtnnnnnnnnnnccatcgacgcttggtcgttacaccatgcctgcaccaggccaccttcttggcttggccattattcgtggcccagtgcaaagaaggacccaccttgccctcgatgcgatcccgcagagctgtggaggcctttgtggcgtagcatgctgctacatcggggttggcgtgtgctcgacaggcagcgagtgtggtgcggggcacccttgcctgcagtaagccaggaagaacacggtatatactggaagcccttatgacacccccaagcaggcctaccatccgcatgaatgagagggattgcatatacttccaacatgcggcatatgctggggcttgctagtctctgctgcaggaggcatcgagacagttagaggggcgcacctcatcttcatccggacaacctcgcgcgcgcacgggctgctttcgtatcgagattgcagcgatgacagacacggggcccttcttctcccgagtgccatctccaacattgcttgtattgcttatgcagatgtgtgatctcttgtcgaggagtgcggccatggctgnnnnnnnnnngttctcccaagtgccatctccaacattgcttgtattgtttatgcaggtgtgtaatctcttgtcgaggagtgcggccatggctgcctgacccgggcgggatgtgatccacccaccctcccagccagcatggcgcccgtgttgcctcccaacacccgccccaccagtccgctggcccccacgccgcgcttctggagaccccctcccgcttccatcctgcgccaaggtgcgtccgaggcccctgtcgagggaaggttgttaccaccatagtgcaggggactttattactcatcttcctcccacctacattcccccttgtcaacccccatcccnnnnnnnnnncataccttattactcatcttcctcccgcctacattcccccttgtcaacccccatcccctcttcacccacacccacatccccctactcctcagcctcggaccgtgtggatgccctgcacgtgtcggggcacccctccagcgtggcggtggaggcggtgggcgagctgcgactgccctggacccgcgcggcctacgcgctgacctggcgcgggctcaccgcgctggtctccctggccgtggccctgtttgcggcgcacgcctccctcctggccgtggccatcatccccatggccgcgcgctacggctgggaccccgcctcccagggcgtgctgctgtcggcctcctactcgggccagctgtgcagccagctggccggcggcctgctggccgaccgctggggcgggcgcgcgccgctggccgccggcgtggtcgcctcctccctggccagcctgctcacgcccgtggccacggccggcggccgcggcggcctggtggtcatccgcgtgctgctgggcctggcgcagggcgccgccacgcccgccgtgcactccctg

SEQ ID NO: 37400 - DNA, 146 bp, Chlorella protothecoides
ctcgcggcgttcagagtaggacacgaacaccgcgccgccgccggcgggggggggggcgggctcatccccgttgccgggcttggagggtgccttgtgcttgggcgggaggcccttgtcgggggagggagggccgggggccgcctcgt

SEQ ID NO: 37401 - DNA, 66 bp, Chlorella protothecoides
agatgccggggttgctcactggctgggagcagcaccccgccgatggctacatcctccaagatcagg

SEQ ID NO: 37402 - DNA, 73 bp, Chlorella protothecoides
gaaacaagaagcaggtgtgcaggcatggatcacgcaagcgtcgtcgccaggacccagccgagtcggcgggccg

SEQ ID NO: 37403 - DNA, 94 bp, Chlorella protothecoides
tagctggatccatactcagcttgttagagaacatgtgtgattgcccagcctcggccggcagcgctcacgttcatgtcatcacttgcctctgtgc

SEQ ID NO: 37404 - DNA, 61 bp, Chlorella protothecoides
aaaggcacatcttctcatcctcctccccacccctacatcctgtcttcctccacccccccct

SEQ ID NO: 37405 - DNA, 61 bp, Chlorella protothecoides
cagctcccagtccaggactgccagcaccttacccgacgggtccagcaccagattgtccagc

SEQ ID NO: 37406 - DNA, 75 bp, Chlorella protothecoides
tcctttctagcccacccacccattactgattgccgcccccccttgttcccccattgccacacaacctaccaccca

SEQ ID NO: 37407 - DNA, 83 bp, Chlorella protothecoides
tcgccaccgctgctgcagctgctgctgctgtcctgctcaggtcccaggacggcggagtccagggcagtgggctgaatctccac

SEQ ID NO: 37408 - DNA, 78 bp, Chlorella protothecoides
ctcaccacgtggctggcaggcgcgggggggggctgtcgcgtgcgctgtcggtgggagcgcatgcacacggcatggcgc

SEQ ID NO: 37409 - DNA, 61 bp, Chlorella protothecoides
cacagccccagcgtctttgagcgaggagtgatatggcgtgatcagagcccaccctcccgca

SEQ ID NO: 37410 - DNA, 173 bp, Chlorella protothecoides
tgatctggaaagcagggagcggcggcaaggactctggtgtggcaagacctggcgccaccctgctcaacaattgcagtgtctgtgtgcaagaacctgccatgtagatgggaggtccccgcaatttctccctccaacccccccccgcccgcctgcacctgctgctcggctgcggc

SEQ ID NO: 37411 - DNA, 26647 bp, Chlorella protothecoides
  modified_base (2922)..(2976): a, c, t, g, unknown or other
  modified_base (5010)..(5019): a, c, t, g, unknown or other
  modified_base (5968)..(6039): a, c, t, g, unknown or other
  modified_base (6520)..(6529): a, c, t, g, unknown or other
  modified_base (7012)..(7026): a, c, t, g, unknown or other
  modified_base (7222)..(7231): a, c, t, g, unknown or other
  modified_base (9166)..(9175): a, c, t, g, unknown or other
  modified_base (24630)..(24736): a, c, t, g, unknown or other
  modified_base (25628)..(25637): a, c, t, g, unknown or other
  modified_base (25897)..(26006): a, c, t, g, unknown or other
  modified_base (26080)..(26089): a, c, t, g, unknown or other
agcaggtccggcgccccgcgccatgccccggccgggctggggctgacgggggccgagggcgccgcccccgcgccgccgcacgacccgctgctgctggcggtgctgcgagcgcgggcggcgccggcggcgggggagctaccgaaaccacgctcttctctgtcgtgatcggggccgtgcgcatcctcgtctgggggggggggcccatgcgccctggtctggaactgaggggccaggctggggcggcctgagcgcgctgggctcggcccactgcctgcgcgaatgtcctcgctgccctgcggcgagggggcctctgagggtgtgccgggctcctcctcatccatggcctgtggatgagggtgaggggagccaatgctgttgaggatgaggatgccatccagaagggggactgagcatgggcgcatgcatctttggcgaccccccacaggctcagaatcgcgatgcgtagtgcaatctcgggcaaggaccagctgcaagtcatgactgggcagccctgctaacctccctccttcaaaacccccctcctccacccacgacttcccacctcctccacctccatgcggaggagggtcagctgctgggcgagggtcagcagctgggactcgtgcttctgcagcccgacgcccagatcatccattccctccccttgcgctgctgactcagcaagcatggactgctgcataagtaaagcagaggagagtcggggtccgtcggagcgtgggtgggggtccctttgtggccagataatcaggcgttgagcgctgcatggggactggtgagttcagagctgctcatcagccatcaccgattgacatccaaccctgcaggcatcatcaaacccagccaaaacctctcgcccatgcccatgcctggcgacgcagaaagtcgagccttcgaatgtaggactcgggcctgaagccggagtcggggctgcctgctccctgggtcggcaaggtccagcgtttggaagggggcgacgtccagctgtgcagaggatgggagagtgcagatggaggagtttgagtttttccaggcatgtagcattggcaactctccaataccgtatttctccccttgcccccatagcatgatgccacactgcctgaattctcaccagccctgggcagaggggggttccacctcgtctgccaggtccccttcacccccctctctcgcggggaggaggggaggcgcagatggtttgggcgagcggctgccgtcgaactccttcgacttgttgcgctcgatcagccagaatacccagcccaggcccgccaaacaggccgcgacggtggggatgtgcgggcccagctgcattcccatcccgttttgggtgagcttggggtccctcgaggattgcggggggggggccatgcagccccaggggaccccacccctctcgccgggaagtgacatgtggccgccgggaaggggtacaacccgctgccgtgctcggcttgcgccgtgttctcggctctggcaccttcaaggatgtctgagaaccgatcaaaggtgggtgtgggggccccgggaggcggtcgtaacgcacgcgacgtttcggtgccgtgcagcaggcggtgtcgtgcgacacgaaacaagcggatggggcctgcaataacacagcatgcgtccctttctggactcggtgagagccgcgaggcgcagcatgccaggatttgaactgggtgtcatactcgaatctcgaacagctgttctgagctagattcacagctgtccagcgacccagtaggacctcgtccggcctttcgcgccctttccggaggggtggttgcctgccgcctgcatgggcatcctgtgcacatcccaccccctgcacatcctgacccttacaacgccaagcagttgtccatgccttcccagcaaatgcccctcctcctggaggataattgctcaggtcctcggtctgaactgttatctgcaggcctggaaatccttgtcactccatgaccccagcacagcacctcccagtggagtgacgaggggctcaagtggatgaagaataggtatggaggttacaaacgcttgcgctggatggccgaataagttggcggcgtcgtcatgggctccaagctgttatgcaggctcacgtcaaaaggcaatataaataggcgcccccctgcaagtgggcaagcgcaggagcagcaagggagacgagcccctgttgaggggtctcagaagcgggacaggttccccgggcagctacgggggagtgcaagggaagggcaagctaccaggttttattgcaaagggtggaggttgcggggaggggggggggcaccagggaggagcaagggctccgtgtgctaggtggggacccaccccacgctcccctgccgccgtctacttggactcctcctccgagccagccacatagttcttctggaagcggtagataaacttctccatggcagagaggtgcctggggttgatggcagggcccgtgtactcgtcgtggttaccatcgacaatggcgagccagcgcttgtcgccctccttcaggtccagccctgtcaggtcagggatgacgaggagggtgaggaccacgcccacggcgccgcagacgccggagatccagaacttgacgcggtcgtccacgaggccaaagacgacgccggcgacgagggcgccggccttgccgacggcggcggcgaagccgtggcacatggagcgcgcctcggtggggatggtctcggcggggaggagccaggtggtggcgttggggccaaactggccccagaaggaggagaagtagtagaggaactggaagacctggatgttggagggctccagcagcttgtggtaggcccccgcgcagatcaggaagaggacgcccacccaggcaaagcccatgacctgcatgcgcttgcgccccatccacgtctnnnnnnnnnnnnnnnnnnnnnnnnnnnnnnnnnnnnnnnnnnnnnnnnnnnnnnnaaagtagtagccgacgagggcgaccgagctgttgagcagggtccactccagcacctccagcaggcccgccttggggttgatgaccttgatgaaggtggactggaagagcttgtttccgtagaaggcaaagtcccagacaaaccaggagagggaggtgccagcgatgcggtgccagtagtagaagaggagcaggcgcatcttgcgagcaccgaagcgcgtgcccttgcccatggaccgcagcgactcgcgtttctggcgccagaccgcagactcgcgcagctggaacacacgccagtagaagatgaagagcagggggagcaggcccagcgcgtaggacaggcgccaggtcacctccagtgcgtagtcatcgtagggcgcgccgcgctggttgaagccggccatgatggccaggatgatcatggtgttgaaccagttgccccagccctgcatggagaagacgcagaccacggtctcgccacgacggttctgcaggtgcttggtctgctcggcgcgctcattagcggaggtggaggccacggggtactcctgcggggtatggaggggtgtggggaggttgggtaacatgggataatggcactgggagtgcaatacacgtctgatggcatgctcatccattgtaggcagcacatgcagcgcagggaggcatatttgtcgcagcttggcttcatggcagagcagacccaccacaacaaccaaaactcactccgccgacgccgacgccaaacagagcctggaccacggtgaacatgatgaacaggttgccggagttggagcccgaggaggcggtgatcaggataccgaacaggagcatgatggaggcggtcaggatggagccgtacttgcgtccgatgcggtccgcaaagaatccaatgaatagctggccggcaatgataccggagacttgggagtagttgatggagtccgacaggttgctgctgcacgtctggaaggtgacccagcagtcggggtacaagacctgtgagagatttggggggggggattagaggatgggagaaggagctaggcagagctaggagaacccgtgatgggctaagcagaatacaaggcgttgaatgtggactagttgaggccatgcatagcgctgcaagcttgggtcgtgtgcatggtctgcgcagcatgcgagcaccccgttctctgacaaagacccactcataccttgaagatgggcttcaggttacccacggagaacacaaagtacgcctcggagaacattcccagaccgggaatggtgaaggacagaacccagtagatgaatctgggggagcggggaagaggaggggaggggtgagggacgcatgtgtgccaacacgtgcggccgtcgcagttccggttgctcgaaccctacggtcccaggctgtacgcagtgcttgcgcgacaagcagtcgagtggctcaggaaacagctcgcacaaggaaggtttgctatgagaagctggaatcagagatcgcagggtatattcgtaccttatcggggaatatatcttccaaggagcatgcatttccccgcctcccctttgcctcggcggagcacgtacctcctgacaacgttgccgtgacggacattctcatatgcggtgtcctcctcggcgtcggccaggttctgtgtggcattggtgtagaccttgaccttgccctcctcgatgcccgcagactcgtgcccctttggggagccgtcagagtcgccgttgttcatggcgaacaccttgtggtggtcgccttctcactaaaaaggaagggagttacgctcgaagggtttctgtacagccgaggcatgggcggcgtcggaatatatggccgcgtgtagaggtgatggatgctttcgcaaagatgccaagatgctttccaggtggaaagcactgttgacgaacggggctcgcgaagacggcgtgggtgcatgcacaagccccaaaggagggaatcgatgcttcccaaagaaataatgttagaggcttgcccacgtgaatattcgacccacggtccatgcgcagctcannnnnnnnnnaaaagaaatattgttagaggcttgcccatgtgtatattcgacccacggtccatgcgcagctcatagagcttagggttcgcccagtttagagatgtgtgatttcgttggaccacgtgacagacgcctgggcggggggatgcgacctcctcaccgcggcgcccgacatcctgtacagcttcttggctcgcagggtagcccaggaatattacagatgcgcgaatctctgacacaagcggctcctttcccgtctcttgcgaacgggagggtgcagcacgttatcttgagcggtgaccacgcgcaggaggtcactgcgtgcgacacatgaaacccagtgcgccctcccctccctcccctggattggaacagaaggacaatttcaacgccatgtagtgttttgggaggtgtattgggccttcccgcttctcccaaagtgacaccgtcccgcaacccaggggattgagtggtacaggcgagccactcctggcttgtctctcctgtctataagaagtagtatggacactcagagagtcttcataacccgcttgctggttctcgagcgtgcagctcgcatgctacgggcttgctcccgatgtcctgcatgttggtccggacgggcggacccgggcgcacttccttcccttgaccacatccaaattatctccacttgcgtaattgctggaatggtaacatcagcggatcagttacgtgtctcaggcccctagattgatctgctactgcggcatgcgccttgtcacgtgcacacgtgcagatccggtccctggagtccttaatcggccaacccggggcaatacgaatcgcacagtcaggtgccactcgtgccgaacccatgcttaaataagatataaaaatccaaaaaattgcttgatgaggatccgagaggaccccgttcggcggggtccattttcgccccttcgggagaccccgtcgnnnnnnnnnnnnnnnnnnnnnnnnnnnnnnnnnnnnnnnnnnnnnnnnnnnnnnnnnnnnnnnnnnnnnnnnaattctaactcttgaatattgtatgaaggcaatagtatcgagtacagagcgatagaacgccgtcgccaaacatcggtcgtgtcccaatgggccgctggtggcgcaggggcctcccccatccttagcccttaaaggggccagatacccccccttctcatacactgcccgtctggatgcctttctagtcgttgacatacatgggatccacaccaggtgcaaggtcatcttggtcctcatttgcttgctgaagcagtccactgcctcttgccaccccctctctcaaggttggagcggatgtggcgtgctttgcacttgacgtgccgctcgtagggaatggtatcagccgaccaagcgggcaacacttgcagatcagcttccatgaggtgcttgtagagtgcttcatgctccgcacgcacttccttctccgcagtcaggttgatcctggtccttagcctctggagtgcttccttgagccctggannnnnnnnnnaatgcggcgtgctttgcactggaggtgccacccgtaggggatggtatcagccgaccaagcgggcagcacgtgcagatcagcttccatgaggtgcttgtagagtgcttcatgctccgcacgcactcccttctccgcaatcaggttgatcctggacgccagcctttggagtgcttctttgagccctggaacgctctcgggtggaggcgccgggtggtccgggatgctcagcagtggtggagcaccgttgctactgtccacagggtgtggggcggtggcactgtccgttctttcagtgcgaggcttcgcagttatcgaggccaggtcgggagtgatgtcaagtggctgctctgattgcagcgtcatgttgcccatcctgcatagcaggcttcccaggttcacttctccggtcttcatccactctgccccagctccctcagcagattcacatgtgtatcgcgtccttatccggcttggtcttgctcnnnnnnnnnnnnnnntggaatgaccgtgtgaggaggagaagaagacgggtgacagggaggagaagaagacggactgatttgtacacgtcgggtgggcattcttcaccctcctgttcaactatcgcagctgcaagggctgtggctggtactcggtgggccactggatgacaaatgggtatagtgtctccgtcaccctgcggcggcagagagnnnnnnnnnncccactgccggtacccgtattaccacagtcatgagaccggataggaggtctttgcaccggggattgccatccctggctaggtgcatcttatatgcgaaccctatgctgggttgcaacaccttgctctcgcctttccaataggctgggatacgactgacccgggtaagaccacagaacatctctgagaaaacattcagggcagagagcctcgtacgctacctcggcctacccgcgcctccttcacaacacgccatttgcgactcgggtgactcgacgctcaagctgcaaaagttgcttctgggggctgtatgaagtataccatattgcaatctgtaagtcatgcgaagtccatcatgtgcatgatcgtctcgaagtgatagcaggtataccctaggcgcttcctcctcaagctcatcaatgggccagttacggtgcccacacgacgatggagttggatcatgacgcggactgggatccactaacctagctagctcttccgctgcttcgatcggaccgggcccctctccgtcgaagtacagattctcggcgggtatcgctttctctcgacatcagcacgcatgactctcgatgccatgcgaaaatggggatagtggtgtccatactctttgcacatctttcagtccgagaatcgctgtgatttgggtcatgcgaccgagctcacatgggttgatacccgcagtatgggagaagttgcaggaagccggcaatcatgaacgcgatctttatcccttccaaacatgacattgcagcctcgaagggccagtttaatttggaagactgtagaagctgaagttgtgttctgcaacaaaaatctcaaagagtgcaacctgaacttcgctaggggtccgagtgcccgagcatatgatgaagccatggatgactctcatcgtctgtgctcttatcaccttcatgctggtaactgtacgtctcttgtgagggacatgttcactgcggcattgttttgggggtctgatgagataaacgaggatggagctgcgcgtcagactgactcgattccctcctgccgtccgtcaggctgcagcgggcatgatgcgcgacagcgcgatcaacctggaagttgccaaggtgtgaaatgtgaagagacataaatataaaatcttctctgcatatctctcaatgcaagtgttctgtcgatgtcgagatcgtctatatgcctaccaagtcaaccccactcgagcttgaacacagcttgacttcccgaatcgggatggacatcgccagctccaacaggcatcatgccctgcacccaaccttccttccttcatttacaatggatatgtcgagtcttattttgtccctcctgatccctcctactggaagagcttcccatcctacatcaacgttgccctcctcttcttcttcacaccagatagccagtacactgctggacaaacagatcttgcgaacacaggcttactcttcgagggcacctcggcggcacagctcacggccggcatacaagcgctgcagagcaagggcaccaaggttatgctttccatcggaggggcatccaatgctgaccgaccggtggagtgggaatcatggaatgtcaaggctgcaaccgactttgtccaagatttcggactggatgggatcgacatcgattttgagccgcgcgagccaggtgagaggggctcttacatcacatgtcatgccctccatttccactctgggcttgaggatcccttttcagctgcaaacccctcggtgtctccccctttggctacaaagctcgtagccatcatcgctcacgacgcgctgcaagcaggaagaaggtcccactagctccttactaccatcactgccacacgcaagctgcaaggtatctcaagacacgggaaacatggcgtgtaacactgatgagaaattcgagaacatcatctctgggtaccnnnnnnnnnntggtctcactagttccttactaccatcactgccacacgtaggctgcaaggtatctcaagacacggggaacatggcgtgtaacactgataagaaattcgagaacatcatctctgggtaccgtgctggactggataccctaggttctggcaagctgctctctgcagctctgtggagctctggcgcctggggccaggccccttggacaggactggggatcggatcgccacagacagggctatccattaacatgctgaaggctaccggatgtgctctggacttcattcacgttatgagctatgacgctggtccaaattttccgtatcgggatgcataccaggcatacagatccttctacccaggtgagggcccgggtaagggttgcccttgcatgctgacattccccccagcctcgcatagtactgctgatttgtcaggacactagctttgctaggttgatttgcccactcgtcagattgatcatcgtggttactggatgtgctgcatgcagcgtattccgggcagattccagaggacattttagccctagagttcccagccgctatcattctcctcatacacgtcgcattcttctcggcatggaagttgcacctgaagcattcgggggaaatgttctgaccattgatactgtctatgacctgggcaacactgtcaaggagctgggcggagctgggctcttcctattttctttcacaaagcggtctgagggaggagcaactgccactgagatctcccaagccgtgtgcaaccaatttcgactgggtgactgtacaggaacgatcccaccgtccaaagttcagtgaagcctttgggtctatccccttgcaatggcctaaagctgccatgcacctgtctcctcctcttcactctgtgaaaatctccctcgatgtgtccccaatctaacggactttcacactatgaatgttctggcatgtctgaaattttacacccacctgaacttacctaatggtgggcttccatctccctctaagatcctgagcactcctagtgtgcacacatccacgtcaaactcctcggcaatcactgagcaagcccaccaggctgagttcctactctgacccgctgcacctgcgctgtgcctttacgtccatgcttgctatgtaaagatgattgatttgggacagggtagcaagcgcatccttgcgtgagtgtgcgctcgagatttggcattaaaagtacatgacgacagtgaggagtgtatttaccatgcgagaaaccctgctcaccccagggaggtcgaatgttgaagccttcaaaccaagatgcttcccaggtcagtcaggaagctatggaagcatgttgtcatcaggtgggctcattgtatggctggtgatcgcccgcgtcctgcgccttgaccgcctcctcgaggggtcctcctgcatagtcaggtgggtggcgatacatcggcccgtttctaaacgcaggtgcactggctggtatggcaggccaggtgtcctgacccaatttgtcctgcatggttagggaggaggaacaaagggcaggcaggtcctagccccgtgagtcactctgcatgctgatctagcgccatgtcacgtgcatgctgagatgcgatgctcatgtccggatcgaccaccaccatgaatctcgctatcgggctctttggatgcctgataccattcaattttagttacatatatgcgacagattattgaacttaagtggtacagtttgcagcttgaaatgaacatggaaatctgcatagaagccggcgtaggtgcatgctgtatcatgtgtatccacgcccctgccagtccttggcatcgttagcattcgcttttcatctttgttagcatcaacttccatggttgtacattataagccagaaaatgcaaggtcgaggctgtagagcacatgatacggcaacaccttgtttttttccagaatcagcgcgtcggtctttatcgctcgggcggctgttcatcccaactatgagaagtgtcttgggaggctctacaatattattaaaaaacgattcgcacgagtgcgtcgagggtcatctcatacaaactcatcccgccctctgatctcggataaatcatcacgcggcgcaaggtggcgctttctccccatgcgcactcaacggcgactcgcagcgcgcaaacgatgaagaataaaatgacgccaaggaggggattctacagatgaagtgaactggtccgccactgtaatcggatcggccgcagcgttttgaagtacagcttcccgagcgatgtcgctctctcttatcgagagcgcacatgactctacatgccatgcgaagtgaggagaatgctatacatgcagatcacatcagctgaagtcccaagtattgctctgtttggtgtatcgcgacggagctgacgaggatactctcaagtatgggaggagttgcaggaagccgggccagggcatgaacgatttcgttatccttccttagcatcacattacagcctcaaagagcgagtttcaccttggaagctttcagaagctgaaagttgcttgataaaacattgtcctcttgcagtgcgacctgaactcgccaggggtcagccgcctgttctttccatgaggcccttgttcacatccatggtctctgctctcttcaccctcatgctggctgcggtacgcctctcagaatcatctggaagggactttgcctttggggcttgacgtgactgaagtcaacatagctcagcgtcagacaacaccccccacccctttcctcctttcgtgttgcagtctgcggtcggcatgacggtcgacggcccgtaagctagggcggagtcgagttgtgaaacgcgaagagacaaataaatactctatccagtgcagatgtcgctatacaagtgttctgtccatctgatgatctctcacatgtctcacgttgacctctcgagcatggacacaggttgaacttccgattcgctacgagtctcgcagcctccagcaagctatatgcccccctccaacattccctaccttcatctacaatggatatctggagtcgtactatgttccccctaatccctcctactgggagagcttcccacccttcattaatgttgtctacctggctttcttcaagcccgacagcacatacactcctgaatcgatgagtttggagggcacaggcctcaactttgaagggacatcagcaggagagttcggggcccgcgtacaggcactgcggagtacggggaccaaggtcatgatctccgttgggggcgcgtctacacctgacaacacagtcagctggaactctttcaatgctgctgcggcggccgcctttgtccaggacttcggactggatgggattgacattgatttccagccggacaagccaggtgagaggggcccaagactctggatcgtgatcgctatgttttcttggcacctaagagcccaaaacggtggcagctgtctcgttcatcaagcttggatggcaagacttgagaacaggtgccccgcttggagaggtgctaggagcagtcaatgtctgaacaggtcctgctcacaaccacccctccatgcaccttgtggagtatcccccacgactggcctcatgacctgtgccgttgacgagcagttccagaatattgtccttcagtaccgttctagcctggccgccacgggatgcaaactgctgtctgcagccctgtggagctctggcgcctggggccaagccccctatgagaacctgggggttggatcgccacagacaggcctgtccataaacatgctgaaggcggtcggaagtaaccttgacttcatcaacgtactgagctacaacggaggtccagatttcaattacactgcagcctaccaggcttacaagtccttctttcctggtgtgtgctcatgggtgtccctcatgacaaactgccaccgagatcctcttacaaatgtcttcgtgtgtcatgagaaaggcagtgcgagggcgtgggtatcatagcattgctagtatggcatcattcttcttgacaatgcagggtagtgagcctttctaaccacaaatgcatgccatcctccaggaaccattgatatctcagccactcctcccacagggattgtgttgcttggcatgcaagttgcacccgagtacgatggcactgcgcttcaaatcagcggcgtcaatgcgctcagcagcactgttaggggactcggcggggctgggttgttcctcttctccttttccaagggcgctgtgggaggagcatctgccactgacacttcccaagccgtgtgcaggaatttccaactgggtgactgcacagcctcaatacccagatccactgttcagtaagtctcctggatcaattctcagagattggttgccatgccacacccgaccccatgttctatcccacctcatccctcatccgatctgtcccccgctactatcgatctctccttccgaatcagatggcctgcatgacgcttgaccaccagctcttcccacatttgtgtgggctttcggctttccctgagattttgagcattctcagtgtgctgaaattcaggctgtactgtctagttcgtaatgtgcgcttctaagtagctcagccctcgttttggcacaccccgctgtctatgcgcctgcacacccatgcgtgccatgtaatgttgattactacaaagcagggtggcgagcctggtctaatcttgagcaaagatcaagatctgtgtgacccagaatggtcgagacaagtacttgaatccacagttcaaagggggtaccatgctttccccaggattattaggtaaccgaggtgcttgaggcaggatgatgccgggctcatttcaaaagtggtgtcgaggaaaatatcattgaaaacttgacctaggccatgcctggtggtccgcccgctgccttctcgccgcctggcgcctggaccatctccatcaagggagacacatacctcgcctggtggcgatacaccgtcctttccagcagggacaggtgcttggctgctatggcgggacctgtgtactcatccgccttgccctgcagcacaaccccgtgggatgagatcgggtgattcagccagtcctatccttgtgcatcaactaaagcaatatgcagagaggcttcttgaatcgatcaggcatgcacagaaacactcacatgtgggagtcccacactcactgaccgaccagacatctcaaccctcatcagtccatccccactccttcccacccttccccttctgcctattggaagacccacatcgacgatggcgagccagcgcttgtccccctccttcaggtccagccccgtcaagtttggaaccaggaggaaggtgaggaggacgcctgcggcgctgcacacgcctgagatccagaacttggagcggtcgtccaccaggctgaacaccacacctgcgaggagggcgcccaccttgcccaccgcggcagcgatgccgtggcacatggaccgcgcctcggtggggatggtctcagcagggaggagccaggtggtggcgttggggccaaactggccccagaaggaggagaagtagtagaggaactggaagacggggaggttggcgggctccagcagcttgtggtaggcgcccgcgcaggccaggaagaggacgcacatccaccagaagcccatggcctgcatgcgcttgcgccccatccacgtcttgtcgatggtgaaggcggcgcagtagaggccgaccagggccacgccgctgttcagcagggtccactccagcaccgccaggagccccgcccccgggtggatcacctcgatgaaggtggactggaagagcttgttgccgtagtaggcaaagtcccagacgaaccaggagaggctggtccccaccaggcggtgccagtagtggcgcaggaggagccgcgtcttgcgcggcgtccattgcgcatcgcgccccatcagcttcagcgactcgcgcttctggcgccagacggtggactcccgcagcctgaagacacggtagtagaagatgaagaggagggggggcaggcccagcgcataggacaggcgccaggtcacctccagcgcgtaggggctgtagggcggggcgtactggccgaatccggccatgcaggccaggatgatcatggtgttgaacaggttgccccagccctgcatggaaaagaccaggaccaccgtctccccgcgcttgttctgcaggtgcttggtctgctctgcgcgctcgttggccgaggcggaggccacgggaaattcaccgcccaggccgacgccaaacagggcctggaccacggtgaacatgatgaacaggttgccggagttggagcccgaggaggcggttatcaggatgccaaacaggagcatgatggaggcggtgaggatggatcctgcacgccggcccaggcgatcggccaggaaaccgatgatcagctggccggcgatgatgccggagatctgggagtagttgatggagtctgacaggttggggctgcatgtctggaaggtgacccagcactcggggtacagagcctgtgtggttgagtgggagggcccaggggtggagggtgagggctgaggagtgtggttactcagtcacagcggcattgcagccccaatcccatccgggtcagactgtcttgtagacaggagtaatgcatgggccattgagactgcactggccacccaacacctgtcatgcgtccagtcccaccgaccttgaagatgggcttcaggttcccaatggcaaacacaaaataggcttcggaatacatgcccaatccgggaacctggagggagatggtggtgggtcagcaaaaccagtcagggagtggcttgcttcctcaggcagctctcaatggcaccaagccgccatgaaggaaggacccaataagccatgagaggaaagtcggggatacacaccgcgaaggagagcacccagcgtagaaacctgtgagttttattattcgttgtagatgagtcagtgcccctgtagcggcagcttcatcaagtaccagcttcccatcacgatggcaacgcattgtaacatgggccaagtgtactctcagaattcgccacccaccttttgcagacgttgtcgctgcgcccttcttcgtgtgctgcatcttcggtggcctcggcaagatcttgtgacgtgagcgtcgcgacagggataggtgctgccgtatcgcggccggtgcccgtacagggcaccggctcaggattggggggcaccatgagcctaggtctatagtagattttgtatggaaatgacacagatctgatttgtgcacaagctttgacatgtcgatgtcctattgcaccgtcagcattctcatttccgcaaagcagggcagattctcgcaaccttccgggagagcgccacgttgacgagttagggtttgcaggagatggttcagctctccagctttgcccacgtcgaaacccgctttgaacatcggaatatttccaccagaatatcgcatggaccacagtacaatcagtctgtacttgcgatggagccatgatgacactgccccattcgatggagaagggtgtagtactctgggaatgccccatcttggtaatcaggagggagacaaccctccctcttaggcatcgcaagatcgtggcttatacactcagaggactaaaagagatttgtaagtgctgtttctgcctctaggcatcccaatctcataggtcatcatgcagatgtgtatgatcaccagtcctagcttacagtgtctaccgttttgaggagtttttccccgagacagggtcactgttatggtgttgttgtccacacatccatctcacatcacaaacagggtcacttgtgccgtcataccgtacaggctcttggctgggatgctgcccactcaaacttcccgattgcacagggtggtggccgcctctgctctgcccagggcttccattcggtgtcctgcaagcacttaaaccgccaacggaccattgtacgagtacagacctggacccttcttcaggatgtcccctgcagtggtgtggtgacgatttgcatcgagtgagcaccgcaggtgttgcctccaccagctttcaccaggctattcagaggtcggaagcagggcccccctcgcgaggaaaaagcttcacatcgcattcggagcgcctgccctcctgaccactgccagacttccatacccagtagatgaaactcccttcaagctcaccgccgtcgttcagcctctcgatgaagccatggaactctggctcctgcacccgagccctggctgcaatgccctccagctccgcgatctgcagctccaggcaccccgtcgcctgcagcatgcagcgagggtgggggcttggtttcgggtgcatttgagcctcagccataccatgcacgatgctgggccggcattggctgggcgtctctgccgggtgagagggactccctgtcacaatccaatccggccgccctcacagccttccgctcgtgaaacaacacgtcttcgccctacttccactcgccacacaatgccggtgcagcgccgccatgaacctctgccgccgagcctggaagctgggcctcttggtccctggcctgggatcatgctgtgggcccgccgtgctcccggggtcctgggcgccagcccccgcatcaaaggcgccgggcgccccacacaccgtgccgcagcacaagctggcaaagagcaggtccccggccgcctggcatggggcatagacgggaagttggggcggagaggtagaccggcacgactgccccctgtccctgcagcccatggggggctgcattcgtggccccagaatttggcaaaaggtgctgcgcctcatgaaaaagccctggggttccgctggacaccctgccactgaagtcctggacctgcctctgatccaatactagggtctgaagccacagcgatcccgcctcgctggctggagttgtgccttcagatcgacccccgggttctcccgcccggcatgtgccctgagccccagccccgtcactgcatcagatccctcctcccctcgcaagccactcgcctcgacgtggctgggagcgacccgcccggccaggcacgcggcggccaccgcgccgcccagccgcaggagcaggtgcaggtggtgccagcccatgggtgcaaggtcgggggcgccccgcacctcggcctgcagttggaggaagcaggccttggctgccgccctggcctcgcctgcggggagcaggggcaggggggggggtggctggatgggcgcacatgtcggtgcgtgcatgtgcaggcgtcgacctcggagcctgtggtgtggtggcgcgggcgcaacaggccggattcccccgggcagggcagcctgagctggcatttgcgagccgccgagcacgcgcgtgcttgccccctccgccagccgaaacctgccaaacgatcgagtcctccaccccacctcacccgtccagctcggcagtgccctgcaccccgccaagtgccgggcgagggcggccacctcccccgccgtgaggcgcggcgagctagcctcgggcaccgccggcccgcccaggtgccactgcgtgatggcctggccgggagtggggctggcgccgacggcgctgctggcctgggacgcggcggcgtcgtatcggcgctgggacgcgccgacgtcgtattggcgctgggacgtggcggtcccttgacaacggaacgtggcaccccccgggcaccaggccggcggcggcgcggcagcgccccccgtgcccctgccctggctgccctcttcctggcccaggcaggccctcagcgccagggtcgcggggtcctgcggccggtccagcagggtgagcaccaggtcgaagcgggccagcagcgcggccggcagcctcacattgtcctggcaggagcacatgatgagcatcttgaacagctgggtggcatggagcttcaccaccagaagaggccggccggctggacacattacacccacccagaccctagcagtcgaaccacaaacaccaagcccctgcacctaccatgagactgcgggaggcatcgtactttcctcctggcggcgtggtggtggccaggatgcacgtgggcgggccctgagcagggggtgcgccgcccacagcgctcccgctcaccaggcccagcagcacctgcgccgagggaggtgtgaatggtgtttcagcaaagcagaggacacggtgggagtcaggtgcggcaccgcttccacacgctcagcagcaccctgcaacttgcatcgcagagaacgcccctagcccttcaacccaggattgcagagggcctgggtgtattgctgtcaaccagctgtagatgcagtcacagccctgcacagatcccaactcactgaccagcacacccgaagccccatgcttcctcgcacctggagctgcctggccggcagccgctcgacggcctccagacacacaagtcccggctcggaggccgcagcgccgcccgccaccgcgccgatgcccttgccgcccgggaaggcatgcggccccaggacggtgtggggcccgcagtcgaggtgctgggaggagcacgctgcagccgatgctgcttcgatcagggagctcacccccatgccagcgtctgtcacgatgaggaggctcaggggcttggagtgctgaatcgggggggtgtcgggggctggtgcgggggatgccagcagcgcaggggcgccggagacgagggccagcagcgtcaccgccttgcacaggacggcgggcagccgctgcttgggctccaggctcgaggccactgcgtccaaaccctacagaggtgcgcatgaaggatgacaagacagattggatgtgaaggctcttgtaagtctggacataaagcaatgggccagcaattcccccacctgtcgcaggtccagccagatacattcatatacaacagccagtacccaacaccctgaggtatagtccctacagcaaagaactcaatatgcacctgctgatctaggacctttcccaactctacaagtctctcatcgtcgagctgggggagctcacaccaggcactgcccagggtgcgcacattgagcgccgagaggtagggtctcagcctgctgctcgcgtcctcggcatctgtgggtatgcatgcgtgcacgcgcgaatgtttgcgtgagagtgaggatcatgcaagccccaggatggtgctgcgcagcaacatgtcaagggtcgggaaaggggtttggaaggcgtgccacctccaggcacagtccatgaatcctggacgagattcccacaccgggaacaacaaaagggcggataccagtacggggtgcaagcatcgtggtgatatgtaggtggtggttgaggcctcgtgccaagcacctcccttttctcaatccagaccccaacctttggaggcccaacgccctacccacaccacccgcccacctgctgcccctccatggcccggcctcacgatgcccgaaacatgaatgcgccgacccaggcagcccacctccgccagttcccccaccaggtgcacctggatggcctgcccaggcaggcccggctcagccgtgtcggacccctgcagaaggcaagggtgcatcgaggccggtttttaacttcaccggcaccaggcagtcatccccttccagtctgtcattgctcagcccacatcaccctcatcccctctccatgcccttccagtccccacgcagctggtacatgcttccctcccacctctggcttgacccagacggagcgccagagcacggcctgggcgctggatgccactgggtccatggagcgagcgcggcacgctcgggacgcgcagtgctccggccgctgcctcacccccgtctccagctggagcaggcgcgtgcgtgagttgcactttcggcacctgaactccagggaggtggccacggggtggatgggcgtggccgcgacgaccgtcccctgcaccgccaccatactcccaatcaaggagggcgtgggcggacggtccagcgctggaacggtgcttggtagggtggtgggccgcaggcagagggggcgacgatggcaggggctgatacctctggtctatggtggatgagaggaagccggggtggcgtcgaagaaggcacggccatgaatgacaccatcctagactcgcacacacatgcccagtcacgatggtcaatttctggtcgaagtgttgtaaaggcaagtgcgacattgatcctcaaggttcatgcacacatttctagtggagggaggtgcagaaatagatggtcgaacaggcagagcgcgggggagcacccgatgccacgccctcgaccgaccttggccggctgggtaacaatacgcggtcctgatcccttgcgatcgacccacagacggccgtacctgatggatcgcggcagcgagcagcaacaggcattgctcgggcccatctcgcagcaggtcatggaaatcatgcccaggatccagtgtgccgcagatcccggcgaggtccacgtccacaaccagttggtcctcccagtcccgagcatggccaatgaagggatcccaatggctctcgagagccatgatagcttcatgaaagagggctctggggtcatgggggtcataagtctccgcatcctggtcggtgtagatggtccaccaatccggcacgccagggctcgacaccatgttcgagacggtcatcgagcacgagctactacctggctgacatggcattcaggattgatggtactttcagaacctttcatgcattcaggacgctgcatgtgtagtcctgtgagcttttaaggattcgcggttgcactggctgcatggcacaccgcagcatgctccgcaggagaaccaccggcatcaattgtcatgatcgggagggagcatatactcgatggcctgctgccagggggtccccccgcagcaatctcttcctgtggcagccttcgatcgcagtcatggcgagaggaacagcgctgctgggagcatcggcagctcttgccgcggggtatctgcttgcgaggtgcgcgtggtgtgcgtgctcgccacaccaatgaggcacatggaatgcaaatggatgacagccggcaagccttcgtgtttgtatttgttcttcaagtagccattaagctggctgcatgccatgtggtggatcaggcctcctcccctccccaccttcctccaggcgcctgcaccccaactacagcctgaacaagctgctgaacggcaacctgaggctgttcgggggcagtgatcggcgcctcctccgcaccctggcctcctcgtccgacaggcgatacctactgcagcactggccccgtccagggaccaaggacgccgccaagcgcgacctggtggcggcggctgcgggtgcgcaaggcgatgctcctggcagcctggagcccctgcgccaggcggtgctcaccgcccccgtggccgagcgccgaccccaccgcctggtggcacacggcgacgtgagggtggacgactactactggctgcgggacgacgatcgcagcgaccccagagtcctggcgcacctccaggcgaggcgtgcgccgcgggggacgggggtgcgggcgcgaagcgtgggcaggagcaggggctcacagccctgcacatccatgttgccgcaatgacagtgactggcttgatgcctgcctcacacgacagtgcactccccctcccaccttcctcgtcgtcgccaggcggagacggagtacaccaaggcgatgctggccgatacggaggcgctgcaggaggcgctgaccgccgagatgaggggcaggatccaggaggcggacgagggcgtgcccaccaggccagtccgggctggggggctgtttgtgcgcaatggatggcctgaccgaggggaggccgcctgcccatttctctgctgcggccgccggcctgaggcgaggttttgttccaaccttgccctggtcgcaccccattaggtacgggcagtaccagtactacagccggacgctggagggccagcagtactcggtgcactgccggcggcggctggggccgggcgcgggcgcccggccgtcggagacggatgccctggaccccagccagccggaggaggtcctgctggacgagaatgccgaggcccgggcgcacgctttctacatggttggcggcttcgaggtgtcccccaaccacgagtgcgttgctgggcttaattttgggagatggtgggttcttggcgcatgcgtacgggtcgtggcctgaatggcagagcgcctgccccttgtgctgcttttcatccagatctcgtccttccctccttctcaccatcccctctgcatctgcccatcccaggctcctggcctacgccgtggataccgtgggcggcgagaagttcacgctgcatgtcaaggacctgaagacggggcgggagctgctcactgagccagtgcaggtgagaggttgaggggtgtgcttacgctttggtttgaccctggcctgcctggtcatcgggagtgcctggaggtggtggttgtggccctgctggtgccacctgcgccctcggatggtgccttgcgcactcatgtccatggcctgtctgcccatcgatacccctgtgcgcccccccaccccctccccctctctttcaaaggacaccgccggtaactttgtgtgggccaacgacaacgccacgctcttctacgtgaccaaggacgccctggaccgcccatacaaggtttggcgccacagagtgggcacccccgccgccctcgacgcctgcgtgttccacgaggcggacgaggcattctatgtgggcgtggggcgcacgcgcgacgaccgccacctcctcatctccgccggctcggcggtgaccagcgacgtgcgcatgctccccgccgacgaccccaccgccgactggcgcgcggtgctgccgcgcgcgcacgagaccgagtactcggtcaccacgcgcggcggcgcgctgttcgtcaccctgcgcgacgccgcgcggcccaactcggaggtgctggtcgcgcccctggccgaccccgctgcccttgccgtgttggtcccccaccgcgacgacgtcaagctggagggcatcagcctgtcggcggggcacctggtgtcctttgagcggcgggagggcctccagcaggccgtggtgtatcggtgagggggggcaggagagggaccgaccgagtggcatacatggcagcagcccctgcggtgcccgtgtatccaggactctgtgctgtggcacctccgtcctccctctcctgcaaaccctccacctcccccctctgccacatccctctcccatcagcctgccggagggcctggcgccgcccacggccgagaccctgggggcaggcgagcccgtgaccctggacgagccggcctacgagcttgggccagggtcccagggcgacttcgactcccccctcctccgcctggtgtacagctcgctcaagccccccgccaccaccatggacgtcaacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcggccgaggtcgttcgtgcttcgcactcccggtgccgacctgtgcatgcgccggctgccctccccgttccaccttgctgctgaggtgatacctcgatgcaggcacgcccttcacttcacctcctggctgaagccccacccttctcacccgccccaccgtccaatcacatctcccccaccacccgactcccgcagggcaataaagaaagtgcagcccgtgctgggcggcttcgaccccgcccgctacacgaccgaacgcctgtgggccgccgcgcccgacggcgttcgcgtgcccatctccctggtctaccgcgccgacctggcgcgccgcgacggctccgaccccttcctgctggacggctacggcgcgtacgaggtttgcaacgaccccgacttccggtcgacgaggctgtcgctgctggatcgcggtgtgggcttcgccatcgcgcacgtgcgaggcggcggcgagatggggcggcgctggtacgaggccggcaagtacctggccaagcgcaacaccttcagcgacttcatcgcctgcgcagagcacctcgtgtccgaggggtacacccgcgccgaccgcctctgcatcgaagggcggtccgcgggcgggctgaccatgggcgccgtgctcaacgcgcgcccagacctcttccacgccgccatcctgggcgtgcccttcgtggactgcctgaccaccatgctggacgcctccatccccctcaccgtcatcgagcgggaggagtggggcgacccgcgggaaccggcctactacgactacatgaagtcctacagcccagtggacaacgtggccgccgccgactacccgcacatcctggtcaccgcgggcctgcacgacccccgcgtcggctactgggagccggccaagnnnnnnnnnncggacaacgtggccgccgccgactatccgcacatcctggtcaccgcagggctgcacgatccccgcgtcggctactgggagccggccaagtttgtggccgcgctgcgcgcggcgcgcaccaacccacgcaagctcctgctgttcaagtgcgacatgggggcggggcacttcagccagtcggggcggtttgaccgcctgagggagcgcgcggtggagatcgcgtttttgctgaaggcctgcggcctcctggacgcccgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaattgattcaaaacttctgccctcgtcgcactgtcctgcaagattccttccatccctgcattcattgtcnnnnnnnnnncgccaattgatgcaaaactcctgccctcgttgcactgtcctgtaagattccttccatccctgcattcattgtcatgctagtcgagcaattcaaagggagcatgtgggtaagcattcccacgtgggcaaacagatctcaaaccggtgatggaagctgggcggagcgtgcccgctgtgggaccgggccatgcagcgcgcgtcgagggggcccaagccccctgcgcgccaatcgcaatctgcaaggacaaccaaggcagtgcatgccagtcagtgcacgttccgccgggagctccggcatgtacggcccagcttaagcccggctcaccgcaaatgggctgcggccactccaaggtaccaggtttggaggggcaggagtcttgcattgtttattcatatcacgcgagtatttttatgttgcccgcgcgtgagctttgcggtgcccggctgtgctgaatgcggcacccctgcttcagccccacaagaaacaaccctcccccgccccccaacgccaggccgtggagggtttggagcaagcctccccgcccccccggccccccac

SEQ ID NO: 37412 - DNA, 67 bp, Chlorella protothecoides
gccaggttgagaatggtgtggccagctgccccctccccatcaaccagtacattgacacgagtggtgg

SEQ ID NO: 37413 - DNA, 84 bp, Chlorella protothecoides
cacagatatacaagtcgttattatggtaatcacatgcgtcgagtgtttgtgacaagtgatgcctgtcagattgcgccccaactc

SEQ ID NO: 37414 - DNA, 79 bp, Chlorella protothecoides
cgtggtcatgcccttctttggctccatggcggggctggtgggagcgctagccttcttccccctgaccatcttcttcccc

SEQ ID NO: 37415 - DNA, 70 bp, Chlorella protothecoides
gaacaagacacatacatatgggagggtggagatatcagatcaccggggtggtgggcccccttgcgagggg

SEQ ID NO: 37416 - DNA, 155 bp, Chlorella protothecoides
atgttcgaggagcacgcagcctccctgccgggcagtccatagacaaaacatatcgtcatgacattgcgattcgtgtgcatgtccctgctcctcctcgtggcatgccaggtgcggctcgagggtgggcaccctgtccttctgggtcgaggcactca

SEQ ID NO: 37417 - DNA, 80 bp, Chlorella protothecoides
ccagtccaagtgcccctacttgccacccaagtacaaaatcaccctcaattcccacctttcccattgcctcaaggtatcgc

SEQ ID NO: 37418 - DNA, 146 bp, Chlorella protothecoides
catgtgagttatgggcgcgcccctgacctgtgggtggcgactcatttctctcccgtgcttggacgatagtggctgatttagagccaggatcatcctcttgacccccatcccgaccactcccctgcgcagcaccaccgtgttcagcc

SEQ ID NO: 37419 - DNA, 66 bp, Chlorella protothecoides
ctgggtccatgggaggaaggtgaggggcgagtatgtgcttggaagtgggcaaggaggaggcagtga

SEQ ID NO: 37420 - DNA, 102 bp, Chlorella protothecoides
cgatggggggtattcacaggcgacttccttgttcgaagtaggtgctggagggaacaagaagggcaggaacacttccccgccctcttgccttgcacagcacca

SEQ ID NO: 37421 - DNA, 73 bp, Chlorella protothecoides
tccaagggtcggccaggtggtcgctcaggttctcgaggggtcccttgccggtgacgatggcctggacgaagaa

SEQ ID NO: 37422 - DNA, 123 bp, Chlorella protothecoides
cggcaggcccagggacgaacgggggcgggggcgcgaagccgcgcgcgggggcccgccggggccggcgccgtcggcgtacacccgcaccacgccccactcccgcccggtggtggcatccgacac

SEQ ID NO: 37423 - DNA, 97 bp, Chlorella protothecoides
cattggtagcacagtaccacatgctccgagatgacaccgctcccccaaaagaagccagcctggctaccaaaacagcctacttcttcccagccgcgct

SEQ ID NO: 37424 - DNA, 66 bp, Chlorella protothecoides
tggtgcacggccctcagcatggttgcgcaccccccctacccggcttgcagtccgctgttatggctc

SEQ ID NO: 37425 - DNA, 72 bp, Chlorella protothecoides
ctccttgccccagcagccgatgtcctgggttttccagagccctctctgcccactcattcccttggcgatgta

SEQ ID NO: 37426 - DNA, 166 bp, Chlorella protothecoides
ggggttgatctggggagttgggaggggagggggggggggcaagtgggctgggggcagaccctggcaggtgcccatcgcaaccaaaaggtaacaacgcacccaccagccaccccctggaggtgaggcacgcaccagggacacgtagctgtacagcgtgcgccctatc

SEQ ID NO: 37427 - DNA, 61 bp, Chlorella protothecoides
ctgcgcagcgtcggcagcaggcctcggaggtgcacactacgcctgacaccctgggattgat

SEQ ID NO: 37428 - DNA, 71 bp, Chlorella protothecoides
cgatcagccctctcgcgcctggggccctggcagctgggctcgtagcgagcactggcaagcatgccgtctgc

SEQ ID NO: 37429 - DNA, 132 bp, Chlorella protothecoides
gcggggtagaaacgggggaattgaggcgggatctgggtcggactccagggtgctccccactgcccctgagcaaaatacaggccctgggatcccttcaggcggagcgatgaggtccctggtggcctgcgcgag

SEQ ID NO: 37430 - DNA, 61 bp, Chlorella protothecoides
cacgattgcactccctggcgacatgtggtgtaccccccctgcccccggaacccttgcccaa

SEQ ID NO: 37431 - DNA, 104 bp, Chlorella protothecoides
aggttgcagggatctacactgccccacaacagaacaggatgaatgcggatccacagagcggcagcagggtgccggccagccagaccacccccacccaccttctt

SEQ ID NO: 37432 - DNA, 443 bp, Chlorella protothecoides
  modified_base (208)..(356): a, c, t, g, unknown or other
acctcggggtggtaggccatgaggttgaggatcggggccgcctcgtggagcctgtgctccctcacatgctggaagccatgccgcgagtagaagcgggtggaggcggcagaggatgcctccaggtacacgccccgctcggccttggcagcctggtccttgatgtgctggatgagctgcgcacccatcccctggccctgcacgcggacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggcacgtaaggggagcgccgtgcaagcatgcatgcaatgtgttgagactcgagtcacgctaggacctgcgatggggcaagtgct

SEQ ID NO: 37433 - DNA, 61 bp, Chlorella protothecoides
cggagcatcggaacgcacctgccgacttctgcttcggtgcaaacatctcgacgggactcgt

SEQ ID NO: 37434 - DNA, 152 bp, Chlorella protothecoides
tctgcgacgtccaggaccacttgcagcgcccggtttctatgaacgtggcagggcctggttgacctcaaacgcctgcccctcccagacgaatacccaaccaccccgacctctgtcccacaggccggctggccaacgccgagtacttccggcgg

SEQ ID NO: 37435 - DNA, 70 bp, Chlorella protothecoides
cccgacccaatcactcaggcaaccccccccccctctccgtccctcccctttgcaggtgtctggcggggag

SEQ ID NO: 37436 - DNA, 61 bp, Chlorella protothecoides
ctctgtacttgccgggccctgcgccccccgacctgccatgccccaccttgcccctgccctc

SEQ ID NO: 37437 - DNA, 61 bp, Chlorella protothecoides
gtggcccggacggaaaccccaccaccacctcccctcctgccacgcagccgctggaggatgc

SEQ ID NO: 37438 - DNA, 80 bp, Chlorella protothecoides
gggccaagggtacacggaagtagtctgtcgcgcaggacccgactcccaaccccctctctccccgctcacatcggcatctc

SEQ ID NO: 37439 - DNA, 70 bp, Chlorella protothecoides
cgcgcccgagcgcgtgatgttctcgctgccagccaggtccaccaggtacagcttgcccacccggatcacc

SEQ ID NO: 37440 - DNA, 62 bp, Chlorella protothecoides
ccacacggtacatagtcatgagcaagacccacgtatattcccgccacccaatggaaagcccc

SEQ ID NO: 37441 - DNA, 7341 bp, Chlorella protothecoides
  modified_base (100)..(171): a, c, t, g, unknown or other
  modified_base (741)..(750): a, c, t, g, unknown or other
  modified_base (1162)..(1171): a, c, t, g, unknown or other
  modified_base (1238)..(1247): a, c, t, g, unknown or other
  modified_base (1434)..(1443): a, c, t, g, unknown or other
  modified_base (2734)..(2743): a, c, t, g, unknown or other
  modified_base (3528)..(3595): a, c, t, g, unknown or other
  modified_base (4858)..(4867): a, c, t, g, unknown or other
  modified_base (5924)..(5933): a, c, t, g, unknown or other
  modified_base (5998)..(6144): a, c, t, g, unknown or other
  modified_base (6954)..(6963): a, c, t, g, unknown or other
gatcacaagcccaccctagcgaacgaggcaatgtctgcgctgcccgccttgagatgcagcagccccctacatgtcctgaacacctgtacatgccccccannnnnnnnnnnnnnnnnnnnnnnnnnnnnnnnnnnnnnnnnnnnnnnnnnnnnnnnnnnnnnnnnnnnnnnncatcgtagattgtactccttctgagcccccgcggcctttgctcctcccccgcattttcatgtacttcctttccctggcatgcccagcatggcgtgcatttttccccagcttggctgctcaatcgctccgcacggcctgcgggcggcaatgcgacctgccccactggcagcgctgaccgcctggttgcaggccccaatgcccggcatgcatcttccgcgggcacttgcccgagggacctggctcactgccacccctgacgcttctgcggaatgatattggtgttgtccccccactgccctgttaataccggtagcgttccatgatcaggaagggggcaggagcagggtctccaggagggcggccgtggtgaccgggccgcgcctcgccaggtggcggtgcagggtgaagacctggtgacgagtcagactggtgcgctgagtcagcacgcctgccagctcctccacactgagcacgccgtgcaggggcagggcagccctcagctgctgcaccagcttcccatctgacgagaggggaggcaggaaggggacggtgcggttggatcctcgaacnnnnnnnnnncaagcagccaagcttggaaaaatgcacgccatgctggacatgccagggaaagaaaggacataaaaatgtgggggaggagcaatggccgcgggggctcagaaggagtacaatcaactatttgggggtgaggggtggaggtttccggcatgtatgccaggagaaagattcgttgccagcagggagggggtggggggcatgtacaggtgttcaggacatgaagggggctgctgcatctcatggcgggcagcgcaggcagtgcctcgttcgctagggtgggcttgtgatcgtgggaggggctggtgacagccagaggcctggaaagatggcatgtatggatcaatgagcgagggtcccctcacacgggggcccagagcaggctcgtcctcatccctgcgcggcccgcgccctgcannnnnnnnnntggattcatgccaaactattgggaaatggggggatatttcacaggtggtggggcgtggcatgcaacnnnnnnnnnnaagcgagggtcccctcaaacaggggcccagagcaggctcttcctcatccctgcgcggcccgcgccctgcaggcgagacgcgggctcggccaagggaccctgttccggctctggtgcggactgcgagggtgggtgagggccccattcagcacgtcctctgggaggcccctccgtcggacggctgtccnnnnnnnnnngccctgttccggctctggtgcggactgcggggctgggcgagggccacattcagcacgtgtcctgggaggcccctccgtcggacggctgtccgggcctcctactcgcagcctcccacctccagccccaccaggtcgtcagaggagtggcgcaggcgggacccggcctcccccgcggcgcccttctgcttcagcttgctcttggcggcgctgagccggttggcgaggatgcggcgcgccttcttggggtctatgcgcgggtccatgcgtgggtccgcggcgggctgccgcccacccttgcccttgcgcaggtgcaggggggtgaggtaggtcatgtggggcacggcggggcggcagccgtccagcagctggctggccgaggcggagcgcggcagcggatgggaggggggcccgcggcgtgaagaccccgggccgcgcaggcgcagctccggctcggagcggcgcgacggcagcgcccgcacgtgcagctcaggcagggactgggtgtggggcatattcgggccggtgtagggaggggggctgggagccccgtccacgctgggcgggggttgcagccaggcctggggcgcctcgctgcgagggcagtggggaacgcatgtgtgtgggggtgggtgggggtggctgcctgatgccctcgtggggactgagtggggatcgatggcgaccagggcatgccctccagggctggcactgggtcttcagtgcacgagtgtgtgagacggggagccaggtcaatgacacgctgcaccctgtggcgcccctgcgcgcttccccacccagcggcatgcaggggctcacctgggaggcagggtggacgtcagggccgtgccgtccagcagaaaaggggatgactctgtgatggcgggtgtgtggccaaagctgccggcatagccggtggtgggaccggcggcccagggctggcccgcactggcggcgaggggcgcggagcggtaggggccggggttgatggggggcagggcgccccagtccgccaggaggggctctgtgtcaaaaataaagtagtctgagagcacggcggaggaggccgaggagggcacagaagccacgccgatggtatctgcctccaggtcgcaggcgtccaggaggcggcccccgctgccggtctctgcgagcatggggtttaatgcacgatcaagcagcttcccgcggcgtctggcatgcaagggggggcccggggaatcgagcaggcatagggcagaaagcactccattgctcagcctaatggatcagacaaaggctggcaagcagtgcnnnnnnnnnnaccccggggaatcgagcaggcatggggcagaaagcactccattgctcaggctgatggatcagacaaaggctggcaagcagtgcacagcaatatgagcctgggcgacggatttcgaacagcgtcggctgccccaaatttctcctgcggttctggggcccctcacctgcatgcatcccaggaaccgggatcataggcgagctgaacatgctcccaaggcgacgaggatagtctcgtgtgagtgtgtgatgcggtcgacgctgagagaggggccgcgtcagggtcagtcaacgtgcacggtcggggtctgaacctgcgtgggccgatctcgtggctgactccctgtggcggaggcaaaccgggcgttatcaagatatttactctaaatctgctgtgatccctgcatgcgtgttgacttggtattgctaggccttggtttccgggcctcggtgtgtcaacgtcgcctagcatcgacgtccgaaaccctactttctttggcacctgattcgcgtttgcatgcatccgagcaacgcgcgcagtgcatcgcagaacatcatagactctaaaaacatcgttaaggtaggtttagtctgtgtcttcgaggagacagaggcagaaatcgatgtgagttggaaatggatccatcctcttcattaccaggtccggctgagtaatggtgattcatcatggagcgttcggagtggccaagggagagggcggagcacaaccccaacaagagtgggcccggctctgatcatcatgtcattgggagatttcgagcactatcnnnnnnnnnnnnnnnnnnnnnnnnnnnnnnnnnnnnnnnnnnnnnnnnnnnnnnnnnnnnnnnnnnnnatcacaaagcaatccttaggaaggctcaggccatggtccagcaatggctaaggctccgattccaacacacgagcccgtgagtgtactcttaattttatgagagtctccaggagttaccttgtctttgaccatgcccaaagagagtctccttggaactctcttggcctcgcatagactcctgtacagcagatcaaagccgtaaggcgtaacaagcctaccctaatcaaacaaggaagccatgcagcaccaatttggtcgatcttaccttcaaaaggatgatcgcagacccccaccttcaaggaccagcacattaggtattccgacgcgcgagatctcgaaaactcggaattgtgcaacagatagccgagctcattttcgagcttgtcgtgacttttcagtggagttaattgtactttttcgaggctatctggccccgcagggcattcggaaggggtcctgacctctgtaactgacccgaccaagggtgctcttgccctgctgtcgggacccggtctgggtgtcgaacgctcaggcttgctcccgcggagctcccttagtcctggtccatggcacttctgacgcatgagctggtgccgggaaggagtctgggaccgtttgtcctgggtaggttatctccttcctcgtcggtctcgagtctggggctgggagccgaggatcccccgcattcctcacccccaagccccctgtaccctacaggtgactcgataacacacaccatggcgtatctgcagcagcatcgcaagtcctacagacgcgttgaggtccagtatgagcctcaggtattcaccctgggtgccgtgcgaccagctggccggggaacgcgtgaccgtccttgctcgtgatgagcgtctcctcgtggtgcataccgcgcgtggtggggcccgacacatcccgtggagtcgccgacccgcccatcccctccccccttcccctgcaggctctgctgagccgcgacatcctcgtcaccctgccagagcacggccttcgcctcgcctttgagccgctgactcagcgcctgcgcctactggagatcctggacagcagccacctcctggtcacgtatcagaaggcgcgcgcgttcggcggcatggcgcaccctccctgcctgggcggcatgtatgacacctttgggccgacctacccaggtggggggcggggaggtcgtgccgtccccgttactccagtgctgccagatgtctttgatggtgggaaacacactggaggtgtcatgcctgtggggtnnnnnnnnnncggggaggtcatgctgttcccgttacctgagtgctgccagatgtctttgatggtggggaacacactggaggtgtcatgcctgtggggtgcaactcaggtggctggctgaaatgtcaaccctccagtcgggaggtcacatccctttccctccgacgaatctcgccgaccccctcactctcctcttccccccccctccaaaccttgttctcagtggagtgggaccccgcgtcagcgtccttccctcttctctacccggggctcctcctcctcttcccggtgcccccctgcgacaaggccacgagtctggctcccggcaacgatgccccgcaggggttcccggtgccgcccaccacccaggcctcccgggtgtgcctcttcacaggcgcggctcgcgacgcggccgctgcgctggcctccccacccccgccacgcgggcaccccggtgcagcccgcgtgctgcatgccgtccccggccgcggagtctactccgaggcagggccggggggggcgaacaacgtctgcgtggagctaggggactccccccaggccgtcgtgacgcggctggggccgcccaccttcaccagtgctgccgcggagcaggtgcttggagttttgggttgggggtgtgggtgggagggccggtggtgcggcggcatccgccaggaagctaagccaggagaggagacaccagtgctctcacacgccccctcgccatgtcaccgggctgacgccgcccagtcccccccttgcccttgcagcgaggcctgggcgcccgctacgtctacatgtaccccgacctggggatggatgtcgtgttgggcgcacggactcacgccgtggagaagctggtgctgcacgccagcatgcccggctccgcaggcttcggcctcgcctcccgctgctccttcaggtgggcacggggcgctgcattttggtagtgtgcgaggcatgctcaggcaggagtgatgcttggcaacagggatgggtggcgaaacagcgggccgggaagggaggagttcctgaaaacgaggcacccggcggtgctgcaggaccgctnnnnnnnnnntctggggatggacgtcgtgatgggtgcgcgaacgcacgccgtggagaagctggtgctgcacgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcagcgggccgggaagggaggagttcccgaaggcgaggcacccggcggtgctgcaggaccgctcacttgcgctgcagcgggagggggcaacggtgcctcagcctctccttgctcatcccacgcagggtgtacgcacccgggaccatgccaatggacaccccacgggcccgcctggtcgcgggtaccagcactgctggcggccgatcgggcgaggagcctcggccagccgagcggcggggcctgactggccgggacgcgacgaccgagcacccggtgcatgtcgagcatgctgcatcgcagggcctcgacctgctcgtgccaagccccctacgtccggcgtctcccaccccctcctcctccatcgacatccccctggccggccccgtcggcgcccccgcgccacgcgtcggcgggaaaaaggggaagaaggcacggctgggccggtcgcggctgggcggcgccgccgcgcccgcgcccgacgacacctcctctgcctcttcggacgccggcgccacggaggcaggcagcagcctgggctcctccccttgcctgggcaccccgctcccccaccgcgaacccccatccaatgctggccagaccgccagcgacgccgacgtcgacagcgactgcggtggcgggcgcggggcagggggaaggcacggggcgtccgagggttggtcggacgcagacgacctggcggctctggtgctcgacgacccgccccggcgcctcggcggctgtgttgcaggaagccccgcgccggcgagccccgtgccggcgagccctggccggacctgcgtcggcgtgnnnnnnnnnncctggtgctcgacgacccgccccggcgccttggcggctgtgttgcaggaagccccgtgccggcgagccccgtgcgtgcgagccctggccggacctgcgtcggcgtgcagaccgacgacgcgggcggcgagcctggcagccacccccacgcccacaccacggcctgttcctgggccccggcggcggcgggggttgggggcgaggacgagaccgacgacgacgaccggtcgaccagcctggggtcctgggacgaggccctgctcccgcgccaggccccgctggccaccggcgacggcgctgaggccttcgagcgcgtgccgctgcagcgcgactgcgcgacccagacgcggcgcggcgcgcccgagcgccgcgccgcgct

SEQ ID NO: 37442 - DNA, 80 bp, Chlorella protothecoides
aagccgtccatctccaccagcagctggttcagcgtgttctcgcgctcgtcgttgccgccggcaaagccgccgcgcccgcg

SEQ ID NO: 37443 - DNA, 64 bp, Chlorella protothecoides
ggggggggggttaaaaggctcaaagtgtgtaattgagggtccgtgacgagctgtgtcgagatgg

SEQ ID NO: 37444 - DNA, 61 bp, Chlorella protothecoides
cttggctgccaggtactccggcaggtcctgcaattgcggcgccttgaagacatggatctgc

SEQ ID NO: 37445 - DNA, 78 bp, Chlorella protothecoides
gaaatctcctcaacccatcccccccttcacaccccaccatctccccgacacgcctgcaggaacagcgagatctacaac

SEQ ID NO: 37446 - DNA, 77 bp, Chlorella protothecoides
cccccccccccccccacacacacacacaccgcaccattcccagcacccaactcagcccgcacctggagccactggac

SEQ ID NO: 37447 - DNA, 496 bp, Chlorella protothecoides
  modified_base (121)..(348): a, c, t, g, unknown or other
cagtctctcatcctgggagtcctgctgtgtacgcaggccctcctgcagggcgcagggcctcttcaggtccacccaggccgtccttccccttcccctcccaccgccacaggaggagctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccggccgacctgagccccacaccatttcctcgttgccagccagcccaaatccataccttctgcacaacccccttcacacacaaacccctcctcccccttacctcacagggtacactcacatcctgaagaccgacgacgactgctac

SEQ ID NO: 37448 - DNA, 95 bp, Chlorella protothecoides
gcacaactcgtagggttcacattacagacatgcaccaatgtcgtgaataactattcgcgaaacattcgttcccgcttgacatcgattttatcaca

SEQ ID NO: 37449 - DNA, 66 bp, Chlorella protothecoides
gctgcggccgtatccacgggtacggggagttcgtaggggacatctcctcacatctcactgtaatcg

SEQ ID NO: 37450 - DNA, 80 bp, Chlorella protothecoides
cagctcgacctccccaccacgccccaacgcaggagccaccgtctttcaggtccccctgcttcccgcggccgctctgcatc

SEQ ID NO: 37451 - DNA, 61 bp, Chlorella protothecoides
ccacactctcctcccacgcgcaaccccaattctccacccagacccgctacctcctagagga

SEQ ID NO: 37452 - DNA, 143 bp, Chlorella protothecoides
cagcgcggcgttgaagtcacaggtcctggcacccggtcggtccagcaggcccaggcatccggccacatccccggcctgggccagcgcccggatgcgctcgtaggtcacccgctctgtgctcgactgtgttggggcagggcggc

SEQ ID NO: 37453 - DNA, 78 bp, Chlorella protothecoides
tttgcttggggcagagtgggtcccacctcctcctcctcctcctcctctacagtgggaagcttatccagtgaaggcggg

SEQ ID NO: 37454 - DNA, 61 bp, Chlorella protothecoides
agaggcccagaccgacgagaccctggcaagtcatgccgtggcggatgtcgggtcggaggtc

SEQ ID NO: 37455 - DNA, 210 bp, Chlorella protothecoides
cgagcgggcgcggatgctgggcggctggggcatgctgagtgcgggtaaaggcaggcgtgccggcgatagtgccgacgcagctgagtcgccgtccattatgctgccgccacgccctgcaacgcgtcgccaccttggccgctgacggccgcatcgccctcgcccaccctaaccagctgcaccgccacgcccgcgcctttgcccttgccggca

SEQ ID NO: 37456 - DNA, 70 bp, Chlorella protothecoides
cgccgcacgccgccgccgcgccaaccagctcccgcttgccaaccctgatcccgactatcggctgcccaag

SEQ ID NO: 37457 - DNA, 78 bp, Chlorella protothecoides
gatgcatgcctcatgcacaaggcacccacccaccagacgatctcttcgagtatgttgcgtggctcatcctctggagtg

SEQ ID NO: 37458 - DNA, 2825 bp, Chlorella protothecoides
  modified_base (576)..(678): a, c, t, g, unknown or other
  modified_base (1582)..(1591): a, c, t, g, unknown or other
  modified_base (2275)..(2284): a, c, t, g, unknown or other
ggtctcaagtgccatgcagcctccagagtcccatggtgtcatgcttggctggtttactcctcccctcctgcgacctctggcgacacccctcaccattccccactcctcgagcctcaatacacacgtcatgcctccaacaatccaatgctggcgtcattgtgggttgcgagatcattcgtgcaggctcgtccacccctcgcaccaggctgggagatgcagaggtcctgcaggccaggggtggtagccccccatgacgaggtccctggcgggtcccaacatcatgcacagactctgcaggtatgatggagatgccatgcctatcctttggcctgcttccttccctcgatggtcatcatgcccgccgccaccatgcaggacgaccaccaatgccgacatggagtggccgaccaccccattgcccacccccgcccccctccttgattctgactctgcagcctggcccatgaccccatgcattgatgttttgaatgcccatcagcacacacacacaccctcttccccccccaaaacacacaagcacaccaaactcaccccaccccccccccccccacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacgctgcgaccccgactcatagcccttttggcatctctgatatcttaggtcaccctgttttacatctggacgtgcaggcatgacactcccctctccacccaccgtccccgaagggtgtcgtgcggttgcacaccagggacacatcctatgaggggctccccccccggacgcaccgactcggcctcagccacaccaagccaacacatgacatcacccagcatcatcctcagcacgccgccgaccccagtacggccaggacgtcctggtcgtcactggttcctgcacagacttgcctgcagaatccacaccaggcatggggccaacctggtgccccccgcatcacatacccaggctcagaagcttgtagtacgtcccatacaacccccagagccctgtgggtgccagtcgtcatgacccaggaggccctccccccccatcccaccgccctcccagcgcctgcaccgccacatgcaggggccaggcgcccccacgatcatcaagccaaatcacccacatgcacacatcatgaatgaagggcccagaccaacatgggtttggcggccctggagcagggcgtcctgcaaggcaccacacttcggagacagagaggctgatggcgggacgcacagatcctgcacccatcatgtgcgcgccccccctgatcctgcgtataaacagcaggcgcgatggccatcatgtctaccatccccgaatgctctgcatgatgcaccgcccggctcccgtgagccctggcaaggactgggtgccgggtgccccggccctggcagcacacctttggcagcaggccagcccccccctcggccccccctggtcaccctcattgaattcccagtatgcagatgaagccagcacagcagcccctggcatgggtgggtgctgnnnnnnnnnnggcaggccagcccccctcgggcccccctggccaccctccttgaactcccagtatgcagatgaagccaacacagcagcccctggcatgggtgggtgctggctctcaccccacccccatcttgcaccctgcctgcccatgaatcatgcatgccaccccaccatctccccaccctctccccccagccccactcccacacacacccctcaccccctacctcccccacccagactacaatcaccacagcctcaaggaccaccctggccctcggtcgcaaccccacgcccccttgctggcatggccaaggtgagggtgcaggtccctctcataggttgcctctggccttgacccacctgcccagcgacactccaaccccccctcctgccccccaacatccatcttcagctgcgtaagagtgcatccgggcgccccctcccgccgcacgaggcccagctcctgctcgggcccggatggcgaggcaggaatcatcccgggccatgacgccggacccgcccaccgtcgagatcacctcctgttccttggacaccccccgcccaactcccagtgttctaccatcactttatctgatctcaaggtagatcatgaaggcatgttgcgtgggatcagcagcagtttcggtgccctttggaatatatcaggggtcccgccacgtgcctgcccatccgnnnnnnnnnngcactcagcgcctcgccctcgctcttgtaccatcgcttcataggatcatctggtacaccctcaggccctggtgcgtgcgatcgggggccgttcggctgccctttggaataaaacaggggcacctgctgctgcctgcccaccggacgggctccaactccctcgtccctcctcctcctcgccatccagatgtcaaatttatgcatcggagtgtcttctacttgtacaccgaggcgcgaggatgttggtggccggacggcgaaatgtagaaatgtttgcgtcagcccggcttcccccaaggccctggctccggcctcgagatcgcctcccactcccggaccgtcaccccaaccacccccccaccctgtatcatctcttgccttgacaccaaggtacgacatggcggtgtgttgtgggggagcggcggcgccttgcctggcttccagaatttaataggcgacctcctggccctccagccctcatgccatgttcgaagaatgctgccacccctcttacccctcgccacttcccccgctttatcagt

SEQ ID NO: 37459 - DNA, 61 bp, Chlorella protothecoides
cgctgaggccggactctgctgtcaacttgttgccctggagtcattgccacagctcgaggtc

SEQ ID NO: 37460 - DNA, 135 bp, Chlorella protothecoides
aatctcctcctgttgcatggggagggcggttgatgccgggcagggacgtgcaggcatgctgggaaaaccgcgcatggccagcttggctatcgtgggcactctactccccaccctccgctttacctcggtgaagag

SEQ ID NO: 37461 - DNA, 77 bp, Chlorella protothecoides
gctgctctacaagtgggtgctcaatgggggtccccgatttgaagaccgggaacaggccaggcagatgggctagatgg

SEQ ID NO: 37462 - DNA, 78 bp, Chlorella protothecoides
cccaaggtgggaggcatgggattcagcgcaatgattctcattggggagtgttcaggcatctccagtctgacgtcttgg

SEQ ID NO: 37463 - DNA, 190 bp, Chlorella protothecoides
accagtggctgaatggtgaggggagaggggcgaggtgtttgcgtgtgtgcccccatgatctggcgctgcctgcagcagagtcaggcctgaggtcatgcagaacccctgcactgtccccctctccacccgagtccaccccctcccaccctgccctctgtctcagggtatgaggatccgatcctgctgctgg

SEQ ID NO: 37464 - DNA, 76 bp, Chlorella protothecoides
ccgctgcaattgccgtggaggtggtcgcctactctttatacacattgtcggtgttacggaccctggacggcatggc

SEQ ID NO: 37465 - DNA, 2810 bp, Chlorella protothecoides
  modified_base (952)..(961): a, c, t, g, unknown or other
  modified_base (1035)..(1188): a, c, t, g, unknown or other
  modified_base (1917)..(1926): a, c, t, g, unknown or other
  modified_base (2058)..(2067): a, c, t, g, unknown or other
  modified_base (2158)..(2167): a, c, t, g, unknown or other
  modified_base (2715)..(2724): a, c, t, g, unknown or other
ccccccaaaaaaaacctcacagaccaagacgagcgagtactgcgagcccatcacctcctttgactggaaccacctggagcctcggcggctgggcaccgccagcctggacgccacctgcacggtgtgggacatcgagcgggggtgtgtagacacgcagctcatcgcgcacgacggcgaggtgtacgacctggcctggggcggggccaccatgtttgcctctgtctccgccgacgcctcggtgcgcgtgtttgacctgcgcgaccgcgaccacagcaccatcacctacgagtcgcggggcggggaggcgctggtgcgcctgggctggaaccgcgccgacccgcgcttcatggcggtgctggccgccgggtcggccgaggtggtggtgctggacgtgcggcggccggcggcgccgctggcgcgcctggcgcgccacaccgcccctgccaacgtgctggcctgggcgccgcactccgcctgccacctctgctccgcgggcgacgacggcgcggccctgatctgggatgtgggcgcgctgggcggcgggggcgggccgggcggcgcggcgcaggaccccggcctggaccccatcctggcctacaacgcgggcgcggaggtggcggcgctgcagtggtctgccgcgcagccggactgggtggccatcgcctttgggaacaatgcgcaggtgctgcgcgtttagaggccgggccgaggccaggccagcgtgtggaggaggagcgccggcggagggcggaggcacggccccacggcgaggcgcggagggcgcgcagcgacaccccggctcgacgcctgagcggggtgcggacagagaatccaccccccgccgcgcagccgggagctcctgacagatactccacacagacccccagccattgaggaaggggtctgaagacccaacagaccacaccgggcgtgcagtcccggctgcacaccnnnnnnnnnncgccgcacagccggactgggtggccattgcctttgggaacaacgcgcaggtgctgcgcgtttagaggccgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacccccggccattgagggaggggtctgaagccccgacagactacaccgggcgtgcagtcccggctgcacaccccgcgagcgctccagctcgcgccatgggatacgcttttctcttggaagcttaccacgtcacttgtcattttcccagagccgtgtgccgcggggggactgtggcgcgccccggccccgcccaggggccggggcgccccctccccatggccgcacggcggcccctgcgcccgccgccgcgagcgccgtctgaagggcagaggcacggagcgtcccccaccccggcccgctctggcccctgaaacgagagacgggtctggaaggccaggccacgcccgtggcgcggcgctgacctctggacccgggaacaacccattattttactgtgctgcacttgctcctcccccggacccttgttacttccttccctgtccagcttgaaaccggtatgtgatggtgctggcttgagagaagacccagagcacaggggattgggtggccgtgaggatgggccagcggccccctggctgtgcaaacactggctgatctgcccaggggactgaggccacggccaggcagggcttgcgggagtatcaatgcagtgcttgccatgactcggaaccactcgggctcatggcggtgcgatcacatggaaaattcaatggaacacccactgcttcatgccatgcacgaaacgaggagcgacacgacgacgctnnnnnnnnnnagattgtcaatgcagtgattgccggcggctcggaaccactcggactcgtggcggtgcgatcacatggaaatttcagtggaacacccactgcttcatgccgagcacgaaacgaggagcgacacgacgacgctnnnnnnnnnncctttcgactggatagttcagggggcactcctgggctcgtgcaggttttgaccccgtagcaccgcgcctgccccatgcctgctgggtgggnnnnnnnnnngcgaggcacgagcactccaaggccctggggaaaatggcggtgtgcagtcaaggggctgaagggatgctcctccactttcgaatgtatagttcaggggggcactcctgggctcgtgcagattttgatcccgtagtaccgcgcctgccccatgcctgctgggtgggaccccacaaagtcccctcagccctgctcaggctccagcgcgtaggcggcgcccctgcacagcgggcagcgcagaggcacgggccccctctgcccggccaccacctggcgcaggcaggcggcgcagaaggcgtgcccgcaccctgccagccgcacccccggcgccgcgtccatgcagacggggcacaacgcctcgctgccggcggaggtgcaagacgacaggcgcggcagggacagcggcgcggcggcggcgtcggcccgccccgcctcccccgtcagctccaggtaggaccccacgtcgaacagcccgtgagcgtgcgtcggggaggcggccgcggcgccggcggcgcgctcagcggggctccccggcgccggcgcggacccgnnnnnnnnnnacccgtgggcgtgcgtaggggaggcggacgcggcgccggcggcgccctccgccgggctccccggcgccggcgcggacccgcgtcgc

SEQ ID NO: 37466 - DNA, 8677 bp, Chlorella protothecoides
  modified_base (886)..(895): a, c, t, g, unknown or other
  modified_base (1555)..(1564): a, c, t, g, unknown or other
  modified_base (3901)..(3910): a, c, t, g, unknown or other
  modified_base (4803)..(4812): a, c, t, g, unknown or other
  modified_base (5871)..(5880): a, c, t, g, unknown or other
  modified_base (6028)..(6074): a, c, t, g, unknown or other
  modified_base (6268)..(6277): a, c, t, g, unknown or other
  modified_base (7627)..(7636): a, c, t, g, unknown or other
  modified_base (8054)..(8063): a, c, t, g, unknown or other
  modified_base (8249)..(8265): a, c, t, g, unknown or other
  modified_base (8599)..(8608): a, c, t, g, unknown or other
gggggggggggggggggggggggggcgaggggtaaaactcttaagcgcggacgaccgccagcccgtttgggggctattcgagttctttgagcgcggtgattggcctaaaatttgggatgctccggacctctatagagccatgggctctgggaggcagagcctggcgtcggtgctgtgcctactgagtcgcaggcacacttccccctcacccaaactgccaccggtcctccaggttcctcagcaggctggaggggacctcgtgcagctcgctggtgacacgccgcaggccgccctttccacccgggcccgcgccagacggggggctgggcgggtgcacctccagccgcgaccccaggagctgggccttgaccacgtcgtacacggccttcttgtcccgatctgaccggatgggctggccgtctgcagggtgatgaggatggggtatgtgttgtgaggacttgaagacgattaaagcaacacagcaggcaatgtccccgacccggcaggcacggccgagaccgggtctgcatgccagaggcgtgccacccattcccaagatgggggccccgtaccctcctctccatccgtacgagcacgcactcggcaggtggatgaggaagcggtgcagctcttgggcctcgccctcgtcggcgtccatgctcaccgactcgatgaagactgcgcgggcggattcgggagggtgttggcatggtttggggcctcaaggcatgggccagagttgcatggtgggccagcccgaccccgccccgcggggctggccccacggccgcgcacctgtgccccgtcctccccttgctcctgcaagacaaccacgccccaatcaaaaccactcccgcgcctgtcttcgcttccccccccccccccnnnnnnnnnncgctcctgcaagacaaccacgccccaatcaagaccactcccgcgcctgtctccgagcccctcccccccgtaccctgcgcctgtcgttttttcacccccaacccacccacccaccacagtcccacgtcacccaggcccacactcgccgtcggccatgaagacgcccagccccgccacgctgagcgcctgggtcacgtcgaacgtgaccctgggccgcccgcgcccccccgtgtccagcggtgcggtgaccaccagctcggtgcagcaggcgtcgaagacgtcgcgcagcgtgatgcgcaccggcagcgtcaccgccagttccacgcggcgcttgacctcctccagcgcgtccctttttatagagggggggatccggggggggggggcagtttaaaaaggggagggaggagagggcgggacgggcaaagggagcgggggatggcagggccccgggtcctgctggatgagtctccaaagttatgcgaccacggcgctcaggatactgcacctcttcttcacctcccaactcttcccccatgtacccgcctacacggtccaccatcccgcccatccaaaccctccccaaccaagaaccccctgaacccattacccctcacacaaaccccagcaaaaaatccaaaaccctccacgcacgggtcgnnnnnnnnnnattctgcgaccacggcgctcaggatactgcacttctccttggacctcccaactcttcccccatgtacccgcccacacggtccaccatcccgcccattcaaaccctccacaatcaagaaccccctcaacccattacccctcacccaaaacccagcaaaaatccaaaaccctccacgcacgggtcgttgatgcggcacaggtcgttgtcctggatgaagatgtcgatggtcacgcccgcgccggccccgtcctcgtccacctccagccggccgtaggcgacacgcaggtccacgcccttgagagcgcgcaggatgtcatagagcaggcccttgcgatccgcgcactccaggctcagcatggtgtaggagggagaggtctcgttgtccacgctgacggtgacggcggagggcctgtccgaccaggcgtcgcgcgccgccgccgccgcgcctgccagccgtggcgagacctccgcggggatgggcacggggacgggccgctcggctgtgcgccgccgcgtcatgatagaacgcaggttgctgaaggacaccgcgtccttgcaggccttgcgccgcaccaggctggggccctccgcgatggagtccaggggggccagtgagatgctgcactccgtgtcgggacccagcacgcccttcacccgatcgcagatctccagcgcctttttattatggttgtgggaaggaaatggggaatggtgggtgacggccctcgaggttggggatctggcgccgttcgtgccccaggcagatggaggcttgtgaaaagtcctgccgggccccgcaggcacctgctcagcttccccgacgcagggtccatgatcgtcccaaattacgacacatggcatgggcacgacgcctaccctatggtgctccggcagctcattacggttgtcatacagccaaaacatgtcggcgacgtcgccagagggggaagtcgtgatgtgggccttgaacacctgtgcgatgatccaggagacaattggtggggcagggttggggatggcatgctggggtatgcaatcgccagcctcagagaacaggcgaaggggcctcctggcagtcgtctgaggtattccccgtcccccttctcgacagagacttcccggtacccctcctccattgccttacaccttctcctccagccctccacccctcggcccctcctccctgcctcaccgtcgcgtccgactcccagaggacgtgtgtcagggagtgcagcatgccctggcggtcgtaggacgcgacctgcagcaggaagggcgggtgctccttgggcagcgaacgccagcgccacagcgcgtccagcgccgcggtgccattggggcacatgctgcccagccgcgcccgcagcagctgccagcgagggggcaccccagagctgagctggacgcgaaagaccatgaagcaccacttgccgtcggtgctgatgtccccctgcaggatgcgcaagccaaagtccagcaggacgcgggtcaggtccacgcccagccccgtggcgtcggggcaggagatgcgcacctcccgcacattcaggtcgtcctccggcaaacgtctgggggagggccggtgcgcgagaactcgttcggtaacaatgcaggcctgccaaggggggcaacgcccaccgtcagcatactattcgtctcattaattgtacctgatcgagacgatgtcctcatctgggtccatcacgagcggcagggggtcgagggatcacctcccggcgggcatcggcagtggactgtcaagcgtcccccgaatccgccctagtaaatcctgtaaatcttcaaggtatgcactgggtgcaatggagctgtcgaggagctggggtgtcacagtcaatctgtaaccctgattcgaggtgggcggtgggcggtcgcagcaatgctggcaccacgctggcgactcggtgtcgggtgaattcgccactgagatgctcgttaagcaatgccgaagaactaggttgaatccgtgtacctgacgctgtttcgcgagttcagaggccgagcgggaaaagcgtgttgagcgcgcccggggtagggactgagaagccagatcagcaggtgaccctgtgcagaacgctctcatcaaactggattgcatgctgtctccaacacacattggatgatgctccttcctgtcaattaatgtgagaatcacccttgtccagtctgacaggtgcagggtgcagcttcctttccccgctaaggcaggtaatgaatggggaggtgatgttcaaggccgtaagaaaaggcgtccttcgagtccaaactgtcataagaaactcagactttgggtctggggcaatgcttggcttggttgcnnnnnnnnnnaccttcgagttgaaactgtcataagaaactcagactgtgggtctggggcaatgcttggcttggttgccgaagctttcccacactccggaggtgaagaagagaatctggatcagactccaccaaatcacgcgctgggtacgccatttggcgatgcacagtgtgcgcgctatttcatacaattccattgtagacataaaatctctatagagcttagagtgtttccatatcgtgaagttccgtggccatcattcccatgccagccctggcatggaccccatgcgcatcaggccgatcgcaagccccaccaggcattgcggggatggcgacggaagtgcaaggtcagagaaacatttgtaatggatatcacacctggcagccggcaggggtgcgagcatcacgcggcaggcacccccaacccgcatcgcctgcctctatgacctcgacccggcatggcaccaggcggtccctactcagcctcgcgaccgcaggagcggcacctccacccgcttcccgggaacctcgcgctgcgaagctgagctatgccgatctgtctccatccgaggtgcgcgtggcggtgctgggggccaccgggtacatcggccggttcgtggtgctggagctggtgaagcggggtttccaagtgctggccgtcacccgcccctcctcgggcatcggcagtaagcaaaaggtctccgacgtcgagaaggtgacttatctgtctgtacggaggaaacgatggtctgacctgtgtgtggtatatcatgcttggtgtggggttggggccaggagggctgcggcggatcaggcccccttctacgcattgttgacattactgtgactggtggcccccaaccccttgtctatgccaaggcgctggagggggccaccgtggnnnnnnnnnnttcaggcccccttctacgcattgttaacattactgtgactggtggccccccaatcccttgtccatgccaaggcgctggagggggccaccgtggcggtggccgacgtcaccgaccccgcagacctggagcgctgcttctcggagcaccccgccccacacgccgtggtctcctgcctggccagccggaccgggggcatcgccgactcctgggctgtggaccacgacgccaacgtgaatgcgctgcgcgcggcgcgtgccgtgggcgccgcccacttcgtcctcctcagcgccatctgcgtgcagcgccccagcctggaattccagcgcgcaaagttggccttcgaggccaagctgcgggagggcgggacgagctggagcatcgtgcggcccaccgctttcttcaagtcgcttgcggggcaggtggagctcgtggccacgggcaagccctacgtctggttcggggacgggcggctggcggcctgcaagcccatcagcgaggctgacctggcctcttacatcgcggactgcgtgacagacgaggccagggtcaaccgcgtgctgcccatcggcgggccggggcgggcgctcaccccgcgcgaccaggcgcagctgctcttcaaggcctttggaaagaaggagtggaccctgggcctgccggtgggcatcatggacggcgtcatcggcatcctggacctccttgctaagcctttcccagggctcaaggtgggtgggggtgggtgctgatggtgtgacacgcgtgtgtttgggggaaagggaggttgggggttgtggcagggcggctggggtttgcggcagggccctggctcgaaataggggatggggggaagtgtagcaggcatgcctcccatgacggttgcgaggtcaagcatcctggtatgcatagcttcttgaggtatcttcaaagcgcagcatttgggtgtgcaggtctcccagtacttttgggtgtttatgtgaggtgtaaatgtgcttttctcaggtgccatctcctgtctatcggccagggagcaatgttgtgtgatccgcaaagtgtttcagggcnnnnnnnnnngtgtgaggtgtgagtgtgctcttctcaagggacatctcctgtctatcagccagggagcagtgttgtgtgatccgcaaagtgtttcagggcccatctccccctccacccgactgtcaggaagcggccgagtttgggcgcattggcaggnnnnnnnnnnnnnnnnnnnnnnnnnnnnnnnnnnnnnnnnnnnnnnngtgtgggacgagaaggaggggaggtatgacgccgacgcgacgccagagtatggctccgacacgctggaggccttcttcaatagggttgcgcgggagggtctggccggccaggagctgggggaccaggcggtattcaatatcaatcgagggacctgatatgctaagagtgttgcctgatccattcgttggtcctnnnnnnnnnngttcaacatcaatcgagggacgtgatatgctagagtgttgcctgatccattcgttggtccttgcgcaagtagctgtaaggctggtcttctgtgaggccagctcaggtggtgtggtgctctcggcgtgctgctgcccatgctgcgcggagaccactacgatccggggcgcagacagatggtcggtccgcgtatgcgatcgcgtgccttctgggcccccttggagcaccccagtgcctcgaatagcgcacatgtactcgtgcgaatgctcctgcccgggtcagtaccaggcacagtcgccccggagttgcgtgccctggtacggcccaacagcgtccggaacccccgacgagtgctcagcccgctgccctgatcgtagatcgcccggcgaacattaattttgcgtattcaagacaatacttgaggttgagggggcggaggggctccctgaagcctcctccatgctgggtcggcctcgcgagaggaagtcttcccatatcaccagcccctcccgcctggataccagggccggcgccgaggccaaggatatcatgtctccaccccggggggtcttgcaacgggtgcgtgggatcgaggggatcgcttgctgggggcctgtcgccgggggggacgactgtacagtggtggggggtttgagaggccgggctcggccgctgcccacccgtcccgccggtccctcttcgaggcatgtacccactccgagccgacgatgcaattcctttcgcacgtctgtcctgcccgccacacccacagagctcccccctccctcacaccatcgaggcacccccctccagaccagcagctccgcccgcagctcccactcctgcgaggcggccccaacccccccctccctccagggccccgaaacggccaaggccacgccgcggcagagcgtgttcacgctggtgaatgcggtgctgggcgcgggcgtgctgggcttcccttacgtgtacaagagctgcggcctgggcctggccacggcgctgatcgcgctggtggtggccgccagcgcgctgtccatgcgcctgctgctcctggcggcagggcgcgcgcggcgcggcagctacgaggcgctggcggcggcgtgcctggggcccgccggcgcgcggtgcgtggacgcctgcgtcctgatcatgaacctggggggcctggtggcctacctcaacatcctggccgacacggggagcagcgtggcgggcagcgtggtgccccccggcgccgagcccagccgcgacgcgctcctcctcgcagtcaccgcgctcgtggcgctgccagtgacgctgggcgtgcgccgcgctgcactgctggccgtcgtctcccaggtgtccgtcnnnnnnnnnngctcctcgcagtcaccgcgctggtggcgctgccggttacgctgggcgtgcgccgcgccgcgctgctggccgtcgtctcccaggtgtccgtcaccttcctcttcttcttcggcgccgccaccgcgctgaccgccgccgcacccgccgcgccgctggcggagctgctgtggtggcgcccccagggcgcgcccctcgcattccccgtcgtcgtctacggattcaccgcccaccagatcctgtttgacatctacgagaccctgcagtcaggtttgaggggggggaggggcgtgtggaggggcgtgatgcatcgcgccgccgacccaggccgccccgatgccccacacggtcccctggcggggaccagacgtgcggaattggcatatcctggcgctgccccgccccacccgcttcaccggtgnnnnnnnnnnggggcgtgatgcatcgcgctgccgacccccgccgccccattgccccacacggtcacctggcggggaccagacgtgcagagctgggatgtcctgtcgctgccccgccccacccgcttcaccggtggatcccctccacctgcctctcaattataccccctaccccccccccccccccccccccccccnnnnnnnnnnnnnnnnntcccacagccagcgtgcacagcatgacgcgtgtgatccaccacagcatggccctgagcacggccatgtacgtgactgtgggcgcggcggggtacatcgcctacggccccgccaccgctggcgacctgctgcgcaacctgggcggcgacagggcctccgccccgcgccgcgcctttgagtccgcgctccgcatcggcttcggcctgtccatcctgggcacgctccccctcgtcatgctccccctgcaggccgtctgctcccgcgcgtgggagacggtgcgccggagggcgggggcgtgcgggccggcgcccggggtcgcgcacgaccccgcccgnnnnnnnnnnctgggagacggtgcgccgcagggcgggggcgtgcgggccggcgaccggggtcgcgcacgaccccgcccg

SEQ ID NO: 37467 - DNA, 431 bp, Chlorella protothecoides
  modified_base (126)..(345): a, c, t, g, unknown or other
ttggacaggaagaactgcacacaatgggggtgcatggagggtatgggtaagccacacggtgatatatgcccggactgagcgtccagcgcatgatgccagcagattcaggtggctctagagcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtactgcccctgcctgctgcacacgtcagaggggtcggtacagcgcagactcaatctcttacacagcctcatatccctaccacc

SEQ ID NO: 37468 - DNA, 61 bp, Chlorella protothecoides
cgaagtacctgcgtggggtcatatggcgggtgagagggcctgggaggctgccaccctcgtc

SEQ ID NO: 37469 - DNA, 61 bp, Chlorella protothecoides
tggcaggcatgtggagatccatgttgtctctgcggcgtttgccggcaagaatgcggtggcc

SEQ ID NO: 37470 - DNA, 61 bp, Chlorella protothecoides
atcggctgcgacccctgattgcgcgagcacgatcatccgtctttgtcgactatctgcaacc

SEQ ID NO: 37471 - DNA, 61 bp, Chlorella protothecoides
gcatggcgtagacggatggcgaggggctggtgaagccggccgggcgcaggcccgcctcgcc

SEQ ID NO: 37472 - DNA, 75 bp, Chlorella protothecoides
tgtacaaccaagcattacaacacggattccttcccgcaaaccaccccatgcgacaggacgtcagggccgggctgg

SEQ ID NO: 37473 - DNA, 61 bp, Chlorella protothecoides
tctgaagaggcatgcagcacacagcgggtcgcggccctcaaacgcgcagccgtgcatcccc

SEQ ID NO: 37474 - DNA, 88 bp, Chlorella protothecoides
aagttgacgcccagtttgaccagatccccacgataactcccaccagcccaactctaagaaagacacagatgcatggctggctcgtgct

SEQ ID NO: 37475 - DNA, 133 bp, Chlorella protothecoides
tagcctgtcgaggtgggaaaggagggttttaggggaggaaaagggcaggaaacaggcacaggggggggatattgctggtttttgtgattattgggactctaaacagaacttgggcgtgcggtggcaatggatc

SEQ ID NO: 37476 - DNA, 61 bp, Chlorella protothecoides
gctcgagcacggccccgcccccagcagcgcagtctcgttcgcccccgcgccggccgagctg

SEQ ID NO: 37477 - DNA, 77 bp, Chlorella protothecoides
ctgtggcccggagggccagagctcggagcgactcgtaaagctccgcatctcgctcgcgggcggcctggcggtcagcc

SEQ ID NO: 37478 - DNA, 61 bp, Chlorella protothecoides
ccaccagcggtcataccctgtcatccaactccaccccatgcaaccatacctgcttggccac

SEQ ID NO: 37479 - DNA, 564 bp, Chlorella protothecoides
  modified_base (204)..(473): a, c, t, g, unknown or other
ctttctttttttttggggggggggggggggttgagacaggggatcaacaagctgagcgagcatttggaggccagcggtgagctccattgatctggcacccagcccttccctgccacggcctgcagccccgacacaagtttcagtagcacagactctgagcgcatcccttcaaactgtcaatccccagctgacacacaacaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctggagagatcaacaacccgtattttgcaacaaatgtagacccctttgccggccactcgaggataccatcctctccgcgccctccctc

SEQ ID NO: 37480 - DNA, 183 bp, Chlorella protothecoides
cgctgcggcgacccctcctctgaggatgatgaatcgagcgggccggagtttgagctggagacgctggcatgggatgcggcctgggacctgctggggtttgtgggctggagcaacacgctgcaggccacggtcatcgcctttcgcgggaccgactcccggtctatttataactggtgagggggg

SEQ ID NO: 37481 - DNA, 61 bp, Chlorella protothecoides
cggctgcatggcacctcagattgctgggtgaaagaagaagaatcagctgtgagccgttcgg

SEQ ID NO: 37482 - DNA, 104 bp, Chlorella protothecoides
tgtcgctccatgctcctgctttccatcccctgtcgttttctctggagatggttttgcggcacatcggggggccgacacatgatcaagcccgtcctcaccgcaaa

SEQ ID NO: 37483 - DNA, 1714 bp, Chlorella protothecoides
  modified_base (522)..(531): a, c, t, g, unknown or other
  modified_base (1388)..(1397): a, c, t, g, unknown or other
cgaggccgcgcggccggtggccacggccatcgccgcgggcgcggcgcacagctgcgccctcaccgcgagcggcgtggtgctgtgctggcgctccgccgaccccctgctccaggcgcgggaggtgggcggcgcgctggccgggcgccacgtcgtgcacgtggcggcggggaagtaccgcaccgccgccgtcacgcgcgacggcagcgtcttctgctgggaagggcgcgccgactacttccccgccggcgcgcggaacgcgcgcgagggcaagcgcagggcggcgggggtggcggtgggaggggccgcccagcgcggcaggcccgtgcagccgggccctcatgcgcgcgtcctgggctcctcccccctcggtgagtgtgggagggtggtcggtggggcgcccttgtgatcgcaggagcaggggcccggcaaggaggttctcagggtggcgggcgtggggcgtcgaggcggcgagcgggagcggtcagggcggggtggcctccctgcatgcgccctctggctcgnnnnnnnnnnaggagggtggtcggtggggtgcccttgtgatcgcaggaacaggggcccggcaaggaggtcctcagagtggcgagcatgggcgtcgaggcggcgagcaggagcgctcagggcggagtggcctccctgcatgcgccctctggctcgcgatgtgtcgccactccagcccgacgtccccctccccaacactgcaggcacctcgccgacggggaggtcgctggggtcggcgcacgcgccccaggcggggtcgtatatggagcgctttgcggcggggcggcagcacgggcgcgccccgaacggcgcctcccttcacgaaggcgccggcggcagtgcgccccggcgcggcgacagcagccccctgctggggaccagcccggggtccagccccggtcccgcccgcctcctgggcacgcccgggaacgctggcgctggcgcggccggcgccgagggcgacgcgccccccgagatcctgcccgagcgcgtgaaccggctgcccggggccacggcggtggccgtgggcgagaagcacacgctcgcgctgcacgagtggtacgccctggagctgccggacgccgacggggacggtggcagtggcggtgcctgcaccgagcgcaggggggcggacgcgtgtcgaggcgctccgggggcgctcgacgagaccgccggcggcgaggcagaccccccggtcggtgccgaatcgggggatgcgctgggggctgcccgagccacgtgccctggggcccctggggcccccacgccaagttccagggacgtggcatcgagtcctgcgcaggggggtgagggcgaggagtccagcaccgcgcggggtccgccccccctgcagcacctctgcgagcggnnnnnnnnnnccgggggatgcgctgggggctgcccgagccgcgtcccctggggcccccacgccaagccccagggacctggcaacgagacctgcgcagggggtggagggagaggagtccagcgccgcgcggggcccgccccccctgcagcacctctgcgagcggctggtgggcgcggcctacgtgaccccggccagcgcgctgcgcgtgctgggcacggccgacggcatgggcgcgcgcctgctgcgcgcgcacgcgctgtctgtggcgctgggcagcctgcacgcgtgcctggcggccgacgccgcgggcctggcccgcctgccgcc

SEQ ID NO: 37484 - DNA, 115 bp, Chlorella protothecoides
gcagagagggggggagcgaaatggagtggtcgtagaggtgggacggtggacgagggtacgattagtggaaggtggagggacgtgatgacagaaggcttgagtgcctttgtcagtg

SEQ ID NO: 37485 - DNA, 66 bp, Chlorella protothecoides
tctcgtagacaaggcgacgatgcaagcggttttcagaatagtcaagcatgcccaggtcctcgactg

SEQ ID NO: 37486 - DNA, 69 bp, Chlorella protothecoides
aggcgatttgcagaggaggcggcggagaggggatttgcggaggaggcggcggagaggcgatttgcggag

SEQ ID NO: 37487 - DNA, 206 bp, Chlorella protothecoides
gcctctccagcgcttggactgcggtgggagaaggagggggggggggtggaggattggagccgggcggcaacgtgctgggggaagtcaccagtcgtgggtagcctgctgggcgtcgtagatggcccgcacgctccggggcctcccgggtcaggcgacccccccctgtttcaagcccctccatgcttgtcttccccccccccccgccc

SEQ ID NO: 37488 - DNA, 61 bp, Chlorella protothecoides
gcgactcagcacggcgcgggagtcgcccacgttcgccacgatgaggcggtcggggtgaacc

SEQ ID NO: 37489 - DNA, 108 bp, Chlorella protothecoides
cgatgacgatggcagctttggaactcctcaacgccgcttcaggaatagcatcccggcatccggaagaccctccggcatccccgtgcaatgtatcgtgcagagcatgat

SEQ ID NO: 37490 - DNA, 476 bp, Chlorella protothecoides
  modified_base (110)..(268): a, c, t, g, unknown or other
gccaatgacattcgcagccggatggtactgggattcgtctactcaccggctcaggctaggtacagtcggtcgtcgtgcctgtgcaggagccgcgctggaggtcgacgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcagagcagtagcgctaacgacagagtccgcaacgggccccgtgactgtcgctctaagggtccccactgccttcgaatgaatcgttgactggacatccatcgatgtttagggtccactggaagatgattgcaattcaaggattgggcgttgcgcgacttttgtctggcgtgagttttgcgtgcgagaggcgtacgccaatgacgaa

SEQ ID NO: 37491 - DNA, 77 bp, Chlorella protothecoides
tcaagacagacaaggtgggtccgtgttcgttaggtggcctccaaaggcgtggcttgcgatgcatggcaggctggcgg

SEQ ID NO: 37492 - DNA, 61 bp, Chlorella protothecoides
catcgcccagtgtttgcaagcctctcccctaacacacattccccctgccctcgccatacac

SEQ ID NO: 37493 - DNA, 64 bp, Chlorella protothecoides
ccccccccctccccccccccccccccccccttcaaatcaatccaaggtggtgacccacctgtgc

SEQ ID NO: 37494 - DNA, 61 bp, Chlorella protothecoides
tccatctgttccggagtctctgggtgcttgttggcgatgccttgcccacggcctcggggtg

SEQ ID NO: 37495 - DNA, 79 bp, Chlorella protothecoides
tgctgaggtggctcaaggcatgctggaacctccaggcttccccttccaccatcacccgccccagccgctgcgcctgagc

SEQ ID NO: 37496 - DNA, 61 bp, Chlorella protothecoides
gccgccacaacatgatcgaggcaggcagggggcactgaagtgatggctcccttattcaggc

SEQ ID NO: 37497 - DNA, 124 bp, Chlorella protothecoides
attgccctcccttggattcaccccggtttactcattccacaggcccccccaccccctccccccccggcctcctccatgcgtccacgcacgcattctgggtcgcgctaggagccgccgtcaccgc

SEQ ID NO: 37498 - DNA, 162 bp, Chlorella protothecoides
acctcctgcggcgcgacgtcctgcagggggattgaggaagggggatgtttgggtggggcggggcggggtgaggttataaattcggtgtaccatggcaggcacagcctgccaccccgacgtgccaagaggagcggcttttgccgatcagccaaccgctgcaac

SEQ ID NO: 37499 - DNA, 65 bp, Chlorella protothecoides
cccaacccgccttttttgccgcctcggccgcggggccggacaagtacgacgccgtcggctgcatg

SEQ ID NO: 37500 - DNA, 90 bp, Chlorella protothecoides
caccgcaccgcatgggaggggccaccgccgctcgtccccggacgagcgccgccaccgagttgggcagcacctcgcagcgtgcccagcagg

SEQ ID NO: 37501 - DNA, 127 bp, Chlorella protothecoides
gaaaggcgatcgcattctatgctgacatgtggtcatgctgaccagagcgcaccccggtaccttggagagacattcggcatccttcgaggtgtaccactcgtagctaccggccctcccgcggccatca

SEQ ID NO: 37502 - DNA, 130 bp, Chlorella protothecoides
gagggaggctctgcaccgggtgttcccactctaggccagagccaagtcgaatgaccgggcaacgcgaggcctgacaaagacactctgtccaccatacctgtaagatcctgtctatttgaagaactagggc

SEQ ID NO: 37503 - DNA, 125 bp, Chlorella protothecoides
gggtagctgtgagagatgctgccatccacacccgctgccgcgccttggaaaggagtgcaaatctcatacatgggattcaaaatccagagcgttgggcgacctaaatgccaccctaccttcccatt

SEQ ID NO: 37504 - DNA, 103 bp, Chlorella protothecoides
ccacgtgtgcatgcaggtcgtgtgaggggggtggaatccttgtgtaaacctgtgagagggtgcacgaatagcacccagctcatcccagcctcccacctcgatc

SEQ ID NO: 37505 - DNA, 66 bp, Chlorella protothecoides
cttcgcctgacatcgatcttaggtctgctcatccctgttcccagagcaagtaaagccgcactgcat

SEQ ID NO: 37506 - DNA, 96 bp, Chlorella protothecoides
tttccatggcatgctgctcgtgggcctgggggaggctctgcagctgctgacctggcacatccacgcgtagcctgtccctttccccattggcccact

SEQ ID NO: 37507 - DNA, 90 bp, Chlorella protothecoides
gaggtagggcagccaggatgtgtgccctgcgttgcaatgtcacgtccatacgttcatgctggaggaagggtattcgcagctgctctgtct

SEQ ID NO: 37508 - DNA, 119 bp, Chlorella protothecoides
cgaggagcccgcccccggcggtgacgcggtaagggcttcggcgcagggaggcgctgcatgcgcatggtgcgcgggatcgtgcacctgcgccccggtttcccacgctcctcacgccctgc

SEQ ID NO: 37509 - DNA, 106 bp, Chlorella protothecoides
cgcagcctgcacgatccgctccagcctccggaaaaagccctggtctgcagcagggcatgctggtacagccttgagatggtatgaaggacaggccatccagctggaa

SEQ ID NO: 37510 - DNA, 23327 bp, Chlorella protothecoides
  modified_base (86)..(95): a, c, t, g, unknown or other
  modified_base (2286)..(2295): a, c, t, g, unknown or other
  modified_base (2849)..(2858): a, c, t, g, unknown or other
  modified_base (3860)..(3869): a, c, t, g, unknown or other
  modified_base (4733)..(4742): a, c, t, g, unknown or other
  modified_base (5567)..(5576): a, c, t, g, unknown or other
  modified_base (5647)..(5656): a, c, t, g, unknown or other
  modified_base (6778)..(6787): a, c, t, g, unknown or other
  modified_base (6850)..(6943): a, c, t, g, unknown or other
  modified_base (7033)..(7210): a, c, t, g, unknown or other
  modified_base (7292)..(7301): a, c, t, g, unknown or other
  modified_base (7383)..(7392): a, c, t, g, unknown or other
  modified_base (7670)..(7716): a, c, t, g, unknown or other
  modified_base (8718)..(8813): a, c, t, g, unknown or other
  modified_base (9542)..(9551): a, c, t, g, unknown or other
  modified_base (10199)..(10208): a, c, t, g, unknown or other
  modified_base (10264)..(10273): a, c, t, g, unknown or other
  modified_base (10393)..(10402): a, c, t, g, unknown or other
  modified_base (10872)..(10881): a, c, t, g, unknown or other
  modified_base (11430)..(11439): a, c, t, g, unknown or other
  modified_base (11744)..(11753): a, c, t, g, unknown or other
  modified_base (12090)..(12099): a, c, t, g, unknown or other
  modified_base (12998)..(13007): a, c, t, g, unknown or other
  modified_base (14591)..(14600): a, c, t, g, unknown or other
  modified_base (15227)..(15236): a, c, t, g, unknown or other
  modified_base (15391)..(15400): a, c, t, g, unknown or other
  modified_base (15469)..(15478): a, c, t, g, unknown or other
  modified_base (15836)..(15845): a, c, t, g, unknown or other
  modified_base (16250)..(16259): a, c, t, g, unknown or other
  modified_base (16587)..(16596): a, c, t, g, unknown or other
  modified_base (17006)..(17015): a, c, t, g, unknown or other
  modified_base (17253)..(17262): a, c, t, g, unknown or other
  modified_base (17356)..(17365): a, c, t, g, unknown or other
  modified_base (18896)..(18905): a, c, t, g, unknown or other
  modified_base (19361)..(19370): a, c, t, g, unknown or other
  modified_base (20076)..(20085): a, c, t, g, unknown or other
  modified_base (20355)..(20364): a, c, t, g, unknown or other
  modified_base (21121)..(21164): a, c, t, g, unknown or other
cgcctctgcccgtgctgccgccaccgactctggcacagcaggcccggcggactttgctgctggggcaggcatcgggagtgggtgannnnnnnnnngggcgggctcatcctgcgtgccctctgctgcagccgcttgggtgccgtcgctttgtttgctaccctctgacccctcctcctcctcggccagccagatgccgctgtgcagggatggagggtaggtggaactggtgaaatcctccatcaacatgcaccttgcttgcatgagtcaccggggcctggaggtctccagccgatgcgcgacattgcaatgcatccgtcaccatccccagcacagtgggtcgcccacagaatggagggccaccccctcagtcacacccacacgcaaccaagctggaccttcaagccccacacacatccagccatacctgaagagatcctggagcgacaggttcaggggggcggaagggtccccggagggtgcttgggcctggacccccaccccaggccccgggtcctggttgtgtctgcgcagaccagcttccgagctgctgccagcttcaggctgggcacccaggatgtgcgcaaggcccggtggcaccgcccgcctcggcgccctgccgtccagctcctccaaccagctcccagaagccgcctctgcccgtgctgccgccaccgactccggcacagcaggcctggcggactcggctgctggggcaggcatcgggagtgggtgaggcgagcggtcagaggccacatggttgccacacatgaaccgctgtgattcgcctgggggcaccagagcgctgtcgcagactgatttgaaaaggatgcacccgacaaaaagtaagttggtggcccatgggacatgtttcccaccctgctcacctgcggccagcgagctctggcctccacgcccccacttcccagcagacttgtctgcaccaggctgccgcactgcaagtgactccgtgggcaatagtgtggaggggacctcctcaaagggagggagctctgagcgggattcctcgccccctccccaggcggcactggaggtcgttgggagcctgctctggaccgtccacctgggagtggtagggtccaggtttgtccatgaccaggacgtcggccggacggcttccagacgcatctgcagggcatctgcaggggcggcatggggaaggatgagagcgcatgcgggtgatgaggaacatcccaccatcctgggtgcagccatgctgcaaagctacacagtgaatatcaggcaagtcgccgcacctggttccgcaggaaggtgaggctggccagtacttgctctgcccactattgcgtcccagtccagttcatgaggcaaatcctgtggattccacagcatacaaggaggtattcaaggtaccatctcggtctgaggagatgcaaccaagctagaggtcacattttgcagggggagagcagcgccaaaccccactgctttccattgagacgcattgtccagaatttccgcttgcgatcccacatgctccatcatcatatccgttgacttttcatccacctcaccggtggctgaaaggtaggtatcctggagcctggcgggggggagcggacatggacctccccactccgactgccctcgaacccgaaacgaggtatgagcggtgcatcctgcatcaagccaacatccgcggggctgacattctgggtatacttcttctcgatgatcaaatggcaggatgctgcctcgtcagggcatgaatccagcaactcggctcttgtcgatgggcaacacgggcctcgagggcgggcgcaccttcccactcctgtcgtcaatcatcttcagatgtcccctccttccccaaacgcatatacccaacacgctcttgatgagtacgcaaagcgtgatatacattcattgaaggcctttggttcatgaggagaacatacagtgcctgtcttgcaaggttcccagatttctaacgtgtgcgcagctgcgtaggggcactccttgccctactcgtcctggtagaagacgagcttggagttgagcctcccgtccttgatggactccagcgcctccttccagtcctccagcgccaccctcttgaatctgtggggggaaaccatgcgacggaacagagctgtgcatcaggcctggtggtgcaaagggtacgggcatgcgcccctggttagcggatctcagcccacccaaatgagcaccctacgactcacttgggagggtccagggcaccctcctcgaagagatctgcgacttccttcaggacctccctcttcnnnnnnnnnngaaccatgcgccggaacagagctgtgcaacaggcctggtggtgcaatgggtacgggcatgcacccctggttagcagatctcagcccacccaaatgagcaccctaaaactcacttgggagcgtccagggcaccctcctcgaagaggtctgcgacttccttcaggacctccctcttcctcgccagaccctcctcatcctgcacgggtgtaggggatgtgaggctggaatttgccactgtgccagcgccttccctcctcattctctccgtggaagccagcgtgcgcaatccccaaccctctgcgtaccagtcagcccccaccccggcccaccccctgcccctgggtccgccgcagacccacctttgagaagcctcccgaggcccagaagcccctgaaccgcagatccttgaagatgaggaggggtgcggggatggccaggggctgcttgctcatcgcgccataggtcaccatggtgccccccttcctgcagaccattggatgggtgtccttggggtcagacgcggagggtccgaaatcaggcagacgcctcaggaannnnnnnnnnaggtgccccccttcctgcaggccatcggatgggtgtccttggggtcagacgcggggggtccgaaatcaggcagacgcctcaggaaccccggcacgatcccctcccggtggtagatttaggacagcactgcactccagccctcaagcaccacctcgtcctcctggctcaactgcagtattgtttccattccaactcacgcaatgccctgccatgccgcctttccttctccattccacactccatctcgcccctttcccccctatcacaatccccacagtgcccttccccccttcccccacgcagctcactccagggtcttggccagggccagggccacctcccccccaacgcagtccagccccaggcggggcgggggcagcccggcggccgccaggtcggccttcagccgctccggggtggtcaccagcgcggcgcccaggccctccagctcccgcgccagctcggcgtcggcggccgcgtcgccacggccacgcacgacgctgacggcgcgcaggccgcgacgggcggccagctggctcaccagccgccccacggcgctgttgccgccgttctggatcaccacgtccccgggcgccagatccacgtagtcgcggagcatgaggagggcggtgggcgggttgatggacagcgcgcaggccgcctcgggggagagcgtggggggtacgcgcagccagttgctcgcagccgccacggcgtgggagcgccacgtgcctgggcaggccgccaccgggaccacttggtcgccggggctcaggcctgacacctggatggaggggttggaaaggaaagccaagggtgggcctgataggagaagaacttctgggctcaggacggggaaaggtgctggtgagtggccttgtactgggcaacacagccttgtgtgaggcatgcctggactcaaccctgctcattcaacgtgacgaggctagtcatgagtggcatgccccgcgctggtatggtagtcatcacctgcccactgcnnnnnnnnnntgaggctagtaatgattggcatgccccgctctggtatggtagtcatcacctgcccactgcctctgagacctcaaccactgctgctgactggcacaccccttgtcacaaaccctgatactcaccttggggcccactgcctccaccctgcccagaccgtcgttgccaggggtcccaggcagctcgggctgcagcgggtacttgccctccaccgtgttgatgtctgacgaattgatgggcgactgcagggatgggatgcagggcaatggctggatggggcctctcgcctcctctgatttttcaagtcccagacaatctggcctcccccaacccctccttgaaccaccatccccttccgtcgtaccgcaatgagcttgatcaggatctgcccatccttaagcgaggatggggagggaactggactctccttcagcgacaggacctctacggggtcccccggcttctcgtagacaagcgacttgcatgtgactgcggtggccatcctggctttcaaggttgtggaatttaggtgggttccgaacactgcaagctttctcagcatacttcggggtttatggagacaaacccagccggggttaggtgagctttctagtcacgaaactcaaagaaagtcgccatgcccagccttcgtcctggtgaaactcatagaacgccagaacatgatttcggcgagtttcaagtgcgattaaagcatgcatgtttatatcgagacaatgtgatcaaactgcatgcttgtcaaaaagtgatctagcgcgcgcgttccggtacaggcatcagggtggcagtgctgccctgctcctatttgagcagaatgacctgtgtacagcaagaccacatattccatannnnnnnnnnaatagaacgccagaatatgattttggcgagtttcaaatgcgattaaagcatgcatgtttatgtcgagacaatgtgatcaaactgcatgcttgtcaaaagtgatccagcgcgcgcgttcagatacaggcatcagggtggcagtgctgccccgctcctatttgagcagagtgccctgtgtacagcaagaccacatattccataaagggcgatctattccctttccctcagtctttggagtccgtgcctaagatcacggagggaggcgatggccgacccgggagcgtccaccgtccagcagcagctgtacccccacccgccgccctacttcaaactatacatgggggatgcggatggaagcgcagagcgtcccttccctccccctcctccccctccagtgtccggggagtacgtcctgtttggagaggtccacacggtgagcgggatccccataatgcggggtaataggggccgtcctctttgtaaaggagcaaatatgcagggtccgaaggaaccccggagtcatgacatcttcatcggtacgccccttgaccctcaacacatttctcttcggcgcccgcagtcagaggctggggatccgccactgcatgctgcacagctgtacaatcaagcggccgacggcagcataggtaccccgggcggagtgctggtggttgcagctgctggaaattcctcttaaagggtagcctgcaaggctggacccagaaatcatccccttcccccctgcccatccacagacttcaaggcagagctgcacgctctgcatggcgagctcgtcgcggggatctgcgatctgctgggtgcgcnnnnnnnnnnggaggggggtgccacacatgccaccagctgcgagtgcccatgtgtcccagaccgatggagctgcccaaagnnnnnnnnnnagcagagctgcacgctctgcacggcgagctcatcgcggggatctgcgatctgctgggtgcgctggagtcccagccctcgacctacgctcgcagcgtggaggcactgggcgtcatcctgaggaacatgcagcacctctcgcgcctgctccgccccttccaggctcgggagactctcatcgccacgctgcaggaggtcagtgcagaatggggtgtcgcacgtgccaccagctgcgagtgcctgtgtgtcccagaccgatggagctgcccaaaggctgggagtctgcacctcgatgcatggctgcgagtgactgagtgtgctgtgcctcacattcccgaatgccctgcctccaggaggtcgcacaccggagagcctgtgccaccgagctggacaagcttgcccaggagagcgcggcgtctagccacgtccaactcctgaaggatgcactggtgtgacaatgtgatgaggtgatattgtttgggcaaagtacaacgtgcagtgtggttcatgtgtgcgtctggtcatgagtcagtctgagcatggtgcagtccagctgaatcctgtccttcagggctcaccctgccagtatcccaccatctttgcagatccgggcgttggggcaaggtccagcactgggggaggaggctgccgtggcaggagacccagagcagaagccaggaggggtccgagagctgcaaagcaatctggaagccaaggcctgattctcgaggccggctcgtgatgctgggccccttccatgtcgcactcttggaagctgccaagctgacaagctcatgtgcagcaatgctgcatgcctgcactgttctgtggccagggtccaactggctagggtttgggagtcggtccctcagcggtcgagctcagagtgctgaagtcccgacgccctcccactggatggcggtgtctggtgcaccgtccaaccccagttggttggggccctgtgggagatgaaaagggatttgactgaaaggtagacgcgggtggtgagcggtaaaagatgcttctcagggcctcgtcgaggcgtgtgtgccgcccacgagtgcatccacacaccccatgggcaagggagtcggtgtagtggttgaacgccggcagtgtgaccnnnnnnnnnnacattccacgcaccccatgggcaagggagtcagtgtagtggttgaacgccggcagtgtgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgggggtttggtggcacggcgattcgcggggcgtgggcggcttgcggcaccgctgatgaccggttggagggcgaggtggaggtaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctccttcctcgcctccttccttgtctttagtcttcgaggtgagcaagtagacgagccgactgccctgtcggccctgggnnnnnnnnnntcgctccttcctcgcctgcttccttgtcttgaatcttcgaggtgagcaaggagacgagccgactgccctgtcggccctgggnnnnnnnnnnggcctgcgttgcgccgtgagctcttctgcctgccagaaaggcttctgctgcggggccagcacgttgggcagccctcccagcacgagcatgccaccaggctttgggggtttggtggcacggcgatgcgcggggcgtgggcggcttgtggcaccgctggtgaccggttggagggcgaggtggaggtaacttggggcagttccccttaccgatgcagtcggggtgggaactccctcctcctcccgcactctcttaatactgggtcgatcatgccctggtannnnnnnnnnnnnnnnnnnnnnnnnnnnnnnnnnnnnnnnnnnnnnncaggcgcctgcgggtgtgtcgatgaagcagaaggtttcgaggaagagaatgcatccagcttcttctgcatcctatcggtgctcgtggatctgtgctcggaggtggacagggccgcatctgtcctttgtaagttcgtgggtcccgtactacggagatccaatactggaaagcatgctgccgcggccgggcgagcaggccggttccaggatggcaacagccctcccagcatttccagatgcatctgcgatgccataaaccatgccagggccctcattaaagcaaggtatatggaggctgagggccccttcgcctggtcccccgaagctgggcacgtgggtggacctccgagcatgacgtcgatcctatacgatgctgtcgatgtgggcgaggtgatcctgagccctcggctcctcgactctgactcagacgatgcgacagagaagcccacggagcagcaggtgaggtggttgtgagctggagacaagcgagcagggctttgttacctcggacgggacctttccacgatccccaacctttcgcacgggttgcgatgctacgaacctctgtgcacccacaggtgtcggctctgaaactgcctgaggcccgtctcgcggccccgcagggggacaggaaacccgcccctccccccctcgaacggagggtgtccctgccctcctccccgatcctacgtggcaagcccatcagcaccccgacccggctgccccccggcctgaaccctcatgagggcgcagatgctcctgcacgctccagcggcagcaccacgccacgcaagaggaaggatgccgagaccccaggccgcactgccgccagcgacggcatacagtccatcttcgtgcccagccagggactcctcgggaggtccatgtcaggtgggggtgtgcatggcgagttgtgtgtgattgtgaatgtggcgccgtcatcctgctgcggggcggccagcccgccggcatcccctggcgtcaacggagcctgccatcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcccgaactcgcccaagctccagtccgaccggcggtgacgtgcaggggcgggtggccgccctcgtgaagaagctcctggccgaggaaaccgtgctcctgcgagaccgtgcccacctggtgcgactggttgaggtgtctgggtgggaggcgtgccatgcctgtgtcaccctggccacacgctctcgtagcgagcggcacagtggggacttgcggctccagtattgggcgactggaactgtgagagataccaagtatattcgaaccctgacaccgcatcgcaattgcccccaccatcaccccgcaaccatcctttcccctgcccagcgcgctctgacgtccctgcccgacgggggcgccaagctgagtgccgccatccagggaaggcaggcagatgctaccgaactgcgtgtcgcgttggtaggcccatgcctgacataccaggatgcgcagggacaccggcaggtgggggggaaggaaagggtggaggcagtgcttgcagaggtcggcctcgccactcgtgttcccttgctggtttgggcgcgtcgctcgtcgacgtgccgtgcctgccatgcctgctcctgggctggcagggtcagaccgccagctacctagcgagcctgcccaccgctgccgcccgtgtgctgcgcccctgccgtttcgcgctcgccacccttaccctccacccctcgacgcgcgcagggccccttcacggcgacccagctgcannnnnnnnnntcacccttgcccaccacccctcgacgccggcagggccccttcacggcgacccagctgcagaccctgctgcgctcgcgcctcgtctcgtccgccacccccgtggagcatgccatgctgggcacgctgccctgcgaggcggctgtcgccgcgctgacggaagccggccggaagctggccgcccccgccccgcagccggcgcaggggccccctccgcaggggccagcagacgcagaggcccggcggcgcgtgccgggctggcgtgcagacgaggcgcagcatgcgcagcgtggcgtcccgctcaccgcgcagcaccagccgcggccaggccaggtccccgggcagcgcccgcgcccagggcaggggcccgcacaagcgctggcctcctcctactatcaggcctggggccaggaggcggggccgggccaggaggcggggtcgggatgggcccccgcgcgggatgcgcaggatgcggcggtgagctttgaagggggggtttgccttcagtgctgagtgctgatcggggagagcgggagggtgcacagaggaggcacagtgcatcgccggtgcggaggagctgcacccgttccaggcacccacccaagcccaagccgcgcgaacctgcccgccactcgacgtcagtccacatcnnnnnnnnnntccacccaagcccacgctgcgcgaccctgcccgccactcgacgtcagtccacatcnnnnnnnnnnagtttggaatcaaagggtaggccccatgctgtgtgagtcacacggccatccttgtataagcatgcgatgccgtgcggagatgagggccgtgatagcctatcgccaccccatgccgtatcnnnnnnnnnncccttccacgcatgccgtccctgcaggaggagagtggggcgtggacttaccccggggtcgggggcgtcgaggaggggccctacaccactggccagctccgcgccctggtgcacaggtgggctcagtgggtcggatgaagggcgggaaggggatggaagaggagggtggtggtgggtctggtgaggagggtttggaaagaaggggtaggcctcatgctgtgtgagtcacagggccatccttgtataagcatgcgctgccgtgcggagatgagggccatgatagcctatcgccaccccatgccgtatcgctcaccccattgctgaccgtgtttgctgacacccttccgcttcctcctcctcccttcacgccaggggcgatctggacccccacgccatcgttggggacgaggccatggggctcagcatccgcgtgctggacctgctgggctacggggccctggccccctcccnnnnnnnnnngtggggctcagcattcgcgtcctggacttgctgggctacggggccctggccccctcccagggtcaggcgcgggctggccccgcccagccggcgcactggggccgcgaggggtggcggggggggcctggagcgggttgagtcgcccccccagagtccctttccctggttttccacaggctggcgctgtattttcgggctataccttgatactttggcagatagctttgtacgtagtacccttcccaggttctgttcccggcaccctaggcccaagtgaggggctggggtgctctgtcactcttgtgcttcccctctaaagcccctgacgccagcttgtcatagcattgtggccatagagccgaatcgtttaatcattgttgttggccagttggcccacagagtccagggagggaccaatggcacaaggccaagagaggggggcgttaacaagggccgcaggctgcgcagacgctcaccctggtcacgcgtccttcccagtcgccccttgctgttgctgctgctgctgctgctgggtgtggatgtctgtcnnnnnnnnnnactggtcacgcgtccttcccagttgccccttgctgttgctgctgctgctgggtgtggatgtctgtcaggtcgggggtgggcaccccctcagcctgcaggtcctgctctattcgctccttggcgcggtagacctttgattggaggtagaaggagccggcttcctcgttctttttatacaggtgctcgtacttctgcacagaggagggaggcattgagggcaaactgaccagggcgtgggcactgcatagcacattgcagcccgcagtcagtccatatgcatgtcccagactcatgacaatagcccnnnnnnnnnnggaaggcggactgaccagggcgcgggcacagcgtggcacaatgcagcccgcagtcagtccacatgcatgtcccagactcatgacaatagcccacccacatgagccgcaaaggtccacgcaccttgctaatctcttcccacgttgcccctgcctcgatgcccagtatttgctcggcctcctggcgggtcagctgcttgcctagacgggcggcggcgcccacgctgtctgctgtcacaccggacttctgggcgtctggagggttgaaaggaccaaggaagggtgattcgatactacacgctcagggactggattaagactcgtgtagaacactctgtgnnnnnnnnnntggaagggtgattcgatactctacacgctcagggaatggattaagactcgtgtagaacactctgtgcgttgtcatctgcctggagtccagaacttactgacgagggcttggcggtatgcttgcgttgcggcacgaaacaggactgtcgcacccgcgacagccaggttggccaaaatcctagctgcctgtagatttgaataggtcgaatgggtgagagagaggtagcatcagccgcgaggtgccccaaccagcgtagtgtctactcaccatgcggtcacgctactccagcagaggaagacctgggacaggttattgtgagagcatgcaacaaacgactcggtatggtggaggatgatataagtgtggcagagtccgcccttgccgcacgttgtgggttcgtcctgtgaggagggagacgggagcacaggcatcggggcgcttcgcgcccgcatgccctgccacatgccggacgcttgaatcccgggatcggcctccagccgtgtctctgacaggccatacacattgcgaagctcgtcccaacgttctttgtgatctcatatcctgctatacactctcccacgcctcccgtccctgcgcttcatggaacgcaggttgctgacacgctaatggaacgaccgtgtatatcgcaccattccaggactcgttcggccttgaacggatctgaccaggcattgcagctgtgttgtgccgtaaggagtggagtatattaatcgtcacggcgctgcgatgctctcagtgggcagtctcaccggtcctccgggaacctgcacacccgtgcgggcggtctgccatggcgagatgtactccagctgcaggcgcctcccgactgcttggcatgcgctggagggccgcaagccggccgaccaccgtacggtgcnnnnnnnnnnggtctcaccggtcctcctggaacctgcacacccgtgcgggcggtctaccatggcgagatgtactccagctgcaggcggctcccgaccgcttggcatgcgctggagcgccgcaagccggccgaccaccgtacggtgcgcgcgggggccaggggctcccctgcccggtcatcctctgaccgcggcctgcagcaccggcagggttccctggacggcgaggtggcccctcggggccctgaccgggggtcccacggcagcctgcactcatacgacgaggagggggagggccggccgggcgggggcctgctgggcggcctggcggccgccgccgacggcctgcccgcacgcaccaagctcatcgccgccacctccgcgtccttcatgatctgcaacatggacaaggtcaacatcagcattgccatcctgcccatggcccgcgagttcggctggtcccccaccgtctcaggcgggttgtggtgggcgggtgcatcctagtggtttgaggcttggcgcggcaatctactcttggctcgccgaccctgtactctcgtctccggcggctccgtttctactccctctgcacttgcagattcctgtcacccagttgtcggacatcacatgccgccctttctatcccaaatctccggacccccaccactcacccacacgcccgccactcccaccacaggcctggtccagtccagcttcttctacggctacctcatctcccagctccccggcggctggctggccgcgcgcctgggcggccgccgcgtgctgcccatcgcggtggccctcttcagcgcggccactgccggcgtgcccttcctggcgggcacgctgctgggcttgtgcgccgcgcgcgcggcggtgggcctaggcgaggcggtggcgccctcctgcgccaccgagatgatcgcgcgcgcggtgcccgtggcggggcgctcccgcgcgactgcggccgtcttctcgggtctgcacgtaggtgcgctggtgggcctgctggccgcgccgccgctgatcgccgccggcggctggcgcgcggtgttctacgtctttggcggcgccggcctcgtgtggtgcctgggctgggaggccctgctggcgcgcctccagcgccaggacccggccatggtggccctgctggacggcagccgcgggccgcggcccgtgcgacgtaccggggcgggcgccaggatctccccgccggcgtctgcccccgccccggcccccgcgacgccctggcgcgccttcctctccaaccgcccgctccaggccctggcctttgcccacttctgcaacaactggttccactacgtcatgctggcctggctgcccacctacttcaccgaccgcctggcgctcgacctggacggtgccgcgcgcttcgccctgctgccgcccctggccgccatcgccgtctccttcgcggcaggcaagatggagtggggagggtctcgggttgtttcctttctgggggggaatgtgtgattctgggtcctgcggtccagacatcgcagagggacatgcatggccgcaggccacccgccctgatccatgcgataccctttccccacccacccaccnnnnnnnnnngggagtggggagggtctcgggttgtttccgttttgggggggatgtgtgatgctgggtcctgcggcccagacatcgcagagggtcatgcatggctgcaggccacccgccctgatccatgcgacgccctattcccacccacaccctattcccacccacacccacacccacaccgacacccacacccacacccaccctcacgccaggctccggcgcggacttcctggtggagcgcggcgtggcggtggccacggtgcgcaagtctgcgcagggcctggccttcctggggcccgcgctgtgcctgctgtggggctcccaggccactgacgacgccgggatcgtggccagcatgaccctggccctgggcctggccagcttcagcctgggcggactgtacagcaatcacgcagacctgagcccgcgctacgcgcccatcctgctgggcatgaccaacgtggccggggcggtgccgggcatcgtcggcatcgcgggcacgggtgaggggttgatcccgatggaggagggaggtggtgggggaaagggggccggggcgggccgcaagactgtggcacatcgcgatcgaggtggggcgcgggtcctcccctggagctggacgcaggctcggtgtannnnnnnnnnagcaagactgtggcacatcgcgaacgaggtggggctcgggtcttcccctggagctggacgcaggctcggtgtacgtctggtgcacgcatgtggtagagtggatccgtggtcacctctttgcgctgcctgttgtccccttcccaaaatcgtacacnnnnnnnnnntgtcggcatcgcgggcacgggtgaggggggttgatcctgatggaggagggaggtggtgggggaaagggnnnnnnnnnnctgcgcgtatccccaatttcatgccctgacgggcaccccccccaaataacaaacattccaggtttcctgtatgacatgacggggtcgtgggatgtggcgctctttgcgccctccatcttcctcttcctcgctggcaccctggtgtacgtgcgctggggctcctcggacgagcaggacttctccgccgcgctggacgccggcccggcccggccgccgtccaaggacgactgaggccgctggtggcgacggcggcggcgacgcagcctggtcggccccagcgcggcagtgcaggacgaataaacaggtcccagcagcccaggatggtcaggccacggccttgctgcccccccattctttnnnnnnnnnntctggtggcgacggcggcggcgacgcagcatggtcggccccggcgcggcagcgcaggacgaatgaacaggtcccagcagcccgggatggccgggccacggccttgctgcccccccattctttctcagacggtattctttatggcgctgcgcaggcacgctggcgcccggggccgggcacaggtgcgctggggcctccctgcccaccctccctggtccacccgatttctttcatacggcgcagcgcagtgcccgcactccccatcacctctccctgagtgcgtgtgcacatccacagcaatcgatcgatcaattttgcccctttgtggttctgtaccaagtgtctgtaacttcaccctgcgaagcggaggatgcacagggccttgccttccacgacgcagcgcagnnnnnnnnnnacccctttgcggttctataccaagtgtctgtaatttcaccctgcaaagcggagaatgcgcagggccttgccttccacgacgcagcgcaggcatcctctggagtggtgcactggcgacacacaggggggttgacaaagcgttgggagggtagcgtgcctcacgcttgctcctgccggcccttgatggggaccaagtacacgccttgcttgggcctagggtgcgcattggccatggaaaggcggatttgccccctcgctgccatggggcgcagtccagcccctctcgccgcgaacagatggcgctgtcctaccgctgccgcatgttcatnnnnnnnnnnggcttgggcctagggtgcgtattggcatggaaaggcggatttgcccctcgctgccgtggggcgcagtccagcccccctcgccgcgaacagacggcgctgtcctaccgctgccgcatgttcatgcctgccctgaggacctcgtccaccagcaggagctgggaggcgatgatgggcgcgctgcagggagtggaaaggaggaatgtgggcgagggtggatgggcaggccaggtgagccccccaggagtgctggggttcaggatttccacagctccagcatcacttgcggagcatattcactgtgtgcattggtgcgcactctgtgtagaaatttatcctgccctccatacatgggcacccaaccccaaccccttggcctggaacccacctctgcatgatctggcgcttgacgnnnnnnnnnncatcctgccctccatgcatgggcacccaaccccaaccccttggccggcacccacctctgcatgatctggcgcttgacgatgtggttgtcaaagatgccagacgtgcgcgggtcgcaggcctcgccggtggcaatgtcgatgcccaccaccccgccagcctcagcctcactctgtggtggaagttggtccggggtgggggagtgagttgacacagtcatgaaggcagggctgcgggcgnnnnnnnnnncgaggcccccaggagtgctggggttcaggattcccactgctccagcatcccacgcagagcatcttcactgtgtgcattggtgcgcactctgtgnnnnnnnnnnggttggtttggggtggtggagtgagtggacacagtcatgaaggcagggctgcgggcgcctggatggaccaggaaggtgatgggaagcagggctccctcatcccacccgtgggattcccctgccgcaccgtcagctcaatgatggcgtcctgcgggtcgaaaccagagttttcggccaggatttttggcaccccgagcagcgcctccgcaaacgccagcacccccagcttcaccctgggagttgggaaggaaaggggagaggatgggtgctcgaatgtctaggtgcagccctgcaactcatggctgtgcagcagtgcctacgatgagcaacccgacgcgaccccttcaacgctgcctgaccagcgttcccggcataccagcacaccatgcattgccgcatgtgaaagccatcgatcttcacccctccccccacatgatcaagaagcatgccatggcggccgcctcagcaggccacgcaacattctccccccctgcacacgacactcccagcctcccagcacacagctcacctcccctcggccgtcttgacggtgacgctgcgcaggtggttggccgccgcaatctcgtaggcccccgctccggggacaaccgccgcgtcgtcaatggtgttcttcaccgccctcagcccgtccctcactgcatccttgatctgggcgatggtgtggtcgttggggccctgcaaggggaaggagtgccgggcggaggattgttgggagtggggacatgcgctggtcacctggccgatggggtccacatcctggagactgtccagcatgtgcccaacatcccagctggcagggtgtctggcgccggccaggtccggtgtctggcgcaaggatggtctgcgcagcgacagctgcgcagactgctcggccccaagcacgcgcagctgtctggagtggcacggggcacccccgtcgaccccaccacagggccaggcccctcgattgccgccccccgccgacgtgccttgatgaggatggtgcaggaggtgggcttggccacatcctccacaaaggtgtacttttcctcccccaagacgtgttcgtagacactgccggcctggcccaggcactccggctcgagctcctccacggagttcaccacgaagcccccgcacgacagctgcaggcgctccgcgttccttcgcttggatcgcctgtgagggtggaggggcgaggaaggggtgggtggggggtgggggaggaagaccagaccgaatccacgggaccgaatcaacaaacccaaggcgtggatgccaggactccctgcctgtgctgcagtcctcaggaggaccttcccgtccaccctcgaggtgggccgccacccggcaccaccagcccgctccccacctgagcgccaggatgccctccttggcgagcaggtccagggagagggggtcgatgcccttctggttgatcaccacgaagcccctgccctcgccggcggggcacacctgtgggtgttatgtttataggtcggggttgggtgggggtgaggggaagatctgnnnnnnnnnngcctgcctgcgctgcagtcctcaggaggaccttcccatccaccctcgaggtgggccgccgcccggcaccaccaccccgctgcccacctgagcgccaggatgccctccttggcgagcaggtccagggagagggggtcgatgcctttctggttgatcaccacaaagcccctgccctcgccagcggggcacacctgtgggtgttatgtttatgggagggggttgggtgggggtgaggggaagatctgtgcatcgtgctcacaaggagcggcgggcaggcccctgtgctggctccggacaagctgcccatgctgtggagatgatcgagctggagcacatgccggtctagcaggccagggtcggggccatgcacaacttggatgcattgcttgcagcagccgagtcgatcctcccccacccccaatggacccccccctccgccatacactcgccttgttcnnnnnnnnnnactccggacaagctgcccatgctgtcgagatgatcgagctgaagcacatgcctgtctagcaggccagggcctgggtcatgcacaccttgaatgcattgcttgcagcagccgggtcgatcctcccccacccccaatggaaccccccctccgccatacactcgccttgttcttcaggtcgatgatgcgctggaccttggcatcagtgacggcgcgctcggcggccaccagcttctcgcgctgctcggcggaggagtagaagaagcccgcgttcacctccgacttctcgtactccagcgagatgttggcgttcaggatgaaggcccgctccacgctgcgtggcatgtccgggtggcgcgagccgtggtccagcaccaggccccgcaccagccgcgtgtcggtgtccagccggtggcgcatgtgcatgatctccaccatgtgcaggtcaatgggcgcgccgtcggcggggcgcactatgcacaccgcgtcggtcacgatgtcggtgagctggtcggccaggtcctcgcgcagcttcgtgcggagcgccgacctggcgacgcagcgcagggcctcgcggtcggacacgtccaccgcctccttgaagccgtccaggaaggtcagcgccgcgcgcttggccagctcataaccctgattgttttgggaagggtgaatgggggagtatgcttttggtcgggggggggggggagcnnnnnnnnnnacgccgccccctcccacgttgatcaatgcccggcacctttggcactggccacgccacctcacctccacgatgacgcgagggtggaggccctcgccaatgtagcgctccgcctgcttcatcagctcgccgatgaagatgatcatggaggtggtaccgtccctgggtgagggaattcgtccattgtggtgagggggttgtggaacgagcgatcctacggaggggcatgcatgtcgagcacgcggggcatcagtcgggtgatgcagcactggnnnnnnnnnncctgtggaacgagcgatcctatggaggggcatgcatgtcgagcacccggggcatcagtcgggtgatgcagcactggcgcagcatgcatcaagacgtcgacgcgagcacgcgcatggactcatgcttgggcgacaatttccgggaggccaccggcgtattagcccccgccacccacccggtgacgtcgtcctgggcgacggcagcacgtgcgatcatcacggccgtggggttctggatctgcatctccctcagcagcacgttgccgtccttggtcagcttgatgtctgtgtgtggtggggtgtgcgggcgctggcatggcaggggcacatcactttgggtgcctaccaggcggcaggcccgggcaccacggctgcgcaccaatccacccatttcgcaaccgcgcacctcctgcgccccccacaagcatcttaatggtgcccttgggacctgttgatgagttatgtcgggggaatgtgaatgagcatcttagttcagaggccctagatccccagaatgggacagtgagaacgaacagctgccgatgcacagcaccatcacgcagtcccctaccagtctgacatgctgcatctagtagacctttccacatcttattttccatccaaagcgctcatgcaatggtcaccctcgcccacctaggttggtcttcatcacgtcatagagtcccttggcggcattgatattcataaacagggctgcctgccgccccatcacctccgccttggggttgagcgttttnnnnnnnnnnnnnnnnnnnnnnnnnnnnnnnnnnnnnnnnnnnnacgacatgcctccggctgctcccaggtaagaggtgcgggcttgccactggtggtgctcccgtctagcgccgcgattgactgatcacgcgacgaggcgcagcgagacactgggcgcccactgatcggagaaggagttcttgaacaaggattctctggatccgagatagtgaaagatctcaaagctctggatggccctgatgggtcgctcagcgaatgctcttgaactcgtatgcgaggcatcgaccccggcacgagaactccgcgcaaacacaaaaattggcggaacagagctggtgtgcagggcggggcgccatgtacttccaactcatcgacttacccttgctcggttcaaagatctcagcgtgtcctgagcagtaccattgccgcgaataccaggccctcgacataccagaggtcgggggctggaaggtagcatcccgcaagcgtctgggctccgccgaaaaccaggggggccaccagggcagcaattgcccagtgggcaacccttatctcccttgtagtgcatttttgcccgcgggtggtccggagagccacaccaggacggcttcgcgggggataggccgacaaccctgcacccagcccctgtagctctccaggccacagaggggtgcagccgacatgaacaccggtctaagcggtgctggggatggtgagcgagtgctgggtgtagactcggagtggctcttgctcaatgtatggctcaggagattggacttggtcaccctggacaccttccacccaccctcgcggccccttccccaggctccaactcggcctctgggctgccgctgacgcccacgtcacagccgctgccatccatatttcccagccagaccccgcaccacctgatgggcatgggtgtgcccggccccagtgggactccaggcagcacgcagtgagtcggagggtgccagggatggcgatggattcgagggctgttgggtgttcaggcgctgtaaaacatgagtatgcatgcagctgggagtaaggagcgcgtgcaaagtccagccattcacactccgtggctcctctgtcgcacccgcaggttcatgagcctgctgcagtcgggcactcccccctttccagctagtggtcgggcccctgctgggggcgggctgccgatgctggggaatcagcccccccacttctattacccagccatgcagcaggccagcgcaagcgcggcggcagccgccgcagccgccatggcgtcgcccagccgccggcccgggggccgccctcgcaaccctcccacggcggccaactccaagcgccactgcaactgcaagaactcccgctgcctgaagctgtgagcatgggttggggcgttgtgcagtctgggtgcagaggatgtcatgccgtgcttcacttgctcgatcgcagtgtgctgctgcggtcgcctgccacagcacatctgccaggcatcaagacccagcacccacgatgttcctacgccctcccccaaaaaactaccaggtattgcgagtgctttgcctcagggcggtactgcgacggctgcaactgcgtgggctgctgtaataaccagcagaatgagggcgtgcgccagtcggcggtggaggccatcctggatcgcaaccccaatgctttccgccccaagatcgccggcgacgtggtggggtttttggggggggagggggggtgattcggacgatccatgccggtccagggtggtggtggctccaggctgcactgatgggaggtcagagcactccacagactcgatgccggcgccgcttacccccttgcaaggcacctcatgcctcacaccacaccacctcacctcgcaccctccaacgcacccccgccgacccagactgaggagggcgcgagcctgggcgcggcgcggcacaacaagggctgcaactgtaagaagagcgggtgcctgaagaagtactgcgagtgcttccaggccggcatcttctgctccgagaactgcaagtgctgcgactgcaagaactacgatgggtcggaggcgcgcgccgcggccatctcgccgggcctgcccgcgcacctgcagaccgcgctggccacgccgccgcaccccgtcggcgccggcccggggtcggcggacgcggcgcactccctgggcgccgggtccgggtcaagaggggaggcgggctc

SEQ ID NO: 37511 - DNA, 79 bp, Chlorella protothecoides
gtctgggctgcgactcatgctctgccagaccacccagcccccctccctaggcgcagaattaccccaatcatctcacccc

SEQ ID NO: 37512 - DNA, 61 bp, Chlorella protothecoides
attctgctcaccgacacccttactgaccgtaaattgtctcagaatggtgcgcttcgatgtc

SEQ ID NO: 37513 - DNA, 66 bp, Chlorella protothecoides
gaaatctggtgttcaatgcccagggcaggcccagtgaggcagagtgcgtgcaggtggatcccaatg

SEQ ID NO: 37514 - DNA, 61 bp, Chlorella protothecoides
cttcgcgatcacccccatcgcgcgctgggggggtgacgtcgagctgcttccctgccatgtc

SEQ ID NO: 37515 - DNA, 74 bp, Chlorella protothecoides
tcctagaagcatggagggcctgcatctcatttccccccccctttcctcctctgccagggtatgcgtgtgaggtg

SEQ ID NO: 37516 - DNA, 61 bp, Chlorella protothecoides
agggtacaagcagtgtggtgctgtctggtagtagacgattacaagccctcccacatatagt

SEQ ID NO: 37517 - DNA, 84 bp, Chlorella protothecoides
ccagccatgagcagcctcatggcgacgggatgacgagcgatctagtggactgttggcccggggtcgatgtcagaatgttgtact

SEQ ID NO: 37518 - DNA, 85 bp, Chlorella protothecoides
ccagacaaattccatcaagaatggggatgctgcatgtctttttcagctgacaaggaaaccaggtctccgccttgtcgacgtcagc

SEQ ID NO: 37519 - DNA, 400 bp, Chlorella protothecoides
  modified_base (114)..(345): a, c, t, g, unknown or other
gaatggtctgcaatgtggagacccccggacactaacaaaactgaatatagggcgcgcgtcagagtcttgctcggcccttcccatggatccacgagatgtaggtgtagtgtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgcgtgctgtgggggctttttccgcccctccacacctcacaagggtcgcagc

SEQ ID NO: 37520 - DNA, 15810 bp, Chlorella protothecoides
  modified_base (367)..(376): a, c, t, g, unknown or other
  modified_base (2371)..(2380): a, c, t, g, unknown or other
  modified_base (2573)..(2582): a, c, t, g, unknown or other
  modified_base (2670)..(2679): a, c, t, g, unknown or other
  modified_base (2920)..(2929): a, c, t, g, unknown or other
  modified_base (3039)..(3048): a, c, t, g, unknown or other
  modified_base (3212)..(3221): a, c, t, g, unknown or other
  modified_base (3458)..(3467): a, c, t, g, unknown or other
  modified_base (4179)..(4188): a, c, t, g, unknown or other
  modified_base (4734)..(4743): a, c, t, g, unknown or other
  modified_base (4827)..(4836): a, c, t, g, unknown or other
  modified_base (6419)..(6428): a, c, t, g, unknown or other
  modified_base (7154)..(7163): a, c, t, g, unknown or other
  modified_base (8092)..(8101): a, c, t, g, unknown or other
  modified_base (8650)..(8659): a, c, t, g, unknown or other
  modified_base (9370)..(9452): a, c, t, g, unknown or other
  modified_base (9610)..(9619): a, c, t, g, unknown or other
  modified_base (9730)..(9739): a, c, t, g, unknown or other
  modified_base (9850)..(9941): a, c, t, g, unknown or other
  modified_base (11406)..(11415): a, c, t, g, unknown or other
  modified_base (12096)..(12105): a, c, t, g, unknown or other
  modified_base (12394)..(12403): a, c, t, g, unknown or other
  modified_base (12659)..(12668): a, c, t, g, unknown or other
  modified_base (13005)..(13014): a, c, t, g, unknown or other
  modified_base (13196)..(13205): a, c, t, g, unknown or other
  modified_base (13774)..(13783): a, c, t, g, unknown or other
  modified_base (14300)..(14309): a, c, t, g, unknown or other
  modified_base (14539)..(14548): a, c, t, g, unknown or other
  modified_base (15378)..(15387): a, c, t, g, unknown or other
ggccctggcggcgggcggggacgaggctggcggccaaggagcgctgtgtggggccgaggcggactacggcgccgcgctggcgaggccggagcgcctcggggggtggcgggagcgggcggacgtgcggtacaacctggcgtgctgcctggcgcggcaggggcgggcggaggaggcgcggcagctgctgggggctctgatagcttcgggcgcggtggctgaagccacggccagggaggacgccgacctggcgggtctctggcagcaggcctgatggtgttcgtggcggcgccagcgggctggagggcctgtgtgatgctcgcgcatttttggttgcagaaaccgtttgcaagtattgcatgagctctcnnnnnnnnnnagctcgcgcattcgtgattgcagaaaaccgtttgcaagtattgcatgagctctcactctgcacccgtggcaggattcaatgttcatggtcaaaactgtacacccatatcagtcacagaggcatgcgtagagtgtatggcagccgttccaccatgcagcgctgcaccgatccaggttgcccgtccctgtcacgccgcgatcgcagcacgcattgccccggccacggcggcgacggtgagctggaggtcgcgtgttgcctgcgccaggctcgtggctcgaggcgccgccaggcccagcatggccacgccgcgacagaggcccacgctcaccgctgggccccactcccaggcggcctgcagcgcgccggcctctcgctcgcccagcgtgcctgggtcgagcagtcggcgccccgcctgcgcgctccagccggccaggaggccggttgcgcgctcgaccacgtctccctgcagcccctcttcaagcgcgcacagcgccgccagcagcccgacgtcgcccgtgagctttgccagctgtgtcgtgcgttgggcgggtgttgaggggtgtttgtttagggaggtgggtcagggaagggggtccgtgcgagagaaagggggggcacgaaatggttggagactcacgggacgacagggaagatgcccttagcagggtcaggatagtggtagtccataccagaatggctctccttcctgctccacactcttcgtctccctccagaacataccccccaggcacctgcgggagcggccacgccaagacgggcgaggcaaacgcgacgaagagcgcgcagacgaccgtgggcgccaggctgcggagcaggcccggcgcactgctgccttcaatgcccagtgggagcaggagctcggccaggagtttgagcgcgttccgggccagggtggggttgtgactgctcatgccggcggttgctgcttccgcggcgcgcggcgcgagctccgcctgagcgacacggtcactccgcagcgtgcgcagcgcacacaggagcgtggtctgccgcgccgcgacggcggcggcgtccgagccagccactccatggcccagcacatcaagcaccgctctcagcaacaggggccgggcggtgacatcggcgccccacgtctccagcgccctgcacagcagcacgtgcgtgctttcctcccccggccgcgccatgcagccgacgcaccactccagcagaccgggcaactccggtcgggccaggtccggcgccagggccaggcagctggccaggcagcgcgagaggcggtccgccagctcagggcgtgggagcgatgcgcccgcgtcccgtgccagggcccgccaccccgccagggcctggctcgaaaacgctcgcgctggagcgctggtcgcggggtcgcccgcgccgcggcactcgaacgcctccagcagcgccagggtgctggccagcgcggcggcaggggggagacctccccctggcccgcaggcagtgaccagggccatggccggggcacccagggaggctgcagggaggccggcacagatgtgggtggccgccaccgccagctggcggcacgcgtcgggggctccgacgctcgccggaccggcctgagcaaggaacgcgatcgcgctttccagcgcagggacgagtgcctgggtggggggcgcgcccgcacgctgcgcggcgaggcacagcgtgcacagcgtggcgggggagcgctcgagcagcgcggctcgtcgcgccggggctgggcctccgggctccgccctgcccgcggcacgcaggcagccgagcgaaaggtccagcgcccgccccaggagtgcctgtggagggggatgaggatgctctgagagtggcgcatcagatgcaccaaagggtccacgatgcatgacgcgagacgacacacccgccaagcacaccgccagcacccccggcgcccatgcccagagcatccacgccccctcgacacacgcacatcgcgctccggccgggcggccaggnnnnnnnnnntgccccaggagtgcctgtggagagagatgaggatgctctggagagtggcgcatcagatgcaccagagggtccacgatgcatgacgcgagacgacgcacccgccaagcacaccgccagcacccctggcgcccatgcccagagaatccatgcccccgcaacacgcgcacatcgcgctccggccgggcggccaggnnnnnnnnnnatgtgaatgctgtgacggtcagcacaccaccgtggccactcctcacctacctggtatagaggagggcgcctgctgccagtcagtcacnnnnnnnnnngcgggcacgaggcctggcgcgagggcgctgaagcaagccagggagtcgaggtggagctgggtcgggcctggggaccccgggcccaggctggggacaccgccgaggagggcggcgaggtctgcgggacaacaggcgatgaccgcagtgctgaacgtgtgaatgctgtggcggtcagcacaccaccgtagccactcctcacctacctggtacagaggagggcgcctgctgccagtcagtcacnnnnnnnnnncctgtgcatatgatggcaatcatgagggatggggggggaggttggtgaaagagaaaaggcactggctgtgcatgtagagccacacgtaggcaccccaggattgagatttnnnnnnnnnncatgtcctccgcctctgtgtcgaggtacgcgcaagacagcaggaaaagggcactctgtgcatatgatggcaatcatgagggagggggggtggaggttggtgaaaggaaaaaggcactggctgtgcatgtagaaccacacgtaggcaccccaggattgaaatttnnnnnnnnnnagttgccagccccagcctcctcacgcagacctcaatcaatgtctgcaaaaccaggtgggtgaatgtacaaggctatgaggtggatgcagcctctcacagcctggtgcccatactttgatgcctgctgaggctctcatctagatctctcacatgcttcgatacagcaggactatcacaacacacccacagcacaggcatgcctcagccagccagcaaagtgcacttcttttcccttcnnnnnnnnnngggtcctgatggtgtatgtgcctgcatctcacacccttcccccctctgcccattgatcaactcacatcgagggtcaccaggtggtctggcggtgaggtctgggcggccgcacgcacctcatgtacaagaagctggagggagtttgccagccccagcgtcctcacacaggcctcaatcaatgtctgcaagaccaggtgggtggatgtacaaggctatgaagcggatgcagcctctaacagcctggtgctcgtactttgatgcctgctgaggctctcatctaaacatctcacatgcttcgatgcagcaggactatcacaacacgcccacagcacaggcatgcctcagacagccagcaaagtgcacttcttttcccttcatagccaatccacctctcccaggcaccatgcagctgacctgtgcatagtctcttgcatcctgcggcgtccctccagggaagtcgtcgctgacttcaccaaggtcgcctgaccggctgctgtctaccgcaatgcccagcggtctgaccaacctgagcaaggtcttcaggactgtcgctgcaaagtcctttagctccgtgggtgacattctcctggcagtgaacgagtggaggcggcacaagtgtttggcactccatcatgacgacggagaaagaggcgcaggaaggctgacaaggagacctttccgtgtgtacctccccgagcacaccatctcaggnnnnnnnnnngcgtcgtagaaagaggcgcaggaaggctgacgaggagacctgtcgatgtgtacctccccgagcacaccatctcaggttctggtcacacggtatgaagtatggcctagtcagcactcatcgcctcaacacatcgcaaccccaccggctcactctggcacagtgttctggggcatcctgagacctttgtctcccaccccaaaggcagtgctgtccctcagcacattctccagagctgccatgatggatgcagccagggcacagtccagacgatcggcagcagtcccagtgtccggtgccctgctggagatcaggaaactcagcaatgcctgcgaggtttgtggagagctgggacggtggcatggccgagcagaaggtcggaagagggaccagtgggtcagcgcacatggcgtcgaagtgctcatgtcctgcaattagtcaccgagccctgtgcccagcccagtccctcatcccccacctcgcgtaaggctgccccagtcttccctcgcccggccaccacgccctgattcctggagtccgcgcagtacnnnnnnnnnngcgatttgttacagtggatgcgtgtcagcccattcagtattcacacagcaagaaagaagagcgattcacatgttcacgaccacnnnnnnnnnngtaaggctaccccagtcttccctcgcccggccactacgccctgattcctggagtccgcgcagtacagccccagcaacgaggcgacggcggtggagccctgtggtccccgcgctgccgtgctcgcaaactgcagggccagtcgttccagggtggccgactgcttgggcgaagcgcgctcgatcacctccgccagcacgtcaacgcctacggtttgttacagtggatgcgtgtcagcccactcagtattcacacagcaaggaagaagagcgattcacatgttcacgaccacaagcccctccacttgcataccttgctgggcccgggatgggttgccggacggctctaggcaggcgcaggcggcggcgatgaagtagtcggcctgacccacctcgagctcctccaggcagccccaggccacccatgcagagaagaccgctaggatggaagcctcgatggcagacccgggacgcgactccttgccgtgcacgctcctgagccaggggaggacagccggcacccaggcgcgcaggcgggcgcgcgcagggtggatgtcggcgagctgatcgacaccagtctccctctcggcgtcctcacactcttgcggcaggaccgtgaagaggtgcaggagctgcgctgtggagaggtgctgacctgggcacaggggaggacggcaggggggcgatgggatggatgcaagcatcgcttgaccaatgcaacgcacccacttgatccaaggctgcatgcgcaacgcgacgcacccagcagggccagcggctcctcccagtctcggactcgcagtgccatggcggccagcgtgacacagcatgccagggacacggggctggatcgaggcagggcactgagctgggccagggcggccaccacgccccggaccaccaccccccactctccccccagctcctcaagctgcctcctgcacttccatgtcagtgcctggcaggcctgcagctgcaccgccaggccggcatggggctgggagagcagggccagcgtgacactccaggccccggggctggccctgaaccttcgaagccactcatcagcgacactgcggtcggcaggagacacgaatggggatcccagctgccgggtgtatgacacgaactcgtccgctgctgacatgctagcggtgccgggaggtcccgagcagggggagtcgcacccctgcccggtactttcagagcggatcaagtgcaagacatttcaaatgtcgcactctttcatgccgcatcttttcacatcatgcgaattgtatgcttgggcattaacttcgctggccgttgcgtttcgtcgacagatcaccctccagctcgaggcgccggcgcccgaagcacgcgcagtgcatatgccgggatgcagcgtggcgactctcggctcctgacagccccattggagggcttcatgttttattagtaccatgatgtggttttcaaagtgttcgtctcagagattgagtgtgcaggagactggcgcagggtgtgacgggtgactggctcgcctgatcagagaggtggcgcctgatctgacctctagcgatggcctctgtacccttactcataatnnnnnnnnnnaggtgactggctcacctgatcagggaggtggcgcctgatctgacctccagcgatggcctctgtacccttactcataatatacgccactgtgacggggaacgcagaggtgcgcagccatataacctgcatttgggcgcgagatcggcgtgatctggcatcaccgtatgtttttttccacccccctccctccctaaaccctactccaggatgtcgccgagcgtgtcgcccgggaggccctgcgccgccactacacccccaccgtcatgtcggcgcacgccttcctcagggccctggacaccctcccctcctggcgcgctgtcgtgtgggtggcctccaccaccggccagggtgaggccccgcccacgctgcgcgcgctgtggcgggccctgctccgccgctcccttccccacaacctgctggccgggcaggccgccgccgtgtttgggctgggtgacagcgggtacacgcattacaacgtggtggccaaaaaactgtaccgccggctggagggcctgggcgcgctcatgctgggaccggcgggccttggggacgaccgcgccgcgggcgggcacgaggccgcgctggccccctggctcacagacctctggcaccggctgcgggcccaggtgcccctgacccccggcctcacagaggtgcggcgggatgcgattcttggggtttgcggaggcggctaatgctggaagatggcgccagggacgcttcatnnnnnnnnnncgtcagggtttgcgccggcggctggtgctggaagatggcgccagggacgcttcatcccacccacgatcatcacccccactcgcccgccccacgctgtccaggccgcgccagaggaccgctacacgcgcccgacgtgcaagtggacggtggaagtgtgcgcggcatccccgtcgccccccgagggcgccccggcgcaggcagccgaggccggcggctgccgcgcagctgtgcagtcggccgccctggccgcgcacgtcgcgatcgcggagatggaggacgaggcggcgctggcttccgtgcccggcgcaggggagatgtggggagttgggcagggtgccacccctccccacgcccacgactctcctgcccggccgctgactgcccgtgtggcggccaccaggcggatgaccgcgccagaccactggcaggatgtgcgccacttggagttggaggttccgggcgcggagtacgagccgggcgacgtgttgagcgtgctgccgcgccaggacccggcagcggtcgtggccttcatcgagcgctgcggcgccggccttgcgcctggcacgacggtggaggtgcggcgcctggcgccggggccggaaaccgccgggcccgcgccgcgccacctgcgcctcggcgacctcgtggccggcacgctcgacgtcgccgccgcgtcgccgcgccgcacattcttcgaggtcctgcgcgacgcggcggggtcggggcttgagcgggagcgcctggagtacctctgctccgcggaggggctggaagacctggccacctacaaccagctggaaggcgagcgcggttggagggggggggttagttgaggagtgggtggtgtgcggttaagtcgtcaggcatggggtccaatgagtcacaggcacctgcgacacccaacgctctcagcgagcgccacggcaccnnnnnnnnnnggtttggtcgtcaggcgtggggcccaatgagtcacaggcacctgttactcccaacgctctcagcgagcgccacggcacctcacgtccgactcacagggcgcacggtgctggaggtgctccaggacttcccctccgcccggccggacctgggctggctgctcaccgccgtgccgcgcctggcgccccgcgccttctccatcgcttcctcccccctggcgcacccgggcgcggcgcacctgaccctggcggtggtcggctgggtgacgcccttcaagcgccggcggcgcggtctctgcagcgcctggctggccgggctgcggccgggggacgagctgccggcctggacgcagcgcggcgcgctgcgcctgcccccagacccggccacccccctggtcctcgtcgggccgggcacgggggtcgcgcccatgcgcgctttcttgcagcaccgcgaggcccagaggcggcacggcgtcccgggtgcccgtgggtcgtgtgctttccggctgtcgagtggtgctgggcggggagcaggtgctctgggtgtggccnnnnnnnnnncggtgcacgtgggtcgtgtgctttccggctgtcgaatggtggagggcggggagcaggtgctctgggtgtggccccggcccgcccgccacatgttctctcaagtgctgtggacgggtctggggcttgggctgggagtcgggagccctggtcatcatctcaacccccccaccccttggaaaagcaggagtggcgcccagcctgctcttcttcggctgccgcaacgtggacaaggactgcctgtatgccgaggagtggggccggctgcgggccggtaacatcctgtccctctactcccttgcggcgtcccgcgaccaagaccacaagatctacgtccaggaccgcatcagggaggcggccgccgccgtgtgggaggccctggacagaggtgggtgaaaagcggggtgttcttaaatgcttctcgccatgcccaggtgcctttgtgctgagggcatccttcagccaagtgcaggacgcttcatggcatccgctcaccgcatgaaacccccgcactcaccctaccctcgatccgcccaccactgacgtccaggtgcgtcggtgcatgtcgcgggatccgcagacaagatgccggcagacgtcgcgtcagccctggcagacgtgctggtggagcgggggggcctgcctcctgaagaggcctccagggtgctgcagaggtggcaggccacggggcgataccaggtggaagcctggagnnnnnnnnnnnnnnnnnnnnnnnnnnnnnnnnnnnnnnnnnnnnnnnnnnnnnnnnnnnnnnnnnnnnnnnnnnnnnnnnnnngctgagtgctgctgtggagcacctgttttcccctcttgggagcgcgacacttttgccacgtcaccccccgctcggcttcacggacagagtgcgagtccaaatcgctcccatgggcctgcaaaccaataactcgataggataatctagccggaagcgtnnnnnnnnnnttgaatggacccagactattctcttggagtattgctgcatgttggaagaaacacactgcatggtttacgcttgaactcctagtcagagcatggatcagtgaatcttagccnnnnnnnnnnctgaatggacccggactattctcttggagtactgctgcatgttggaaaaagcacactgcatggtttacgcttgaaatcccagtcagagcatggatcagtgaatcttagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctcggcttcagggacggagtgcgagtccaaatcgctcccacgggcctgcaaaccaacaactcgataggataatctagccggaagcgttgcaaatcacggtcaggagactctgctcgcctgtccgtgcggacgcgtggacgctatgtcttacagctacctctttaaatgtgggcatgtgtggggtggcagggtggctctgcagtgtatgtaagcacatgctactcctactcaagcgtcctttacatgaacccatgcagatattatcatcggcgacacaggcgaggctccctcaggggcggaaggttcctgggctaccgctagtcgccctcccaacaccacatgcagcctgctcgacaccgctgcgaccatgcatctcaatgtttaaccctcgcaggtgtgggaaagtcatgtttgctgctgcagttcaccgacaagcgcttccagcctgtgcacgacctcaccattggcgtggagttcggagcccgcatgatcaacatcgacggcaagcagatcaagctgcaaatctgggacacggcgggccaggagtctttccgctccatcacccggtcctactaccggggcgccgcgggggccctcctggtgtatgacatcaccaggcgggagacgtttgaccacctggcctcgtggctggaggacgcgcggcagcatgccaaccccaacatgaccatcatgctgattggtaacaaggccgacctgtcggtgagcgggggtggctggtggggaggtgggcttgaatggggccgcgtcgtgggttgcgggatctgacatgcgcatgcagaggcccttttcttctcgattggtcggcctgagaaggagtttgaaccgggtttttgggtcgtgatgaacgccattttatgctctggaacagtggcagagcatgtgcagaggtcttcttgctgtatgttggagcctctggcatgtcacccgcaagtgccttccgcctgccaagccccccacggtattccttcctttccacctcacccccagcaccggcgtgccgtgagcacggaggagggtgagcagtttgccaaggagcacggcctggtgttcctggagaccagcgccaagaccgcgctgaacgtggaagaggccttcatcggcaccgcgcgcgccattcacgacaagatcgcctcgggcgtgctggacgtctccaacgagagctacggcatcaaggtcgggtacggcgcgggcggcaacgctggcgcgacagggattgtgcgtcccggggacgcagcggcggcgcccaggtcgggcggctgctgctgagtgggcccagtggtcaagcccctccgcaacctgccctcgaccgcccatccccccccctgtaccatcccatgtagctgtgatatgtccttgattccgtccatgccctgctccttccctttcctctgcaatgcccttgcgaagcatgtctgtgtggtcaccacccagcagcccgctnnnnnnnnnnatatgtcattgattccgtccatgccctgctccttccccttcctctgcaatgcccttgcgaagcacgtctgtgtggtcaccacccagcagcccgctgatcgatggggagggaggtggcaggacaattgtccctgggcttgacacgggggagctgagtagtgtggggctaccgaaggggtgggacagcacaagcggcggggatctgcaggtggaggagcagagtgcgtgccgccctcgatgggcttgcatgggtgcggaggaaagaatcagtgtgcgaggccgagaggcaaggaagtgcagtcaggcagaggcgtggttcgtagtggggccaggacccagcccagcgacagtctggcactcgcgcctagtcctctgccccgtcagcgccgcgcagcgtgcccagcgccttgggtgcggtggtggccacgatggtcgatttggagtaggacgaaaggtcggccccctccgtcttcccctcgcgctccaactcaccctggagcagagagggggcggtagggggcagggcgagtggtgagtaggtggtaagcagggaatgcacggtgaggagggtggcaattgccaggtgcagagaggtgcgcaaaggtctggtctgagattcaacgtgcgtccgctgcaagatgtattcggtcgatgccagtgatgtcctcacgctactgttccnnnnnnnnnnaaatcaggggatgcagggtgaggagggtggcaattgccagatgcagagaggtgcgcagaggtctgctctgagattcaacaggcatccgctgcaagatgtatgcagtcaatgccagtgatgtcctcacgctactgttccaggagccttataatcaacagtcattccaaggtcaagccgcccaacacacatgtagacaaatcccagacatccatttccctccccattcccgcgctaccatccccgccctcttgcaacctctgtcctccgtcccgaccctcctcatctcccnnnnnnnnnntacaaaccccagacatccacttccctccccattcccgcgctacccatccccgccctcttgcaacctttgtcctccgtcccgaccctcctcatctcccaagcccccaccttgatccagtcgtaggtgatgcgcaggccgtccctgagggtgatgctgggtgcccagcccagctgctcgcggatgagctggttgtccgagttgcggccgcgcacgccctccggcccggggatgtggcggatgggggtgctcttgccannnnnnnnnnacgcccgcgcacgccttccggccccgggatgtggcggatgggggtgctcttgccatcgaaccccagcaccatctccatcatgccattcatgctgaccatctcgtcgctccccagattcagcgggcccgtgaagtccgacttggtgatgcgcaggatgccctccacgcagtcgtcgatgaaagtgaaggaccgcgtctgcaggccgtcgccccacatctccagctcgtccttggacgtcagcacctgggtgggaagtgaggagtgtgtcgagaagagaaggaggttggggaggagggcgtggacgttgccgcagcaggaaggggatacccagtctcgnnnnnnnnnnagtgttgagaacagaagggggttggggaggagggcgtggacgtcgccgcagcaggaaggggatacccagtctcgctggcgcatgccactgaaggcaaggcagcgaggcataggagacatgcagtggatttggccgagcctatgggcgtgcaaaggagcttgggacccagccagtgcaccgcnnnnnnnnnngaggcagcgaggcataggagacatccagtggattcggccgagcctgtgggcgtgcgaaggagcttgggacccagccagtgcaccgcgcgaccgacccgccgtctccaggccctctgaccaacacacctttctgcagaaggcggcgggcgccttctcgcgaccacccttccaagtgcccaggggaccgtagatgttgtggaagcgggcaatgcgcgtctccatgccaaagtccttgccatagtggatggccagctcctcggatgccagcttctccaggccgtaagcatcttgcggctgtgggtgggtcaagccaggcatgtggacggttgaggtgcggggtggacaccgtcgcgtgctttgacaaccgtaccaaccacagcagccaggggtgccccttcttgacacggaatgggcccctggcagcatgcagtgtctgtgaagcctggagctgccacagcaaccctcagggccttgcctctcaacaccttgtccgacgcaacacttccatccccaaccctgcccggtgagggttccagctacttccatggctgcatgctgtttcagtcctnnnnnnnnnngccgacgcaacactgccatccccgaccctgcccggtcagggttccagccacttccatggctgcatgctgtttcagtcctcccacccccaaaaccccgagacaaacccaccacacctgtgccggccaggcagtgtcctccttcagacccccgccctcgatctcagtctccagctgccggttctccgggtagatgcaggcagaggaggcgtaaaagtagcgctggatgccctcctgcctcgcagcctccagcatgttgaaggagatcatggtgttgttataaaagatgacggagtgattgctctggatgaagcccatgccccccatgtcggcggccaggttgaagacatggtcagcgcccttcaccacacgggcgcaggccgagaactccctcaggtccaccaggtggaactcgtcgcagaagagctcctcctgtgatatacgttgcacggaggggttgctcagttgcgctggtcgtcctaggttgattccatgccttcactcagatcttcaacatgtnnnnnnnnnnaagctcttcctgtggaatacgttgcacggaggggttgctcggttgcgctggtcgtcctgtggtgagtccatgccttcactcagatcttcaacatgtgatgactgggtagagccctgggtttcccaatcacctccactgggcacctatgtgcagcctagcatgcacaggatctgcacacactgatccacacaaagaggcgcacagcaccatgatcccacctgcatgtgctnnnnnnnnnnagtagcctagcatgcacaggatctgcacacaaggatccacacaaagaggcacacagcaccatgatcccacctgcatgtgctcgttgcgcttccagtcacatgcaataatgtagtggccctccgacttcagacgagcggccaggtggctgcagggatggggttccaagtcgaaaggcgctggtggtcagttcacagccatgccaaggcagcattatgcaggaggccggcatggccacctaaacccatcacgcatggcatggtgtgggcatgattgggccatacaagcgcactccgcagtttcggcacccctgtcgacaccggtccattgggcaacgccggtgtgctcacagcgcccctcgcaatgaagcctccagcccctgtcacacagattcgcagcttctttgaaggccagtacggctcaaaagggtacttggcgagcccactgctcttctggtacacatcggcaatggtctggtttgccatggtgatgcagggaggcagtccctgggttcaggagaggagccttggaatccgcttggttctatatactgtctcctgtgtcaagaatgtacacaaataaacttcgctccgcatgccacggtgattggttgttggggatttttgtttgtggatgtgcggaagcatcgccagcggtcctgatggaaagcgggattattactggggggtcgggagagcccgggcccaccagcgggtgcaaaattgcagtgtggctctgctatgagtaggcccagatccctggtggacgaagatgccatggctgctttatgcaagctgtgttagaacgccaatgctcttgacaatgcgctgcnnnnnnnnnnggatgcacgatgatgccatggctgctttatgcaagctgtgtcagaacgccaatgctcttgacaatgcgctgccccctccctggccttgcctgtcccctaccctcccatacatttgccaatagcaacttctccaggcgttacatgatggcttgaaagggtttttacaaacaggctcaaccaacaaacccacaaccctctccagggcccagtcaggcctgctttgccctctgctgcaggccctccacccgcgcccgcttggccgccgcactcctctgcaggctggcgtacagcttccgcgtcttccgcgtcatcatagtgctcaccatggccgcctccgcctcctcctctgcggtcctggcggccgggtcccggtcgtcggccgccggcgtggcgggcgccgcgccgccctcgcgcgcggcggcc

SEQ ID NO: 37521 - DNA, 62 bp, Chlorella protothecoides
gccggcgtggtccagcagcgcccctggcatgcgtgggtgggtgggggttgcggtgagaaatc

SEQ ID NO: 37522 - DNA, 73 bp, Chlorella protothecoides
gagcagacgcgtttcagggtcacccggccgccctcccgcggaagcagccgcgacggcccgggtggaaagaagg

SEQ ID NO: 37523 - DNA, 61 bp, Chlorella protothecoides
ctgcgcagcgtcggcagcaggcctcggaggggcacactgcgcctgactccctgggattgat

SEQ ID NO: 37524 - DNA, 112 bp, Chlorella protothecoides
tggtgcgcgcgacgccctgttggtggcggccgcggcgtcgctggtcgcgcaatccgcgggagagcaaggcggctgggttggcgcggcagaccgaacaccatgtgatctggaa

SEQ ID NO: 37525 - DNA, 80 bp, Chlorella protothecoides
ccggggaagggtcccctggtgttggtgtgtcgcgtctggctgtggaccagggtttgacatggaggtggagtggaggggcc

SEQ ID NO: 37526 - DNA, 124 bp, Chlorella protothecoides
tgtggagggcatgtcggtgcgtgggagatcgaaggtgttgcaaagcgcaggcgaagcgcatgaccaagctcagggcccgaggcagcgcaggggaaatcacgggggaacctatctgcgcccccct

SEQ ID NO: 37527 - DNA, 2563 bp, Chlorella protothecoides
  modified_base (530)..(539): a, c, t, g, unknown or other
  modified_base (666)..(675): a, c, t, g, unknown or other
  modified_base (841)..(850): a, c, t, g, unknown or other
  modified_base (1407)..(1416): a, c, t, g, unknown or other
  modified_base (1583)..(1592): a, c, t, g, unknown or other
gacgcacgcgcgacggcgggcggccctcgccgcgcgacgcgcgggctgggagctgaacgcgcggcccctgagcgtgcgcagcgcgctgtcccgcctgcccatcgagatcgtcagacaggtggcgtggggtgtgggggtccagggtgggtctaggggggtggaatgggatgcagagcaccttggacggggtgggggggcagcatggcgtggggagatcacgcgcagcccgcttcccagccgtgccgccatgccgtccagtccattcgacgcgcccgcgtccccctcccgcacaggcggcgaggcggggcgggcgccggcccgtgcccgaggcggaggttgacgcgcgcgggcgctggactgcgccgcggcgcctggcctgggcttcccgcgcgcagcgcgcgcagacggcctgccagctggcgatgtgcctgcgcgaactggacgcggcgctgcgctgggaggcggccgcgcggcccaagcccgaggcactggcgcccggcgaggcagggctcgaggtcgtggaccggcgnnnnnnnnnnccttccccctgacgcagcgccgggcggccccgcgacctttgagtacctcgtgcgctgggaggaggcggaggaggaggcgggggggccgaaggcctcgcccgaccagcatccggcgccgctggctggnnnnnnnnnngggaggaggcgggtgggccgagggccttgcccgaccagcatccggcgccgctggctggcgcgggcttggctgcgggcgccggcgcgaggagtgtgggtgccggggcaacagacgcaagtgccagcgcactggacgacccaggcctgggtggccgagcgccgaagannnnnnnnnngacagacgcaagtgccagcgcactggacaacccaggcctgggtggccgagcgccgaagatcgatacgatggcaggcgcggccgcggcaccctcgaccgtggcgcccggcctcacggcgcagctcctgtcccccggcttccccgacgcgccgggctctgtgacagtgcaacacgggccgaggtctgcgcccctcacgccggctgcggccagggtctgcgccgccgagcccctgcccacgcctggggtcggggcgggagatcgcgcccagcccgaggcggagggcacgcctgcgcccagcttgcaggtgcaggccagcggcagccaggcggaagccgccgatgggcggggggacggggcggtggacggaccggcgtccgagcccggcgacaagccaaagtcatgtgaggggagcggctttgtcgttgtcgtcgggctggtgtaccttgtcacgggagagcgaggtgtgtcgatgcgtgcggtgtgcgccctccagccctctcaaccctgcctcttgccccacattccacctccagccacgcggcggtgcgggcggtgcnnnnnnnnnnttgcgcgcagccaagcgtaccaacaccgccggcaagcggtgagctcgccgtggttgccgaagggccgagcagagttccggtggagtgcaaccgcacagatgccatttccggtggatgttctgggacggcctgggtacctctgtcgtcatcacgggcatgccctcgcnnnnnnnnnntgttgggctggtgtgccttgtcacgggggagcggggtgcgtcgacgcgtgtggtgtgcgctctccagccctctcaaccctgcctcttaccccacattccgcctccagccacgcggcggtgcgggcggtgccccaactgcctcaaccccgcggcgaagaaagggtgcacggtgctggcgagcgtgcgcgcagccaagcgcaccaacaccgccagcaagcggtgagctcgccgtggttgaccaagggccgagcagagttttggtggagtgcaaccgcacagatgccatttccgatggatgttctgggatggcctgggtgcctctgtcgtcatcacgggcatgccctcgcccagattggagagaatggatccattctaatccattcacgctctccacaaacttctaccagggtctcgacggggtttgcccctgccggggacggcagcgcggcgctggtgcaagcactggtggcctcggccatcgccaaggcgctggtggcggccggcgggatggacgagggcgccgccatggccgccaagctccgccgccacggtgcgtgggggaggcacggctgctttttgaccccgggatggggccgggtgaggccaggcaaccaggcaggggccttcagcgatgagcttcccttgcggtggttgcagcggggagcgactctcctgttttcagcacgctcgacccagcacgctcaacccgcccgacgcctcacgcgctccacaaacccctccgcgcacagcaatgctagcggcgggcgcggggcgcctggccgaggcggccagccacgcggcgcagagggaggcccagccggagccggagcctctggccgcccaccagcggcgggcggcggggcggcccctgtggctgccggaggcggaggtcccgctctgggccgtcaaggccttcgaggaacgcgcgcggcgcgcgctgcaaggccccgggacggccccacgcggcggcg

SEQ ID NO: 37528 - DNA, 78 bp, Chlorella protothecoides
gttccgcttctgcagcacagaggagcacggggagggaggagagtcaggcacaaagggtaccttggtggaggttatcaa

SEQ ID NO: 37529 - DNA, 101 bp, Chlorella protothecoides
tgagaagctggagaattcatttcgtagagccctgtcgcaggcagtccacccagcaccctgcagagcgccagtcatgtgctttcctcgcaggctgcgcagga

SEQ ID NO: 37530 - DNA, 61 bp, Chlorella protothecoides
ctcctggcgcgagggcctggtcctgcacggactggggtacaaggacggcggtcgcgtgcgc

SEQ ID NO: 37531 - DNA, 63 bp, Chlorella protothecoides
ctgcagcagaagcacgtggccgccgccgcgacactgctgggcgccgactcccccgcgctggtg

SEQ ID NO: 37532 - DNA, 64 bp, Chlorella protothecoides
cacaagtcagccgcccatccgccgcaatccctccaacagaggcaactttgactatgagcagggc

SEQ ID NO: 37533 - DNA, 61 bp, Chlorella protothecoides
cctggcccgcgccgtagccctggcccgcgctgtagccctggcccgcgccgtagccggcgtc

SEQ ID NO: 37534 - DNA, 102 bp, Chlorella protothecoides
ggtgcagcagcggtgcgtcatccatctcccacaccacgccatgcacgctatatcaccctcaggcgactgtgcgggctggtcggccatgccagaggcgcccag

SEQ ID NO: 37535 - DNA, 75 bp, Chlorella protothecoides
cggtcgtcgcacccggtgccgtctcgcgaccgcccgtccccggctggtcaggggtctggctggtgccctgctgtg

SEQ ID NO: 37536 - DNA, 82 bp, Chlorella protothecoides
gacccagcccagatcatcgacgaaaaggtgcgaggccccaggccaggcgtgggggggggggtgatcctgccccacgtggagt

SEQ ID NO: 37537 - DNA, 120 bp, Chlorella protothecoides
tgttgctgcacggcctgcgggatgccaggtgcgtgagtgaggaaggggagcctgtgtggatccctggagagaaaaggagatgggatcggcctgcaccctcagggccatgggttgcgtgga

SEQ ID NO: 37538 - DNA, 92 bp, Chlorella protothecoides
tgtgcacatgttccgctcactggtggaccgcgagaattgggcgggtgcaaacgccactgcgcgccagtgcgcgcgacggctggcccttgacg

SEQ ID NO: 37539 - DNA, 65 bp, Chlorella protothecoides
ctcatggagcaaaggcatcttgctcaggttgtaaattatctagtactccagatgaaaatgggctc

SEQ ID NO: 37540 - DNA, 94 bp, Chlorella protothecoides
ccaccgagacggcctgaacccgtgtgcggcaccctgtccgtgctccgaaccgcgcctgctgggctgggcgtcggccacggggctggcgcgcggc

SEQ ID NO: 37541 - DNA, 80 bp, Chlorella protothecoides
ataaaacctgcctaggagatactgaaacctcactgcaccaaccgaggtgcctcacctggtacccaactcgaagcgggggt

SEQ ID NO: 37542 - DNA, 70 bp, Chlorella protothecoides
cttcctgcctccctccattcctcttccaccccccccccaccacaccaccacacacttccctgcctcttcc

SEQ ID NO: 37543 - DNA, 61 bp, Chlorella protothecoides
taactgcattcggcggtttctatcagcgggggcagccactccggatcagatctgagctcat

SEQ ID NO: 37544 - DNA, 14174 bp, Chlorella protothecoides
  modified_base (780)..(789): a, c, t, g, unknown or other
  modified_base (1070)..(1079): a, c, t, g, unknown or other
  modified_base (1442)..(1451): a, c, t, g, unknown or other
  modified_base (2752)..(2761): a, c, t, g, unknown or other
  modified_base (3187)..(3236): a, c, t, g, unknown or other
  modified_base (3386)..(3395): a, c, t, g, unknown or other
  modified_base (3493)..(3502): a, c, t, g, unknown or other
  modified_base (3839)..(3848): a, c, t, g, unknown or other
  modified_base (4142)..(4170): a, c, t, g, unknown or other
  modified_base (4454)..(4463): a, c, t, g, unknown or other
  modified_base (4731)..(4740): a, c, t, g, unknown or other
  modified_base (5484)..(5493): a, c, t, g, unknown or other
  modified_base (5570)..(5579): a, c, t, g, unknown or other
  modified_base (5782)..(5791): a, c, t, g, unknown or other
  modified_base (5910)..(5919): a, c, t, g, unknown or other
  modified_base (6434)..(6443): a, c, t, g, unknown or other
  modified_base (6832)..(6841): a, c, t, g, unknown or other
  modified_base (6936)..(6945): a, c, t, g, unknown or other
  modified_base (7502)..(7511): a, c, t, g, unknown or other
  modified_base (7628)..(7637): a, c, t, g, unknown or other
  modified_base (8729)..(8738): a, c, t, g, unknown or other
  modified_base (9796)..(9805): a, c, t, g, unknown or other
  modified_base (10304)..(10313): a, c, t, g, unknown or other
  modified_base (10453)..(10462): a, c, t, g, unknown or other
  modified_base (11274)..(11283): a, c, t, g, unknown or other
  modified_base (11882)..(11891): a, c, t, g, unknown or other
  modified_base (12487)..(12496): a, c, t, g, unknown or other
  modified_base (13305)..(13314): a, c, t, g, unknown or other
  modified_base (13774)..(13783): a, c, t, g, unknown or other
  modified_base (14000)..(14009): a, c, t, g, unknown or other
caggcgcagcaggcggcccgggtccggaggccgggcggtgccgctggcgaccgccgcgcagcgcacgcccagctccgcacgcagctcggcatgaagcctggtgagcagcagcacgcggcgcagggcgtgcgcgccgcgcgcgccacgccgcgccaggcccagcagccgcgcctcggtggcaagcagcgcgggcgctgcagatcgctcgaccggggtcactgcggcgccgttgagcgaggccagtgtggatggcagggtcgccaccaggtgcgcgcgtgcgtagggcaggctggccacggggcagccgtcgaggtgcagggactcgaggtggggcagggcggccaggggccgcaggctgtccagcgtcgacagcggattgtcgcccagggacagggcgcgcaggccccggaacgcctggatgccttccaagctctgcagcaggttcttactcaggtacagggtctgcaaaatggtgcaaatgagtggggccttcaggcggctctcgggccatgctgggttgatgtgtggcagccatacccggcctggagccaatccccataggcatgtgcaaccaatgacccaaatcatgatcccagtaaccagaccgttgcatggatgtactcgggcgggactgtgccgacggcgccgatgccgcaatccacggccgagagcttgcggccgtcccatgcggggcgaccggcctccaaaaccgccgcgagggtcaggggaggccccacacgaggcctgatccgccctttaaggcggctcaagagctctttnnnnnnnnnntgccgcgagggtcaggggaggccccgcccgaggcctgacccgccctttaaggcggctcaagagctctttgcgatggcatgcaggctcccccggcctcatgtcagtctccgtcgtgcgacatatcgacggcacccatggggttcatgcgtcagccacaggagctttgacgacagcttgttctgttaacatcgacaacaagtcaccccagatgtcttgactggagcccaggagggagtgcatgccatgggataccctcgaggtccgagctgtgcccttcgtcnnnnnnnnnngcgtacgacatatcgatggcacccatggggttcatgcgttagccaaaggagctttgacgacagcttgttctgtttacatcgacaacaagtcactccagatgtcttgactggagcccaggaaggagtgcatgccaggggagaccctcgaggtccgagctgtgcccttcgtccggaaccgacgtttgaagggcagcatggtgggtgggctggaaaggacagcagccgatcgtttaagcgccagcctccgctaaaccagattcgtatggcctcacggcggagtgcagctgtaaattgtgcgcacagcaattgttgttgcgtgtcagctgttcagcattgcatcctgtgctttcacgcggttggctnnnnnnnnnnagatcgtttaagcgccagcctccgctaaatcagattcgtatagcctcacagcggagtgcagctgtaaattgtgcgcacagcaagtgttattgcgcgtcagctgttcagaattgcatcctgtgctttcacgcggttggctgtggccgcagcgaggccgtcccggcctggtccccccccttgggtacccattggcccgttcagggacaagaggcagtgcgaccatggtgatagcgctataacatgatcaggatacaatttgcaaggtctgcaccggccgcgatgcggaggcgcactgcgcccagcctgggcgcctgcatcctgctcctctgcgcagtctgccgcgtcgtcgacggggtgcgttcagagcgggcgggcccggcctactcctgcacctcctgcattcacaagagcttctaattatggatgggtcccaatcaatttcatacccgcaggtctccaacagcgctcacctgggccccactctggcctcctccctcgacgacgacgcgttcctggggtttcttggcgaggcgggggagtgcgccgactccccagttcccaacttggtgttcacgggcggcaagaacaagaccgagacgcgccttccgtccctcaccgtggagggcgtgtggaggagttccatgaaccatagcctggatgatatcactctgtgcaccaacactggcatcgaaaggtactgagggggctgggcccaaaggcaggcacagggatcacaggcctctaccctgttgcttggagcccctctgagccacttctttccgggtctgggtgcgtgcttccagtggaccaccctctgcaactcgagacactgcgccatggcggccgcctgcatgctgtcattgcaacctccaatcgccccccgaaccccctctatccttctagtctgtaccatgcaccctctcgcttgcacacgaactcacaggagctacatgctggagggccagtgcacaagctggggcggcccagtggtcgccatcctgtacctgtccctggagctgtttgacacgaacaatgcgctgcacatcgaacaagcaagggcacaggctgcagacctccacgccaggatggaggaagcgggtgagggagcaagggtggatttctgggccggggttgggtggcgcctgaggcagggaatcgtagagcttgtggggattcaaaggacattgggaatgtaaggactccatgtgaggagaatcccaacccaagggaccttgctttgtcatgctcctgcctcagctgctggtgagactttggaaaacccaggccagtaaagcccgggnnnnnnnnnnttgaggagaatcccaacccaagggactttgctttgtcatgcccctgcctcagctgctggtgagaatttggaaaacccaggccagtaaagcccgggagcccaggcctttgcggcagccgatgccagacccacagcacaacctcgacagctcccatccctggtcatccatcctccgccgtcccagccacacatcctccccgcccgccacgccgcaggaggatgcgccctggacctggtgctggtgggcgacgccttgccagccaacgagagctgggcctacccctacaactcgctgcgcaatcaggccatcgcgcgcgcgcgcacgcgcctggtcctactcctggacgtcgacttcctggtcagcacgggggcgcgagagcgcttgctggcgcgcgacgcctgggtctgggcgctggacgccacctannnnnnnnnnnnnnnnnnnnnnnnnnnnnnnnnnnnnnnnnnnnnnnnnnttccagacaacgctgaacctgagcctggcagagggcacggccgtggcgcacgactccgcggcaggtgggaaggaggaggggaggcggccggaggaacagggaagcggcgggctgggtgttgagggcgggcaacatgtcattgccccaggnnnnnnnnnntgtgccagccaatgagagctgggcctacccctacaattcgctgcgcaatcaggccatcgcgcgcgcacgcacgcgcctggtcctactcctggacgtcnnnnnnnnnngcagggaaggggcgggctgggtggtgagggcgggcaacatgtcattgccccaggcgacagcggcgaggtgtcttgtccattgcctcaagactgccccttggccaaagtaccgcggctctgcaggaggcgactgcgtgcacgaaatcctggtcccagactgccgaccagggtcagccctgctcaccatatccatctgtcaccctctcaaacatgcccgccccttcgtgccacagccgggagcaaggcctacatgaaggcagagatggcgaccggccgcatcacgcgctttgcatcgttcttcctcagaggacacaagtatgcctgcactgttcatgcnnnnnnnnnngccggccgcatcacgcgctttgcacccttcttcctcaaaggacacaagtatgcctgcactgttcatgcgatggagtgaggggggggtgggggggactgagcaactgccacacctggatgagtcatcagcctggctggctggcccatgccccatgcatgcacggcaatgatgcccacccacaagcccctgcttgcccactcgccgcactgtggcaccgctctccacctcgctcgcaccggtgatcccggccccgcccctgcagcgccacggactacaaccgctggttcaggtcgnnnnnnnnnnnnnnnnnnnnnnnnnnnnncctcagccccgcccccgcccccgcagtgccacggactacaaccgctggttcaggtcgagcacgccctaccccatcacctaccagcacggctacgagcccttcatccttgtgagcagactgcacgtgccctggtttgacgagcgcttccgcggctatggctgggacaaggtgggtgggtggcgtgaggggggtcgaggggcatgtggccaaggggttagaggggcaggatgcccagcctggtggacgatgcgccgagcagaggtgggcacatggaggtgcggatnnnnnnnnnncggctgggacaaggtgggtgggtggcatgaggggggccgaggggcacgtggccaagggttcagaggggcaggatgcccaacctggtggacgatgcgcagagcagaggtgggcacatggaggtgcggatcgggctgcggccgtgccgcctcgtcaaagtgccccgtggccttgggcgccctggggcagggaccctgccccgacccccgcccccgcctccacgctttccatccaccccaccccccagatctcgcacatgcacgcgatggnnnnnnnnnnggacccccgcccccgcctccacgctgtccttcgaccccccccagatctcgcacatgcacgcgatggtggccaccggcttccagctggtggcagacccatccatttacgtggtgcaccggccccacatcccctctgccggctacaaccacacgttcactgggcctgcttacaccaagagccacagggccactgcggtgggtgcctgggtagggaaaggggggatgcgtggcggggcaggctgctcatgagcccatggtcccacacagtcgcaggttgtgaagctcgacccacacgctccatcacaccccaccctgacgccgccaggcgatggagaagctgagcgtgatcggcatggagctgatccaggacgtgaaggcgggggtgtacccggagcacggcgtcaccgccctggcagcctgccgcccgctggagcgatggtttggggccgagcggaggggcccggcggaggggccaggggcggcggccaggagcgcagggaaacgagagacgccctcccgcctcgccttcatgcgtggcaggctgcagaacccggtcgtggcgtggtggtgagggacgcgagggagggaaggcgccttgccagctgtcacggcctgtccacaccgtcacatgctcgtgcctgcggcgccaatcttgcgatggttgcccgcgggccctcccatcttgtgccctgcgcctccttgggcacatgccgtggggacaaggggcatgccgaccctgcctggnnnnnnnnnnacgaaggggcccagcggaggggccgggggcggcgcccccgagcgctgggaaacgagagacgccctcccgcctcgccnnnnnnnnnncagtgactttgacgcctcacccacggacacatagacctggtttacgatgaagccccctcgggcatggtgcttgtattgcagggtgtgcaatgaatggagatgcttgtaacgaggatggtcgcgatgttgggcgggggatgaggatggacagggcccaaaaccaccgacctctgcccctgcgtcgtcctcagccgccggccggnnnnnnnnnntcatgctcgtgcctgcggcgcaaatcttgcgatgattgcccgcgggccctcccatcttttgccctgcgcctccttgtgcacgtgccgcggggacaaggggcatgccgaccctgcctggnnnnnnnnnnggaggatgatcgcgatgttgggcgggagatgaggatggacagggcctaaaaccaccgacctcagcccctgcgtcgtcctcagccgccggccggctcgggtccgggccggggtagctgcgccagcagggcctgcacggtcttcggcagtgcctgcgccgcgtcgacccaccgcggctgggcccccgcctcccagggcttggcggggacgaaggtgcggcccgcctccgcaaagcaggctgcctggagcatgtcctccagctcaaactcgtcctcatcctcgatgaagaagcggtagccccgccggcccagcattccagggtgctccttggaccggttgtcctgccgttggcctttgggtgaggagggggtgggagggccatggtctgggggtaagaaacggaggtacctcgatggaaggaagagcgtcagacgagcttgcatcagccatgggaggcccatggccgcaaggtcgtgcacctctcttggcagcctcgtgagtgccacccgcacaaccnnnnnnnnnntaagaaacggaggtacctcgatggaagggagagcttcagaccagcttgcatcggccatgggcctcccatggccgcaaggtcgtgcacctctcccggcagcctcgtgagtgccacccgcacaacctgctgatccatgccctgacctttcttccacgtgatctcctcctccgtcagctcgggccgggccaaggtgaccatgaggatgcgcaccgcctccccgcccagctcctcctcgtccagggaccacaggcactcatccacgtccacagcagcgtaggccctgcgccggcctgcctcctccctgtcgtggacagcaggtgggtggaggaggtccaagggccttggctgcacactcagcgggaagccccatggggctgaacgctccaggnnnnnnnnnncccctcttcgtggggaaagctaccgacgggagtggcgggcaatcgcacctcaagaccccagaatggcggcgctgccctccaccatcgacgccccnnnnnnnnnnggcaaccatgcacctgatccgcaccacgccgctacacccttccccccccatcgcaggctcactcgttcctccagaacgtgcgcgagacgtgcagcgtgttgcggaccatcacatcgacgccggtctccgagaacacgaccccgacgtcggcaggctcgatccagaagggcagggtcacctccatcaccacatcatccgggccatctggcgtcagtttggggcggggagggtgtggaaccctcttcgtgggcaaagctaccgacgggagtggcgggcattcgcacctcaagacccccagaaaggcggcgctgccctccaccatcgacgccccatgcccccgtgtcgagagcggggcgcacctgtgaggcggtaggggggctccaggcaccgcaggccgtcagagtcccccctgaacagccgcgtccagaattggccgtattcagccttcgtgacgctgactgtgcagaaccggttgtccacggtcctgcagttttgcgcgcggggggctgagaaagcgtgcgttggcgccaagcatactctgcatcaaacagcgctgnnnnnnnnnnagagcacacccaagttttaggaaggacccgctcacatgcgtcatgctctgaatcggaccccccccccacccccgcagatctgggcaatacctggagacctccacgggggcacctgcnnnnnnnnnngcgcgcgggggtttgagaaagcgtgcgttggtgccaagcatactctgcatcaaacagcgctgcctcccaagggagtgcatgggctaggccgaatggaaagccatcgccgtttctgagcgcacccaagtttcaggaagggcccgctcacatgtgtcatgctctgaatcggattccccccccgcagatctgggcgatacctggagacctccacgggggcacctgccagcacggggaaggcccagtcgcggtctatgagggcgggcgactcctcactctggatcagtaggccggcggcactcgcctccaccaccagctcccgatccgcataccctgttgatgaagaacggaaagaccatgtgagaggggatgcaggtctgccccagccagagccctgccgcagcgtgccaggtcccgggacatccgctcaaggacgaaggcatgcgcgggctcccgaccctctcccccttcgctgcagcctccccccgggcccatccccacctgtgggcacgcgcgccgcgatgagaacggtccgctcggtctgggcccacatgtagaagcgggtgaggccctgcacaggagtcccgcgggggtcgggccccgccagcgccgcctgcgcggcggccttgaaggcccgcacgtccctcagctcccgctccgagcggtggttggggccctccagcgctgcttggctcgcatcctccagccgcttcttctccagctccctccgagccaggcgctcccgcatgtggtccgagttgatgagtggccagtgcagcgggaagttgtcctggacgggggatggattttgaaactggaggttgatgggcatcacagggtgttgggtatgacctcgcgctgaatataacaggggtgaccagccgtcctcgacaacacactcgaggatgggttgaaagtaaggctgtgctccacccatggtgtagagtgcatcccccaccctggcatgtcgtccagctaatcagtcctgtgggctccacttgacgtcatgtgtcgccctcgggcctcgctgggtccaccagtgcacccacctggacccattcctgctcccaccccaccttccagtgctgcttgagnnnnnnnnnnccgctgggtccaccagtgcacccacctgaccccatccctactcccaccccaccttccagtgctgcttgagggtgcagaactcgcagatgggcatgccacacgtccagcactgcttggtggcgggccggccgcacacctcgcaggtgacaaccagctgggtggccggctcgcagtgcagccccagcgcatcaaactcatccagtagaatgtcctcgccgccgcgcccctgagtggtggaaagggtggggtgtgaggtggcatgcaaaaggtctctctggaccctgagccgggcagctcacgccgactacctcacagcacccagcgcaccgcttgctgtgccacgctgcgcacgctgcggtactgcagctgggccgcccaggtgtcgtacaccgcccgccgcttggggtcgatcaggacctcaaaggcgtgctgcagggctgagaaggcctcgggccgcccacccttgtctgggtgcagcgtgcgcgccagtcgccggtaggcctggggagacaagtgcgggtcgggttgaggattggggtggggtctggcctggaggctggacgaggtggtggggacccctccagtggtggtaaacaaaaacaccttgaccactccagccgcatgcgtgatgggtcgagctgcttttgtaccttttttacgtcttcctggctgcaccgcttgtccagacccagcgccgtgtagcaagccgtgccatccacatcgtcaagctgcgccagggaggggtccgggggggtctgggacaatacgaatctccatccgcaggctacaagaggtcaggagcagtcctcgcaattctcactcactcacctggccccaaggatcgctgggagtgggacctggcatcgccttcccctcgcgtcttgactctcactgcaagtcaaacatggtggtgggtacaaaccagcaaagagggccaggcgtctgattcaatgctcggaagaaatcagtatacattgctagtatatttgcgacagtctgatcggcttgctcaagtatatacgagctctactgtttgcgattcactctccctgcgactnnnnnnnnnncaagctcgaaagaaatcggtatacattgctagtttatttgcgacagtctgatcggcttgcttgagtacatacgagctgtactgtttgcgattcactctccctgcgacttccgacaacaccctttcttcacttgttgacaaaacccctcccagcatgttttgccatggaggagcctctgatggagtattgattgaaaggtcttaaaagcacgaaatagtatagtgatgctgtggcacgccatttgttaccacgcaattcactcttcctgcatctaccaccctgatccccagtggggactccaccatcagcaggacaaaagggtaaatgcaattcttttcgtgcctctgagcacgagcgacattcaagattggtgcagatcgagcagactgtatgccaaagcaaaccaaagtgctatggacaacgctttcagggttgctgtggaaacgcctgtgccactttgacagccacccacttataacgcagagctgcaaagcagcgnnnnnnnnnncatcagaggatccataagttcctactccacgcggcccctgccgacaaactcgtgggcggcaatctctcaccagataacacttctgtaacaccgcccctctcgtatgtacgcgtaatgtagagcatgaagaagtcgtgagnnnnnnnnnncagggtgaatgcaatccttttcgtgcctctgagcacgagcgacattaaagattggtgcagatcgagctgactgtatgccaaagcaaaccaaagggctatgaacaacgctttcaagcttgctgtggaaatgcctgtgccactttgacatccatccacttataacgcagagctgcaaagcagcggatctgctgatcagaggatcaacaataagttcctactccacgcgcgggttggggcctgctgaggattgcccagactgtgatgtgcatgctgcgacgctgtcggaagatcgaggcccctgccgacaaattcgtgggcggcaatctctcaccagacaacacttcggtaacaccgcccctctcgtatgtatgcgtaatgtagagcatgaagaagtcgtgaggattgtaaggcgccatgcccctgctttcgctgctgggcgtggggttggtcatcgtaaccctcaccgttgggctggtgagccgtgtcaggggatcacctactctatgtgtttccattgagtttgaggttatcaactgttttgaatctactacaccgcaggagttcatcctgctggcagcgtccctgctcctactggtcctgggtgtgctggttgtgctgttcaagatctggaccctctacaagttccctcgtccgacaaaggtggggggaatgcctgccactaatcggttgtatgattcagtccatcgaatggatgcgtattgatttcagctcgtcccaaaggctgaccagactctatgttcaatcgctaaccctcccccatctcgtcaggatcttgtgggcttcttccatcnnnnnnnnnntaatgcctgccactaatagtttgtatgattcagtcaataggatggatgcgtcctagttttagctcgtcccaaaggctgaccagacgctatgttcaatcgctagccctcccccacctcgtcaggatcttgtgggcttcttccatccctttgcagacgctggagggggaggagagcgtgtgctatggtgggctgggttatgtgcttctcagattgcgccatcctcatgttgtggtttggcagtgagtgatgatcatcaagtctgaggggacttttctaagcctcccaatgatcacatcccttgcagggccggaatccgctcgctgcaggtcacccgccctgatctacaagtacgtttttccaatctgatcctgatgtttggatatggcaaggcctggcgcattgactgcttggtcacatgggcctcgagctcaacaaccaatttcagttggcagggcatatgctcactgaggaacttaatacccctcccgcctctttgtgctgttctgccttgtaccctttccggagattgttgcagctgctcggatcttgctttcccttctggggtcggctcccactcccaatgcacaacccccttggcnnnnnnnnnnatctgcttggtcatatgggccgcgagctcaacagccaaattcaactggcagggcacatgctcactgaggaacttaccccccctccccgcctctttgtgccgttctgccttgtaccctttccagagattgttgcagctatttggatcttgctttcccttctggcgtcgactcccactcccaatgcacaacccccttggcagattgcactgtatgtgggaggcagcctcttgccctcggagctcgtctcgcgcgttgaatcccagttccaaatccgtgtggagccaaccttcacagtgagtgtcagggatgtgaagaggtcgactttcatagtaatgcagcccgtacggtgggaagaagacacattccatgcctgccgcaaagaaggtgtgcccccatcatactcggctgcatcccatgtgtgtatggcgtatgtttccttctcaccgtatgcaacgcacgcgagagcgtcccccttcacagcatgcatccacagtcatcagctctttcaatcacctcgaccaccccgcggccaaggtccaccttctccgcctttccctctcactcaaccccgtgcggactgcaggtcatcaggctgnnnnnnnnnngcttggctgcgtcctatgtgtgtatgcgtatgcttccttctcaccgtatccaacgcactcgagagcgtctcctctggcagcatgcatccacagtcgtcagctctttcaatcacctcgaccaccccacggccaagcttcaccttctccgcctttccctcctcactccaccccgtgcggactgcaggtcatcaggctggagtcgcgtgaggagctgctgcctgcccgctacccccgattcaccatgctgcggcaggccctggcctcggtgcgggtggcctttgcgggcctgcgccgccgcgtccccgccgtctggctggacaccaccggctgggccttcccctacccgctggcttcactgctcggctgccgcgtcgcggcctacgtccactaccccaccgtctccagcgacatgctggcgcgggtggcggggcgggaggccgccttcaacaacgacgtcggcgccagcacgcccgcaacgctggccaaggtggcctactacggcgcgctggcggcggcctacagcctctgcggcctctgcgcccacaccgtcatggtcaactccagctggaccaagcgccacatcagcctgctttggctaggccaccgggaccccttcctcgtctacccgccctgcaacaccgaggcgctccaggttgattgaagaggacgggaggcgtgccgaggcggcgggcgatgtacgggcggggtgcggtgcagggcagtcgatatctgtgtgattccaaggtccagccataccatccggtccttgctgggccccatctcgcttttggttgccagtttcctccccnnnnnnnnnnaggggcaatgcaggacaggcgatacctgtgtgattccaagtcccagccataccctccggtccttgctgggcccgatctcgcttttggttgccagtttcctccccctcccccagtgcatcccacccattcacctcccctcctcacaccacaccccatcctcccatcaggagctgccactgagccggcgactcaagcggctctacatcgtctccgtgtcccagttccgaccagagaagcagcacgctctgcagctgcgcgcctttgcccgcgcgcggcgtgatgccgagcgcctggagtccgacgccggcgatgccgtgctggcggcacggctggagttggtcggcggctgccggaatgcggaggacgccgcccggatcgaggagctcaaaggttggtgctgggtttggatggacgagacgggcagggggaaggagtggttgaatgatggcaggggttctgnnnnnnnnnnaggatcgaggagctcaaaggtaggtgctgggtttggatggacgagacgggcaaggggggaggagtggttgaatgatggcaggggttctgaaggtgggtggagggcgctgaaatcgagtacgcgcgggatgcttgctgcaggaggaagcctgtacctggcagggggcgacagagggctcaaagatgctcgcctgtatcagagtcagccgttcgattgnnnnnnnnnntgggaggcctgtacctggcagggggcgacagggggctcaaagatgatcgcctgtatcagagtcagccgttcgattgatgcagtgtgcgtcatcctgaccacagacatgccacgtcacacgcacatgggcccccgcacctccacccccaccctccacccccccgcc

SEQ ID NO: 37545 - DNA, 155 bp, Chlorella protothecoides
taggggtggtgacggcgaggagaaggtcagaagttgttgctagccattgacggctgggatgttgggtgagaacatcatccagcattgagtgtctttactgctttgcactgcatggcactcatttcctccagactctcaccaaccaacatctttat

SEQ ID NO: 37546 - DNA, 151 bp, Chlorella protothecoides
ggtcatccagaaggtgagagagacaggggggtgcagcggggggccaggggtgccaaccctggtttccgaggtgctcccgcctggacctactgtcagacgcccgatgccggctgtgcaagcccattcaacactctcacgcgcccgcaccttg

SEQ ID NO: 37547 - DNA, 130 bp, Chlorella protothecoides
cccttccaggcacgcaggcagcctgccctgtatgagacacgatgccgctcagttactggatgcacaacagggccgttgtccccatacactgtcccaatttacggagccctgcctggcggtgcgtgcattc

SEQ ID NO: 37548 - DNA, 130 bp, Chlorella protothecoides
ctcccactcaaactgcctaacaaacaggcccagctccccaccacatccccgcaaccccccattcctcctttcccaccgcatcaccgcccaaaggctcacgcagtcaggatggaggccagccgagaccttg

SEQ ID NO: 37549 - DNA, 70 bp, Chlorella protothecoides
ctctttcacgtccgagacatcctcctcatgcgtcgatggacccaccacacgcgcgtgccgggttccgctg

SEQ ID NO: 37550 - DNA, 77 bp, Chlorella protothecoides
gctctcgtcacccatgcccggggtgccatacgtagcttagactgtcatggaaggaaaggaagcggtgagcacgcaag

SEQ ID NO: 37551 - DNA, 93 bp, Chlorella protothecoides
gttttgaggggttgccaggaggcagatctgggatgggtataacacaccgagagactgccgtgccagagagcaacccttgccaccgacctgctc

SEQ ID NO: 37552 - DNA, 77 bp, Chlorella protothecoides
attcatgtcttgcttcttccctagagatagccggtcctctgaagcccttcctcctgccctcccccacctccacaggc

SEQ ID NO: 37553 - DNA, 614 bp, Chlorella protothecoides
  modified_base (213)..(481): a, c, t, g, unknown or other
agccgagagtaggagccgtggtccgatgcgaatgccggaggaagggggcccagaggactgtgtgcatccccagaggctgacgcgggaggcccgggcgtactccctgcggctgcatccttgtcgagaggccacgccactcctcacacggaccccgcaacgccttcccaccccgcccctccccggtaccccatctgcacaggcgtgaaccggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggctgggacccgtgaagggccagaggaatgcgtggctgcctgctgcgcgtcacgagatgcagggacagacctgctgccgcatgcggggtggggctctgggtctcagagtccaggtgcagcggactgcagg

SEQ ID NO: 37554 - DNA, 61 bp, Chlorella protothecoides
cctagtttctgaggtatgcatatatttctctcgaacatcaatcgtgcctccatccatccgc

SEQ ID NO: 37555 - DNA, 118 bp, Chlorella protothecoides
acccaagttgggctcctccagggggcgaccacccctggcccccaccgcagtgaaccctcgcatgtcacggcacaccaggtacgtgccacgcaagcacgtccgccagggccaggcgcga

SEQ ID NO: 37556 - DNA, 138 bp, Chlorella protothecoides
cagacaggttgccgcccaggtcccgccacaccgcgtcgtcggccgtcggcctgcgcacgcacgggatggggcgttcggtcacccccggcaccacgccctggtgcctctgtccaccggcggccttcttcccctttcctg

SEQ ID NO: 37557 - DNA, 1124 bp, Chlorella protothecoides
  modified_base (320)..(392): a, c, t, g, unknown or other
  modified_base (694)..(703): a, c, t, g, unknown or other
  modified_base (961)..(1014): a, c, t, g, unknown or other
gcgcgaggccgagcgcctgcaggccgcgcgcgacgacctggcctcccgcctctccgccgccgtggacttccggtacacgcctccggacccgcgcttcgacgcggcgcgcgtgcggggcgtggtggccggtctcgtgcgcgtgtccgacccgggcgacgccaccgcgctggaggtggcggccggcgggaagctgtaccaggtggtggtggacggcgaggccacggccaaggcgctgctggcgcgcgggcagctgcgccagcgcgtgaccatcattccgctggaccgggtggcggggcgcgcgctgccggaagccgtggtgnnnnnnnnnnnnnnnnnnnnnnnnnnnnnnnnnnnnnnnnnnnnnnnnnnnnnnnnnnnnnnnnnnnnnnnnngcgccgcggccgcgcccgcgctggagctggtgggctacgacgccgacctgtcggccgccatgcgctacgtcttcggcaacgcctttgtctgcaaggtttgcagggtgggggggggagatggagagtgagggggtgggaagagtgtgaagggggcggggagagtgagggggcggggagagtgagggggcggggggcggggatcgagtcagtggaaagtgggccccgcagagccggtgcggccagggtagatgggcttggtgccggcgagacgggcatgccggcccacactttgatcacccccnnnnnnnnnngggaaggccgggatcaagtcagtggaaagtgggccccacagagccggtgcggccagggtagatgggattggtgccggcgagacgggcaggccggcccacactttgatcacccaccccctccctccccaccaacccatgaaacccacaaggatgtgggcgcggccaagaagcttgcgtttgggcgcgacacccgcgcacgcagcgtcacgctcgagggcgacgagttcaacccggcgggcacgctgacgggcggcagcnnnnnnnnnnnnnnnnnnnnnnnnnnnnnnnnnnnnnnnnnnnnnnnnnnnnnntgctgtcgcgcctgcacgagctccgcgccgcggaggccgagctggcggggaagcgcgccgagctggaggcggcgcgcgccgagctggccgcgcgcggcgcggcgcgcgag

SEQ ID NO: 37558 - DNA, 81 bp, Chlorella protothecoides
gcctgacccgataccagcttgcgctggaatctgtcgtgcaggactgcctggtctggaccattgcgcttcttggagggcgtc

SEQ ID NO: 37559 - DNA, 12538 bp, Chlorella protothecoides
  modified_base (443)..(452): a, c, t, g, unknown or other
  modified_base (622)..(631): a, c, t, g, unknown or other
  modified_base (3657)..(3666): a, c, t, g, unknown or other
ggctgccgccaccgcgcgcgcggcggccgcgggcggcggcctcagcgcgctcgcgcggtcggggccggagggcgcgggcctcatggagctgtaccgcctgagcgcggaggtgaaggggccggcggtgcaggagtacgtcggcacactgctggacggcggcaccaagttcctggcctttgcgcaccacacctgcatgctggatgccatcgagcatgaatgcaaccgccgcaaggggctcaggtccgtgtgtgtgtgtgtgtgtgtgtgtgtgtggttttggagggcggggtgaggcgggggtccagggggtccctttggggggatgggggaaggggagacgatgctcttctctgaaccagagagaatgcatgagggcggttgatggatgcaggggatcgcgtacacgaagaacgagcaaggagaaacgtccaagggcatgttgnnnnnnnnnngtgaacaagagagaatgcatgagggcgggttgatgaatgcaggggatcgcgtacacgaagaatgagcaaggagaaacgtccaagggcatgttggcatgcttggttcgcctttctagcgctcaggagggtttccgtgaacaggcacccaaccgcttgggatccaccgtgcnnnnnnnnnntgcctttctagcgctcaggagggtttccgcaaaaaggcacccaaccgcttgggatccaccgtgccctttccgcaccacgctgagatgatttgtgaggcaaggcacggtatcagtcatgcgcctgccctctacagatatcatcaaagcacatccccagccgcccgcgctgcccgcaggttcatccggatcgacgggtccactcagacctcggaccggcagcgcctggtaaattctttccaggagaacgctgacgtgcaggtcgccatcctttccatcaaggccgccggcgtgggcctgacgctcacggtgaggggtggcgaggggctgggaggcaacgtcatcatggccaaggattggttggggaggagccagagacgtccccggacaccaggagcgccggcgcctcccttcggtgtccggtgggcgcttgtgccggagccatgagcgcatgctcatatcctaccttgctcaaccccttgcaggctgcctctaccgtggtgtttgccgagatgacatggacgcccggggacctcatccaggcggaaggtgggagggccccgagtcagggtggcaccaatgctcgcttgagcgccaccgacataagagcccttttgaattccgccacccctgtccactgcacgcctcccacccgcccttgtcccccagaccgcgctcatcgcatcggccaggcctcctcggtgaacattcacttcctgcatgccaagggctccgtggatgacatcatctggtccaccattcaggtccgtgctggatgcttttgtgagggacagctccggaacgtgcacagcatcgtagccgtgcacaacccctcgacgccgtgattcggatgcagcgggcggcaccgcaacctcctgacgccgccattccaacccatcgtatttcacagagcaagctggagagcgtgggggaggccctggatggccagggccaggcgctggaggttgctggcggggcgcgcaccctccccgagcgaggtgagacggtcgggtggggctgggtatgggtgggacgcctgggattggccggggattgtggggccgcggcagggcctgggaaagcgtgccgggacccgtctgtcaccagcacgcacagcccccatgaacgcagcactgcatccatcctcaacaggtcagatgacggtcacaagtttcatggagggcggggtcaggaacgcggcccaagctggggcgcagcaacccgggcatcaagtgcctgcatggcaggctccggcgccgctgccgccccaccaggcgctcaacaagaagaacgctgcgcccatcgccgcggcaggtcacctgaagaggtcctttggtgaggttgacctgacttgaagagctgtttaatcagttgtgttcgacagaccaaccaccccatgaccaaccaccccatgctggtcgcggagcgcgcccagcatgcggtcgtcgtcgtcgccatctcatgatattccagaaacaagtcaggaggaacagtgacacagctcagcttatactcatctccacatggaggtggtgcatgcccagtccggctcggcgacgaggtcgcgaccgggggtgtttgtactgagaaggggtccacccggtcggtcccaccctccgaatcccctcagccttgggagaggcggcgctgcgacccaggttggaaggcgtcatgtaagtttcaggggctcccggaatggatggcgatgaatgcgaaaccgtcgaaacgacgtgccaagagaaccaactttgccggacgccatgacaaggtccccgcctctcgcaggtggcacgagcgaccggatcatcctttgatgttgtagacgagatgctggcgcagcaggcggcgagcatgcggcagtttgacagggagatggcccgtgtcgagaggggggggctggatcagatgctgagcatggagcggcagactgcccccagggtgcacatgcacgacgacatcaggacgggacagcattggagggtgtacgagagagagggaggctggcgtggaacgggtgagcgcgcggtgtcctgatgttgggtcgggctctggtgtgagcggttggtatcgtctgcaggccccctgatggcgatgctgcaccgctcccaggcggaacgcgtcctccttcatcaccccccactgctcctacatgcacaccacaggctccctgagcttctattcggagaggtacgcggtctcacagcccgttcgccaacccctgccgcccagggtgcagagcacgcagggcagccccatcgcgtccggcttcctggtggctgccgcctttgcagcgggcctctgggcggtgctgagtgcgctcctggtgcgcaaccatggccgcacggcgtacgcgcccgagagccgcctcacgctcctcgccctgtggcccctcctgctcctcacctcaccgtccttccgtggccagtttgcgagggcggtgggatggacagatgtgggcagccccactgcctccacacatgacagccctctccgcgaggatgaggcctgagctcggatgcgccagcaatattcttaaattgccccctgataggatgctgggatggcgctgttggctaggagtagccagatttccctgtgtccttctcaggagagggtggtgccgtctgtgcaagccacccggtgcataggcatgccctgtctttccttgtgttgtggatgcgcccaaactttgacctggataccctcgcatgcgagctcttgcctcagtacagagcccttgatggtgaggacgtgccacatgagacgaagtcagaccggatggtgctgcgcaaggggggactccgttgccctacgcagttccggcaacgtgggcaccatatgcatacaacactgaagagatgggctgactgaacagtagagagcaagggataaaaattgagctctggttggaagagggtgggtgcctcaagggagagggggggggcaatgcaagcgatggtggtgcaggctagggaagtgcattggggtatcggcccagtgacaagacaacaaaaggtgactgggtcgtnnnnnnnnnnggtgctggtgcaggctggggaagtgccgcctgcattggggtatcggtccattgacaagacaacaaaaggtgactgggtcgttttgcaggatggttcaatgcacctgctggaccagcagaccggaggggaagagcatcccggtcatgcttctgcagccacggaggtacatggagagggcaaccaaggcgggatcaggaagtcaatacgctatggcacatccaaccagagcaagtgtgattgggttgggacctggaacattgcaggtgcaaacacggccatcgctctgtggtgggcatggggctgcaccctgtgcggtccttatcgcaccacccctgcctccctcaggagggccgacaggtcccagttcaacgccttgcacacctccagctcacgccagctcagttccgccgggcacacggagctggcggagcagatgagggagcggcagggcgctgcggtcctcaccgcgatgagtttcatggccagccagaggcagcagacgagggagcagtggtcccagaagcccaggttcttgaccagcaccagggcggcctccagcgtgttgttgtcgcaccggacctgaaggcggggcaaatggggggttggaggggggctgtgacgggcagtgcaggtgttagaagtcggaccatccattggtcatgatcagaagcgtgcctggggcccagtcaggcgagagggcagcgatgccggttgtgaatgatcagaatccgagaaggggcccaggaagaaacagagcggaccggctacggggctcagcactcccaccccgcggaagaatggacgtcatggtgcccacaattagttctcaagctcacctggggttgaagtgagatcagacgactgcggatggtcgctagactcgcacggagcctgtagtccacggtgtcgtagtaccgtacggggaagtgcagcccagggaggaggtgaagctcgtagtcttgctgctgcaaggactccgaggtgtaggaaagctgcaaattgggccggtggtgagcggtgctggaggtttctggagcccgcctctcgcgggtgggtcagcccctccctgatgaactggcggagcacccacctcggccaggatcctcgagtccaactccgtgatggtggattccgtcgatagcgatcgctcaatatcggcgcattcttcatcatccgagggttgcgcaggtcgctttgacatggcacggcccgctttagggaggtagacccgacacacgagcgtaactcctccgccctgtgtgacaccctcttccactacactaagggatgcgatgtcgtacgctcgaatgaacggtacgtctctccaactgtctcttcgcacatgggtgagtcctgacatttcttcacggacgattcattggccattcacctgtcattccggaggggggcgctcacggtctcctcaagtcgcgctcgcatgttgaccgctgtgccaagctacgcatgggagctccatgacccgaagacagggatacaattcatgtaaagtcacccaatgtaagtgcaaggatactaatttgctttgtgagaaggttcattgtcctgtcacgccgtcatggccgtcgcaccatgacggccactccgcccagccggtgcctctcgcactcccgatgtacgcacccacgctttgccagaagctgatgtcgcgcgactgtttccacgcgaccatgctggtaccatgcaatgtcgatattcctgcgtcggagtgccgccggaaggtttatatcaagacactgcgccccgattggtcacgcaccgcctgccgtgccctcgacagagcgtagatgtggatggcggggtgctcataggcagggtccagcttggagacggggactctgcgcagggtgaacacaccctcgcaccccgccagaaacgcggcgtggactgaggccgaccggaattcgttggtgacgaggatacgggaggagggtaccgtcagggccaggagcgtcgcgaggaagtggggcactgcgccctcggcatagatgcagtcagccgccagtaggaacgggaatgggggccccagtgacgcgtaggcagcagcgtccgcccaatccaggggagccacactggcggtccccacgcgtgcggcggcggcgtcggccccgctcactgcaaatctcattcgggaggggggagagccgtctcacacatggtctttgcggggcatgggggggcagcaatgcgcccttgcatccacaagggcatgagcgggaccgagtgcctgcccaaggcgcccggctgactcgtagcatcgcctcgcccagctgttcccgcactttcccagcagcactattccatgctgggcagctattgtcccatccccactgcacccctccaggacccacgtctcaaggccgatggcgtcaggttgttctgcacgttctggcgcaggagtggcagcaccgactccaagtccgtgaaggtcacatgggcccccatcagagccatcgccgcgcctgcgaggcccatgccggcccccagctccaggcagcgcttgcccttcacacgcacagtggaccactcgcccttgcgcgcgttctgcgtggggtttgggtgcgtcgtggggggggggagtgtggtgatggaggtgaaggggtcacagggaggggtggagtgacacacagcagaaggcagattgtgaacacttctcagcaccaagctgggagcaggatcggggtgcggcaagaaatggacccatgctctgctccacaggcatgcctgctggagtgatcagcattcacaccagggccgcattctctgacagtctaatagtgagactttcacaaaagcgggcaccatattggacccctcgatacagcccccccccccgagtgcaccttttcaaggaattttgctagtacgatggaggcatcccagacggtggtgccaaggttttcggagtttgggtcctgtgcaaaggtcaatctgaccctgagaggagggaggacctccttcagttgctggcggggtggcgagcgtagaagtccggatgatgacagggcgagaacatgaaagtgaaagagtccagacttttggctgcccaagctgtcgcagaggtctcaataacagggaaatgccatcgcgtcactcacccaaacagctcttgctcaacactggtgctgaagtgagtgttccaccgttcctcgagaggcatcggcctcgcccaacccaccccagattttgtagttgcagcgatatccttggcatgtgtaagagatgacaatggagcatgcagccatcagtttcaccgctgtaccggacacgcatgttcagggcgcggaaacagtccgaggtcgttcatgagcttcacatggtctgtcgacacaacagaagaggcataatgtttggcgaacgcctcttggaattcgtcacatacaaaggctgcctgtgcgagatttgcactgtgcatgcgcaaggcggacctgcacatgcagagaaggaggagactcatggcgcgatacactttcctctacaaagtgcaaggtatcggtgtgcatggcggcttgccctggggtttgcagccttgcatgaacgactatttgggcttccgatttcatacagcagcatggatcttgcagggtcaatgggttcccctccaagcgcaagaagtacagctgcttcttgaggatcctggcgtcacagctgtcgaggatcaggaggaagttgagggtgtcagagctgagccgggatctgtgccttgagggctttcctgggcgacactcctggtctcctcctcctccacctgttttgcgcatggaggatggacaagtggcgacggaagagcagcactcacagcaatggatactctcaaccggacctctcgagctggagctcgacaggtccctgctgtcgatcaatcacacagacgcacgagaccgcatgtggcccccccacccaccagttgccgtcgcaagctgcagtcattcagcaatgcattctgtttcagctctcggttgatggccagcaggttttcagcggccaccagcatgcgctcaacatacacatcgggcagggctcctggggtggtgccctgggagtggcaaggagatgtagggtgagggtttgctgaccatcaataccatcaacgcgactcgcagtgtaaggatggacccagtccagcaagcaaccagctgaccaaagttctcctgtctaccccgaatggggcacgtaagggtccccacctacgctcaccttcatgctacctgcatcgttttgagggtgcaaatccacctttgcgctcttaagtacgttcatgaagctttcggtgatcgtcccaaagtcttgcacgatgcgatcctggagtctcgacgacatactccctaggtgccttagcgaggctgtcgcaggtccagcgaacacatgtcatctacaagcaatctgtggcgtacctcaccggggaaggagcgccgcagtattaaggggacggcatgttcccgggctggtggtggtgaagtggccttcagtcacaatatggcccgcattttattcaatcctgtcgtcagtgtgccccagtggtctaaggggttggtctcaagtgaatttcgcgcttccagcttaatgcctgggtattccaatggcttcggccgcgtgggttcgaaccccaccgctgacaactttttcgtatctctctgttttgcatgacatggatgccgcatcatgtagtcaaactacctggctgcatcaggagccataaccttcctccctccacatccgctgttctgctcccttacaggccaaggcacacgtcgtcccagcaagccgactcgagcgcgctctcaaagaggtacataccgggcccgctcctcggcagatgaagcgaagatctccacgtacctcgtgcccatcatctggcggtgcttggtctgggccgccgccgccgcctcggggctctcaaactccacgaagcccatcccattgggccggccgtcggccgccacagcaatagtgaccctggggcagatgggtacgtgtgcaaatctggttgcaggcaatggggaccgcccatgcccacccaggtgcagtattaccaagcgcctaagagggcacagtgcaatcctgctccgcccctccggcacccagcgcacgcatctttcgcccatgcaggtaacctgtccaccccttgcgcgcacttttcggggttgggtgccagcaggccgatggtgggatcggcgaagaaggcggcgatgtcgtcgacggaggcggagaagggcaggccgcgcagcttcacgatggtggtgggcggcggggcggggcgctccgagccgggtgggggggacctgctcctgctcctcccgcggaagccgccgccgccaccgtggtggccgccgtagccgccaccgccgccgccaaacgtgctgcacaccgcgttgtagtagtcgggcttgcgcgcctccagcacctcgatgtagcgcgagcccatgtaggccttgtgcttgcgcatagcgccctccatttccgcggggtgcaccagcacgacaaaggcctcgcccgtggcgcggccgttgttgcgcaccagcaggatgtcaatggtgtccaggccctggtagtggggagggggaggagaggggggcaaggtgggggggtggggctcgcacgtgggaccgagcgaggcacggcgtgcatccgaccgtggctgggccaagtgcggacggatgcgagggcagaccggcactctcgctgatcacactgcaaagaccagcagccaagcctcccagcaatgcatccatgcggcgctgcactcatcttcccaccccaaacaaccctgcgctgaacccacagacccccccacgctgtgtacccaccaggaacattcccacttcagcctcttgcaccccaaacggcaacccccgcagtttgacgcaggcgaaaaagctagatggcatccctcccatgcccctgaaggggggtgggcctggttcataggcaggagggccgtcgtacccatacccgggcccgggcccatagccacctggtggggggtagcccggtcctccatggtgggggggacccggggggtggtaatgtccgggcgggggggcaccgcctggaggaggaccatagccagcagggcccggcgggcctcgcccgccgggaaatggggcgccgctctccagcgtgatggatcctggggtccgagctggggtctccagacagaggacgcagggcgatgtacccgaagtggcttgatgtgacgagtcttggaacaaagtgaccacggagatggtggtagctctcgttgggtgctgccttcgccgatcgcactgggtaacggagggcaacctcaagctcctctcttctttcttcccgatggagcagtcctcgaaatgcacccatgcacatgccctttggagctgcatgtgtggttctggttgacaattcgcatcgaagacagtcctatttggagacagatatcgactcgactctcacaaccatcgacatgcaactctgcgcacccctccctgcacagttgagggcggtgtgcaggctggtggccttcacaccgcgacacatctcgagcttccactccagctcccggtgccaccgaccacgagagggcccggtagccgatgccaaaggtcgcaggggaatggctgagctcatgaggatggagaaggaagaggaggagcaggcaattccaggtgatggatcggggggtgagctaggaggcaaggtcatggactcgggggtggcattcttgcactcgaccctgctcatgcgtttctgcattgggcaccacagctctttctgacttcaagctacgacccaccgtcgccaccccctctcaccgaccagcagacgcacccctgctgtggaatgcgccactccaagtcatcaagtaccccgacccgcgcctcagggctggcaacgccacgatcacgaggtttgacgatacactccgtgcctttgccaaggacatgttcgacgctatgtatgagtgagtcggcgcgggtcgggcatggggttgcagtagaacgcttcagagcgaatcagtcccattgctggattgcgagggggcggctcactgttggcccgcatggaacgggagcgaggttcctccagcgcccaggcgctgtgcggctgcacacagatccctgccgctcattagactagcgagacttcccagtatctcccctacagcgggccccccccttcctccccttcctgcagtgatgaaggcgtgggtttggctgcgcctcaagtgggggtgaacatccgcctcatggtgttcaacgaaatgggcaagagaggtgcgacctcgccggcattaggggttgggagttgggttgttgtagtaggggcacggaggcccctttcactgaggaggtttgcctaccattgagcatccacatgctggattctgggcggctaggggctgttaagttcccaaagagtacattggtttaggttgggctggcaagcccgacttcttccactattcctttcttccccaacccctcgtttttcaatcttaggcgaaggtgaggaggtggtgctggttaaccccgagatcattagctatggcaagacgcaggacctgtttgaagagggctgcctctccttccccgaactctatggcaacgtggaggtgcgcggggccaaacgatacgtgatccctggagcttggggggaggtgacgaggaacagaggactgatgcgcgtctcaaccccacaccagtatgcaccatccacaaaacatctgcacttccctaccacacctcctcgcagcgaccgacaaaggtgaccatccgtgcgcacgacgagtttggcaagcgcttcaagctgacgctgtccggctggccggcgcgcatcttccagcacgagtacgaccatctccaggtgagtggggccagccggcacagaagcatcccgtggagggcaggctgcgcacctgctgacagccgagcgcccagcctgtccacgacccaccccaccacgaaggtccattcactcgttcgccccccgcccccgttcacgcccccttgccaccagggcaccctgctgccggaccgcatgcagccagaggtacgggaaaacattgccgccgggctggaggctctggtgcgggagttccaggccaccaaccctggcacctcgccagcgctctgagcctgtcctggagatgaggtgtcgatggcaggtgctgtgaccatattattgatgcacagccacagccggctgggtcgtgttcagccgggagcgaaaaggcaaagagccgccagtcagcggggggcggtggtgatttggtggtgtgggaatggggaagaagagggggtaaaagagggaagggagtggagagggggcctttcagggttgcgggtgagggggctcaggttgtgcgttcccgggccgtcgcacgggggacggcaggcaggtttggtgggggggtaagggatggagcaacctgagcgtccgcaaaacacggcatgtgggtcaggggtttgcaccatggggctcaggcagggaaaaaagagagaggggtagtatccggaatgagcgagcccttggggctgtcgaaaagcatgggctggagttggggtggcatgtctggtcttgggccggccccgcggcaatgcccacccagattgtgcagacaggaagacattgcagtgggcgggctgtcagtgcggcaggcgagcagacagccaggccgtcagggtcgacactggggctggatctgtcggcatccaggcttctgcacacaggccgcgcacatcgggagcaatgttggccgcgccggcgcaggcgacccggccgtcgacgccgctcaggcggccgagctgttggtcagcccgctgccggccggcgcggcgcccacgctgagcgcgcggcgcgcatccaggcccgcccc

SEQ ID NO: 37560 - DNA, 61 bp, Chlorella protothecoides
cctgagggatgtggcggagctgtgtcggggggtgcagcacccaacccggggtctattcctg

SEQ ID NO: 37561 - DNA, 75 bp, Chlorella protothecoides
cttgcatcaccatgatagctgtgctgcacaggatgggtgtttccatgtagggcatggcgcagcactgggatggca

SEQ ID NO: 37562 - DNA, 118 bp, Chlorella protothecoides
ggtcaccgggctggcagacggcggcggctccagcatgtctggcatgtgcgaagctggggggccaggggtgttggaccccgtgagtgccggggacaggccgaggagcgactcctccggc

SEQ ID NO: 37563 - DNA, 61 bp, Chlorella protothecoides
caaggccagccggagcagggcagaggtgaccgcggagcaggcccagcgcgtgctcaaggac

SEQ ID NO: 37564 - DNA, 74 bp, Chlorella protothecoides
gggtggacggaaggggtccttgcgatgtgaagcggattggaccggagaacctcccctgggactcggggatgtcc

SEQ ID NO: 37565 - DNA, 3648 bp, Chlorella protothecoides
  modified_base (1138)..(1147): a, c, t, g, unknown or other
  modified_base (1437)..(1446): a, c, t, g, unknown or other
  modified_base (1897)..(1906): a, c, t, g, unknown or other
  modified_base (2500)..(2509): a, c, t, g, unknown or other
gcgccgcggccgacgcacagcgctgcggtgcgcgtcgcggagacgcggatccaggcctgcacggcggcggaggggccgccctctgcgccggtgtcgtcgcccgcggcgtcggccggcagctcgacgggggcctcggaggacagcaggcgcgtcacctcctccagccgccggtccctgccgaagcgcagtagcggccttgggggcgggggggtggcggtttgggggttccccatgctcgccgccagcccggcctcggtggtctcgatggagcccttagctcccggcctggcctcgacgcgggcatggagggggaggactgcggggtcgcaggcgcccccgacgcggcccctgccctctcccgggaagtcgtcgagcgcccctgcgtccgcctttgcacccgctgtcgccgcatggttggccgcagcgtccagccgccctggagaggtgtggatgagggaagtttgtgggttaaagggctggacagacacggtcctcatctcctccaggagcacaacaggtccaccactgcctcagagagggtcatttcatgagagggcatggtcagcccctgcacggcgtgggcttgctcaatccaggacacgctccagcacaggaggcgtgctcccgcatcagccccccttggctcaaaacccgtcgatcaatccaccctgacctcctcccacacccagcgcacctatgagggtcagggctgcgggggtccagccctggtgcagggacatgacgcggcagatgcgcgccgcctggaggaggggcagccgcacctccaggcgcagctcctggagccgcgccggggtccagccgcgagcgcccagggtccccatggcccgcgcgcacgcggccgccaggacctcccgcggcccttgcgcgggcgcggtggcccctggcggcccggtcagagacgccgcggaccccagggcgaggtaggcatccaggacatccacgctggcagccacgctgcggctgcgacgccggacgagcacgggagccgggaacgacggagtccccgcccgcgaaccgtcgactccgtccagggccgccgccagcgcggctgccagcgaacccggcaccggtggggggaggctgctttgttcggccagggcgcgcgcggccgcgtgcnnnnnnnnnnccccggcatcggtggggggaggccgctctgttcggccagggcgcgcgcggccgcgtgcaggcggggcgcggcacgtgcgcgcagcgtgcacagcgcgcagtcctccgccacggcgtgcagggcgtccaccagggcgccggcgagggccgtggtctgcgcgctgggaggggtgtcctgtgctgggtggatcgtcccgctgtccctaggctgaagcggagctatcggcaggctggcttgcgctgggccccgcccatcggcatccaggcggtccagccagggggagcgccggnnnnnnnnnncaggctgaagcggagctatcggcaggctggcctgcgctgggccccgcccgtcggcttccaggcggtccagccagggggagcgccggggccgggaccaagccagggtgccggtgcgttggggcgtctgaagccccgtcccttggtcccgccgcgcggcgccctcggcgggacgcggtgccggccaggcgagggcggcgcggcacagcgccgccagctcctcgtccgcggtcctgccggggactcttggacctgtggagtgtggggccggtgggtttgtgggcggcggggtgggcttgtcgggaggagtgggaggagcatgggcggcggcaaaaaccagctggttcgcgttgcgtgggggaaggaatcgctgcagttcccagaggaatgcgagtcaacactcgcatggccctccaccctctacacccaagcgcgacccgaaagggtgggcatnnnnnnnnnnggctggttcgcgctgcgtgggggaaggtatcgctgcagttcccggaggaatgcgagtcaaaactcgcatggccctccaccctccccacccaagcgcgacccgaaagggtgggcattgacatgcatgggcacctctcctccccgtgcaggcccaattcccccccggcccacacagaatgctgctccaccgctcacccagggcctgcagccaggcggtctgcagctccagcccggcgccgtggcctgcggcttcagccaccgccgccagcgcagcggccaccgccgggcagctggggcgaaggtggaagctgacgcgcagtcgtgtgccgccgtccgtcgcgatcgtgacctcgcatcccgccgggtcagcgatggcagtcacgctgcgccgaccagattgccgcccgggcaggcacagccgcgccaggtcgtgccggggcccggccagcgcacgcagcgcgcccgtgcctggttccagcaccagcacgcagcgccgtgcgggaggaacggatgaaggatcgccgccgcgcagcgcgtgcggggcgtcctccaggggtagcgccgtgagggcggggcgctgggtggctgtcgcgcnnnnnnnnnnacacgcggcgagtcctccaggggtagcgccatgagggcggggcgctgggtggctgtcgcgccgccgggcccccgcagccccgccagcatggtgagcgtggcgcggggggcggagtgcaggcacaaaaggggggcgacgccgtcggtgtcgtgcgccaggaagcaggcagagggggaggtgggggtggaaggggtgtcctcccacaccaggcggcactggactggactggggtggtccgcgccgccgcccgccgcgtccccggcctgccacgccggcgggcggtccctctttccagggttaaatgccaggggagacaagtggccgttggccaatcgcatgggagccctgggggtgtttgtggggaacggtgatgggtggatgagagtatgctggagccccggtcaggggtttgccgagatgcacccccggatccaacgggcagtgcgcggaccatcgagaaacccggaaacaccgcctggtggttggtccagaatcgaatgtgaaagacagatcgaggcgagcgggagtactcttttttggacaaacttcgatggaagtaacgagcgatctggacgtccgcttcagcaaggccatctggctggtccggaaggggcctcccgtgcccggcaccaccaacgacaccaagttggcgtactacgcccacttcaagcaggccacggagggggatgtgaaagggaaccaaccttgggccgtacaaatggaggccagagccaagtatgacgcctgggccatgttgcagggcatgaccaaggacgaggccaaagccaagtacattgaaatgctggagaaaggtgggctcggtggtgcaaggacggcccaatcatcgaggatcggcggttctcccacgtatcccattgcagcgcattggcgctggtctgggcgggacctgcgcctcccagttgctccaattccctccttactatgttcacatcacccctgccccccctcccacatccaggagatgccgagtgggagagccaccccgccttcaaggactttccgcatgcttgatgaagcccaacacaatttgcaaaatcctcccggctgacccaatgtgcccacctgtgggtcgagggcgtgccggcagcggtgttcggcatggccgaggtcagagcggc

SEQ ID NO: 37566 - DNA, 62 bp, Chlorella protothecoides
gcagccccacatgccctcctctcaccacacatgacaccgcgcagtggacgtgccccgcgcat

SEQ ID NO: 37567 - DNA, 137 bp, Chlorella protothecoides
gacacacatgctcgcccatgcccaccgcgccgccctcaccctccgccctttcaccaaatatccgccagccgccccacctgagccactctggtctgacgaggccgggggatgaagcccgacgtccagcccacgttggg

SEQ ID NO: 37568 - DNA, 61 bp, Chlorella protothecoides
aacaatggtggcagcttcaatcatggtaggtcgcagtggagtgccatcttcatttacccat

SEQ ID NO: 37569 - DNA, 192 bp, Chlorella protothecoides
ggggaggaggcgccggccgacgcccaggcgcccgccgcttcgccgagcgccgcgagtgcgggtgagctggcgggcatcgccttgttgtccatggatgcaggcacgcgtgtcgcactgccgtcggcatgcgacgagacgccggggggcagcctgcggccaagcgccgcgggtccgtctccagccctttccctc

SEQ ID NO: 37570 - DNA, 69 bp, Chlorella protothecoides
tttcaggccatgcacgatgcggaaggtggggaaaagggctgttgtcaggtgctgcggccagggtcggtg

SEQ ID NO: 37571 - DNA, 11320 bp, Chlorella protothecoides
  modified_base (114)..(239): a, c, t, g, unknown or other
  modified_base (354)..(363): a, c, t, g, unknown or other
  modified_base (1438)..(1447): a, c, t, g, unknown or other
  modified_base (2257)..(2266): a, c, t, g, unknown or other
  modified_base (2976)..(2994): a, c, t, g, unknown or other
  modified_base (3275)..(3284): a, c, t, g, unknown or other
  modified_base (3359)..(3398): a, c, t, g, unknown or other
  modified_base (3733)..(3742): a, c, t, g, unknown or other
  modified_base (6964)..(6973): a, c, t, g, unknown or other
  modified_base (7900)..(7909): a, c, t, g, unknown or other
  modified_base (8490)..(8499): a, c, t, g, unknown or other
  modified_base (10962)..(11023): a, c, t, g, unknown or other
ctgcgcgccgccgcggccgccgcggccgtcgtgccgggcggggtcaggcctagcagcaccgcccaggccgcgggccgggcggcgggcgagacgccgctggagaagacgcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcatggcaacgtacttgggcgccgtgtacatgaggacacgcccagggaaggattggcatcccatgcccccaacacgccttcacggcaaccacccccttcccgatcaccgacnnnnnnnnnngcaatgtacttgggcgccgtgtacatgaggacacgtccagggaaggagtggcatcccatgcccccaacacgcctttacggcaaccacccccttcccgatcaccgaccctggccgcagcacctgacaacaaccttctacccaccttccgcatcgtgcatggcctgaaactcctccagggacaggggcggccccgggacctggccccacacgctgccgcaccccggcaccgccttgtccagcagctcaaaggcgtccgccgcgccgtccacagccccgggcacggccgtggggcagcccggggtcgtgggtgtggccaggaggacgccggagccgtccgactcgagtgcggccccagggtcgaggggtggaagggcggcgcattctatgggcccaggcccctcgtccacggcgaggccgccaaagagggacgaagctgcgagggcgcacggggtttgaaaaagtttgagcggcaccagtcccgcgcagctgtcctccagcctgaccccaaagccggtcgcaaggcagcttgtgaggggccgacgatgcagcccttcggcccaggcatcgttgccgtctcctgccatgtaaaacgcacctcaccttctcacccgctcacgccccacgccatcatgtacccactcttcccaacatcccccttccccccagccccacacatgaaacagcgcacccgtgtccctggcgctgagcgcgaggccctggactctgtccagcagctcggtcaggtgggccaggacgcccgcctccggctcggcctcggccagtgcgccccaggcctccgacgcagcccggggcatgtgaccgcccagcgcggcgccggcggccggccccggccctggtgtgggggagtccagcatgcccagctcggagagcgagcgctggagcgggtccgcctggtcgttcaccaggtaggtgttggcgtccgaggctgagcgcgccaggggcacatgctcacgcagcgctgacatcagcgacttgatcccgccctgtcattcgaaggggtgggagagctcgggcatgagacgagaagccaaggctcgacgggcgggagggtgtnnnnnnnnnnaaggctgagcgcgccagaggcacgtgctcacgcaacgccgacatcagcgacttgatcccgccctgtcattcgtcggggtgggagagctcgggcatgggatgggaagccaaggctcgacgggcgggagggggtggccctgtggccccagtgaacacaccaccacccttcctcctcacatgttggaagtagagggggggcagggacacgccgttgaacagggtgagcacgatcctgtgggcgccaagggggggggcgtggcggtgcagcgccttgacctcggacagcgcgacggggtgcaccgcgtacatggtccggtctgcgaaggaaggaagggaagggttggagggatggggctggcatgctcctcgttggggggcgcacggcagtgtggcaggcatgatggccagacgggtgaggggaggggcagagtgaagccctccagcctccgctggaacaggcgctgcaggcccctcctttcacaccatgcaggcaggtcgcccttcccattcgagagaacctccccccctcacccttggctgcggaggcctgctgccctgatccgggggccgaggcgctcagcagcttgtccagggtgtatggcagccaggcgatgaagatggagctgcaatgttgtagagtgggcagggctgatgtttgcatgggggtcaagctagcaccttgaagccagcccctgcagagcttgtggggggagcacccacccaactcagctccttgctgccattcgctctccaaagagcaccttcatcagccctcacccattctgctccaagagactcagtctgccatcgnnnnnnnnnngaggaggttcaagatagcaccttgaagccagcctctgtagagcttttggtgggagcacccacccaactcagctcctttctgccagtcgctctccaaagagcaccttcatcggccctcacccgttctgctccaagagactcagtctgccatcgatgcgcgtggtgcgggagggccacactgccacgtcatcgcgcaggtagacgacgctgacgtcaccgccacgcggctgctgcaccttggcgtagccgtcctcgctcccagaggctgtggaagtggaagggggtttgtgttgggcccagggacacaggaccgacatgccctgccaacacagcgtgcagcagggtgctgggagtgcctctaaatcggcagcctcgtccacctcgtgaaaacgcggggacgtacatgagtcggaagaagaggtgtcgtgggaggtcagcgggtgcgagagcacggtgccctccgcctcgtctccgctgctgtcagaccccgcctccccagcgatccagtcctccccatccatcaggccgctttcaggggtggcggcagcacatggggccgccgcaggatcatcggaggtcacggagacaccctctggggtctgcaggagacgaggaggttgggcgctcgatgtcgcaccacgacatcaacccgctcggtggtcaaatgggatacaatcgtaccatggtgtgtgcgctacgtgatgcggtggnnnnnnnnnnnnnnnnnnnccagtgcaaggttaccagtccttggtccgatcagctgagcagtcttgcaatgcgggagaagacctctcagtctcaaaagtgatatggtgcaacagcagccataagtaactagggctcgatgtgagggagaagttccttgcaagaatgtttcgaccggatcgtccgcagtggctcggtgtcggaagtgtgcttcatgctgggcaggttcagagcccatttagcgtctgcactcatcagcggcatggcgttgtattccatgtatctagatgacccttcatgannnnnnnnnnggcagccataagcaactggggctcgatgtgagggagaagttccctgcaagaatgtttcgaccggatcgtccgcannnnnnnnnnnnnnnnnnnnnnnnnnnnnnnnnnnnnnnngtttcttgcacgtgcgtgattgctgtcactcggtgtggtttcatgaaactttcatcgaccagaagcaggcatcctgatctcgtccagtaccctactgctcttattatccttttaaaaagtatacacctccaactgctgggtccggtgatgacgaaaccctaaactcaggctttggactgatccggtgcgtcactcccagcaggcaaccccgcgtgcaatgatcatctcgtagtctgcattcattgcaatcggcaaagatcagcagcatgtagaattattataccagtctggtatacacgaaaactgcaaaccactgggattgcagcccctcggcnnnnnnnnnntcttttgaaaagaatacacctccaactgctgggtccggtgacgacgaaaccctaaactcaggcctttggactgatccggtgcgtcactcctaacaggcaaccccgcgtgcagtgatcatctcgtagtctgcattcattgcaatcggcaaagctcagcagcatgtagaattactataccaattaggtatacacgaaaattgcaaaccactgggattgcagcccctcggcttgccagccggcatgtcgcagcagaggatcgcgacactggccacgtgcaatctggggcaatgggccatggactttactggcaacctggacaggattatcaagtccatcgaccaagccagggctggtggcgcccggtatcgggtgcgtctcggggcaggctgcaggctcaaggcattggtggggggacacccacagcgagggtcgccggcctatcagccgcaacatgccgaactcacgtttcttcacccccctcattcctctggcagctgggccctgagctggagatctccgggtacgggtgcgaggaccacttctccgaaaacgacacggtggagcactcctgggagtgcgtcgcccgcctgctggccgagggccacactgcgggtctggtggtggacgtgggcgcgcctgtggtgcaccgcggcgtgcgctacaattgccgcctcttcctgctggacggccgcgtgctgctcatccggcccaagctgcacctggccggcgacggcaactatcgcgagcctcggtacttcagcacatggaagcggggcgcgggggtggaggagcacacgttgccaggtgtggtccgcgccgccacgggccagcgcacctgcccctttggtcacgcggcactggccttctccgacgcggtgttggcctctgagtcctgcgaggagctgttcacgccgcgcgcgccccacatcgacctcgccctggcgggcgtggagatcatcaccaacggctccggcagccaccaccagatgcgcaagctgcacacggtcagggaggggagggggggtggggggttgacgggggaggaagaggagggctgggactgggaggcgcggcggtgaggaggagaagggtggagggcattgtaactgtgggaacgaggtgggagcggtgcgggaaagtgaggcgaaagcgatggcagtggcgccctgcaagcccacgtgcggtgcaaggctctctgtccccacctccttgcacccaccccactcacctccccctgttccccccccccttctttctcagcgcctggacctgatgatgagcggcacggccaaggccggcggcgtgtacctgtacgccaaccagcagggttgcgatggtggtcgcctctactacgacggctgcgcggcggcggtggtcaacggcgctctggtcgcgcagggcgcgcagttctcggtgcgtgaggtggaggtggtcctcgccaccgtcgacctggacgaggtggtgggtcatcgcggcgcagtggcctcgctgcgcgagcaggccagcgccgcgccgccgccggcgctggtgcccgtggactgggcactgtgcgacccgcgggtgcacagcacggccgcgctgtcgctgccgcgcgcgccgcgctacctggccgtggaggaggagattgcgtacgggcccgccgcctggctctgggactacctgcgcaggtgtgtgtgtgtggtaggggaagccgggggacgtatgacgcgtgggaagggggaagggggggagtgagtggttgtcatggcgccagcgagagtcgtcatgaaaagaatgggaccagcgctgactcgcccaggctgcgaccagcgcatgagtgccgactcgcacccgccatggctgggctgtgtcacagccccgagcagcatgccccgcccccaacctgtggcgcgtggaccccgatcttcacctcccacacacatgatcaccacctcattctcatcaaacaggtcgggggccacggggttcatgctgccgctgtctgggggcgccgacagctcggccactgctgccatagtagggtcaatgtgccgcatggtctgcgaggccgccgcggccggggacgctgacgtggtgcgggacctgcaaaggtgggtgtgatggaaggagcgcctgggcgggggggttggtgtactgagatcctgcggggcgctgcgcacagcgtacaaggagcacccacccctcatccgcactgtacatcaggatcgcaaagtatggcgacggggagctgcccgggtcgccacaggagctggcggggcgcatcttcctcaccatgtaccttggaacagaggtgcgggtgctggactgggaggggctccgggcattcatgtgaagtgtgggggagtgtgcatgtcacttatatcacagcatggctctcgcgtgcgatgctcaggaaagggctgggttatcagatggcgaccatgcacacccagatggatgcctgccaaccccattcttcacccgcgcagaactcctcggagaccaccaggggccgggcggcggcgctggccgcagaggtggggtcccgccacctggcgatcaacatggatgcccccgtcaaggccatggttgccctctttgccgccgtcaccggcttcgtgccgcgcttcaaggtttgcatgccctggccggcagcttgggatggcaagccgtcgcctcaggccccgcatgagaatttgcagggtgggaactgcactgggtcgagcagaagggagcctggacgtgcgccctgcacatgcaggttcttggcgcttcatccatggtttacaccaatggaggggccgacactctctttccccatccttcagttctccagcaaacctcccccacccatccctcatcctgcgcaggtccagggtgggtcggtccaggagaacatcgcgctgcaaaacatccaggcccgccttcgcatggtcgtctccttcctcttcgcccagctctggccctgggtggggggccagggcgggtactacctggtactgggctccgccaacgtggacgaggcgctgcgtggctacctgaccaagtacgactgctcctccgccgacatcaaccccatcggtgcgcagagttgaaggggggggaggaggggagggcggggatgtacgtattggcaacacgactgagttagggtatcaatcaagggggcatttgcaggcaggtagggtatgaggcgggaggatgcgccctcgcgcatctgttggagggtgatgtggggaggcnnnnnnnnnnggggtggaggaggggagggaggggatgtgcgtgttggcaacacgactgagttagggtatctatcaaaggggcattccaggcaggtagggtatgaggcgggaggatgtgccctcacgcatctgttggagggtgatgtggggaggcgagggcgcagcctagcccctccctctccttctgtcccaccctgtgttggctggcgggcgtgccacccccgaaatggtgtcggccctttcatgacaccctcgtaacccacaccacccgcgcaggtggcatatccaagaccgacctcaagcgcttcctgggctgggcagcggagcacctggggttcccctcgctcgccgggatcagcgccgccccgcccactgcagagctggagccgctcagggatggggagattgcgcagacggacgaggcggacatggggatgacctacgaggtgtggcctgaggagccttgggctactgcgcggtgctgccgggctgccgtggtggaggaaagtttgcatgaaagaacatgggacacaagctgtcaaaccccggtgtcaaatccgattcctacctgccccacacgagtccggacatgccctcaccgtttgcccctcccacccaacctcccccacaggagctgtccctgtttggcaacctgaggaaggtgtcgcggtgcgggccggtggccatgttccggtccctcctgagcacgtggcgaagccggtacccggcccctgtcatcgcggacaaggtcaagcatttcttcaggtgaggtgctgcggtgggacccaggagatccttgcatgggccgcggccgtgccaggggtgcatgactgtgtaaggagagggtagggaggaacagggctgggcatactgtaaacccattcccttcctcgtctccatcacgcccccaggtactatgccatcaaccggcacaagnnnnnnnnnngaaagagagggtagggaggaagagggcttggcatactgtaaacccatttcctttctcgtctctgtcacgcccaggtactatgccatcaaccggcacaaggccactgtcctgacgccgagctaccacgccgagaactactccccggatgacaaccgctacgaccaccggcagttcctttacaacatcaggcgagtctgggggaggttgactaggctggggtcttcaatgctgagcccagtgcctgatggaagatgacgaagtcatgtgtcattgagccaaacccccaaccatgcaggtggccctggcagtttgccaggatagatgcccttgtggaggaagaggccctcatgcatgggcgggaggggccaaagggaggacaagcagtctcatcgtgacaaaaactgatgcactggatgctgttgaccagggatcaagttctaaaaatgcaactgaggtcattcctgaagaaggaaggcacttgcgtgcccccggctgcacacggctgggcagacgcgcgtgtgagccattcatacagttgcaaagttatccgtcgcttcctcatagccgtcaccgagctctannnnnnnnnnacactggatgctgttgaccagggatccagttctaaaaatgcaagtgaggtcatccctgaagaaggaaggcacttgcgtgccctcggctgcacacggctgggcagacgcgcgcgtgagccattcatacagtggcaaatttatccatcgcttcctcatagccgtcaccgagctctacctgggcaagtgtcgattgtttcgtcacggcggcaccacaaccccctaccacatcgagctcacagcctgggccgcggcttgcccgatttgctggcaatcttgttcagccagtcgttcccgatcttgctcgccacgggatcgttcaccagcaggatctggtggctgttttcggcggtcaccgtggcccggagactcatgccatccgaggcggcattcagctgctccttggtcagctgcaggccctgtgtgtcattgggggaaatgttgggtagggatggcttgtactcgcgagccggagaaggctgataggagtggcggccaccacacaagacacgagcatgggggtgagacttgctggagaaggtgccctccccagtcttcccaaccggctcctgttcggtacacatgcccctgtcgcatggaacagccaccactcgccctcgccaccccaaggagcaccttgtaggagcagaggagcatgtccttggccagcccctccgcctcgacgcgcagctctgcgggccccgccgccagggcgttgagcatgcccagctgaaaagcgcgctcggcgcccagcgcccgccctgtcagcagcagctcggcggcgacgcctaggcccgcaacccgcggcgcgaagaagctggtggccatgtcactgccggtgaggcccagccggacaaaggctgcggagaaggagctggcgctcgtggccacgcgcaggtcgcaggcgagggccagagcgaggccggcccccgtggcgataccgtccacggcggccaccaggggctgggggagggcccgcatcttttcgatcaggcgggatagcagctgctgggagcggatgtcgcggtagtcccaggcctcgcccccgatgctcagcgctgaggcctgatgttggagtggttgtgtaggggaggttataatgagaaaagtgaaggagcgggtttgggagattgggaagggtgatgcatcacctgtgtgcagaagtgcgcgcaacacaatcacacaaccccaaggtgggtctgggggcccaccttcatgtcgatgcccgaagagaacgccctgcccccctccgcctgcagcacgatgacgcgaggaaagtcctttggcaaggaggcctccgccccgagcagggagtaggggtgtgaccactcgtcgaagagcaggaagagctcgcggagcatctcgccgctcagggagttcagggcttggggtcgatccaacgtcagccacgctatgacgccattctgggtgtgttgcagctccacccgcagcgtcttcaggctgggcacgatcgatggccccatcgtgcggccccgcaggatccgggcgctggcacagctccaccactgcgagggaaagctgcgagcagccacttacataccatgcaggagtgctggattgttggagtgcatacgcgctgtgctcctgctgatagcaaaacgaaccgctccgggcacacgtcagccctgtttgccaagatacttgatcttcccaagatatcgggagattcatcgtcggccaaactacgagagctaccttctcgtcgcaccattgattagatataagaacatttccccattgatcacccgatgtatactgctgcttctagcctttccaccaatcgcaggggtggctaatcctttataatttgcgtacatcacgccgggagccacctttcagtggggagggagttccggaagctttccttcccctgctgcaaggttcaagacaggtaaattacgccttcaacgagaaattgcgcaggccatgcatcgcttcattcattgtggctctgtctgatatcctgagcgcaggccacaaacccgtgcgggggcagctcgggtttagtcacggacgccaccgagacaaatgcctttccaatacacatgcaaagagccaattccatccctcgatgacaacactgattccttccttttattttctacgtgcaaggtctcacagttgtgattttcgcagactggctgaggttccggacacttcccccaggtcctacggttcgtgcctgttgtccactgctaccgagcagggccggtgcaccctagctccagggctttgcattgggatgacggagagctttgtgctcggcaaaggatttcgtgggcatctggcgatctaaagtggatggctgcggttctcgcgccccctccccgcggccagcccatgcggggctctgtgagcgcttatggcctcgtcgacctctgcaagcggctcgaggcgccaggagctcagcctcctgcacagggccagggcacccccagggcccgnnnnnnnnnnnnnnnnnnnnnnnnnnnnnnnnnnnnnnnnnnnnnnnnnnnnnnnnnnnnnnagccgctccgagcgggccggcgccgagacggtgtcggtggacttcctggagttcacggtgagggggttgccttatttgcttgctcggcagacaggccctctttgcttggggttgtcccttggagaagtgcactgccaatgcccatgtgcagcagctgcattgccatcaaatgtcatgctgtgggttgtgagtgcgacatggtctgcacatggatggctcaatgacagtgcgcccacccttatggtatcctttacagcgcccagcctgtcctcccacatgccatggcatgtgggagga

SEQ ID NO: 37572 - DNA, 61 bp, Chlorella protothecoides
cgccagaagccccagtttttggtagggtaccctaggttcctcttcctgtgtgtggaggagg

SEQ ID NO: 37573 - DNA, 61 bp, Chlorella protothecoides
gtgcaccgacagcgtggcgttgtagggctctaccaccgtgtcggagaccttgggggagggg

SEQ ID NO: 37574 - DNA, 75 bp, Chlorella protothecoides
tctccaccgccgccatccagacagtctccaatcccacccgccaagacgtctcctcctcctccttcaaagaagtct

SEQ ID NO: 37575 - DNA, 17940 bp, Chlorella protothecoides
  modified_base (600)..(609): a, c, t, g, unknown or other
  modified_base (1044)..(1053): a, c, t, g, unknown or other
  modified_base (1550)..(1559): a, c, t, g, unknown or other
  modified_base (2633)..(2642): a, c, t, g, unknown or other
  modified_base (2849)..(2858): a, c, t, g, unknown or other
  modified_base (4348)..(4357): a, c, t, g, unknown or other
  modified_base (5057)..(5066): a, c, t, g, unknown or other
  modified_base (5595)..(5604): a, c, t, g, unknown or other
  modified_base (6318)..(6404): a, c, t, g, unknown or other
  modified_base (6555)..(6564): a, c, t, g, unknown or other
  modified_base (6673)..(6682): a, c, t, g, unknown or other
  modified_base (9732)..(9741): a, c, t, g, unknown or other
  modified_base (10266)..(10275): a, c, t, g, unknown or other
  modified_base (10618)..(10627): a, c, t, g, unknown or other
  modified_base (13222)..(13231): a, c, t, g, unknown or other
  modified_base (13649)..(13658): a, c, t, g, unknown or other
  modified_base (14539)..(14548): a, c, t, g, unknown or other
  modified_base (14774)..(14783): a, c, t, g, unknown or other
  modified_base (14886)..(14942): a, c, t, g, unknown or other
  modified_base (15206)..(15215): a, c, t, g, unknown or other
  modified_base (16296)..(16305): a, c, t, g, unknown or other
  modified_base (16709)..(16718): a, c, t, g, unknown or other
  modified_base (16853)..(16862): a, c, t, g, unknown or other
  modified_base (16915)..(16924): a, c, t, g, unknown or other
cgcctggcctgccggcggcggtgcgcctgcgccgcgcggcgcagggtccgggtgtcgggccgggcgggcctccagggggatggcgccgggcggaccggcgccctggatggggagcaccgggggcgcatggatgggcgcgcggacggggggggccggcaccatggccgccgccaggttggtcaagccaatgggcaggaacctggggtgggtggcgtgaagagggggtgctgggagaaaggggcttgggcgggtgagcgggggcgcggttcttgtttgcaggaagtgaagagcagcccccaaactgccaccagccacccatctcgcacctgaagatgtcattcagcacatagtatcccttctcctggacggccaggaagaaagtttgcacaaagggcctcttgggcttgccctgcggcaggaggagaacatgcgggaggtggatggatgcgacacaatgggtgcccaacagagtgttaaagtggatgagccacgccggtgcggccacaccactcccttccctgtacacctcggtccacctcctgctgtgccatcaggcccgggcagcgcctcacgtgccaaatctcaccctgctctggagtnnnnnnnnnngcacctcggtccacctcctgccgtgccaccaggccagggcagcgccccacgtgccaaatctcaccctgctctggagtgtcccggagacctgcaccacaacgccttccacagcggagggctgggagtccacgctgtagatctcggtcacggcctcctcgaaccccagccgctgcacagcctcgtagattgcctgtgtgggtgaggtatgggtgtggggaactcatgtaagcctgtgcggcggggggcagcgcggatgcccgccatgtttcgtgtgacgactgcggcacaccgcctgtcacagccctgctctgtcccaggtatggctcaggaatgccatgcccgcccaggcagggtggggaccaggcatgcagcagagcatcaggtcgccgcacccgcttcagtttcgaggcgtcctttcccacagaggcgcctgcnnnnnnnnnntatgtgacgactgcggcacaccgcctgtcagggccctgctctgtcccaggtatggctcaggaatgccacgcccgcccaggcagggtgggggccaggcatgcagcagagcatcaggttgccgcacccacttcaattacgaggcgtcctttcccacagaggcgcctgcctcgtcctcggaccactacacatcacatacagcccgacattcgacaatcaacaacccccatcgctcgccaacccacccgctgcccgacggcggtgtggaccaggccatccccggccacatttgccacagaaaagatgctggagtcggcatagaagcgatgcagctgcttcggagactggtgcaatacagtgtagaactgctggacgaactggctggtcacctgtggaaggaaggtcccgggggcggggggatgggcgaagcctgttcgagacatcctggtgctcccagtggcggaggggagtatgacaacgaaggtggacgacgcccgggnnnnnnnnnnaatgggcgaagcttgttcgagacatcctggtgctcccagtggtggaggggggtatgacaacgaaggtggacgacgcccgggacccctcgcgtcctaccgtgcttgctgtattcacttgattgttcagtatggggagactggtgctgagagaggggatggacccgtcggcactcgccatcgccgatcctgggagagggaggggatgacacacccaatgtgacgatcgattcaagcaggacaacatcgtatacagctttgtatcgcaggttgacatgtgcagatcactgtcatggcgcgcagtgtccccatgactgaggagggctccattgacgcttacaccttacttcctcccagcgcacctcaaaggccacttgaatcgagctggagctgggtgtgaaagtacctatcagctatctattccaagcctggtatcgaaaggctcattttgtggacttgaagcgtcttacaggggatgggggggtgaggggcctctccattcggtccttccttcttgggcaatgcaggcgaccgaaatactggcgcctcccacacccggctgcatgcagtattaggtcagtgcatctcgcgaaagagcatcatcaagcatctcacttagttggggaacaaatattgcgtacatacgaccatgtataaaaggagggactgggtttacaccgagaaagggagagcggcagcggagagcgactccagtgactcctcctcgtccagtgaatccgatggtgggtccttcgacagcggcatcaaccatatgttactccctggagattcatggatgtctcgcaacctcgacatttccccatgcagacgcgcggaggaggggtgattcggaggacgacagtgccagcagcagtgccagcagcggtatggaaatgatgaggggctggtcagagagtctgcgcaggcggtttgtaagatccgcgttgtctcactctctcttctcacctgatcatccaggttctgagagggacagcggtggcgaggaggaggctgaggtgattcgtgccaagggccaggcggcagcagtgccgccaccttccgcagagcgcgaggagnnnnnnnnnntctcacctgattatccaggttctgaaagggacagcggcggcgaggaggaggctgaggtgatacgtgccaagggccaggcggcagcggtgccgccaccttccgcagagcgcgaggaggaggacgaggaggaggaggaagggtcgagtgaaggcgaggacgaaaacgaagaggacgacgagagtgaagaggacgacgaggtcggcggcnnnnnnnnnncagggtcgagtgaaggggaggacgaaaatgaagaggacgaggagagtgaagaggacgacgagggcggcggcgacagtgatgcggaggccctgtctggcgatgtggagctcgactccccactggacatagaaacgattccgctgaccacccgactggaggacctctccgagagcgattttgacgaggaggacttcgaggccatggagcgcctggcggcgcagctgcgcgcctggctgtcggacgccccggcccccgacccggctcggcctcttaagtgcacgctgtgccgcggcgcgctcatgctcaagcctgtgaccctgcgccagcacgtggccagcaagcgccacatgcgccgcctggcagctgagcgcgccagggaaagggcggagcgcggcggcgccgacgccggcagcagcagcagcgaggaggacgaggacgccgcggcgctggcggtggccgagggcatctgcttcgcggaggactacgtcagcgacagcgagaagatcgagacagcggaggagggcgcggcgcggctggccgctgcgctgcgggcggcggcggagggtagggccagggtggaggccaagaaggcgcggaaggccaagcaggtgccgcagccggggaatcgggcggcgcgccgcgcggccgcaggcctgggtgctgctgcggcggcgggcaagggcgaccaagggagccaggcgggcagtgaagcagccgccccggtgcaggcggtggcttcatcagaaggcaaaaagcgggagaagaaggagcggaagcggccaggcaaacggcagcgacaggcgctcaagccggccccggagtctgacagcgaatgacatggctgcctgaggagtgttgcctcgccgcctcatacacagcaataacattgggcagcctcttatatgctaaatccaaccagataccttccaaccagatttccatcaactgctacccttgggcatcctgctactgctgggggtggctagcacccacataacaggacttgctgtagtgagtctgaatgaaatatactacaagaataccctatcaccctggggagttggggctatggtcctagaagcctgcttgatgcaccaattgggtggccgcagagggagcaaggaggagaaccagcacatcgggtgtgcgctaaaacagtctgcctactggtcggacggaggtgtagccctgccccccacgatcccaccatcggggccaggatgtgcattctttcccagaagcggctcgttttgactggtcacctgaggcaggcgggaccaggggcttgcaattaagggatgcacggtgcatccttgcctgcgtcctcccccaacccgctatcgacagccaccatccagacgaacacgacgccgcatgggatccagttatgcgagctcaaagggaattcgtcagcatcaccagccagggtcattcctcccactccacagacagggcgtgaaaatgcaccccgccttcaccccgcccacggnnnnnnnnnntgggaattcgtcagcatcaccagcctgggtcattcctcccacttcacagacagggcatggaaatgcaccccgccttcaccccgcccacggtggactcccggccttccgaccccagccccacctccggctccgtcactccacctttctggcggcgagagcgacgctcctgcgctcggcccgcatccgcagggccaggccgccctggaccaggccaaacccggcccacgccagtaaaaacatggccaggaagccgacccaggcatgcggccgcttcacatccatgaaggggtagatggggcggccgtggcgcaggaagaagacggcggcccagactccgtagacgccggcccaggcgccctggccgcccgccgcccagaggtcgggcgggaggcagcccagcgcgatttcgccggccatcatcagcgcgttgatgccgtgctggctgtacgactcgaggcagaagaggcggggcgcccacatcgcgcgccgcgccgggtcggggtctgccatcagcatgggcacgaggacgagccaggtgatggtgtcgaccacgacgatggcctgataagtgcgcaaaggacgaatttgggggggaaaggaggtagagggcagattagggggtggaaagcaggggggaacagtggaccaaatgccttgcgagtcgatgctaagaggacccgcagcaaggagatatcgggannnnnnnnnngaacagtgaaccagatgccttgcgactcgatgccaagaggacccgcagcaaggagatatcgggagtgccagtgacagacagtgagcaggctcggagtctaagcagatcaatcccaaccccttctcactgaggcttcggtgtggaagatggccaccagcacccagtgcagggtcctgggctttgcgctactccaccccttgcggctgattgccagccagctggcgagggctgctagtgcaaagtaggcggtcagcagccaccagttccagactggaggaagggtggatggaaatcgcagaggcgtggatggagtatttctctcaaggagtgattctactcaaggcgtgcaggtcactggcacttggcccatcccaggcttgttgtagacgctcccccagatttggaaggtggaccacacaggcaccggtgtcggattctcatccaatctgctgcgccccacatccctgcgcaccggtgtagtagacgaacgcaatgctaccacgatccaggtactgccggatgccgatgnnnnnnnnnngtggagtatttctctcaaggagtaattctactcaaggcgtgcaggtcattggcccttggcccatcccaggcttgttgtagacgctccccaggtttggaaggtggaccacacaggcgacggtgtcggattctcatccaatctgctgcggcccacatccctgcgcaccggtatagtagacgaacgcaatgctgccacgatccaggtactgccggatgccgatgaacagggcataccccaggcaggcgaggcggtagaccagcagggtccttcgcgagactgcggtgcatgcgtggggattggttgaaggaatgatggaagggtggtatgaggacacgccttcaggaagatcatgatcaggcgtgctagcaagggatctgtagcattgtgaccacagtgtaaagctgaagtcgggcacaagaggccagcaaaagccatgtgtggatgcctcaccgctggcagaggctgtgacatctggcggcgatgccttgcgcgccttcctaagcctggagagggttgcgtcagggttgttttggcgtgcagggacccagagctgagcactctgttagttgcagcatgcctattgcgtctctgggaaagcaagctgctcagcagctcctccgtgccgactcactcaccatacgatcaggaaagtggtcgtctgcacccaggcggcaagctggatgactatgatggaagtggggatcgtcatgccgnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctttcaagattgtacgcttggattgatacaatgcaaggagtttaagccagtgtcgccgcacacgatcaagctagagcacatgttaagcagctgggaattttcgaggcactcgcgattacgcgtctgcgcgcttgcgccctcgactatnnnnnnnnnncgcccctataggcacgacagctttgtgcaagagcgagagccctccggtctccgacttgctctccacctcgaccctcgtgcagagagctggcttggcctctgtcgtcccnnnnnnnnnnaccaggccatgcaacacttttatgacaatgtgacaggaagaacgagtataccccttgatcacccaaatccatcagatgcgcagcaaaatttaggaacatctgtggtcatatccttccagtactgtggttgagcggggtgtggtgttcgagagatgctcgcgagcagcacgtgtgcattccgtttctgtcctcccccaccacgacaaaggtagtggaactgaggaccggcgatgttgcgagatgtcgccagactcgtcatacagaaatcatcggtgacagaacccgcagatcgccttgccccaccgctgcatggctatgcactcttccaacctcacctcccacgcaggagggccgttccacagcctcttcgggccacctccccggcgatgacacccgccatcggcacccaagaccttgagcccttcgtcgccctggcaaaccgccttgccgacagcgcgggcgccgtctcaagccgctacttccgcaccccggtggctgtggacgtgaaggccgacgcctcccccgtcaccatcgcggaccgggaggcagagggcgccatgcgggacctcctctccacacacgcccccacgcacggcgtgtttggcgaggagtttggccatgcctccggctccgacccggactggacgtgggtgctggaccccatcgacggcaccaagtccttcatcaccggccggcccctctttggcaccctgattgccctgacacacaggggagtacctgtgctgggggtgctggaccagcccatcctgagggagaggtgggtgggggtgctgggggcggagacgtccctcaatggcctccccatccacacccggccatgcgccagcgtgggggatgcctacctctttgcgaccacgccacatatgttctcaggtgagggaaacggggggctgcaaggatgttgttgaacagggggatgcagggcggtggaggacaactgctggtcgttgaaaatcatggaaagaaacagtgttgactctgcatgcttgactccgtttgaggatgaggttgtccaccctggaccctccgaggttctgttgcaacatcagcataatgaacattgagtgcctgaccaagagtgcgccaccctgtcagggccctttgagttgctaaatgagatagagtggagctgtgcccctgtcccccacccttgacaacaagtcctcacaaccctcgcaggtccaaacgctgaggcctttgctcgagtgagagatgccagccgcatcccccagtacggctgtgactgctatgcgtatggcctggtggcgcgagggttggccgatgtggtggtggaggccgacctgaagccgtatgattttctggccctggtgcccatcctcgagggggcgggcggcgtcatgaccgactggatgggggaggcgctgcggctagacccggaaaccatcacagaagcacacgaggtggtggctgccggggatgccaggacccatgcgcaagccctggaactcctggactggaggcgctgatgggatgacctttggtgtgcatgcatcttcatgtgtactccaagcatctgctcggatccaagtgggtgtgtgttggtaattgctcttgatttaattcgctcatgttattgatgcatgctgggagtgtacacaacggtatgtcgtgatctaggaacatgcttccacttgatgaggtgaagggaggatcaccgcgcgcgcaagattccaccggcgggggcagacctggatgtcgctcttgtaacgcagcagaaaacccaaggcatactacatggacgcatgcttcgagtcctcacgcatttaaagacgccgaatagatacccagtccgttgtttgcttcgtcgagcatcacacggccatcactgcaccatggctgctgctcccggcaccgcggcgcagggcctgcgcgatgacggatggtacaccgagctgagctccctatggccaggccagggcttgagcctgaaggtggatgaggtgctctaccagggtcgctccgagttccaggtgggaaggccccgggcttgatgggttggtgggtgctgcacccggtcgggtgggtcctcggtacccggcatgcacgcgcaacaacgatctccatggctgggctcaaacgcaaatcccaagatatttctatggctcactcaagcatgccacgtcccccctccctccaggacatcgccgttttcaagaccggcgctttcgggaaggtgctggtgctggacggcgccatccagtgcaccgagcgcgatgagttctcctaccaggagatgatcgcccacctccccctctgcgctcttgcagtgagcaactttagcctgggatggcaggggcaggttgatgggcactgtccgccccgaggccatcggccaatgatgtgctgctctggcatacacacgcccagtaaaacccctaggagcacgctcacgctgactctgagctgccccccccccccctcctcgcagcgcccagccaagaaggtgctggtcgtgggtggcggcgacggcggggtcctgcgcgagctcagccggcactcctccctggaggccattcacatggccgagatcgacgggtgcgcgtcatttggttctccagggacgcatgcttgcaatagcggtgcattaaagatacctcctggcctgtctgtcgagtgggagggtcaagtcggcggttgacaattttggaccatacctgcattttccggcctcaactcaaggtggcgtgcatgccattcatgctgtcgtggccagacccaagagttctgtgtgatgccagcgcacgctccattccacgccttcctttcctgcgtgcagcggcgttgtcgaggctgccaagatccacttcccgggcatggccatcggcttctctgaccctcgtgtctccttgcacatttgcgacggtatcaagtttgtccaggtgcgtgctgggcggtgtgtcaaggggcgccaaggattccacagagctagtaggggggtttgggggtgaggacctggaccctgcccgggtctatccgggcacaaccaagccaaggccgggcgtgattgnnnnnnnnnnttgctgggcggtgtgtcaatgggcgccaaggattccacagagccaataggggatttggggttaaggacctggaccctgccctggactatccgtgcacaaccaagccaaggccgggcgtgattgtgaggcgcttcccctggggtctgcaggctctcctgacatgcccctatgccgcctccccccccccccctccttcccaggatgcggaggagaacacctacgatgccatcatcgtggactcctccgacccagtgggccccgccgaggtgctgttccagcaggtgcgatcacaggagggcgggcgcgcatgtccgcgccaccccgccgcaggccggaatgcgagcctgcgtcccgggattctgtgcgcgttgctcgtggggcaggttatattgatggggtctgccttgcgagcccggcacaatccagcatacatgcccttcgccccctcgctcccccccattgccccggagacacccttccaagcctcccgccccaacaccctcccagcccttcttcgaggccatnnnnnnnnnntgctccccccaattgcctcggagacccccttccaaacctcccgccctaacaccctcccagcccttcttcgaggccatgcaccgcgcactcaagcccggcggcgtggtctgcacccagggcgagtccctgtggtaccacctggacatcatcaagggcctggccgccatgtgccacaccgtgttcgtgggcgggacggtgcagtacgccttcaccaccatccccacctacccctccggccagatcggcttcatgatctgctccaaggccgaccccgaggcccaggcccagctggatccccgcacgccgaagcgaagcgtggacggcgccgacagcgccgccctgnnnnnnnnnnacccaggcccagctggacccccgcacgcccaagcggagcgtggacggcgccgacagcgccgccctggggccgctcaagtactacagcccggaggtgcactccgcggcctttgtgctgcccgcctttgccaagcgcgagctgcaggcctccctatccttttgaaagatcggagggaggcgggtttgccatgtgcaagtaggcgaggggattttggcccctagagcctgcaggaagtggcttgctgtgtaattaaatgatgcaaagtcagatgctgattaaatgggcgagcgagtgggaggggacccagtgtggctctcgcaaagagttagtccggacgagctgatctttccagccaatctattggccctcctggaaaaatccacgcatgtgtcagtcacatggagagcacaccacacgaaagaggtcgcccaccactactgccctggaaattatctgcctggctagcattcgtgctgagcggattcccctctccaaagagaatcttaggctttacttgatcaagactttccacaagcggaatcaaaagtggtatgcgagcaagaccaagaaagagaggggaggggtggggtatatgccgggaagcatgcattcagctgacaccgctcgctccatcctcctcgacagcacacaagacgcctgccctaccccgtcaccaccccctgagtcccccctccttccttcgcctcccctaggccagcttgggggtgggagtggccttgtaccgcttcacggcctcggtgtaggcgtaggtgcccagcagcgcgatgccggtgcccaccttggtctgcagcgtcagcttgttgccgaagaagagcaccgaggtggcgatgatgacgacacgcttgaccacgttgcagacgccgtgggagacggggctgatgcgggacagggtgttgaaggcaaactggttgtacaggtggtacaacaggccgacggagagtagggcgccgtagaactggcccgcgcccttgagcgcgacctgggtgcggatggcggaccacacgccgcgctcaaagaagaagatgccggggacgcagatgaagacggagatgagggtggtgtaggcgtagatgcccgtggagctcaggttcttgatcgtcgtcatggccctgagggtaaagggcggaaagggggggagcgaaatggagtggttgtagaggtgggaaggtggacgagggtacgattagtggaagatggagggacgtgctgacagaaggcttgagtgcctttgtcagtggccagcctgctgccgaccagcagtgcccttgctgacatgcccataggcccgctgcccccacccgtctgacaaagggtgcattgcagcagacagaatccccccctcaacactcacttcttcgaccagacagccctgaagccaaaggtgaggttggagaccatggcggagatgaagccggtccagttgaaggacaggtcggcggctgaggcggcggccacacccaccatgacaggaatgagggagaggatcacaggcgcgggcgtggactggcctgcacagcgtggagaggggtatcagtccggttaggacgagacgtcgtgggtgggtatcggacctcctctgcaaaaggcgctgctgaatcgctctggcagtgtgcagcaaaattgctgcctcacatgcgcctgccactgccctccgtattcctttccccaaggtcagcccccactcggacccctccctcgcgctcacccaggatcagctggctcagcgcgacgttgaaggccggctccagtgtctttacggtgtgcgtcaggctgatggccacggcggcaaaagaaaggttggccgccacatgaccgatggcatgcatggcggcggggccggagatggcgcccagctcctcagtagtgatcggctgcgcatgggggaagggtgcaagggggtggtcaagcgtccggcctgcacgatgcagatgttgcccccgctgaaattgcaaggtttgggtgcaggggactgctaggagaatgccttgtcgacgagtgcactcccaactccccacatttgcaccatgcttgagatccaccaaaccctccaatccccaccataaccaccaccttgtcgacgcacccgctcaaaggaggccttcttgagcccgatcaggtagaagaccgcgcagtaaatggtccccacgacaacatgtacgctggacacaaaccaagggtaggggaagtagttgaagatgaccttgttctgtaggttgaaggccacgttgaggccatacctgccaaggggtgtgggttggtgggcatggtgggttagccaggagcctgaacagaaagatcccgccttctcctggcaatgaggctaaggaccagactccagccccatttaacagggctccagggggttgcaaaaaagcagcagaacttcccgctcaaaagccctctcaccagattgcaatgtatgtcaaggtggtggcagatgcggcggcagaaggccccataaacttgctcaatgtcctgtgaggagtttcatatgcttcacaagctgtgaggcgagatcagggcaccatggggccagcctgaggtggaaaatgcgctgtaacccagtggctgggnnnnnnnnnnaacatgcttcacaagctgtgaggcgagagcagggcaccatgggcccagcctgagttgggaaatgcgctgtaacccagtggctgggtgggtagtttgcagtacaggaccccaatcctccacggccagtgctgcccacctctccacagcatccttgggctgtggctccagggccccagcactggcatgtacttggaggttagaggcacgacggcctggcctcagcgcgggctggaaggccctgctgcagcctgctgcctggttgagccctccagcgaaaccctgcggtgcggacgagggtcggtgacaatcggccgcaggcgaggcatactaccattaattgctggcatcggtgcaaggattgaatcaagagggtgaatgcgtcgtcaatctggcggagccactcacccgaagctgggcnnnnnnnnnnacgcatcggtgcaagggttgaatcaagagggtgaatgcgtcgtcagtctggcggagccactcacccgaagctgggctgcacggggtgcgaccagccctgcccgggtgggaaccctggcagcctgccggcacaggacgggcgctggggcgctcaggctagtgcaggcttgcatgatggcttgattgaatgtgtgtcacggtcctgtccacccgactccagatgagggagggcggatggaattcggatcacgtggctcgacggacaacgccgcgagcaagcatcctgagcatttcctccccgccatgcacggaatgcgaggctctgcacgcctgccatggcgcaccccccgcccgatgccatgctctttacagccaaatttgtgtgcgacgcaggggatcgggagggcaccggtccccaccgtccccttcagaggccctcgaacagcttcaggtggtcctccagggtctcccccctcctgatcatcttcagggtgtcccccccctccacccagtactccgccggccgcatcttcaggttgtaggtggaggccatggccatgcagtaggcccccgcgtccagcaccgcaagcccgtcccccgccgcgggcgtagccagctcgcggtcctttcccaggaagtcggcgctctcgcacaccggacccaccacgtcgtagacggccttgggggtgtggtgtggggcggtcagctcgatgtgctggtaggcggagtagagggagggccggatgagctcggccatggagccatcgatcacgatgaagttcttgttgccgttggtcttcacccctggcggcgttgtgtgggaggggagtgcggtgggcgctttgtgaacaagggggatgtgttgatgtggggtgggcggannnnnnnnnngtcgatcacgatgaagttcttgttcccgttggtcttcacccctggcggcgttatgtgggaggggagtacggtgggagctttgtgaaacagggggatgtgttgatgtggggtgggcggacggccggttggtagcagcacacctccgtgggaaggcaatgcactccagatccagaatgcagccatggaaagaacatccaccctcctgacgcatcacatcatgccattnnnnnnnnnnaaatggtagcagcacacctccgagggaaggcaatgcactccagatccagaacgcagccacggaaagaacaggcaccctcctgacgcatcacatcatgccattnnnnnnnnnnnnnnnnnnnnnnnnnnnnnnnnnnnnnnnnnnnnnnnnnnnnnnnnntgtgacggtgttgacaaaggcggcggagttggccaccatggacctcccgggctcgatgatcagggtgatgcccagggaggacaccaggtcgcgcaccgtgtcgatgagatcgcgcggggtggggagcaccgcgcccctgcacggtagaagttaaagatggtggtggcagggattgtgtctgtcgggtgtgctgcgctccctggggagcagaaggggtgcaacgtgccctcccgtatctatgtaagacctcggccggtcttcgcnnnnnnnnnnaggtgtgctgcgctccctggggagcaggagggttgcaacgtgccttcacatatctatgtaagacctcggccggtcttcgccgttatctccgcgcccggccacacgatgccgctcccttcccctgggcgcgctccccaccccaccccccgacaaaaaactcactcgtgacggtagtcaatgcccagcccgccgccgatgttgaggaactggatggggaagccttgggcccgcatctccttcacaaagtcgaccatgatcagggcggcgtcacggaagatgctgaccttggtgatggtgctgcccaggtggctgtgcacacccaccagctccagcgcgcccggctcggccttgatggcgtccaggaaccactggaggtggctgttccggatgccaaacttggactcggacatggaggtgcagacgtaggggtgcacgcccgggtcgacgtcggggttgatgcggatgagcacgcgcgcggtgcggcccacgcgccgcgccgctgccgtgatgttgcccaggtcgaactcggagtcaacgttgatgagcgcgccgtgctgcaccgcaaactccaggtcccggggcagcttgccattgccgttgaagatggtacgggccacgtcaaagccggcggcgcgggctaggcgcagctcgttgccggagaccagcaccgcaccggagcccagctcgcgcagcagctcaacgatcttcaggttgttgttggccttgatggcgtagccgatgagggagggcaggccctccagcgccgcggcataggccgcgtggttggcccggatcttggcctgggagtagacgtagaaggggctggcgtcgacctgaccccggatgtcgtccaggcgcagcccgtccacgtacatgtagccgtcgctggcggtgtagatgcccaggccggagccgggggcgggggcgggggctgagcgctgggcggcggcgggggctgccgctgctgccatggtggtgacctgcctgcgtgcctgcggggttgagtgattggggagtgggcagcccttcaggggtttctaccgtggggatcaggcagtaacacggtatcagtgaccggctnnnnnnnnnntggggttaagtgattggggagagggcagcccttcaggggtttctaccatgggtaacaggcagtaacacggtatcagtgaccggctttcaggcacgcacagcctgccagggggccagcaggagatatgtcatgacaggaagcctcaccactgaaggacggccctgggggcgcgatgggagggccgcaaaggcacccgcgcgcgcgccagcacgattcccaccagtgcaactgagtggttgagagagcgcagatgcccgcccggcatacagtgtcgtctgcatggtcggtgttaagggccggtgcgggggggtgctcctggagccaagggtctggagctgcgggactggacttcggtcctgatcgagaatgggtctaatccttcctgtttccttacacagagaatnnnnnnnnnnccagccactctgcgcgccttcagcacgtgcctggggtttgtgaggcagtcaatttgggataggctgggcccgtcccaatccccgacccccgcacccaaccctgcgaagctcgcctgggctgctcacacccagcannnnnnnnnnagtatcgagtacctatgcatgagccggggggagggggcatccattgtcccgcnnnnnnnnnncgggcccgtccccatccccgacccccgcacccaaccctgggaagctcgcctgggctgctcacacccagcacaaccctccacatgatgtgtgtgcgatagaggcatgacgacctgcgccatggtggggtctggcccgggcccaagatcacttgccacgcaggcccgggccctaccccatcgcgtcgctccaggctgtgccgcggcactatgcatcacagatgggttttgtggatgcaagtcctcgcttcggccccgtcgcttgccggtcccccgctctgctgcggcctccgtgcaccacccccacccctcatcggagcacgaccacgaccacgagcatgggcaccgcccccactggctggcgcactcccccctgggcggggccctggactggatggagggcggcacggtctcctccctggtcaaaatcgcatgcctggtcgtggcaggggcctccccctggctgcccctctcggccgccgcggccgccgccacgcgcacggccgccatctccctggtatacgccctctgcgccccctccgcggccctggacctgtgcacgcagctggcggcgggcgaggtcgacacccacgtgctcaccagcctggcggcggcgggcactgcgctgacggggcacgctgcggaggtgtgctgagtgtctcgggtcggggggggggggccctggtctcaacgcatcaggcgggccctgctccagcgccgtgcgggccctacccaccgatcacctgcacgtctccctctctccgactaccccctccctttccccccctctgccccaagggcgcgctgctgctgaccatgttccagacctcgcacatgctggagcaccagctgacggcgcgcgcgcggggccggctggccgacctcttcgccggcctgcccgacgccgcggaggtggtggaggtggacctcgccgacgccgcgccgcgcctgcacacgcggcgccacgtggccgtggccaacctgcgccccggcgaccacgtgctggtgctgcccggcgc

SEQ ID NO: 37576 - DNA, 125 bp, Chlorella protothecoides
ccgccaggccacttcaccacacctgcggcccagcagacatggtggggcagcgctgggctgtgcagagcgtctcatccagcacctggtagagcacattgagcgcgttgtagaaaaacaccgtattc

SEQ ID NO: 37577 - DNA, 61 bp, Chlorella protothecoides
ttgagcgcgttgtagaaaaacaccgtattcaccgccagccatttattgatgtcctcgcctg

SEQ ID NO: 37578 - DNA, 76 bp, Chlorella protothecoides
attgccagtgcccacattgccatccagattcggctggcatggcattactccagaggggacgcactggatcacgctg

SEQ ID NO: 37579 - DNA, 61 bp, Chlorella protothecoides
aggatgtgcacaccctctccgactggcacctgccccctaaccccgcacacaacctgcacaa

SEQ ID NO: 37580 - DNA, 79 bp, Chlorella protothecoides
gaggctggccccttcccctcgcggtccctggatcctgccccgccatgctcgcaggggcagtcccctggcccagagcgca

SEQ ID NO: 37581 - DNA, 136 bp, Chlorella protothecoides
gtaatctacctggattggccatccagtcgctaattcgctgctctccacccccctctccatgcacccctgaatctccgaaactatgaactccacaccccatccctgtaggtggaggagcacatggtggacgggcgga

SEQ ID NO: 37582 - DNA, 107 bp, Chlorella protothecoides
gagcccagtcccgtccacccctcacccatcccttacccccccccgggacccctcagaaaaaccctcagcttccacctgacttcgcgcatctcattgcggatgggcac

SEQ ID NO: 37583 - DNA, 132 bp, Chlorella protothecoides
tccggcagtggggatggggtgcctgcctgaactgcagggcatggcctgtggggcatgccaaccgatctcacggagggtgcttgagcatggcatgctcgcccctgcacggctcagaccattgatctgaccctt

SEQ ID NO: 37584 - DNA, 87 bp, Chlorella protothecoides
catcctcctcgacagcacacaagacgcctgtcctgccccgtcaccaccccctgatttccccctccttccttcgcctcccctaggcca

SEQ ID NO: 37585 - DNA, 234 bp, Chlorella protothecoides
gggggggcaggcgtggtggatgcgagggggagggggcctggcgacgtgtgcctggacatgggggagggggagtggaatcccgcgggggttctccccatcacacggtccatcgccatgtgcgaaagggctggcggtggcctgcgtggcgaggtgtccaccttggtgggccccagaaacctaccacccgacccaaatgccccctgtccccgcacctgcagtccctggcgaggcccc

SEQ ID NO: 37586 - DNA, 956 bp, Chlorella protothecoides
  modified_base (114)..(304): a, c, t, g, unknown or other
cagcaggccgccgcccgcgccgccggcgccctccgcgcgcttgtgccgcagcgcggccggcaggccgtcctccagccgacccggctcctccagcgcccccgtccagctgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgtgcgcgccttcttctccagcagggccgatatgtcggggcgggggtcaggggcggcgccgggggcggcaccggcgccgccccccgcggcgcgcggcgtggctgcgaagccgtgggccgccgagtccagccgctccagccgctggccggggccggtgctgtacatcgtgctctggttgctcaggctctgccagtaggcgggcccaaagtccaccactgcaaaggggagggagggggagaggcgtgtgtccaacgcagtctacggacaggcgatggcgcggggggttgaccgggcatacacaggggcggcacgcaaccttgatgacgggccccggacgcaagtccctgccatggccacgctccccccccgcccagcccgccacctgcttggtcgccgttgctgacgccgctgacgcccgaggggtagcgggccagggtcccgttgccgttggagctgcgcacgttgccgggccccaggagcatggcgttcgaccccggcgtgctgctgggcgacggccccacccccgggttgtgcttgatgcgcggcgtggtccacaccatgagcggctggcggcccgtgccggggtactgcagcgggcctggcgcggcgccacgcggcggccccggcccgggcggcggcttggcgccgcc

SEQ ID NO: 37587 - DNA, 61 bp, Chlorella protothecoides
ctcatatgccacagcctgcgccagaatgtcgttggtggcatcaaggacatcttcctcgtta

SEQ ID NO: 37588 - DNA, 61 bp, Chlorella protothecoides
ccatcaccatcgccgtctgcagcgggggatacggagggggggggggggggggggggggggg

SEQ ID NO: 37589 - DNA, 67 bp, Chlorella protothecoides
caggcccagcaggacctggcggctccactttttcaccgccttcacgtccaggttcttgtgtcgctgg

SEQ ID NO: 37590 - DNA, 61 bp, Chlorella protothecoides
gccaggaagaatggatgggtagctcacttgggggaaatgcaggctgaggattattctacat

SEQ ID NO: 37591 - DNA, 2328 bp, Chlorella protothecoides
  modified_base (765)..(774): a, c, t, g, unknown or other
  modified_base (1683)..(1692): a, c, t, g, unknown or other
  modified_base (1874)..(1960): a, c, t, g, unknown or other
gtgggggtggggggggctggggggtggctctaggtgggtacagaaggttggggtccttggagggtggtgcggaccagggcgcgagtgaaggcaggcctggctggtgccccctgcaatcgcacatcgggcgcatggagccggcggccggtggcccaattgagttcccacatcccctccatcgatcctttcgcccattctccctcatccaccccacaaaccccctcgccgcgcagtttgcggggggcaaccaggtgctggcggtgtaccccgacggccctgctctggccggcgcagtgaccatgcacacgcccgggtcggggtacaccccgcactccactccggggtacgccggctccaccagctggctgaccgacgagctggtggagccggtgtactggttcgtggacctcaccacgccgctgtcggtgtcggtgctggtgggcatggcgggcgggcccaccaccgacctcgtcgtctacatggggtcggacaccagcaacatcaccgccaacgcccaggtgggcagcagcctgaccctggacctgccgggcgcggtgggcgcgctggccttcaccgacggcgtgccgcagacggggcgctacgtggtgctcgtggccgggccggatggcacctcgcccttcaacatctccgccctggaagtctaccccaaacgtgggtgctccccgtgtgtgtgctgctgtgtgtgtgtgtgaggggggtgggaaaattggtcgggaggtggggtgttggcggggggggttgggnnnnnnnnnncggaacctcccccttcaacatctccgccctggaggtctaccccaaacgtgggtgctcgtcttgtgtgtgtgtgagggggcgggggaactggcccgcagggaaggtggcgtcgtgggaggctgggaggaggggggcgcctgggcgtggccgggcaaggacacgacggccacgggcatggcgggatcaccaccacgagcgcgtcgcacgaggccggcgtgccgcgccaggcctgccgcagcgggcgccgggcccacgccgtcttctgcgtcgtcgggaccccagaactcccaccctcacctcatgtctggcaccccggcatcgcaagcctggcaaacccccctcgtctggacagtgtaccaacaaaccaacaaaatcccgcgccgcctccaccccccccctccttctccgcagtggccaacgccgcggtgaacaagccgctgaccctgtccgacggacgggtgctggagggcgggacggatgggtcgctggccacctgcctaaccatccagccctccgccagcggcaccgcctgggtcacggccgacctgggctacgtggcggcggtgacagcggtggcggcggcggtgaagaacaccgcctcggccgcgcaggccacggtgttcgtgaccaactccaccaccggcgacttcttttccctccccgccaaccagtcctgcggcaacggcggtctgcccctggaccagggcgcctactccgccctgccctgctacatccacggccgctacgtgtccatcgcggtgcccaaccagggcgcgctccagctgtgcgagctggaggtctacctgggcgccgatctggagtggcctgcgcccacgcccgacgccggcggctcgcccaacctggccgccatcatcgcccccaccgtggtcggcggcctggtcctcgccnnnnnnnnnnatctccgcagtggccaacgccgcggcgaacaagccgctgacgctgtccgacgggcgggtgctggagggcgggacggacgggtcgctgaccacctgcatcaccatccagccctcggacagcggcaccgcctgggtcacggttgacctgggctacgtggcggcggtgacggcgggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgaccaacgcgaccaccggcgacttcttctccctccccgccaaccagtcctgcggcaacggcggcctgcccctggatcagggctcctactccgccctgccctgctacatccgcggccgctacgtttccgtcgcagtgccgaaccagggggcgctccagctctgcgagctggaggtctacctgggtgcagacatagagtggcccgtgcccacccccgacgccggcggctcgctcaacctggccgccatcatcgcgcccaccgtggtcggcggcctggtcctcgccctcgtcctggcatggtgcgccgcggtctggcgcagcacgcgccggcgccgccacgcgtccgccgccgcgcgccgcgccagcg

SEQ ID NO: 37592 - DNA, 79 bp, Chlorella protothecoides
ggaggtgtgccgtgccagccctgggcaggcatgtgcgcctggacctgttctcactcgagcatgtgcagcccgtgccttt

SEQ ID NO: 37593 - DNA, 117 bp, Chlorella protothecoides
gtttgcagaattgtgagctgggcttgtgcccccagccaccccccccgcttccctttcttgctgctccgccagggccctgccctccttcgtgccttccagcagctccagtgggatgtc

SEQ ID NO: 37594 - DNA, 78 bp, Chlorella protothecoides
gaaatgggcgcaccgttgggctctggtttcatggcgcaggggaaggcaggggtgggaatccatgcgactgcatcaggc

SEQ ID NO: 37595 - DNA, 61 bp, Chlorella protothecoides
acgctcatgcgatcatccaatgatgcccaggctgcctctcgggaggcatgccgagatttgt

SEQ ID NO: 37596 - DNA, 77 bp, Chlorella protothecoides
catagatccggccatgaatccacagcctgttcatttccttcccccctcccccccttcctcccatcacaggtacaagc

SEQ ID NO: 37597 - DNA, 111 bp, Chlorella protothecoides
caggctgcgactgcctgcccctgcaatgcgcggactgtggcgcaatggggcctctcctgccctgtccactccctgctggctctggctgcatgactcttcctgctcacttca

SEQ ID NO: 37598 - DNA, 66 bp, Chlorella protothecoides
gccaagcccccgtcacttcgggcctcatgcattaatcctccccgcacaaccacgagaacccaccgc

SEQ ID NO: 37599 - DNA, 65 bp, Chlorella protothecoides
aggaacagggtgtcgcggtgacacaccgcaatgcatcggcacccccaaagtttgcaatcaagatc

SEQ ID NO: 37600 - DNA, 61 bp, Chlorella protothecoides
tggggcgacgaggacaacgatggctcacggtctgagcgcttcctgcgccccgccgaaccct

SEQ ID NO: 37601 - DNA, 70 bp, Chlorella protothecoides
agcccggcgtttctcagcggggcgcggtccgatactcgccgaggttgaaagggtcacgcgacacctggtc

SEQ ID NO: 37602 - DNA, 10916 bp, Chlorella protothecoides
  modified_base (475)..(484): a, c, t, g, unknown or other
  modified_base (930)..(939): a, c, t, g, unknown or other
  modified_base (1083)..(1092): a, c, t, g, unknown or other
  modified_base (1165)..(1174): a, c, t, g, unknown or other
  modified_base (1637)..(1646): a, c, t, g, unknown or other
  modified_base (2266)..(2275): a, c, t, g, unknown or other
  modified_base (2939)..(2948): a, c, t, g, unknown or other
  modified_base (3224)..(3233): a, c, t, g, unknown or other
  modified_base (4147)..(4156): a, c, t, g, unknown or other
  modified_base (4466)..(4475): a, c, t, g, unknown or other
  modified_base (4638)..(4647): a, c, t, g, unknown or other
  modified_base (4717)..(4836): a, c, t, g, unknown or other
  modified_base (5784)..(5793): a, c, t, g, unknown or other
  modified_base (6232)..(6241): a, c, t, g, unknown or other
  modified_base (7669)..(7678): a, c, t, g, unknown or other
  modified_base (8083)..(8092): a, c, t, g, unknown or other
  modified_base (8467)..(8476): a, c, t, g, unknown or other
  modified_base (8698)..(8707): a, c, t, g, unknown or other
cagtgccgcggcggccgcgccgcgccccgcgcccgacagcagcagccagcgcggggactccggcagccaggccatgccggccgcgagggccgcggcgggggcagtcgcggcgcccagcatccagcgccagccgccgctggcgtccacccaggcgtagctggcggcgtagccggccaggatgcccagcaccaccaccgcctccttcagggagatgaacaggccacgcgcacgagcggggctggtctcggcgatgtaggcaggcgcggcgtgcatggcgaagccgatgcccaggccgaacagcgcgcgtgcggccagcaccgcgcccagggagggcgccagcgcgccacccgccgcgccgccggcgtacaggcccgcggccagcagcagctcgccgcggcggcctgccggtcgcccaccacaaaggcggcgggggagcccagcagcgcgccgcccagtgagctgctcaccaccaggnnnnnnnnnncagccggtcgcccaccacgaaggcggcggcggagcccagcagtgcgccgcccagtgagctgctcaccaccaggccggtgaggaggggggagagggcgtaccagtccgtcccactcagcgtggggctggtcatggacacgatggcgccgctgctggcgccgatgtcgtagccgaacaggaagccgcccagggcggggaagaggaagagcagggaggcaaaggcccagtcggggtcgggaaggggttttggggcgtctgggcgccgtggcacgagcggggcggtctccacgtcgaaggcctggcgtggcggctgcagggcggcaaaggagggtttttgatggagcagggttgggagttgatttgcaggagcaggtgcgtcgattcaggacatgccactgccaccgcatcctgagtctgggccactccgtgtgcggtacatcggctgcnnnnnnnnnncggcggctgcagggcggcaaaggagggtttctgatggagcagggttgggagttgagttgcaggagcaggtgcgttgattcaggacatgccattgccaccgtatcctgagtcgagggccactccgtgtgcggtacatcggctgcnnnnnnnnnntccgtgcggcagccgggctagaccaaggcagggtaaccatatatcccagagtcagatgcgcgggggcagcacnnnnnnnnnnccgcccacgctggtacgagcctacctcaggcatggccctgggcaagccgtgcggggatcgggcgggggacctgatcctgatggtaggcccagtcatcgcatgctgcgttctgtaggcagacgggggccatgcatttggtgtggaccgtgaggcagccgggcttgaccaaggcagggtaaccataaatcccagagtcagatgcgcgggggcagcacctctacatgcccaaaagccgtatgcaatgccatcgcatgtcccattacccccataaggttcagaaacctacatgcgcgcagcccaggcgggggagggagggctccggcacgggtcgcgcagccgacgggaggcgcggaagccgagagtgccgctacggtcgaggcgggcgcatgtggatcccctttgcaggccagagtttgatacacgtgggcgatcaatgccctgcaggattgagcgcgtcaagtgnnnnnnnnnnggtgccgctacggtcgagccgggcgcatgtgaatcccctttgcaggccagagtttgatatacgtgggcgatgaatgccctgcaggattgagcgcgtcaagtgatcggcccggcaggtggagcctgctgcggggacgcacgccggtgcattcatgccggatgcacctcgaggagagggaggcgcgccgagagcccaacggatgcgttgcaaggaagtatctatgcatgcatcaaaacagaccgcatggggagctaagacatcagcctattcatcgtgtccgaattttctggtgggcatgatggtgtccaagccacggtcatgaatccactggattcccatctcctgatcattagagcacgcgccgtaacggtgaccccgagagacccaaagcaaaccatgctctgatatcagtccagtgtgcagtactcactcaaggttgcgaatccgaatgcaaattcctactcctccaacctcaaagtgaaaggtggtgacacaggtgaatggtgctcagttctgcacaccgtttcgcttagaatattattcagtgcacccactccacatcccagaacgctcactcgctgttcttaagtgcgtgaggggcgacagcggtgggaacgaannnnnnnnnngattcctactcctccaacctgaaggtgaaaggtggtgacacaggtgtatggtgctcagttctgcacaccgtttcgcttagaatattactcagtgcacccactccacatcccaaaacgctcactcgctgtgcttaactgcgtgaggggcgacagcggtgggaacgaaaatcctgagcctctttgcaagagtcaattgagttgaacggctgatgcaggcaaccaggttcagacgagtttcagacgttcagggaggctttcgcaccctctagaagatatcgtaggtggaaaaatacatgtcgaaagctttgatgtgcaaatatatgttattcggctgagaaatgctcagtgcagggagaatcattccatcaagactctcacgcattttggacttccggtgatactccgcacaaaattcacttttggcatcgctgcttcccggtacaccgctgtactgatccgagtacatgggccagtggtctacgccgtggcgtttaggtttggccaccgatttcccgtcggtgactccctcgcaagagggttcatgaaacccgccatccgagagggcgcaggttcgaatcctgctgtactcatctcatttcctatcccggcagcatgtggtcttttgcaaacccgaccttgctgctcaaggatctctcactgctcnnnnnnnnnngtttcctatcccggcagcatgtgggcttttgcagaccctaccttgctgctcaaggatctctcactgctctcgcctcgttgttgaaaagaagcagggccctgaatcaccgtgcgattactttgcaaactgtttccttgaacagcagatggcaggtcaatatcaatgtggagggctgcacaggcagcggccaagccctttttcgcctccaccctggaggagcgcaggggaggcgcgtcctcaccgccccagcatggaagtgggcatggtgctgtcgannnnnnnnnnaacaggcagcggccaagccccttttcgcctccagcctggaggagcgcaggggaggcgcgtgctcaccgctccagcatggaagtgggcatggtgctgtcgagctcggtgccctccgacatgcaatgccaggcggggcccagtccccaaaactctctccaggtctcggacggcacaggccctcccccggcctgggggagacccagcgccggcgctcagaacagcatctgctgctccaggctggggtggatgccctcgcccatcgccccgccgggtaggggcatgaaggcggccatggtccccgggtccagggccccctccgcggcagtgcaggggtcgggcagggggcgcagcgacgcgtcctccagcgcgtagttgaacatgccggcgtagcccttgagcagcagcagcatgacctcgggggtggggacaaaggccacccccggcgcggcgccaggcagcacggccgtcgcgacggccgtgccggccggagcgccatcaccctcccgcgtgttggccggcggggccggcgccgcgcctgcgatcggaacgccgtaccgcccctggaccccagctccgccgccgccgccgctgccggcggcggagcactcaccggcgcactctgccgcgccgcgcgcgtcgggggggtgcagaccgcgcagtgagaccagtgcctggagctgcgccagctggactgggtctggaggccgcccgctctgcgctgcctgggtattggaatgtggcaagggcattctgtgctgtcttccttttcaaggggatgggggagtgggagcggcatgtgccttggcacgacatcccttcaaccagccccatatggcactgcccacgcccgctgtgccattctacaaacgcctgacaatcaattcaccccaccggccttgcctgtaagagggcgnnnnnnnnnncgttcaagaggatgggggagtgggagtggcatgtgcctcggcacgacatcccttcaaccagccccatatggcactgctcacgcccgctgtgccatcctacaaacgcctgacaatcaagccaccccaccggccttgcctgtaagagggcgttggaggcgagctgcaaggcctcctgcatgacctgcacatcccgctgtcctaaaggggcgccggggacgagcggccgcagcccatcctcctcctcgttgggccgtttccttcgacgctgattgtgccgctgggaagggagagggagggaggaaggacctgnnnnnnnnnntgctgggccataccgccggccgagctccccgcacacacctgcagcctgacccggcaggagcgcttggtgtcgtcaaagtcctccaggggctgatagcgcccgcactgctggcagaagcgggagcgcacgccattgcgcatgatgcagtcgaccttgaggtggnnnnnnnnnnctctcagcgtacgagatgttgcatggaaatctcctgctaccccagccacagccaggcctgtgcagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaccgcccgcactgctggcagaagcgggagcgtacgccgttgcgcatgatgcagtcgaccttgaggtggtactcgcacaccttgtagcgctgtgagtagagagggtgtgtgtgtgtgtgtgttgggttcgtgacgatgatgagtccttgagggagacaccgtggctctgctctgaggatgcacgcagggtgcgagaaggaagtggagggaacacggagtccttgcaagcacgagtgcatgcccttcgcagagcacagcatgacgacagaacaggcacccttgccatgtgcacacccggtggtactccttgaggccctccagctgggctccacagccctccacttggcagtagagaggccctgcagaaggattgtgagtgatctggaccatgcctggtgccggcagtcgatgcgcctgtcagagaataggcgctgatgtcgcagcgggtacagccgcaaagcactccatgagaccacgttgggccattttctttccccccctgccattcagctcaccgctccggcctttcaaggccatgccaggccctgtgagggagtcatgcccgccagaaacgccctgctcatgcccggggctgtccagcggactctgtcccgaggcctgctccggggcttccaccagtggcgcgaagctccccagcagggagatggactgcaggccctgcatggctcccaggtccagcccggggcctgtggggtacccctgcatgggctccgcggtacagtcctccctgtcctgccgctgtcctgcgcggtacacttccgagacgacacactcggactaccttcacccaggtatgttctaaatttgtgacagacacaattaacaacgcagagttaaagaacgactttgcgagttgaagcttgcttgtgctacctgttgcctctggggctgcgccgcgtccgatgctgctgcctggcttttccgtnnnnnnnnnngattttgtgagagacacaattaacaacgcagagttgaagaacgactttgcgagttgacgcttgcatgtcctccctgttgcctccggggctgcgcagcgtccgatgctgctgcctggcttttccgtcggacaggcgattttccctgtgatgatcagagctgtgcaggtccattgggcccgctgatcaaatgtgtgaattacatacaaggacacactgataggattacaacaaagtggcatgttgctcgctcctttgggctccaggctgctctgatacacccatctatggaatctgcctgcctcactaggtatcagagttccatgatgcatacaaacaataggacactccgctcacatatgcatgaaggggatggtaatcctctcctttagacttcattaatctggttgtctcggtggacatgctccctgttgcagaccgnnnnnnnnnngtcagagttctatggcgcataaaaacaataggacactccgctcacatatgcataaagggttggtaatcctcttctttagacttcattaatctggttgcctcggtggacatgctccctgttgcagaccgggagcatccccccagcttgccaagccatggtatgcaaggggcttcgtaccttgctcccctttgagaaccgaggaggtgccctgtcttcctgggagagccctaaaggtcttgacgtacaacatccttgcggactgcctgaccacacggtgaatgtgtagggaagcagtcagcatgggagtaagacagcatgcatgcaccgaatgacgtaagatgcagtttcaaggacagaatcacagaattgcatgctctggtcaaagcaaagcaaatccttgcaattgcaggatgcgatccgagtatgatgccgcagtactggacccagtcagacgcgtggccttgctcatggcgggcctgcaggcactggatgctgatctgtacttcctgcaggaggtggaggaggggctgatggagaccctgcgcgaaatgatgtcaggtcacgaggtgggttggagcagaaggatgtgcatacatgtgttttccggccaggcagtttgctaccccggactggcagtctgcctctgcagcagaaccaaaccacgggtgaggactcatatccttgtcctcgctgctattttggagcggcgcaggtgcattgctcccttgcggatgcactacacagcggcaagcgcgtggggatctgcctgctctggcgatgtgcccgtttgcagcctctcgccagccttgagcagcggtgggtcggggtcctgggttgttgtagggccgatggagagagcctggcgctttggtcccagtcatcgacgaggtagactcccggttgccaaggggatctcgcacggctcccgatgccgagcacccccagcagcatgacgctgaggagtcttcccccacatgcaaatgccacttggacctgcggccccttctccccaccaccgcccagactggacgccgtcgtgttggagccaggcgacaccgcgccctttgcgctgagagcacgcgcgctggacgagaccgtgctcgtcaagaggttcttggatttggagaccggacgggcattctgcgcggcagtcacgcacctgtactaccaccctcgccaccccgacctcaaggtatgctgcatgcgatgcagggccccttggctttggatgtgcaagcaatgatgatccccttcaatgatcccgccctcccctgtttcactgtcaccctggtgtgtacatcgattgctcgtgtattctcctccattatacgacatccctcccctgccaacaacgtgaccaagcggttctgccacactcctctgagcaggttctccaggcgcacgccgcctgtgcggctgtgcgcgccnnnnnnnnnngatgatcctgccctcccctctttcactgtcaccctggtgtgtacatcgactgctcgtgtattctcctctattatacgacatccctcccctgccaacaacgtgaccaaacgatcctgccacactcctctgagcaggttttccaagcgcacgccgcctgtgcggctgtgcgcgcctttgcatcagcccaaggtggaccgcagcccctccttctggccggcgacttcaactccctcgccgagaagcgcgtgtcggacgagtttgacgagggtgcgctcagcgttgtgcttagcagcggtttgaatgggagcaggcagggggggtgcatgtggtaggcggcgagacaatggaatcccatgatttgggaaccttgcgtggtcccaccttcttcaccctcctgtcttctcnnnnnnnnnntggtaggcagcgagacaatggaatcccatgagttgggaaccttgcgtagtcccaccttcttcaccctcctgtcttctcagttccggagggctgcatcaaggtcagcggcgtgtatgagctgctgagtcaggggcgggtggccctctccaactcagaccaccctgccagccgcaactcgccggccgagcttgggcgcctgagggacgtgagttgtgaggccttggagtgcccgggaaaaggaagctggattgggaatggctctcgcttgtatggcagttctccttggttgcatttgcattttgctcggctggctgggactcttggagtggtgcatgggatcaatacctggtggggctgcatgggcagaggagcttnnnnnnnnnngagttctccttggttgcatttgcattctgccccgctggctgggactcttgcagttgtgcatggggttgatgcctggtggggctgcatgggcagaggagcttccgggaagggcgtgcgggttgcctccccggtcacgcttgaaccaagcatcggccaccgcgccggccgagagcatcggaaaggggaggccatgtgcacaccccatggcgcaggtggagtggnnnnnnnnnnggggttgcctccccggtcacgcttgcaccaagcatcggccgccgcgccggccgggagcatcgggaaggggaggccctgtgcacaccccatggcgcaggtggagtggaccagcacagggctgagcctggaaagcgcggcggtgagggcctgggggcgggagccaagcttcaccaaccacacaccctccttcacggggtgcctggactacgtctggctgagccgcggggattggcaggtggtcggcgccatggccatgccaggcggctcagagggcggggagcccaaccaggcggcacctggataccggccgctgcccagtgccgcggaaccctctgatcacgtggccctgggcttctgcttgaggctggtgagggcaggtggagccaaccccgaagggcagcgtaaacaagtttgcatgacgacctcgacggcagattctctgaaatgtatggctggcctcagcatataattgaccttccttgtgctgaaatccacctgatggacatcacacagggagagcactgatcacagaagtgagtcatgcagcagcgttcgctcacgtgcctgttgccattcgagcatccggaaaacccccttcgcaatactcttccctcctccccccccaccccacccccccgcagccgctgacggtgaattcggcccattccggatgacacattcaggcgttccaagatgtcgcaaggattgtgttgggcctgacactaagaaaacaagtacagaacttcccttttcgcgccagcatgttgcgaggggtggaggatgttgagtggaacatgtgccggcaacggcttcagctagattcccgcaacacgctcccgcaccctcggggggtagtcaggcgtatcagcacatgggtgacgaattatattgaacatttcatgtctacattcctctacatgtcgattgttttgcccacatgggtgctgaggaggcccgccgggcatcagtcctgccttttccagcgcggcgccctttcttcgaatctgcagctgcgatcaccggggggcaccgtgacccgcaccttccaggaccgcccttcccttctccgtgaacagatcgggtcctattttaaagacattcgacagaatagcgctcagtcgccaagcctcaggcggcgcacgagcgggctacgaagtcgcccagcacgtcgtcttcaaggcacaacctcccctttcctccggacctcgtccagacgcctctcaggccccattttgattgccgatacaagcctttgattgagttgagcaccccatctccgtgagctggtgcgcgcgagcttgacgcactccgcacgagcacgcgttgcccgtcctctgacaaacctcgcgactgccggtgggccgggtgcccgaacggcaatggctgcagaggagcagctcctccagccgttcagggagcacagcgccctgctggtgagccgagggtgttcggcgctgggacgcagcggggtctggcatccagcatgaaacgggagctccctccctccgacactggaaggtccaacggaaagcatctcgctgccagggccctgaccccaacccctgcccccttgctcacaacgctcatgtccacttcacccccaggacgaacatttggcgagctttttcggccccgcgggcgcctcacggacggggcaccccggccgtccggactgcatcaacgagtacggttccctgctggaggacgccagcgggcccgggccccagaaatggactcgactgagtaggatgctgccgtcgggattgaatctggatgtcctggaggagacccccgccccccgcccgggccaccggtcagcctcggagccacccccacagctggggaccgcccgagcagacccggcaccggcaggcgccgccccgggatccccggtcctccagccgccccgcatcccgcgtatgaccatcaagctggggggcagggtggtggcctccacggggccgggcgcccccaaaccccccatggcgccgccccgcccccttcccgcggccccggccgtgcaggccatcctgcgcagcctggatgggctgggggcggtgcccgcgctggtgtccccactgccccccacctggtcggccagcgtgcgtggcggggcaggccccgagcggcgcgagtcggagccggcgcacccgtcggtccggccgcaggagggcgccccggctgcgaagcgggcgcgccggggcgcagt

SEQ ID NO: 37603 - DNA, 396 bp, Chlorella protothecoides
  modified_base (142)..(275): a, c, t, g, unknown or other
gctggagggtcgggtggagcggctgggctgcgcgccggccgcgctggggccgctggccccggccacgccgcgcctgctgcccagcgtgcacctgttctgggagccagtcgtgctggccctggacgactggcgcgtgccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcctgcgccgcttcggcaaggaggccgcgccgcgcctgcgccgcctgctggcggatggggcggtgcggcgcggacaggggcccccgctcccgggccgcgaccgcgcggacgcgccggg

SEQ ID NO: 37604 - DNA, 166 bp, Chlorella protothecoides
ggttgaggggggaggaggctgtgacagggccgggagagagggcgatgcaacaatgctgacagtggaggaacagactcattcatctcacatgggaaaaggtcatgacgtctccgacatctgaccactgcccctcttatccccatacgcaggggtctgagccagcgtc

SEQ ID NO: 37605 - DNA, 68 bp, Chlorella protothecoides
ctcttggaaaatctcctcccccccccccccttgatctacagagaatcccaagatcacgctcaagtgtg

SEQ ID NO: 37606 - DNA, 73 bp, Chlorella protothecoides
gaacgtagaacatgatggcgttgatgcctgagggggagttgaagggaaggggctcgtgggaaggctgtcaggg

SEQ ID NO: 37607 - DNA, 61 bp, Chlorella protothecoides
ggatggcgctgggcgtgttgctcttaatatctgcagagctggcaggctgccagcatcaatc

SEQ ID NO: 37608 - DNA, 61 bp, Chlorella protothecoides
taccagcacatggtctggattctgtggctaacccataacgccacccatcatgcgacattac

SEQ ID NO: 37609 - DNA, 61 bp, Chlorella protothecoides
tctcttgccgagggggtgcccgttgctcattcccaatcccgccacgaccatgggtgggggt

SEQ ID NO: 37610 - DNA, 61 bp, Chlorella protothecoides
caaggtagtgcaggacgtaccccggctccgacaggtgtcgctccagccccagctccaggat

SEQ ID NO: 37611 - DNA, 69 bp, Chlorella protothecoides
gggatcagggtcagagctgcggtgcccaagggcgtgatgcccggccccagccgccctcgcgccggtggc

SEQ ID NO: 37612 - DNA, 61 bp, Chlorella protothecoides
caccgacgccatgttcgacatccaggtcaaacgcatccacgagtacaagcgccagctgctc

SEQ ID NO: 37613 - DNA, 121 bp, Chlorella protothecoides
gggtttggggggggggggggggggggggggttgctgcgttcgggggcgtgcatcatccagagccaggcagacatagaccccagaatgcactcaccccatcatcgccagccggcagggctgc

SEQ ID NO: 37614 - DNA, 8150 bp, Chlorella protothecoides
  modified_base (225)..(234): a, c, t, g, unknown or other
  modified_base (394)..(403): a, c, t, g, unknown or other
  modified_base (753)..(762): a, c, t, g, unknown or other
  modified_base (847)..(856): a, c, t, g, unknown or other
  modified_base (1166)..(1175): a, c, t, g, unknown or other
  modified_base (1285)..(1294): a, c, t, g, unknown or other
  modified_base (1674)..(1683): a, c, t, g, unknown or other
  modified_base (2171)..(2180): a, c, t, g, unknown or other
  modified_base (4333)..(4342): a, c, t, g, unknown or other
  modified_base (5392)..(5401): a, c, t, g, unknown or other
  modified_base (6113)..(6122): a, c, t, g, unknown or other
  modified_base (6746)..(6755): a, c, t, g, unknown or other
  modified_base (7996)..(8031): a, c, t, g, unknown or other
cggccgaggggcccggcacgggctgcgcggcgagcgtggcggcggccgtggggtccgcggtcgccagcgcgcgggccagcgcctctctttcctccccagcccgcagcacggccagggacgcggcccggacctcgctcgccagctcgtcctgtcgggggtggttgggatggagctggggtgggtgtgggaggcgaaggaggcggccaggcgactgcagggtcacgnnnnnnnnnnagatggagctgggggtgtgtgggaggcaggaggaggcggccaggcgactgcagggtcacgtgaggaatggcagcaggggtggccacggggagcgaggctcaggcctggagactgagtgcacagaccacggcctcccggcctgactcgtgtcgtgcagcgnnnnnnnnnncctggcctggagactgagtgcacggaccacagcctcccggcctgactcgtgtcgtgcagcggaggcatcgcccctgcccacccttgccacccccgaccatgcatctgttaccagttccaccccctcgaggccccgtgtgacgccgccctccccagcctccccccccactcaccctctcggcctgcagcttgtcgacctccagctcggcggcgcgcaggcggcgccccgcgtcgaccatggctgcccccagggcctcgtccctggaaagcatggaatgtaggtcgtggtccagttggtgggaggacccggccccagactcatacaccgccagccgctgcctgcggggtggnnnnnnnnnngacgattgagtgtccgacatggtgcagagaccttggttcccaacgtcaagttcaagctccagactccaccaaacagggtgtgatnnnnnnnnnnggtgcggggcactgagaagcgagcggccagatgctgcgttgtgtgagggttcgggggttgcacgaggtatgacacagttgagtgtccgaaatggtgcagagaccttggttcccgacgtcaagttccagctccagactccaccaaacagggtgtgatgccgatgtccaaaccacacaccgcatcgccccagccatccgacattgaatgactgcctcacacctcacccccggcctctggattcacgcgttcgcagcccctgccctccccctccaaccgccaccccccccccagcccggaagcctctcacttnnnnnnnnnntacaccgcatcgccccagccatccgacatgaaacgactgcctcacacctcttccccggcctctggattcacgcattcgcagcccctgccctccccctccaacccccaccnnnnnnnnnnaccacggggcggttgcggatgttgcgcgcgcgcgaggcgtagcgcagcgtgttcatgctttcctccaggttgatgtcggcgggggacacgcaggccaccatcagcgtccggctgttgccccccagcgagtcctgcgcggccgggagcggtcgggagacggccatcagcggcggaaaggcaggtcgtggagcggaccgggcgagtgtgatgcgtcagcagcgaggacatcgagaggggtcggggtggcacgccgtggtgcgaggagggtaggaggttggggcgcaggttcgtggtggaagcagtgagtgcaccgacacccaccctcccatcgtccccaccccaaaggcctcagcgcggatgctgctcctgtctgctctccnnnnnnnnnngaggaggttggggcgcaggtgcgtggtggaagcagtgagtgcagcgacacccacccccccatcttccccaccccaacgacctccagcgcggatgctgctcctgtctgctctcccacggacgcacacccgtggatgcacatgacctcactccccctgtttcccagcttgcacgcgcctgcagcatgcgcgtcagcttggagttgcggtaggggacgtggggcttgccctccgacagcgcgctgatcacattgcccagctcgctgaggcccttgttgatgtcgatgccctcctggaggcgggcccccgtggcgccggtgcgcttgagcctctcggaacctgggggagagggagagggtgggggggggaggggggcgcgggtgtggagaatgcgagagggagggagaggggggccggggaggaggtaccccatgcgcccgatcaggcacccgtgagacaaaccaggtaccaccgagacgcacggcgctggnnnnnnnnnntggagaatgcgagagggagggagagggggaccggggaggagataccccgtgcgcccgatcaggcacccgtgagacacaccaggtaccaccgagacgcacggcgctgggtgggtctgggggggccaggcaggtgcagggcatgggagggcatgctccctcagcgcaccgcatgctcgcctacccgggaatgcgaggcacacgccaccgtggccggcggggtgccggccagcccctctgccctcctccagggtcccccacaagcgcgcacctgcgaggtccacgaggtgcagcttggcgcagaggtaggaccccgccccgccctcgtcctcgccgggcgcggccgcttgcggcgcctcctccgccgcgtcgtcctcggcctcgtccccgctgcgcccgccgccgtgcgtgtcctcctgcgaggccgttgagcagcggcgcggcccgcctgcaccatcctcgccctcctccatccgccgctgctccacggtgacggtgaagatggcgtgggagcgggaggagcggcggttcatgcccgtggcagcggtggcgcgcagcacgctgcccgcctccagcaccgcggccagctcctcgcggctggtcacctccatctcggcagcgccggcgaggcagacgccctggcccggcacctcgcggatcttgatgccggcgccgccccccgcgccgccgcccccgacggcggcggtcagcaggtcccggatctcctcgttgtggatctctacaaatcccacgcgcacggtgcagtgcatggcggggcgctgggtcacgtggccaaacaggtcctccatggcgcgagggatgacgccgcgggcctcctcgggccgcgcgccgaagccgctgctgcccatggtgaaggtcttgccggagccggtctggccgtaggcaaacacagtggcattgtagccagagaacaggccctccaccagcggcgccacgcaggcgccgtacagctcccaggcggggcgccccatgtctccgccaaagacgtggtcgtaggtgaagcggtgggcgccatgcccaacctgggaggagaggggggggtgtgattggggaacagcaggtggggcctcgactgactcaggcaggcactgggcgcaggtgctcaacagggaagggagtggacacctgtttcccccttgctgatggggtcggcacgatcgctcgatgaccggcatgagcagccgcttccaccgtactcgactgcgcgtattcgtcggcagcactcaaaggggcccccccaccataagtcgcacctgtggcaggccgggggtgacggtgagggcgtgctcgcacccctccgccagctccgattcaatgaggggccgcacgtggacggccacgcacacgcactcggccttggaggcctctgtatcgggggtgtggggctcagcgggggccttggagggcggcgaggacgctcccgccatgttcaaagggtcggcctcacgggcaggagggggggcagggcgcgggacggggcctcgacccctggagggcgcacccctgggccccgatcagtcgatacatgcgatgcgatggatatacgatgaacaggtcctagggaacaggccagggctgtcaggggctcgtcaggaccgtggtcacgcagggccggtctctaccagctgcgacgatgtatttggaagggtgctgaaaagaaagtgtcgctggtgatgttgtccctggggggtgcttcattcattgggtgaaatcccaatgttcagtcgaatcctcctcagcgcgagctttcagagtgccaataaatcaagcaagtatctagagacgccaggccttgcagcaacaatatcaaaatctggggtcccgcagtaaggcatgagcacagctatgcacatcatgtgcaccccttccccatgcaatggatggagcacttgatcacaatccagggtggcaaaacccctggggcgtacgtgctgatcacgattgctctaccgaccagctggcagccacgggccacaggcaggcatgagctggtgaggcggtggatccaggatgctcaagggtcgggaggctcgcctgctgctctgcggttcaggaccctgaccagcgcaccgacatgagcccctgcacgcgcccacatcctcccgggggctccagtgccacctgacctgctgggnnnnnnnnnntgcaacccccctggggcgtacgtgctgatcacgatggctctaccgaccagctggcagccacaggccacatgcaggcatgagctgaggaggcggtgtatcaaggatggtcaggggttggaaggctcgcctgctgctcagcggctcaggatcctgatcagcgcaccgacgtgagcccctgcacgcgcccacattctcctgggggctccagtgccacctgacctgctgggccggcctggcaagcacgcggtcgttgcatcagtcgcagcacatggcttccacccgctcaggcccctggctgccggctgctcccccgcccctgccgccgccacccgcctccgcctggaagcccatgccctggccccccgtggccaggagccagtcgcggtagcgcctgaggtccttgtcctccggctccacctcgcgccacaggccccggcagaacatgtggtaggcgtccgccccgtaccgacccacgccgtggagctcctgcgggtcccgccagtccttgtgggcatagtcccaggacaggcgctggatggcctccgcccgcttgttggccaggcccaggggctggatgagggcctggatgcgggccacgtgggtggccgctgccaccaaggggccggggcacatgtcgaagagcgtccagatgacggagcgcacggcccggctcgtggtcttgttcaggagcatgcaggccaccagcagcttccaggggtcagggtagagctcctcctccagcagaccgtagggcgagatgggtgggtgccacagcgcgacgcgggggtcctcggggagcaggcgggggctcgccgggcctggaccctggtgggtgtgtgcaaggggagaggcaggtatgggtgtccgacgatggggttgatcatgcgctggggaatgagctcgtcagcggcagtcaggggcacaggaatggctgtgtacgaggcagtgctggagcacgccacagctctgcagcaaactgccgttgaatgcagcctcccaacctgaatgcagcgggacctccacagggagtttcagaaaggatgtgccctnnnnnnnnnngggcagtgctggagcacgccagagctctgcagcaaactgccgttgaacacagcctcccaacctgaatgcagcgggaccgccacagggagtttcagaaaggatgtgccctgcatcaggcgcaagagctcagatccccctctcccccaccaagccactgacgccaccttgcacatccgcttcagagggggagagagcggcgatggatgggaggtgtcggatttaccactcagccgccgcttccgggcctcctccatccccacctccagcttcttccggaagtctgccgcaggaacggcatgggccggtgaagggggcggggccgtggatgtactgccgctgctcactgtgccatgggacggcgagcagctgcctgacggctggaccctgcggaatttggagggcggtgggccatctggccctggcaggggcgcagcttcggggccttccctttgcctcacgctcccggtggcagcagcgaatgcctgcttgcccggaacaggtgatgcctcctgctcgacccggcggaatttagccggcggggcggcgcacgctcctgtttgggactgcgcctttgaagcggccggcgcttcggctgggaagcagcgcttggagggtccagtctgggagttgttctgcagatagacattgagagagtgagacggaggacccttcatcattctgtttaattcagttagagccctgagatagcgcnnnnnnnnnnatgttctgcagatgaacattgagagagcgagatgggggacccttcatcaatctttttaattcagttagagccctgagatagcgcacgaacacattactttgtgcattctgacctcaacactccacaactcctaggctgcagccccaccgctaactcgcacctgcttgagctgcgcagggcctcgtggagcattcgctgcagcgccacgcctgccaagtctactgccgagctccctcttctgacgcttgatcctccgggcttcgggactgagtgcccgacagcgcccgcatcccctgacggcccaccgacacttggggcagcccagggccacagcctcgtcgtggccttgcaggtgctcgatacttgccccgtcatgcatgtgaatttgggagtggcaagtgcatcgtgacgtccgcagtaggaccagggcgcctcgggcacagtataggctgcggtgctctccccagatcacttcctgcgcagctccccacgtggggttcccacagcgacttgcgggagcacaccatcgtctctcagtgcgcgcgcgcaggcaatgctttcacatgacgagggtatcgatcgatttgttttcctgctctggactggggcaagatcacacacccnnnnnnnnnnacccacagcgacttgcagggagcacaccgtcgtctcagtgcgcgcgcgcaggcaatactttcacatgacgagggtatccattgatttgttttcttgctctggactggggcaagatcacacaccctcaacttgcggcctacgagaggtgtcgggggtgcacaggggaccccggctgggcctgcgcgacccgcagtgtgcctctcgccatccatttcaatcagcatcgtccatccagtgactttgcggcatctcgcctgccctagctcatctctgagcatggagtgacagccgcaggctctcctgggcatggacccgtacggagccgggcccaatggcttcacacccgcccagctggatgtgctgcgctgtcagatagtggtgtataagcagctccgcgcggcgccggatcagcccatcccccctcagacgctggcagggtcgatcccccctcccctgacgcgggtgggccagggccctactcctgtggaaaaggtggagggagggccagcagcgcacgccctccagcctgcagcgccccaggctactgacgctgcaggccggggtgtcaagccccaggtggcggtgagcgtcggagcaagggacgagccaggatcagccccgacgtcgtcaccgcgcagggagggcggcgtgaaggtggacgaggcgcccctcgtctacaaagtgccccaggtgggtggcctgcccggtttggtacctggattatggcaggggggctgggcctggccatggcgctgcatgacagaaatgtaggtgcgtcctgcgatcctccgcggccctcgatcctctgcggccctcgtgatccgtgacaagatgtgtgcagccccggcagcgctggcaggtggatggtcgagtgtcggttctgtatggccctcgtgacgcggtgcacactccttccattgtgattgacagtcgggaccgctgtacgagctggcggcggcccacgatccgacaccggcctcctccaagcatggcccatccctgcccacgctgccgtatgccctgaacatcctgcccctcctgcagtccgagtttgcccgcctcgtgacgcagtgagttcagggcgttgtgcctgggtggacagtgtcaaggggggttggcaagctgcccggccctacacatgtgcctgtcctgtgccgatgtggggcgctgaatgggtcgtcacccacatcccccttcaccctccgcccttcccacctgccacaggcgccagcgtgaggccnnnnnnnnnnnnnnnnnnnnnnnnnnnnnnnnnnnnttgcgtggaggagccctgccctgccccgcgggcaggccgcgctgcaggcgcgcaggctggcgctgctgccgcgccagcacgcgctgcgcgcggcggtggaggccgcgcaggccgagatc

SEQ ID NO: 37615 - DNA, 198 bp, Chlorella protothecoides
tcagggcgcgagccagggtggacaccgccaacttgcccggggcgggggagggtcgcaaggggtgcgagggtgtcaggcagggtgcctggtgagagggtgtgtgtgtaggggggggtgaggacctcttgccgaaggctcctgcctccagccggctccctggagctcaggacacaggcaaggcatcctcctgcctgcatg

SEQ ID NO: 37616 - DNA, 61 bp, Chlorella protothecoides
ccccgcatgctggaacacgagctgggggggcacggcggagcgcggccgcttggcgtcctgg

SEQ ID NO: 37617 - DNA, 1505 bp, Chlorella protothecoides
  modified_base (94)..(103): a, c, t, g, unknown or other
  modified_base (312)..(321): a, c, t, g, unknown or other
  modified_base (540)..(740): a, c, t, g, unknown or other
catcacgcgccccatctgcagcacctggaaacagaatgtggaggggtgcagcgatgtgtgtgaccacttgctgtgctcaagacacagagcacannnnnnnnnntttgaacgtggaggggtgcagcgatgtgtgtgcccacttgctgtgctcaagacacagagcacagttacgatcctggctgctgatgtctggtaccgtctcatcgcaggtgtgggcatcggccgtgccggtgatcagcgtaacacagtcatctgccaggtgttcctccagcaccatgatctggggcgtctcctcccccgggcagccccgannnnnnnnnncacgatcctggctgctgatgtctggtatcgtctcgttgcaggtgtgggcatcggccgtgccactgatcagcgtaacacagtcatctgccacgtgttcctccagcaccatgatttggggcgtctcctcccccgggcagccccgaccagtgcttctttgctcccccacctgtgtgccatggccctcccaacagctttccctcccctctcaacaggcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgtgtgtggggagggggggggtgcaagggcgcatgtgcgttgctgggtgaggggcgcagcggggtcctgggattcgccaccaacagggtccccagtgccttaccggtaacccccgtgaaccccctccctccctaaggcagacacctttgcctcacctgaggaacacctcggcccggacctctggcgggaaactggtgaccagcgaggcaaagtccatgtcggcggcgccgggcgcggggcccccgcccgccgcgcgcgccgtctcgcgcgcctccgcctcccgcgccagccgccgctcgcgccgcgcctgctccagcacctcggcctgcagctcgggcggcagcgcagccaggaactcggggtcgatgccgctcgtgctggactcccgctccagcggcgcttcgccgcccgcgccgccggccggtcctgcggccccttcctcgtcctcgtcctcctcctccccttcctctggctcctcaccggcgctcagcatgtcggcgtcgctgccggcgcccaggatctcggcgcgcaggccttcgggaagcacctccaggaaggcggcgtcgatgggcgcggggcctgcggcagcttctgcgtcggtcggtccgcgctccgccgccgcgccgcccgcgctgtgtcgcatcgcggccgccagggcgctactgaacgcgtcctgcccgatgacgcccgcggcggctggggctggaggtgttgctgtagtagtcggggccgcggccggtgccgcagcaggggccgcggcc

SEQ ID NO: 37618 - DNA, 138 bp, Chlorella protothecoides
gcagtcggggccgtagcccacgacccccggccgccggccggcggtcgaggggctggcgccgccgtcctgcgacgcgccgcgcggcgtcgtgctgatggtcggcatgggcccggcgtcggtcgggacagggttcgtgac

SEQ ID NO: 37619 - DNA, 147 bp, Chlorella protothecoides
ggccaccttgcccactgcggcaaagggggggagggcaaggcacgtttcgaggtgccaggccctgctgggtcatcagggcatgcatggctgtacgtaagctccagacctgatcaaggaccaagccttcgagtccagggtctgcccaaa

SEQ ID NO: 37620 - DNA, 6599 bp, Chlorella protothecoides
  modified_base (253)..(306): a, c, t, g, unknown or other
cgccgccccgctcgccgaggctgccccgcccgcccaggccgcccgggacgctgaggatgcgccgcagcccgggcaggcccaggaccttggaaagcgcggcgtgcaacacatggtcccgccgcgccgccgggtccgcaacctcggcggcggcggcgtcggcccccagaatgctcgccatgtcgacggtcagatcgctgagtgcctgtcaatgtttgcggggatggggggggggggggggaaaagggcggggggnnnnnnnnnnnnnnnnnnnnnnnnnnnnnnnnnnnnnnnnnnnnnnnnnnnnnngacgctcggcgcgatcaggatgagtctgtgcgggggcgcctgaccccaggaacgacatgcttgcggcttttcggggggaccattccctcctcctaccgcacggccagctcacacaccccaccctcctggccaggcatgcagcgcaccttgctgatgtctgccatgcagcgctggacagccgcgtcggcggcctggaacaggctccgctcctcgccgttgccgccgggctcctgccgcacatgggaggtcaggagcagcagctccgcggcagactggatgcgagccagggagcggcagagggagtcccggagcaggcggaagacgaggacctgtggtgggagggaggcttgctcaagcttggtgcagcatgagaaggtacagggcggaagtactacctgcatcaccctgcccagccttgtctcggtggcactcgcagaaacccgcccttcccgcccacgacacccaccctcttctccatgagctctgccgagctcagcccgccggcttgcacctccttcagccggaggagttgggcgctgcgatgcaagaacgcgccgggaccctggaaggaagaaagggggagtgaggttggatggcgacacatgcaactgcgcatcgagacagacacagaaatccacatctgaagggcgtgacctccctgttgcaaacgccggaaggaatctgtcacagcatggctccatgtgtgaggagcaggttggagtcatgaacggacaccaagggagcctgccatgtgccgatccttccccatcactgccctctaccgtcctgccacccacctgctgcagccagatgaaccagaagtgatgctcctgcttgaccctgccctcccagaaggtgaggttggcggtggcatcatccagctccgccaacaccctgctgaaggcgacctgggacagctgcagagctgcaagccacacctcggccagggctgcctcctgcaggtgggttagcttgactggctactgacctcgagtgtatggattgcctaggctgagaatctcatccgtgcgaacagtctgcgtcccaaccctcctgcccgagaaccctctacttactgattcactggttgctgctcggcgcagggcaaagattatgtcctgggctcggccctcatccaggccagccactgggaatgtccactttcgtcgacgggtatcacgggagatgaggagcgcctgggcgggcgcacggaccagtcgccatggcaggcgaaccaagttctttatcattacaatacaggcactgtaaacagaccggttcgacagtgaatctgcggttgttggggtcggaggtgcgtcgtgcactctccgcctgccgccaagctacacaccccaacgcggcgtgtgtgtccgtcgcgaatggtaaatgtgatttggagtacacgccagatcgcgatgggatgcgaggtgcgaggtgacagctcggtgcactgccgagaatccggcgcgcgcagtctgtcgaagtgatctcgtgtccggttggtgatcagatacaaacacgctgcagacacagcgatggaggtggacaaaagaggctgtctgtacacttgcagcaattctggggcacagagtgagcagtgccgctgtgggaagaggaaaatgcaatgtaaacctcacaggtcagatgatttccccagtctccagattgagcggcaggaagccagccttctccctgttctcggacaggcacacgacgtccccctgctcgcaatccttgcaggccccgcacgatttgcggcagacccccaacctgaggggttgggatgggcaatgtgtgtatgatattggaaagggcacctaccctcaaattcgcgcagcaggacggctgccctcagcgctcatcctcgcgtggacatcttgcacacatgtgtgggatggtgactctatctcctcaggcccccccacataatcgcccaccccacccagaatccctgtcaacgtgcccactcttcccggaaccactgtaaatcccacaaccccaggctcactggaacatgtcgccgaccatgaagccggagttgctgctgcactgccccgactcgacccagcctggacaccgctcgtccctgtccgagcaaatttccggcacggggatttccggaaggggctgcgtgatggtgggaggatgggtgggaggacaaacgctcagcagggcattggccggcagaagctgatgtgtgggcgatgcgggcgagacatgtgtcgtccaggctctttagccttgccatgccggggacgaccaggcgcaaccacccgccccggtcacacccaggctcggcgctcaccgtgtggtccgggaagccctcgggccggaagggcttggtgtggatccacttggtggcggtccacttggtgcccttcaccacagggcagccggtgtgcatggcggcggggtcgtgggtgccgtctggcttcagagagtggaagagcagggcgtcccccttcctgggccgcgccgccacgctcccctgggcgcagctggagaaggggcccagccgctgctccagggcggggtccacccactcagagccctgtggagaggaggaccggagggggagcttggtacccagggagggctagagagcagtggcagggggcggtgggctatgagcagtgggagtaccattaggggttgtctcgcaggcagtcacgccctttcatgcatggccaagtctcgtgctgttcgtagttcgagagggtgggcgcatggcggagggcagcagggcacacgctgggcgccagcaccctgccgggctgcaccccggtgcgcatgtactcctgctcccggcgagcgccagaactgggcccggcccacgacctgcccaggagacacacacacaacccatccccttgcagccccgcggaccgtggggaacgcggtctcgcctccctcctcggtgtcggccaggtagacgaggacggtggcggtgcggggggagtcgttgtccagcgagtcatagtgcgcgccgtacttctgcccagggccgtagcgcaggatctgggtgtcctcctggtgcgtaatgttcagcttggtccacgacgccagccgctcctccatggctgccaccacggggtcctgcagtgcaggtgcgggggcaggaaagggtgggccaacgtcgggacctggtggtgcagaggccgccgtgcctccatggccccgcaaacagcccccggggccacagctctcctgccacccgattgccgattcagagactggaccctgcccggggggccacctggtagcggcgaaggaaggtgccgtaggaggtccgcacgttgtccagcacagacttcccgcccagtccaaccaccgtggagcgctgcatctgcaggaggtggaggaaagggaggaaaggtgctgagtggctctcgcccttccctggaccgcgatgcgctgccagtacaatgcgcttctcctccgaacgagcctccaccactgctttgtaagcctgaagggttcctccgacagcgtcttgaggatgcactctaccaaacacatgtagaaagacctgaagtgtggaccaccccaccacccccaagttaagtggcgcaccaagggcttcgcgatcgccaccaggtgatccgcgtcggcggccgtcaggaagttatggtacaggtacgctcgcggtttccaggacagctgctcgatcctgccgcgtggtggattgcagggtagggctggcacactgggacaccagctggcaaccaaccaggaaataggggagggctgtgggaaagtccgtacggccctgctggcaacccccagactcaccatggctccagagatcttgtgaggtctcgcccgacgggccgatttgtcatggcagatgtgactgcacggttaggtggggggggcgtaagcctaaggaggtgtgtgtggggggggggccatgacccagaagtctttttgttggcgtaatttaaggttctattacctgttatgagtaggctcaacgccaagactgtccatcctgtgtgcgaggtcgagcgcatggctgcgtgtaccacgaggactcgttcgacagtatagctgcggatttactgtcgtctaaaggaggggagacacgcgcggcaccgttcaccctcgatttcgcgtcaatttactgctgcgaagatgtatgacgaagaattcttgccgtaagaggatgattcagggggtcgcaagctccttacaagtggcgcgcggcctgagcgttgtccgaccgcacgccccgcacgggcatctcgcagatctctggtgcagcggaagctccccgatgattaccttgccagctcctgtgataggaaccttcctcgagtgctgaataactccgacgatctgtgaaggaggagcctgtggcttcttcgaggagtgggcgattacctggaacacaggctgtgggcctgcaacgcccctgacggtatgtacacgatcattccttcttcgctatacaacattcgtatatcttttaaagtctacctgggccacttactcccactcctcgatctcacagcttatcgtgcacggcgtttgaaaaatgagtgacacgggcgaggactcgaaggccaacatcaagcccgagggtgcgtccgaccccaatgtactgagcatcaaggtcaaggatcagcttggaggagaggtacgcggtcatctgagaccctgacttgtgcacgcgacgaaagtcgcttggtgtggccgtgcgggctcggccaggctctgcatcgatggtaatctctccccgacatcgcaaacggtgccgaacgtgctcacctccgcaggtcgtgttcaaggtgaagaagtccaccaagttcgaaaagatcctgaacgccttctgtcagaagaaggctgtggcgatctcggaagtgaggtttgtgtttgatggcaccaggatcaacccaagtatgacaccagaggacatggagatggaggatggggacacggtgaggcgatgaatgagtggctgttttgggagtgagagccacaacgggttgagtggttgcgtgtggctcagtgccctgtcgtttgcccttgctgttcaggtcccgacgccttggctcctgcacccatcccatcgatgcaggtcgatgctttcttagaacaaacaggcggctgctgagagggaaggatggagcctctcagcctttgctctgcactctcaagcatatttgtgcagaaggcatgggatgccttgggctgctgagattcacacacttacttgtcactcttctgccataggcacccctggctatctgatgtgtcagggccctctctttcctgcatagtcggtcacaggttacgctcggcttcaatcagagttggagtggggtctggcggggtgcagatcatgcgaggaggtgggatcgcaccttggtaaaggaggggccatgtgcgtcacacggacgacagaataagagagtcctgttcaaaggagtatacagcagtgccaggtggggttgcagatgcagcccttgctctacggcagagaattatgcaagctggtcaaggacgagtagatattcttcccggaagcacaagtcatgattttgagtttcctggcgctcgacaccgcgcccacacctcagtctgtctcagccgctctggccaagcttgagttggtgcaggcgcgcctccagcgccgccctggacgcggcatcctcaggggagaggcatgctaatgcctgtgctgcattgtccagctggtcatgtggaaaggattggaggtgcctcagcaggtttgacttcagggtctccaccagtcgcctgggggtgggggagcgcggatgtgggttggcagggggtctgagtggagcagggtaaagggtgtccgaacggtgtcattctcattgttcggactgtgtggagggggagtggctgcctgaagccctcagcctcgacgcactcggccaatgccgccctgcagtccctgatctccatgaatctggcgccccatgagccccccctctcaagccagccgctctcagaccccgccccctttgcccacttccgctctcaccctgggtggcgcgggaggtgggcgcaggcggccagcgccgcggcggcccccactgggtccagcctggccaggtcgtccgcccgcacgctgtccgccaggagctggaggaggtccagcagctcaggcgccggggcgccgccgggcgtacgccgcgccagacgccccaaggcctgcagcaggcgcgccctgtcccccggccccagcgcgtgcaggcgcgagcgaatggcgacggacagcgcgcgcagcgtgtgccggtcgaccggctcgccgaccgcgtcgg

SEQ ID NO: 37621 - DNA, 73 bp, Chlorella protothecoides
tggaggccatgtacctgtgcgaggtgggtcagctggcggggaccagggggggctgaagcgtgtgatgggcaag

SEQ ID NO: 37622 - DNA, 135 bp, Chlorella protothecoides
cgcggggcgcggcgggccgggcgccgtcggcggggtggtcgggagccccacccacggccccgccacgcccagcgcgcagggcggccagccgctcagggtctggggccgtgcagcgcgtgccgcgccgggagaagg

SEQ ID NO: 37623 - DNA, 104 bp, Chlorella protothecoides
cgccgacgtcggccgtcccggcggcagcgcccccggccgcgacgccggcgcgctgtcggcggtggagctgggcgcctacggcggcctggccgcggaggtggaga

SEQ ID NO: 37624 - DNA, 3415 bp, Chlorella protothecoides
  modified_base (183)..(192): a, c, t, g, unknown or other
  modified_base (1412)..(1448): a, c, t, g, unknown or other
  modified_base (1504)..(1513): a, c, t, g, unknown or other
  modified_base (2623)..(2632): a, c, t, g, unknown or other
  modified_base (3253)..(3262): a, c, t, g, unknown or other
cccaccccacccccacccccccacctacaacaggcgtggacaacaacgacagctatgaggagctggtgcgcttcgtgcacaccgtctccactggctcccccgtcacacacttcattgtgcatgcgcgcaaggcccacctgaagggcctgaacccgcaccagaaccggacggtgccgccgctgnnnnnnnnnncgtgcacgcacgcaaggcccacctgaagggcctgaatccgcaccagaaccggacggtgccgccgctgcgctaccaatgggtctgggcgctggcccgcgacttcccccacctctccttctccctcaacggcggcgtggcggggttggacggcgtggtcaccgcgctgcgcgccgaccccggccccctcgccggggtcatggtggggcgcggggcctaccacgcgccctgggacgtgctggccgacgccgaccgacgcgtgttcggcgggtccaacgccgcgctttcccggcgcgtggtgctggacacgtacgcggcctacgcggacgccatggtcgggcgctggggctccaagcccgacggctggcgcgcgcccagcctgcgcaccctgttcaagccggtgctgggcatgtttgcgggggagccgcgcgcgcggcagtggcgcgccgccgtggacgccgccttcaagcagggcgcgggcagcgtgcggggcgtgctggacgccacgctgcacgtgctgctgccggagtcgctggacgccgcgccgcgggaagagggggacggaggggtggcgggaccggcgcatgaggcgctgcgcacggtgcagcactgggagccggaactgccgccgacgccggagtggcttgcggtggagcgggagctggggcgaggggccgcggagcgcgaggggggcatgccggcagccgaggagggcaaggcaggcagcgcgagtcaggacagcgccctgaccgccgccgacaagagcgaggcagcaaacttgcgttcaggagcccagccaggtggtacggggtcggagacgtcgacgagcggaaacctggcgcagggccccgcgccggcaggtggagccgccacgcccggggatcaacagcagcagcaggaggaatctggcgctgcctgcaaagatgacggagcgtcgcacgacgagtcgtgggtgctggtggagaagcagacatctgtgccattacagggagcggcatcataagtgtcagtagtattcttgcaccctttatatggcattgtactgcaagttatagagtgttgagaggggggatgcacggcgtactcacaggctgcactgtggtgaccgctgatcgacgcacttatttgcgcactgttcgatccagagtgttcctggccattcctggccagggctcgcagtgttttataatacctacatactgtaggagacctgtggcggtacnnnnnnnnnnnnnnnnnnnnnnnnnnnnnnnnnnnnntaaacaccggctgtggccgcaggaatggtgcatgtgggtggaaagagtgatgaatnnnnnnnnnntggcattataagtgtcagtagtattcttgcaccctttgtatggcattgtactgcaagatatggagtgttgagaggggggatgcacgacgtactcacaggctgcactgtggtgaccgctgatcgacgcactcgcttgcgcactgttcgatccagagtgttcccggccattcctggccagggctcgcaatgttttacatatctacatactgtaggagacctgtggcggtactaacaaacaccggctgtggccgcaggggtggtgcatgtgggtggaaagagtgatgaactagtcagaggggacatggagactcaagacgctgtcccatcaccaaggtgcaagtttgatggggcgaacaagtttgtgatccgtcgattttcaaaaagaaccggcttggggtcggaggggctcggtcgagccggactgcacgccctgtgatcctcgtcgagacatagccatgccgccatcgctacagaatcacaggattcggacgaagcctcctcggaacattcacgtcgccaactctcgcgatgtcgtcgaaggcttgtcggactaggtggtagtagcccggctgcttgggaatcgtagtaagcgtgtatgttcagcgacgtcaccatggctgaagtggatcggttcaaagtgccccagtcaggatcagaaacctgtatcgagggaggccagagagggctcgtgagcaaggacgtgccgtggcaggcagcagcgcgaaggcgataacgcctatctcctctcactactcaccgtctgggttgcttctctattttaagagacgtcggatcaatcttgggagtacaaatacgcgtgctccgcagtctctcttaggtgattttggttagcaagtattcaaaaggaggtggtccggaattggtacctcggagccatgggattgatcggttggtgtacaaactgtccaaaaatgattgtctgcaagctgcgggggacggatttggttcgcgctggtgtgcagtgctgcccaggccgggtgagtgcaccacagggtcctggcgaagcatgcgcgtcatcgttctcccccgagtcgggtcgcccatgcacgagtatagcacgcagactcccttttcacgaggcacttgcgnnnnnnnnnnaggtcgcccatgcacgagtatacctcgcagactcccttttcacgaggcacttgcgactctaatggcttctgaaacgcctcgatgccaagttgagtcacaccaattgcggagcaggcgtggcaagagtcaattgtccttctgacacgccacccaccccttgcccggcgccgggggggacgccggggaggcgaggatgtcccgcctgcagcgcttccccctcatgacccggcgtgaggtggaggacagcccatctttgcgggatggggtgtctcacaccaacgagacgcggacccataagactgcgatcgggaacatgatgcgcaccgccgcgaatttccagatgtgagtgcgtgcctgcacgtcgcatacgaaattctgtgggtgtgtagacacgagtgacacgagcaagcccgtcgaggttgcccctcaggtccatcttcgtgtgtggcgtggcggtgatcctgtaccgccggttctacacccagcgcagcctgcgcaagaacaactcctacgtgcgtggcgcgtgggtgccggtgttgctcggatttggatcatgatcagcctgcctgccggtgtgtacagtctgatgtagcgggggtgttcaggctgtccccacctggnnnnnnnnnntggtgttgctcagatttggatcatgatcagcctgcctgtcggtgtgtacagtctgatgcagcgggggtgttcaggctgtccccacctggcgctttcccctgcgctccaggtatgtccctgcctcccccctctcaatccccgccccccccccac

SEQ ID NO: 37625 - DNA, 109 bp, Chlorella protothecoides
gccagacagcctgctcctattgctggccggggtgtgtgcggcgctggccgaggggggtttggccggagtggccaagcagctcagggccctggcgacgaccgagggcggc

SEQ ID NO: 37626 - DNA, 61 bp, Chlorella protothecoides
ggaaacagacggaggctcgtgaagtcgaggggccagcatgtccacccgtgcgacccatact

SEQ ID NO: 37627 - DNA, 73 bp, Chlorella protothecoides
caggaggccccgtgcccgctctccgtccagaggaagcctcgctgccggcgccggcggcagacctgcccgcgcc

SEQ ID NO: 37628 - DNA, 61 bp, Chlorella protothecoides
cccgtttcaaagtgtcctctgtggcggaggggtcgcagatgcctgccattcctcgctcaca

SEQ ID NO: 37629 - DNA, 61 bp, Chlorella protothecoides
gaataccactctatacgttcactgcatgtcaccagcaactgcccaagccgctttccctcac

SEQ ID NO: 37630 - DNA, 382 bp, Chlorella protothecoides
tggccttgcacgctgcttgccagccaggcagggggatgagcatcaagtggaaggagggagcatggctagcgccgacccggacacgcgcactgcgcccgcagagtcggtgagctgggtgtcaaaggtcagtcgccggccactgatgcgcgacaccgtcacggaagccagcatcggctcggacacctggagggtgtggaggaaagcaggcacaagaagttgcggggagggttgctcgacgcagcgataatcgcccgactccccgtggcagacaggctgccgaggaagatgcaagcgtgctgtcatcggtctgattggggctccggagcgttacgctcggtgcgcactgctcctggcgtactgtgcgtcacctcgccaagcctcc

SEQ ID NO: 37631 - DNA, 116 bp, Chlorella protothecoides
tgctactccacctctcacaccggctcgccgacaccccaaacgtccactccaggactctgcggcggagcgcagggcccgacgcaccaggaccctgaacgcggcgcacgcggcgcgtg

SEQ ID NO: 37632 - DNA, 74 bp, Chlorella protothecoides
acccaagtcctgccctcacatcaacccccaaccccccacccgcaacccccacgctctcgtagggcgctcattcc

SEQ ID NO: 37633 - DNA, 83 bp, Chlorella protothecoides
cacaaacaggcggcagaggtgagtggtgatcgtcatcgccgggaggtgtaccgtgtcgagcagggctcctgcgctacctgcaa

SEQ ID NO: 37634 - DNA, 61 bp, Chlorella protothecoides
tcctgcatggcccaggaccggatgccggcccgtggccatgcgccatcctgtgagttgatat

SEQ ID NO: 37635 - DNA, 88 bp, Chlorella protothecoides
ccctgatcacctcctgggcagagcatgtgaccacgaggcctcttcagaggaaattatccactgttgaattgttgcatgtgtgtaggtt

SEQ ID NO: 37636 - DNA, 115 bp, Chlorella protothecoides
tggaaggagacgcgccgtgcagcggcctgtgggaggaaagtgggctcaatggattcaatcatgtgtgcttgtagctggacatcacccggtgtgaagaggtcaggagactgtggtg

SEQ ID NO: 37637 - DNA, 563 bp, Chlorella protothecoides
  modified_base (135)..(206): a, c, t, g, unknown or other
gccgtacgccggcgggggagcggcgtaggcgctgctcggcgcgagggcctgctgctcgggctggaacagggccgggcccccgggcgcgggctggtgctgtgcgccggggtcgggggcgtagtgcggggggggggnnnnnnnnnnnnnnnnnnnnnnnnnnnnnnnnnnnnnnnnnnnnnnnnnnnnnnnnnnnnnnnnnnnnnnnntgggccgtgctcgggtcgggggcgtaggagtacgaggcgtcggccgcgccctgggcgtaggcgtagccgccgtcggcggcgccctgggcatacatgtagtcggcggcagcgccgtcctgggcgtacccgccgccgccgtggatgtcgccatcgccgccgagccgtgccgcggcatcctcgcccatcccgcgcggcgcgctgtgcgcgattctgtcgcgcaggtcggagacgccggccgcggcgccgggcgggaccaggtccaggaaccgcgctgcgtcggccaggcgcccatcggccaccagcacgtcagcgtagcgcgtgagcagcccgaccagcgcgggcgccgccagcgcggcg

SEQ ID NO: 37638 - DNA, 62 bp, Chlorella protothecoides
agtgcatgcccttcatgggaccaggggggggtcgagtcgaccgcaccctcccattcgtctag

SEQ ID NO: 37639 - DNA, 127 bp, Chlorella protothecoides
aatgtcagccatctccaagatcatgcccggtctgatctagcaaaattgcgcccggccctgatgttgggtgtccttggggccggccagtctgcgcaacatgaagtatggtgattagtttagaggagac

SEQ ID NO: 37640 - DNA, 408 bp, Chlorella protothecoides
  modified_base (128)..(304): a, c, t, g, unknown or other
cccaagaccctgagcgacaaatacaggtatattgtcggagacaaggtgtggcagggttgccaagcctctccgatgcacggtgcacggtgcccaccgcgggtttgtgttcccccctccaggttgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcagacgcctgccgtcctgattgcgatggtggcaatcctgtcccggggaggtacggtcatggccccatttttcattgtcgtagggcattgttcgggaggtc

SEQ ID NO: 37641 - DNA, 142 bp, Chlorella protothecoides
tgtgggtgaggggccggtctgagaccgccgttgtggtgcgagacttgtgaggtatgctctctttggtcgtgctggccggactttgagcaggtacacatcatgcgccccacatctccccctgccgcttccccccaggctccag

SEQ ID NO: 37642 - DNA, 73 bp, Chlorella protothecoides
gtggcatgtggtgccggtccttgggggccagggaccctctcgaacccgcctcctgcacccctgtttgaaagaa

SEQ ID NO: 37643 - DNA, 61 bp, Chlorella protothecoides
tgatccccagccgcaggccagcagctggaatccccggcgccagcccacctggccttggtcc

SEQ ID NO: 37644 - DNA, 95 bp, Chlorella protothecoides
gggcaacaggtttgctggtgggaggtgggtcgggggctcggagcctgccccggcgcgcgctgcatcctgtcccagcggtggccgtccatgacccc

SEQ ID NO: 37645 - DNA, 61 bp, Chlorella protothecoides
aaacgagggaccaaaagaggcgggggggcggttacatcccagcatgaccagggcagggccg

SEQ ID NO: 37646 - DNA, 61 bp, Chlorella protothecoides
acttccagctgccgggcatgcaacccccccacccctgcccagccacacacctgcgggaagg

SEQ ID NO: 37647 - DNA, 61 bp, Chlorella protothecoides
gttacgcacatatcgcactgggtaccccttgtccagcaggaatctgtagaggatgtcaaac

SEQ ID NO: 37648 - DNA, 187 bp, Chlorella protothecoides
aggggtggcgcagggctggggtcctgtctggacaggctctgggctgctcttctgcgtcccaggactcttctgcgcatgcatggccccacccccccacccaccccgatccagcctcagcctggcacattactcagccttcatcaatcactgtccaggctgcatcctgggcgaactgctgaatgggaag

SEQ ID NO: 37649 - DNA, 66 bp, Chlorella protothecoides
gcagggtgttgtgtgggtgactgcggtgtgagggcaagggaacactgctggcccgaggtggggagt

SEQ ID NO: 37650 - DNA, 61 bp, Chlorella protothecoides
gtggagctaagcactgttctcgctgggagcattgtgcagatccctgtttccgccaagcacg

SEQ ID NO: 37651 - DNA, 61 bp, Chlorella protothecoides
gcagaccgccgacgtggtgcaggagctgcgactgctggaggtggaccctgggtccagcgtg

SEQ ID NO: 37652 - DNA, 61 bp, Chlorella protothecoides
ccaaggttaggggctgccggaactggttgcgtgggagggatggtcgctgactccacatgcg

SEQ ID NO: 37653 - DNA, 159 bp, Chlorella protothecoides
aagggcgggagggtgtgcaggtggttggtgtgagcaacgagacaagtttttgaagaagcaaggattttgcaatacatcctcttgtgacacgagagagtctcggaaaaaggccatgaggtagcagtgctgggacaggaatgatggacggcagcacccatt

SEQ ID NO: 37654 - DNA, 67 bp, Chlorella protothecoides
gcagtcccaaggtgctcaaccacgttggtgactacgacctctcgggagggtgctcggagggtccaaa

SEQ ID NO: 37655 - DNA, 61 bp, Chlorella protothecoides
gtggtccacggggatgtcaaagtagcccacgcactgcccgctgtgcaggtccatggtcagc

SEQ ID NO: 37656 - DNA, 61 bp, Chlorella protothecoides
cgatcagtcacaccttgccgtcccaacccaccccgatgccgcccagctggagatcgaaagg

SEQ ID NO: 37657 - DNA, 148 bp, Chlorella protothecoides
cagcgagggctgtggagtggaggaggggtgatccctgggtacagcggacggctgtcgggcagctcctcagatgatcctcacaacgctgccgctgagaggagtcatcccgcccaatcaccccgccgcagggaatcaagctcggggcggg

SEQ ID NO: 37658 - DNA, 61 bp, Chlorella protothecoides
attcgtgggcttcaattacacatctatgcgtctttggatgcagtatcaagggtgagctggc

SEQ ID NO: 37659 - DNA, 178 bp, Chlorella protothecoides
aagtacaagaccgcaggaccccactgggaggcggccctgtcgtcatggacagtgagtggcggtcgcgtagagggggggtgctgccgtgtgcagcgatgtggatgataatactccagcatcacgcacatttctcctcaccgtgccctcttagtgccccacaccggcgaacaacagcaag

SEQ ID NO: 37660 - DNA, 64 bp, Chlorella protothecoides
ggaaggggacaggaaacatgatgatgggaggtctcagagaaatccgctaatttttctcagcagg

SEQ ID NO: 37661 - DNA, 61 bp, Chlorella protothecoides
ccccccccccccacacacacacacacacaatatattcccccagcgcgcacctcgtgcgagc

SEQ ID NO: 37662 - DNA, 61 bp, Chlorella protothecoides
acctcagcgacgtgagcgccgtgtcgggggtgcacccgctcacctccttccaggccctggg

SEQ ID NO: 37663 - DNA, 79 bp, Chlorella protothecoides
gaccccttgacgcagatcgtggacgagctgtctccccatcgcttccctggctcgcagttggaaccgacgcccatcgaca

SEQ ID NO: 37664 - DNA, 61 bp, Chlorella protothecoides
gcatgtaacacatctagccaggacaggaagctcctcagcgtgtgggagacaaatgccctta

SEQ ID NO: 37665 - DNA, 61 bp, Chlorella protothecoides
ttgagggtggaagacgccagtgtggctgggatgaagagctgacagctctaccgtattccgt

SEQ ID NO: 37666 - DNA, 63 bp, Chlorella protothecoides
ggacgggggagcggcctcggtgtgtgaagggagtggcatggcgacgcaaggcgatggatctgg

SEQ ID NO: 37667 - DNA, 26000 bp, Chlorella protothecoides
  modified_base (886)..(895): a, c, t, g, unknown or other
  modified_base (1156)..(1165): a, c, t, g, unknown or other
  modified_base (1613)..(1622): a, c, t, g, unknown or other
  modified_base (1898)..(1907): a, c, t, g, unknown or other
  modified_base (2909)..(2918): a, c, t, g, unknown or other
  modified_base (3134)..(3143): a, c, t, g, unknown or other
  modified_base (3553)..(3562): a, c, t, g, unknown or other
  modified_base (3693)..(3838): a, c, t, g, unknown or other
  modified_base (8265)..(8274): a, c, t, g, unknown or other
  modified_base (8356)..(8365): a, c, t, g, unknown or other
  modified_base (8443)..(8452): a, c, t, g, unknown or other
  modified_base (8522)..(8531): a, c, t, g, unknown or other
  modified_base (9459)..(9468): a, c, t, g, unknown or other
  modified_base (10046)..(10055): a, c, t, g, unknown or other
  modified_base (11565)..(11574): a, c, t, g, unknown or other
  modified_base (14349)..(14358): a, c, t, g, unknown or other
  modified_base (18932)..(18941): a, c, t, g, unknown or other
  modified_base (19642)..(19651): a, c, t, g, unknown or other
  modified_base (21842)..(21851): a, c, t, g, unknown or other
  modified_base (22484)..(22493): a, c, t, g, unknown or other
  modified_base (22699)..(22708): a, c, t, g, unknown or other
  modified_base (24565)..(24574): a, c, t, g, unknown or other
  modified_base (25447)..(25540): a, c, t, g, unknown or other
  modified_base (25709)..(25869): a, c, t, g, unknown or other
ggggcgctgatcctctcgtcggcgccggggcgcgcggcgtcggcccccgcgggcagctcgaagacgtgcgcggtgccgcggccggagacggcgacgcacctccgcgtgtcgggcgagaaggccaggccctggatggaggccggggtcaggccccgcaccaggcacgccaggcactgcaccggcgagggtcgcgctgtggcatccggagcgggccctgccacgcggccggagggcgtgaccacccgccacacacgcacgctgcgccccgcggtcgaggccgtggccaggagcatgccggaggggtcgaaggccagcgcggccagcgccgaggtgtgcgcccggaagtgcgcgaccacgcggaggccgcccacctccctcaccaccaccgtcccaggcacgagggcgtcggcgacggcgacgggtccctcggcgccggacccgggtccgggccctgcgccgatgccggcccctgcccacgccgcgtggccctgcccgccgcgccatgcagcgagctgcgtggagaggtaacggtaccccgcgccgccggcggccttcagcgtgcggccgctgcgctgcaccgcgtcgcgcgccaggtcggaggccgccgggaagctgtggccgccgccggcgggggagggagttgtccgcgccgccggcgcccgggacgggaccggcgtgatcctggtggccgtgacaccagacttggcgcagggtgtcgcctgcagggtgacgggtggaagggagggttgatgaaggagcttgggtgcacgatcaccacgccaaggttcatccaaacgccaggggagcacgcctgacgcggccgacagcaagagcagcgaatgctggggtgggtggagcacacacgcacctggggcgaggggtatgnnnnnnnnnnaaagcttgggtgcacgatcatcacgccaaggttcatccagacgccaggggagtatgcctgacgcgaccgacagcgagagcagcgaatgctgggatgagtgcagcacacacgcacctggggcgaggggtatgccagccatgccgggcccagggcgaagggcaccgcggcggggaggggggtggcggcctcatggccatttgggttcacggaggggtggggcaatgagggcaggctgtaggccaggcaggtgaacttctgctnnnnnnnnnnagcggggagggggatggcggcctcatggccatttgagttcacggaggggtggggcaatgagggcgggctgtaggccaggcaggtgaacttctgctccagggtcacggcgtcaaaggcggccagctggcccgggaaggaaatcaggagcaggcggcgcgaggcggccagcgccagcgccggcgccgacagcgccaggctgtgcaccgtggcgtgggatcgcagcgagtagaagcggagtgcgggcggggggtcggggtgggcgggcgtggaccccggggccagcaccaggactgggtgcatgcccgccagagggctgtcgggcaaccccgatgcccccgccattgccggggcggtggggggggccagcatgtccaacagcctatgggattggtgaggggttgaggcctatgcgccagaaatgcagagggacttgtgcatcctgggagtnnnnnnnnnnccaccgatgccaccgccattgccggggcggcggggggagccagcatgtccaacagcctatggggttggtgaggggttgaggcctatgagccaggaatgcagagggacttgtgcatcctgggagtctgctgcgattatcaggcttggacgtatcaatgcaaggatcatacgcgtgggcgagcaagatcatacttccaagaaggaacccggacccccccacacaccagaaacacacacctgacgggaccgtcacgccgagacacgagctccaggggcnnnnnnnnnnttgcgatgatcaggcttggacagtatcaatgcaaggatctgacgcgtgggcgagcaaggtcctacttccaagaaggaacccggacccccacacacaccagaaacacacacctgacgggtccgtcacgccgagacacgagctccaggggctcggaggagttttccaggctccaaacttgaaaaccagtctcgtaggccaccaggagcacgggcgacccgccctggccatccaggctggcaaaccttacggcagtgaccttctcgcggtcggtcgcggtgagagcaccgacacccgcgaccgcggctcgggccaccttcgatccagcggatgacaaggcagacagcccaaccactagggatctgccggccagctgacgggcacgatctcggtatgcctccatccgaagcccaacgagggtggggggcaggcctcgctggggtatcacccctcgaccatgctcgctgcgctgcagacaccttgagattggcaagaccgaacgacacggccggtaaaatcagtgtcggtgcaacgacaggcacacgcccatctgttggcccttccgaaagtttttgactgtactttccttgggggtcccctcctcatccgcaaatccatctgggtggcaactcctgggagcgacactcgtgggcaaccaacgtttggctatgacaatcttgtttgtgtgtagatgcagaatgatccacataccatgcatacgcgtgagcagagagggaagcgcggctgcacctcagaacttgacagacttggagatgcgagacttgatgccggtggcctctccgccgtagctcccagctgcgccagccttgacgccctggacttgccccttccgccgcacagtggcttcgtcgaacttgatcctgcacggtgacgggacaggggtgtggggggtgtggggtgtggggtgcaaggaccaggtgatgccactttaagagagatcagccgacaccacagtgccactggtggccgcttcgccactgggcnnnnnnnnnnaggggatggcttggtttgcagtccaggagttgaagaggatgtcatgagcccatctcaaagttctcatcacctctgactcgcagcggaggcacggcgtgtggcaaaggaagcatacaagtacccagacacccaagtgccgctggaggaaccccaggccccgggtgcccgcgggatcaccaccggtgaggggcacgagaggctgtttggcatttgccnnnnnnnnnngcccttccgccgcacagtggcttcgttgaacttgatcctgcagggtgacgggacaggggtgtgggggttgtggggtgtggggtgcaaggaccgggtgatgccactttaggagagatcagccgacaccagtgtgccactggtggccgcttcgccactgggccccacacctgttcttcttgcgcgggttcttgagatcccgacgccggtgcggggtgaacccgcgattcttctcgatggctgcacggggcaaaggggtggcacagggcgatcaaattctgtgggactgaccaagcagccgcacacccgaactggcatgcacaggcttggcactcctgtccaccgatcgccaagcctctcaaccaccacaatccatgcagcgggcaaatgccaaacagcctctcgtgcccctnnnnnnnnnngagagactgaccaaacagccgcacacccgagctggcatgcacaggcttggcactcgtccatcgatcgccaagcctctcaaccatcacaatccatgccgctggcaaatgccaaacagcctctcgtgcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactcctggagtgcaaaccaaaccatccccagtggcaaatgcaacctccctcctgcccaatattatggcccctgtgcagtgcttgcaacccgggacccccagaacaagctccctcaccccctcacccttggaagccttgacggaggcgtagaactcgtcctccgtgcgcgccagctcgccgccggccgacttctcgccgctcgtgcgctgcgcctttttggccgcgacgctgtcgaaggcggcgcggcgcttggccagcggctcccgtgccggcaggtcggcgtcgcccgaccgcggccgtgccgcgccggcggccgaggcgtccccgccccagcgctgccccgtgcggtggcgctggaagtcgccgcccagcccgccctccagcaccgacgccacatcctcgcggaagtcgtccagcagcgcagcgccggcgaggcccgcgcggcgcgctgcgcgctgcgccttgccctcctcccggctcagtgggacgcgcagcatcaggtcctcttccaccgcctcgcgtgccgccaggcggtggcgctggcgcaccgccgccgcgctgtccatccccgtcagcgtctcgcgcagctcctcgggcgcgccctccacctcgcgcgcgatctccgacagctggcaggggggggaagattggaaagggtgaacacggtggggtcgagaggggtcgttcgagcgggcagcaggcagcggcgaccgcatccccccataagcgaaagcggcaggttcgtatggtgtcattccacgtccgcgccccaaaccaccacaaagctccaaaccctcccgtaaacacccccctccccatcacacatccagccctccttccccctgctcaccagcgtgctgcggccggcgcgacgcgccttgtgcaccaggtgccgctcctgccgctccgtggcgcgcccctcctccatctccatggacacagggttgaggcggggcgggcggtacagccccgtcccgcccacccgcgcctgctccgcggcctcctcctccgcggcggccagcagctcctcgccgccctcgctggcggcggcggcgggagcgtctccctccgccagcagcgcctcggggcgggggccgtgggccagcgaccccgggcccgcgccggccacagcgccggcggcggccagtagcttgtccatttggtgccgcaggcgcttgtcgatgggccgcaccctctccaggtaggccttgatctccaccaggcgggcgatgacagggtgacccgccacctggcgcccctccgccttcagcagcaggtacaccacaatgccaatgcagtactgaagcaggagcaggtgcttggcctccaggtaggacaggccttccgccgtggccagctccccctcccgcacctccttcagcagcgggcccacgcggtggcgcacctccgccagcgacccgcgcagatccgccaggaggcccgccagctcgggcgcggcctgcgcggccgcggcggcgcgctccgcctctgtcaggcccgcgatgtcgcgcgggacgaactccacgtccccggcgccctccccctcgctgccgtcctcgctggaggagggagagtctcctccctccgccacgccgtagtcctcggggtccaggcccgacaccgcggcgctctgcaggcgacgggcctcctcctcctcctcctgcagtgcgtcctcctcctcggacccctttggcagcagtaggcgtgttaggggggcaggttggggggtgttgggggcagagcagcggtgcacagccaatctcgtggccacacagacggcatccttgaattgcacgccagtatcccagactgttcctcccagcatcatgcacggctcaaggagcctccgcagagtaaatcgcctgctgctcgctccccatgcaacgaccaccccggctcgcacctccagatcaatgttgtcggcgtcgtagtatgcccgcttgttgccccatcgcccctcgccgtgcttaccctcctcctcctcctcatcgctcccgctctcgccctcatccttctcgccacgcgcgatgcgaagcttggcctccagagtctttgcttgccgggcgactgcacagtggggaaggaggtgtgagtcccggacgccctacgcactccctggaggccaagctgtgcccatactcagccctactcacgtgcggcgtagcgctcatcggcggcaaactcctcgtcctcggagtcgtcgtcgctggcggcatcaatgtcgaagacggcatcctcgatggattccacgtccgacacctcatcctcctctccgtgcatcgccagctcttcactttcgctgccatctgagtccttcggcggctcagcttgaggtgcgcgtcccttacgaggggcagacttgcccctcttgggtggagcgcgcgccatgtggaagaccactgcgcgacacctacccgatgcagtctatacaggtacaagaagtgcgagttagcagatgaattggaggtgtagtagtatgtatatgcatggatgtgcatgcatgctgactcctgcatggtgggttcctggccgcctgctgtggcatgctcggctcggcattttggctcggcagcgcatccacgacgcagatgccccggcactcggccaaagccagcacattctcctctcgcgttgactggtgtacaaacaggctcatgaaactcagcctggagacttcctgctgattggccttccctttccttgactgaccgactcctctcattctgtgtcgggtggcgtggagccgaacctcgcagtagtcggaagcccacctctctggagtgacatcgggcagccagtcggacggcagtctcttggaatcaagctcctcctttgtgacatccaaaagggtcatcggacgggagcttgctgcgtcgggcccctcctcaaattgtgccggcggtcctcctctcttaaatgtccctcaaccccttcgccagcgactggacgccaggtcgaggcaaatacagtgctcccacccagtccagggacataaggagtcgttcaaagatcgatgcgaacgctgggaagcctgcagacccgtcgccgttcaccaacaccactgcatcacccatcccgatgccttcccccacgcttggccggagtcagccgtccctggatagagaaggcgagctggactttgatgtgggctttgactctatcccagaggccacaagcggacccagcaccccctctggcagcgtgagtgggtggtgcaatgttgtgcagctgcctttgtggctgcgtcagggggtccgccaagcatcctcttggcagcgcctgcagacagcatgaggctgatgctgggggcattctgtctgttctgtcaaacacaagtggacctcaaccgcgccctcggttcccctctctcgtacagctcgtgggcccctccgcactgccctcccgctgcacgtcggtggagcccagccccggaaaggccatcagcctgctgagggccaccgaggatgtcctgcccccagagccggtggtggaaagcaccgcctatgtgtctgaagccacgactcatgccgagacgaggacctctgcccaggcatcaacatcgggcaggaagctgggaccagctgatttcgagctgctgcgagtggtgggccaaggtgcctttggcaaggtgttccaagtccggaagcgtgacacgcaggagatctttgccatgaaggtgagcactgcatgggggtgctgcctgcccgctgcagtgcccagcagtgtgtgagtgttgcaagagtgtggcctcatgggagtatttctagcgtctgtgtccatcagcaatgatgaaatccaccagacagagcttctggaggtgcagtaagccctcagcttgccccaccgcggtctctacttcgcccgttgacctccatgcccgccacccgccaggtcatgcgcaaggacaagatcagggagcgcgaccatggctcctatgtccaggcagagagggatgtgctgaccggggtcattcacccctacattgttaccctccgctactctttccaggtggggtgcctcttgtgctgcttggtgaagcagagaagtggtgtgggtatgatgacacaggtgtcagtgtccctgacggctgctcccaacatgtcaaatggaacgccaaaggctgccccggcccaggagcgtccgagccctggcgcctcgccgcgcctcgtcctcctgtcagcgctgctcgctccattccccccctcctcagaccccgctcaagctgtacctggtcctggacttcatcaacggcgggcacctcttcttccagctgtatcgcgcggggacatttgacgaggcgcaggcacgcctgtacaccgccgagatcgtgctggccatcgcccacctacacagcctcggatttgtgcacaggtgtgcgtgtgtggtaggggtgcatgggagggggacaggggtggtgtgttgactnnnnnnnnnntctgcacagcctcggatttgtgcacaggtgtgcatgtgtggtaggggtgcttgggagggggacaggggtggtgtgttgactnnnnnnnnnngaaatggaacgccaacgactgctccggcccaggagcgtccgagccccggcgcctcgccgcgcctcgtcctcctgtcannnnnnnnnnctggtgcccatcatcgtcatccttctcaccatgaagctgcctctcacccatcccccagggacctgaagcnnnnnnnnnngcggtgcccattatcgtcctccttctcaccatggagctccctctcacccatcccccagggacctgaagccggagaatgtgttgctggactccacgggccacctgcgtatcaccgactttgggctggccaaggggggcatgggggacgaggagcaccagcgcagcaactccttcatcggcaccatggagtacatggcgccggaggtcatcctgggccatgggcatggcaaggctgtggactggtggagtgtgggcatcctgctgcatgagatgctgtgcggggtgccgcccttccgcgctaagtcgcgtccggccctccagaaggccatcaccaccgccaagttcaaactgccgagtgggtgacagggacgaggggggtggggggggcccagtggaaggggacatgtgtggcgtgctcgcaaggcgactgcatgaaggaggctgctgggaagcctgcaccgcctcggcgggaaagggggggttgtttaccacaggctcccagtctccagccaagaaccatctgctcacttttggagcccaaatcctggaacaggctacctgagcacgcccgccgccaacctggtcaaggccctgctccagaaggaccccaccaaacgcctcgggtatggccccgctggcagcgcggacatcaaggcgcacccctttttcaggtccatcaactggggcctgctggagcagcgcaaggtggcgtcgcccttcctgcccagcgtgagccacgtggagagtgtggagaactttgaccgcatctggacagacctgccgccacaggtgggtgaggggcaactagtatctaggtggggtgagggggtgcttggcaagagtgggaacacagcttccctttcctccagtcaacaagctatccctacaaagggtgacgcgcgatcctacacctcctctcacatcaagtnnnnnnnnnnagggtgcttggcaagaatgggaacacagcttccctttcctccagtcatacaagctatccctacaaagggtgactcgcgatcctacacctcctctcacatcaagtttccatctttgccctgcacccaggactcgccgtgcgtcactccccgtgatggatccctgagcgtcgatgacaatctgtttgtgggtttcacctatgtggcaccctcgttgctggccaacctgaagctggcagacctaccgaagaaccccgaatcacgcagttagagcgtaagcagtcgctaacatgacccacggcacaaagcctgttgaactctcttgtctctcgcgttgtaggttatttgacagggtagacgcagaccaggcatcttggggtgcatgcatcgttgtgcgcagggatgccactcctgcctgcatatgcgcgcagacaaggtttgtccgtgctactgatgaacatgctgggtcgtggcagcctcatccggaggctcgtcgctcaatgactaccaggcgccatgtgagagcgtgctacaggcttctagcgcgctcaaaggtgtaaactctgaaggctttccgaggnnnnnnnnnngtctggaggctcgtcgctcaatgactaccaggcgtcgtgtgagagcgtgctgcaggcttctagcgcgcttaaaggtgtaaactctgaaggctttccgaggccaggtggcgctctgtcaggaactcgtgcacctgggcctctctccaagcattgcctgtgacaccattacagcatgatccgatacgttcagtcttgatacagggtggtggtctctgacttggccacgtccttcattgctgctcggatctggtgctcccagcggggtgggatcttcaccgcattgccttccatgactgacggtgcgggcgcgggggcaactgactcgcccttgctcagcgcctccaacaaagcctgtagggagggggatggagatggtacaagagtactgtcatgaattcctttggaatatatggatggacgccttcattggtccatcccaggatcgacatggaccctcccgcaattgcgcgccgaggctaaaactcggagtgtatcttcaatgcagatagctttctcccagaccaatagtcccctcgaccccaagcgaatgcaacaccacacgacccaccaatttgtcgctgccgcctcccatggctcctcgcccttggctgctgccgccgtcaaagtccactgatcgagatggatcagtaggataccgtctctggcaaaaggtcatcatccgtttcagggcctggatgaactttcgcgtcgcctcatcattcataatgtgtgcctggcaggagacgtggcttatacgtgtgaggcatcaaagtagccagaggacagctttgcaaagagcctgtacaccacctttccatgcactcgaggcagaaaaggccagcactggataccgcagtcggttactataggcactgtctacaaagtgactctctctaatccaccacaaattcacgatcaatacttggctgaacacccccaagccccctctccctatcaaaaaagcccacaaccacacaccgtgctcatggagcttttgaaggagattttttcgcgggcagagcgctcgtgcaggccgacctgggtcacgccgatgggccaggggctgttcccgatggccaggcccatgtaaatcttgtaggcatgcaggtagttgcgctccgccatggcctccacgatcatcttcagccccgccagcatctccggctccaggctgcggttgcgcaggcgcgcaaacagggggcgcaggtactgcacggtctcgcggtaccggagcgtggcctgatagccggcggggctggcctggtcctcctcggaccgagcctccaggtccgcctcccagtcagcgcaccagctgcgcagccggcgcgccagccggtcctccagcggcaggttggtagccgcaagcgagtctgccgcggcacggaaggaggccatcagggcctgcggggagaagaggggtcaatgggtagacttgtgggttgcagtggccagtggggagaccatgggctgcagcagacactgcaagggagggaccagaggcaccaggacnnnnnnnnnnggaagaggggtcaatgggtggacttgtgggttgcagtggccagtagggaaaccatgggctgcagcagacgctgcaagggagggaccagaggcaccaggacatgggccgagaaggggtgggtcctgattgcaccccacctttccccctctccggagacccaagcatatgccgccaccagccccttaacccggaccaatcacgcgcgcacctgctgctctgggtcgagttcggcgccggcgggggcggcggcctcctcgggtcctgcagtcccgccctcccccgtccgccgagccttcttcgcggcgcgttgctgcctcgcaaactcgatgttgaagttagcctgctgaccaccctccgtctcgtcatccaccgtcaaagttcgctgcgcctcagccagccgctcggcgcgagcctcgtcgctctcaccaaagagggtcgccggctctttgaggcgccggagcctgcgaatgacctcctcccgggtcagctggggtgtgtctgtctgtaagcctgtgcgggagcctgcggctgccgccttgtcctggcgactcgagggcctcggcttggacgtgctggcggtcgcctcgccgtccttgcctgctgcatctgcagggaccgaagcgggtgaggcgtcctcctgggagtcattgggtgcctgttgcgtggaggaggatgcacagtccagagcttgagctgcacaggacgacgtgatggtacacccgcagcccgcatgggatcccatcacatttcaattccagtccgcaagtatcgtaagaagcaattgcccatcccagccagtgctcaatacgacgcaccttgcgggctcgctccgcctcttcctcttctcgcagcttccgcagtcgcagctcttcgagctcagaccgcttgaggtattttttgccaccaaattctgcttcggctgctttcttcttgctggccaacagctccctcagtttatccatgcggacagaggtgagcaactcagcagggggtccagccagtcttggttttcacaggcacagcgcaacgagacccaggcttatatcgccggttaagaggattgactgtattttgaaccgtgctgaatgtttggtggtaattgactcgtcgtcgtgggtgcccgacctccctggcctgtgttggcgcgcggagagatctctcggattccagtgccgatggcacgctgttcactgtagtgcatacgcctgcccaggcgacgctgccggcctgcatccccgcgctcatctttccccccttccatcccctccgccttgttcttacgcgtggcagatcccgcaccggtgcgcaggttcacgccacgggggcgtcgaacacccacatgtggctggccacgaagaggaagtgggccgcgccgcaccaccaggccaggaagcccaggcccgcatccagcacgcggttggcgtcgacgcccggcaccagccgcgggttcagcccgctgttcagctgcgccaggcccaggcccaggaagagcgcggcgggggcggcggcctggaccgcggcgcggccggccaggccgctgaccagcgccagcttggcgcggaccagctccaggcgcaggccgcggtgggtcagcccccctggcgcggggtgcttgagcacgtgccagcccagcaggcccgtgtccaggtaccgctgcatgagcaggcgggtgttggagagccccagcaggcctacggccgccagggcggcgccctggatgagacgggcgccggagggcgtcacgtcgaacaggatgtcggcgcgcaggctaccctgtggaatattgagaggtgagaggaggggtgacgggggttgttgttgcacgggggacggccaaggagccattgagaggaacagaggttgggagggggaacagccatcagggcaggggcccaccgacgacatgtcacacccgacgcacaccttgtcgacaccctccaccacacagacaacacacacagaaggccacacagcaggtcgccctggggactgcaagcacaccaggcccgcacgcccccccgcacccagagcatcgacgcggccaggggccccagaaactggaggccgagccgcgtcttcttcacgaggttggtggggatgttgccccccgcccaagcggggggcgaccgctgcaggcggaaggcggcggcgaagcgcagcgcgggcagcagcagcagcgcgccggccacgcccgacgcgccggccagggtcaggcgcaggccggccagccccagactgcgcggcgtggcccccgggcgggccagcgccgccagcaccggcccgaccagggcggcggcggagctctgctgctgcaccggcgcccacagcggcgcccgtccctggatcacccaggccgccaggccgccccccaccccgtacccgagggccatgatcttgtccccggtgctggtggtgcgcgccaggaactccgttttggccagcgagaccaggctgcccagcacgcacagccccgacaccgccagggcgtggttgggaggaggggaatccgtgtgccaggcgtagagagcagacagggcggtcaccagccccgccagctctgccaggcagatctgaggaaggaagggagagcgtgggtgtttccgtggtgtgctcatcttggggaagcggtcgtgaatgttgggcagtgatgaggtgcagcatggggccgacctgtgataactgtcactcgctggcaagatttgcagtagcacacgccagcccggcgcagacacagtcccgagcctctacaacccccacgcacacaccgtgccatcnnnnnnnnnnagtccctcgctggcaggatctgcagtagcacacgccagcccggtgcagacacagtcccgagcccctacaacccccacgcacacaccgtgccatcaaacaggttgaagtaggggaggtcccagacctccctgtaagttgtgggcacgactgccagagcttctgcctcccccaaggagtcatcctcctcttccttcttcttgctcttggtcgtcacacgcttggatcgggtcttctggttggacagcagaccgccggcgagctgatagtgacggaggcccaccaacaatcgagccgggaaggcatacctggggtgtcaagtaccgtgggttgggcaacgagcactccggtataagggagaactgcaagcaaacgtccctcgaacaatgcacgatacattcggcgatgtacattaaggcacctggcattgaagatagcgatgagaataacgctaaggatcaggatggcggtgcccggcgacaaggggttctccatcgcacttctggtgcctcgtcagctgcgtctcacaccctagcccaccatgcaccgttttgtgatgagtgtcgatgggaaatttcccagatactttggagtcactgcacactaaaatttacgccgaggatgcccgtcagcaatctgccatgaggagcgtcaagattcacatggggcaaaagtaaaatatccgatccgacatatccggtctaggcgtcctgcttttcccaagccgggacggaggggctgcatctagtcttgttcaattcccttattaatatcgaggtccagtccctggcaataaggcttggagctgtggatgcaagtatgagcctcccgtcgccacttcaactcccccgggcgccaggctggcggtcaggcatcccagtttacgtctttcgaaccctgccttgccaagtgatcaataaatcaggtcgatcccgtgcccagccatgcagagcacgtaaaacaggtgagcaatcgcgcattgagtggtggatgacgcccatcgcctgcgctgctctggcacgataccaccgtcatccggcaacaggtcccttgcctggggtgggcagggagcaatggtgatatccattcacattcggtgcggcctaaattatcacgcacctccaccctgtatcttctgtagaagggagctttgaagatgtctcagagggtcccccccgtcccccacccctggtgggaggctcatccagcacagctgaaggtcgggagaggagtcatggcggtacacaatgtgaaacactgctcactacatgactgcatcgagacctctgctcctgggtgttgcctgatgtcgtgttggcccccattcttccccccgcccagatccaccttcaccgcgtgagtcatcatcctctggcatccagctgccctcctgggtggaccgagacgacctcaacaccgtggcaatagctgtggtggtgtcttatgcgatacgctggtgggtctgaccgctggcaggtccaggtgcaggttgtagcgtatacgaagcatttggcacatggtctgtctccaggtcaaggcgcatgtgattagtatgcatggctggagaattatgcttgcaatgtcactcaggcatgcgggcttgctctccatgctccagcactcccagcagcctcaatccggcctgccctccaccacccgcaggtttgttgcggagccacgattcatcccctccctcagtatgtatcccacctttgaggtgggcgaccgatttgtggctgagaagctgacataccgcttcgcccatcccccgaccgccggagacattgtgatattccggccacccaagggcatcggcggcaatggtggctggctcgacgacaatgtgttcgtcaagagggttgtcgctgtcgctggtacgcggcagagcaagggcctttgcagctgggggccttgcattgcggtaatctgtgctgtccgtgggttggacaggctgcgcacctcgctgcagcgtttttctgggggcagcagtcgtgcctcgcatgcattgcaatcctctcctgcctgctcgcgtggaggcccttggccccctggccacaccattgcaccgtgcatggggtttagatttcttgtgcccatgtcccatcaatcacttccttcaggtgacactgtggaggtcaagaagggcgcgctctttgtcaatggggaggagcgggtggaggagtatctggcagagaggccggcctatgagatggagtccctgaccgtgcctccacggtgagttggaaccatggggcaaggcttagtgtatggactgcgttacgtctatcgcgggtgcttcaccgtggactcatttgtcactgtcactcagccagcagggttgggcactgatagctagcgttttgccgctatctcagtcaccttccccaccctcctctcccattcccagccatgtctttgtcatgggcgacaaccgcaacaacagctacgactcccacttgtggggtccccttcccctcgagaatgtggtcggacgggcagtatggaaatactggcctcttcaggaattcggacccgtggacagaacttttaccaggagcgggacaggtcttgccggtgaactggcagcacccccgctgaaagggtaaagtgccacatcgcttacactcctatatggctggtaatcagtacatcaatagcattcattgcaaagttgtgaaggtgggcttcggttggcaggaaggctatagaaattccttatcagggagagattcctcacgtatcgagcctcacaaggctgacactcagagaatcccattcagcaaggcttgcacccagggcagctgcagggtcgcaaaaacgaggtagtgtagaccgcgataggaaaggtagatgatacctgctcgtctcggggaatgggtgagcagaggaggggtgagagcttctggtgtaggaatctgtctcgtgctgcacaaaagggcaaagcccgatcgctgcaccggtgcgggcacctgtagcggcctcactcttacaagcgccacccagatggattccttgacgtacctacgggcaggcctaagattatagcgatgataaggatgagaagggaggtagccactaatgtctctgctgtatccagtgcaagtttccgactgcgcctggataaaagcaggaccagtgacaaaccgaggaggagaagcgtcccttgtattgtctggagtacactctctggaacttttttgaggtctgggaaggtgcctgcctgactggctcgtacgactatgtcctgtgcctggcggagttcggccaccttgacggccaggtactctttgatcaccatgagggaatgtgatcttccttgctatactcggattcttcgcgaaccccgttttccgatcagtttgagaagctgggagctgaatgagcatacgtgtaatgcaggattgaacgttgaacagcctgcgcgcccggccatggagtaggctgacctggcaatttacgggagaccctccgacacagagaaacaggcatggtctcgaacatcccaaccgtcgccactctgccgcagcatatgcattagcattgctccacatattgaagctttcaattccatggaggattccactgcccgtcgcatatctcagctagcccagcacctgggggatcccggtggtgcgggcgcgctcacgagggccctcacctctgctgctggcggtcaggtgcagcatgagatccagatgctcctggagcacgacagccatgccgagcgccagaagatgaaggacctgatgaacaccgacctgttcacgccgtgcgtgactggagttggcgggggccacacgtgactccctgttgacccgcccctgcacggtgcaccgcaagctccagcagcactggcaggcgctagaggctcacaaaacccttccccaccccccttcccacagccgctggaacatcccactggccgaggagcgcgaactggccctgcgtcgcctgaaggtgctcagcaacagcggcaacttctccatcaccgacttccgcagcgacccgctgcggatctttgccgcgcacgaggtggcggccctggctgacgtgtccctggccaccaagatgaccgtgcagtacaacctgtttggcggcacggtgctcaagctgggcactgcccgccaccacgacctcctcctcgccggcatcgacaccatggaccacatcggctgcttcgccctcaccgagctggggtttgggaacaacgcggtcgagatgcagaccaccgccacctttgacgaggcgcgggatgagtgggtcatccacacgcccgggtcgctcgcgcaaaagtactggatcaccaacggcgccgtgcatgcgcactgggccgtggtcttcgcgcagaccatcagccgcggccagcgccacggcatccacggcttcctggtgcgcctgcgcaaccacgaggtgaggcgcggatgggtgtcttcggcgtggggtgaggggcagtgggggtgcggatgcaggatgctgccctcggtacgactgtgtgctaggtagctggagggctcaccagaccagggctgactgtgcacacctggtggccatgacgctcacaggcgcaccgccccttnnnnnnnnnntgaccagggctgagtgtgcacacctcgtgccatgacgctcacaggcgcaccgccccttttccaacagaccatgcagccatgccaaggcgtgaccattcacgacatgggccacaaaatgggctgcaacggcgtggtgagttgggagttgcaaggtgtgggcacacaggttggcacctgtgaggaccagcctgacaggatggcatggggtgggcgggagttggcgccgtcagctgcccagcaagcctcttgccttttcgcgcaacaaatacccccctcccctctctcctcccctccacaggacaatggcaagctgtggttcaacaatgtgcgtgtgccgcgctctgccatgctggacgccttcagccaggtggcgcgggatgggacgctgacctccaagatcccacgagccagggatcggttcctcaaggtggcagaccagctgctcaggtgcggaggccaaggcagggagtgggaagtttgggtgcgcgctgggctcccgctgttggggttgcggtgggacgagagtgtgagggcagggtgtggtgccctgtgtgctgtgtgccgctggttcagtcatggttcatcgctcaggggtgatctccttccttggcgcgccagctcaacccccaaccacccatcccgcccctcgcattgctcaaacagtggccgcatctgcatcgccagcatgatgctgagcgggnnnnnnnnnncttggggttgaggtgggatgagagtgtgagggaagggtgtgatgccctgtgtgctgtgtgccgctgactcagtcatggttcatcgctccggggtgataacctaccttggcgcgccagctcaacccccaaccacccatcccaccccgcgcattgcacaaacagtggccgaatctgcatcgccagcatgatgctgagcggggcgaaaatggcgctgaccatcggcatgcggtatgcaagcacccgcctggccgtcggacccacgtgagccgcggcgagaggggggtggaaagggagtcgcgaggggtagaggatgtgaaggagtctgggtttaccctcaggcagtgggtgcggaggcgctctcaagatcttgcgggcaggcggggagggtggctgcatcctgaatgcttcacacagcttccacccgtcgtgtcactggaccgactgcctcctggttttgcagtgggaagagcgacacacccattctggagtaccagctgcagcagagggccctggcacccctcctggcctccaccattgccctcaacatcgggctcaactatggtgcggggcgtgggaagctggtctgctagaaacaggatctgggtcctggcttgcgatggggtcgaggtgtacatcacttgggtccatgctgctggcgtctgtgtcgtcagccgcagcactcaacccagctccaaaacggacaccttacagtcaaggagcggtggagcgcggcgagtggcttcggagaccgcttgatcccggcggatgaggcccgcgaggtgatcactctggtctgttccatcaagcccctgtgtggctggaacacggaggagacggcgaccacctgccgcgagcgctgtggcgggcaggtgtgtgagtgtgttgctctgtgtgttgggatcctgcgatttgagacctgcggagggctccatgtgggcttgcttcggtgcacccactgacttgcagcgcacaggggcctatcgtctgtcccagactcaatgccacggccgcactgaaccttccctccctctccgcgccaccccaccccttgcgtgacgtctcactcccacccccgcacctccccacctccaaagggctacctgagctgcaaccggtttggctccatcatcggctttgcacacgccggcatcacggcggagggcgacaatcgagtgctcttcacaaaggtcgccaaggagctgaccgccagcctgcacgtgcccgaggtcaaggcacggctggaagccgggaagaagccgccggccgtcaccgtcgccaggtggggtgcagttgtcgggtgcggcgcgcgagcggtgagatgtgccggtgttggcacgcctcccctcatcccaacacttccctccgccaccctcccggcatcacacccaccacccaccctgcccccaactcactgcagcctgtccgaccccgaggccctgctggccctcttcacggcgcgcgacggccggcgtctggccgcgctggccagcgcaatgtcgggcctgggctccagcgcggaggtgttcgacgtgtggatgcgacgcgagtccgacgctgtgcaggccaccgcgaccgcgtacgcggagcgggaggtgctgggcgcgtgcgtgcgtgcgctgcgcgccgcctcgcccgtcgcgcgcccactgctggtgcgctgcgtcacgctgtacgcgctgtgccggctggaggccgacctggcctggctgatgacggagggcatggtgccgctccgcgtgggcgcggcggtgccgggcgcagtgcgcggcctgtgcgccgcgctggcgccggactttggcacgctggtgcaggcgctaggcgtgccggagcacctcatcgccgcgcccatcgcgggtgactgggcgcggtacaacgagacggacaaccgcggggaggttgtgggggaggtgttttagagcggtgcctcagttgcggcgcagggctcctgacgaggtctgccatttttgtctagcgcacttgccactcctgaatcttgagaaactcctatactgtagcgctgtggtagtacatggctgtagaatgtgaaagacggggcacacgggaagtgtcgcaatttctattcctccagccgatcacacggcggagaactcgcgcccgcggagcgatgggagtggcattcgcctcatagcactgccttgtatggacaatagtgtcaagctggagaagattnnnnnnnnnncattcctccagccgatcacacggcagagaactcgcgcccgcggagcgatggaagtggcattcgcctcctagcactgccttgcatggacaatagtgtcaagctggagaagattatagtaattgaaaattctagtgttgtattatttagcccattaaattatacctgcgtcggccaagggctgtgagtcctcctcggcgtgacccgtcgtgtgccctggtcggagctcaggcatggatggggatgcatacaagctgctgggcttggagaatggacccgaggctacagatgtggagattaaaaaggtcaggagagttcaaatgcacggctgctgtgcggtgcagggtgattgctctcaagggatgtgaggggtgggtaaggctgaagagtcaagccgcctgggccctaagaggccggtgcacagccctcatttcgaccctcgcttccctgtgcaggcctatcgcaggctagccctgcaaaagcatccggacaagaaccccgacaaccccaacgccgcctcagagtttgcagctctgcagaaagcatacgaactcctgtgtgatggtgatgcccgcgcagccctcgacaactttctgcggtgagcacagtaatacgatgcacggcgtatggtttgcnnnnnnnnnntgcagccctcgacaactttctgcggtgagctcagtaatacgatgcacggcgtatggtttgccttccatacctgcattgcgcttgagattatgacactgctgcagctggtgtcgcaatggttttctcggttggtgaaggacgcatgttacacatgaacaagttggcatcctgttccccccccaatctccgttcccaatctcatgtgnnnnnnnnnntcatgaacaacttggcatcctgttccctccccccaatctccgttcccaatctcatgtgaacgcaccccctacactccatttggcagggcctgtgccgcacgcatcgtccgcaccgcgaccaaagacgcgaagcggcagaagatgatggccgacctggaggcgcgggaggcggctggcgagactcaacggagccaggtggaggccgcgcgtgccaggctggccgaggaggtcgccaagctgcgacgccgggccgcggaacgagaggccgccgagcgtgccaggactgtgcgggagcaggagcccgctgcgcaggctggggcggcggaggtggccggcctggatgccgaggacttggcgagcgcctccctccaggagcgcctcgctcgaacagtcaaggcctcctgggcgcgttcggtgcgtgctggaatgggcttgggagaatttcatttggcaacctgagcctgcatgctcggcgaccctactccttaccatgggcttcttgtgcccctgggcgtgtgtgcgaccagttcagacctcccagcccagcctgcagcctcatttgagaagtcacgacctcaaaccacattcatggcacaggacggcgagtacagcgcggaggagctccggctcgtgtttggccggcagggcgccgtggaggacgtggtgctgcgtggtgggtccaagaagaagggcagcgcctgggtggtcatggccagccgcgagggtgcggcggctgcggccccctccctcaacggcagcgcctcccggcctctccttgtggtcccactagcccgtatcagagcagatggggtaggcagggctgacgccagaaatggggagagcccctctggagccgtccctggcccatggtctgctatggacgggggcgacgcgggcagggcggggacaggcctgagctcggctcagctttgggcacaattcgatgcaatgctcgcctcggcgacactccccagctccggccctggccggccgctgtttgctgccggtgcagccttccaccagatcccgcagcagagcaccctcttcccggccgccggtggcgcggcgtccgggcgcgcccccagcccccaggtccagtttcccgctttccagagcaggagctacaaggcccaggaccatgacggtgcgcaagctgcagctgccgcggcagggttccctcggcacgaggaggccattctggccaagctccggcaggctgcagagaggaagcggctggcgcaggatctgcagcgacaggagctggaggagcaggaaaagggctgacggatgtggcgttgtcagcatgggagaaggtagagaaactgtaatgaaacgacctgacctcagtccaggaagtggtctgtcttttcatatcgaggggtcagggacgcgatgagagttcatcccccctttcctttcgccgtgcaccctggatcacattgtttctccacgacacctgccggtcccggggggactattctgtgccagtcggccgcgatcaaggcatgcaaactccatcttcatagtttgtcgacaaatttgagacaagcgttggtccagcagcggttgcaagcccaccctcgtgggtgtggtgcggcttggccgtgcttgtgtaggtggcagccatggagaccgcagacgaggctggaagctacgcaggctctggattgggggttctcgctcccgcagatgctcttgtcaaccccgtcatcggcgataccgtcagttttgggggcaacaccagtccggtgggtggtcctccgctgcctggtgggattccagctctgcgacccccccatcgccaggcagctggccccttcccaatcgcgatactctttgtaacatgcacattctccnnnnnnnnnnaagctctgcaaccccccatcgctatgcagctggccccttcccaattgcgatactctttgtaacatgcacattctcccctcatgtagcgtgcggcgcgcagccaggcgagccgagccttgtacagcaccaccccacacccagccctggagggaacctctgtcgtgctgtcgggggtgtctggcggtcaggacacctacctatctgcagcaggagctacgggtgcgtgggtgcaatgctcttcctggtgctctcttctgggagggcagctgtgatggtggctgcaatgtggtcctactgcttcccccaccatcttccatgattggggcatggtgtgtggtgccctggcaggcataggccgcttcattgcctttcagtgtatgtcctggtgcttcgcggtgcaggcgagcacacgtccgctttcccagccctgggcgaggcgggtgctggggcgcaggcggcctcgggtctacaacaggctgccagccttgcctctcatttcgagcagcccccccgcggggactggaccggcggcgtcccacgcggcggcagccctgccgtcagccgcgtggaggccggggagcatggccggtgcgcagaggccgggggcgcgctcctcgcgagcgcacgcagcgcgggcggcgccgccgacgcggccgccgcgctccgcccctcgacctcgggcaccgaccccggtggcgtggcggcccgccgcgcagccagggccagccgggagtcgcagtacttgggcgggggccccccctcgccctcgctgtccagggcccaggacaacctcggggccagccccctgaccagcacgctggctgtggcccgcggaggcaggctggagggggcggggtcccccggcccgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcgcacttatgcccgacggcgaggcggcgccagggcgccgggctttcgagcccggccacgaccagcgtgccgagaccccccgcggcggggtccacgacgccggcagccccgcccccggcgagggcagggagggcgagcggggcggggagggggagcccgaggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcctggccggggtcgaccgacggccaggtgggggacgtgggcgagtacggtgcgggcggtgtaggcggggtgggggccctggaggccacggccgccagtgcgccggtgccggggcgagaccgcggcgcg

SEQ ID NO: 37668 - DNA, 76 bp, Chlorella protothecoides
cgcgggacagcgtctgcttccgctctcaggctcgagcggagatccacgctgtggccctccattccaaaccaaacca

SEQ ID NO: 37669 - DNA, 79 bp, Chlorella protothecoides
atttattggctgaaagccatgcccaggtcagcacccaacgcctgcatgtaagagcccatacgctgacaggtgccctgcc

SEQ ID NO: 37670 - DNA, 61 bp, Chlorella protothecoides
gctcgtcagcccttcgcgcctcccaaggccaccccccccaagcagtgcaacagtgtacatg

SEQ ID NO: 37671 - DNA, 19639 bp, Chlorella protothecoides
  modified_base (704)..(713): a, c, t, g, unknown or other
  modified_base (802)..(811): a, c, t, g, unknown or other
  modified_base (1147)..(1156): a, c, t, g, unknown or other
  modified_base (1526)..(1535): a, c, t, g, unknown or other
  modified_base (2090)..(2099): a, c, t, g, unknown or other
  modified_base (2497)..(2506): a, c, t, g, unknown or other
  modified_base (3042)..(3051): a, c, t, g, unknown or other
  modified_base (3259)..(3268): a, c, t, g, unknown or other
  modified_base (3819)..(3828): a, c, t, g, unknown or other
  modified_base (4130)..(4139): a, c, t, g, unknown or other
  modified_base (4675)..(4684): a, c, t, g, unknown or other
  modified_base (4991)..(5000): a, c, t, g, unknown or other
  modified_base (5055)..(5064): a, c, t, g, unknown or other
  modified_base (7816)..(7825): a, c, t, g, unknown or other
  modified_base (9387)..(9396): a, c, t, g, unknown or other
  modified_base (9579)..(9588): a, c, t, g, unknown or other
  modified_base (10385)..(10394): a, c, t, g, unknown or other
  modified_base (13512)..(13521): a, c, t, g, unknown or other
  modified_base (13728)..(13737): a, c, t, g, unknown or other
  modified_base (13919)..(13979): a, c, t, g, unknown or other
  modified_base (14292)..(14301): a, c, t, g, unknown or other
  modified_base (14363)..(14597): a, c, t, g, unknown or other
  modified_base (15802)..(15811): a, c, t, g, unknown or other
  modified_base (16211)..(16220): a, c, t, g, unknown or other
  modified_base (17918)..(17955): a, c, t, g, unknown or other
  modified_base (18422)..(18431): a, c, t, g, unknown or other
  modified_base (18988)..(18997): a, c, t, g, unknown or other
  modified_base (19149)..(19158): a, c, t, g, unknown or other
  modified_base (19419)..(19482): a, c, t, g, unknown or other
cggccgggcgcggtccgcccccgacgccggcgcctggatggcgccagggtcgagcgcgcgggcgctgccgcgcgacgtcgcctgggtggcgctggccggcctcttctacgccctcgctctctacgtccgccactcggtgtacatcgcgggcgagcactactccgcgccctccatcgtgctgcaggtgctggaaggggcagggaggggcgaagcggtgtcaggttgcatgccgatgcatatctgcctgcagggcccagttcgtgccatgcagtgcgcgactcgatgcccacccccgcacacctgcctgccggagactctgcgtctcccactaccacccccattgatccccgcgctcacccctcatcccccgctcgcagacccggcagcgcgacggctccatcaaggtgtttgacgacttccgggaggcctactcctggctgagccacaatgtccccgccgacgccaaggttgcctcctggtgggactacggctaccagaccacagccatggccaaccgcaccgtcatcgtggacaacaacacctggaacaacacccacatcgccacgggtgagggctggcgagggcggcgggagtctgggtggtgcagggtctgagtgttgttttggggttgaatcgatgacgaggatggaaggcatctgcttctgggaggggtccgtgagatcaaggatcaagggtgtgattcnnnnnnnnnnagataatcctgcgctaggaatgcgtagggaactggaagaacaccgtcgtgtggagctggtcagccatgcccggcctgcactgctctgcnnnnnnnnnnttcgatgacaaggatggaaggaatctgcttctgggagggggccgtgagatcaaggatcaagggtgtgattcctgctcggttggaaaggagcagcagggatggccttcggccgtcggttgtcttgtgtgcgaccagatgcacggcaggaggggcttttctctctggataatcctgcactaggaatgcgcagggaactggaagaacaccctcgtgtggagctagtcagccatgcccggcctgcactgctctgcattgcatttggttcagcatcgtcaagctgaccctcccctcctcacgcacatgctcgcagtggggcgtgccatggccctcccagannnnnnnnnnctgcgtttggttcagcatcgtcaagctgacctccccctcctcacacacatgcgcgcagtggggcgtgccatggccctcccagagaaggcctcctccgaggtcttcaggtccctcgatgtggagtatgtgtttgtcgtcttcggcgccttcatcgggtgagtgcttgggttgggagggggtgtcaaagatcagggagggatcgaggggggaggagccagggcctggggacggagaggacaccttgcttgtgggatggtcatgggatgctgtctcagggcctccgtggagatctcaccaaagggttctcatttaggtccagcagctgaccttttcccctcgacgccccccctcccgccgtaggtacccctcnnnnnnnnnnttcaccaaagggttctcaggcaggtccagcagctgaccctttcccctcaacgccccccctcccgccgtaggtacccctccgacgacatcaataagttcctgtggatggtgcgcatcggcggcggcgtcttcccggacatcaaggagcgggactacctgaacaggggccagtaccgcgttgacagcaccgcccccaaggccatgctggactccaccatgtacaggtgggtgcggagagagacatggggtggaagagggggcgaagctaccagggtccagaccgcgtgcccctgggcgggctgtgtccctccagccgctggcatgcgctgctatgcccttgacacgtggttgcaaggcaacggacggcatggagatgcatgcagcgtcgtgggttcgcgccgtaatatgcatggccgtggcgcactctgaatcccctcgcaccaatcgcgccccccttgggcctgccgtgtgtgtaagattctagaacctcagccccctccacctgcctgccttctactcgcaggttgtcgtactatcgctttgcggagacggggcnnnnnnnnnnagcgtgggttcgctccctaatacgcatggccgtggcgcactctgaatcccctcgcacaaattgcgccccccttgggcctgccatgtatgtaagattctagaacctcagcccccctcacctgcctgccttttactcgcaggctgtcgtactatcgctttgcggagacggggcccctgtttgggatgccctacggctacgaccgcgtgcggcagcagaccattggcctgcccgacttcaagtgagctgcgtgaagaggggcggggcgctgtggggagcaggggggtgctcaatcctacatactgtagggggcactggcagtgcaatgcaatgtgcggcggacgctcaaatgatcctcatgtggccagttgaggctctcatggcggcggtgcgacccaccnnnnnnnnnntgacttcaagtgagctgcgtgaagagggcggggcgctgtggggaggaggggggtgctcaatcctacatactatagggggcactggcattgcattgcaatgtgcggcggacggtcaaatgatcctcatgtggatagcagaggctctcatggcggcggtgcgacccaccctatgctgaccccacgcggtcgcacgatgcacacccaattgccaatccaggtccaccctccccctccaacaggctgaagcattacgaggaggtattcacctccgagcactggatggtccgcgtctaccgcgtgctgccggagcccaaccgcgaggtccgcctgccaaacccaaacagggtcaaggcgcagcgtggtgccaaggtcaaacccaggcggccctctggtgaccccacctccatgccgtccaagaccaggcagtgagggtggcgggcttccccctccttgtgcgatggaggcatgcgttcatcagggtgctagagccatgctctgaacggggttgcattgcccatgcagctggtgtaaggagnnnnnnnnnncgtgcgatggaggcatgcgtgcattaggatgctagagccatgctctgaacgggattgcattgcccatgcagctggtgtaaggagatttatcgaagggggtgtcagtcatgtttctcactttgaggaggaacatgtgtctatgttcgcctcctgctagtatgctgtggggggtagttcgtcagatgagtgcatctcccagtatcttcannnnnnnnnnagaggaatatgtgtccatcttcgcctcctgctagtatgctgtgtcgggtagtttgtcagatgagtgcatctcccagtatcttcaccacaaggagctctgttgctggatatcaccgccctggctggcttgacgagcagccacaagatcatgggagatcgcataggcaaggaggcagtgggcatcctacaaggccattctcctttacgtatcttgtcttctcactagaaatcgcagtctggggctgtgaaacagaagagtccaaggtcaggagaatctccaaaagacgaatctgtaggccccaaaagcccagctcaacaacgcgatacaatagtgcagaatgtccggggttcgaatcctcgcagctccatccctcttaggggttgtggcgcagtggtagcgcgtctgctttgcattcaatctttttactttttgctccggtgaatatttacatcatcctacgttgcggtactttactccaaggtggtttattgtcgtggcatatgcagctttggatgatgttacgcgtgtcactgcccagatgccaacagtgnnnnnnnnnncttttttgctctggtgaatatttacatccgcctacgttacggtactttactccaaggtggtttatcgtcgtggcatgtgcagctttggatgatatcacgcgtgtcactgcccagatgccaacagtgcttggccagcccgacttctggggccacaaccctgaagagcaccataaatcccacattgtagtggatgtttggacttcccgctctcctattctatgactgccatcttactcggatgcatgccgtattggatacttggaagtttcatgcagcaggcacgtggctcacacagtcactgnnnnnnnnnnagcagcgtagattccacattgtagtggatattggacttcccactgacctgttctatgactgtcatcttactcggatgcataccgtgttggatacttggaagtttcacgcagcaggcacgtggctcacacagtcactgctccagtcggagtgagttccccacctcttctcaaacccgctgtacatgaggtcaggacttgcaactctatacaacacgaaatcctcagactaaaggggaatgcaagtgctaggacagacgcgctgggacgtttctgcaactccttgggggggaagaaaagcacaccctactgccagttggtgccggagatgcggcggatgtacgcgcccgacggcttcacatcgcccaccgtctcctctggcttgccgggcacccggtccttcatcggcttgtagtccctcagccacacgccctgcaaggttgggagggcggtggagggggtctcctccgggcgagtgccgccgtgtgttatgcgcaaagcgccccaagcatgaaatcccccacgcgagcgacggaagnnnnnnnnnnatggagggggtcgcctccgagcgagtgtcgccgtgtgctgtgcgcaaagcgccccgggcatgaaatcccccacgcgagcgacggaaggctgtcgactctctggtacaggcatgagaacgatccgcaagggcacctcaccgtgtagtcctgctgcggcctgacgatcttggtgtctgggtcggcgagtgtctcgcgccaatgtgcgaggtagcctgtcaagagcgatggaaggcaaaggcttgtcgtgaagactgcggcctagggcgacagccatcgcctgggagatgcccgcgtggagggtgggcannnnnnnnnnagcatgaaaacgatctgcaagggtacctcaccgtgtagtcctgctgcggcctgannnnnnnnnngaggcttgtcgtgaagactgcggcctaaggcggcagccatcacctgggagatgcccgcgtggagggtcggcatacagtgtgctgcactccaatgcaacccgtttctcgtccccataccccaatcctcacccgtgatgcgcgggatggcaaagagcacggtgaagaagttgggctggaagcccatggcggagtagaccaggcctgcatgtggaaagaagaagaggtgggggggtgttgagcatcagggagcgaccagaggcaggccttggcgtggaggattgggttccaaaagggtcgatctggctctgtgcaacgcccgatgggacctgacatgcaggtctcgagccctgccgcacatgctgtggtgtcccaacgaagccactgccccctcccctgcttggacggtgtcaccaggggcacagggcaaacctccctcctccctcacccagcctccctgtgagcagcatgatcagccgcagaatgttgacaccccccagctttaagcgcccgtcccctcccccaaatcaccccacccacccgagaagaagtcgacgttggggtagagcttgcgtgacacaaagtagtcgtcagcgcgggcagccttctccagcgccagcgcgacgtcgatgagcgggttccggcccgcgatgtcaaacacctcctccgccacggcctggatgagcttggcccgtgggtcatagttcttgtagacgcggtgcccgaagccaaacatcttctccttgcggttcttcaccccctccaggaacccgggcacggcgtccacgtgcccgatgcgacgcagcatgcgcagcacggcctcattggcgccgccgtgcagcggaccgtacagcgcgcccaccgcgccggcggccacggtgtacacatccacgcccgagctggccaggtggcgcgcggcggaggtgctgcagttcagctcgtgctcggcgtggagcaggaacatgacgtccagcgcgcgggccaggcgcgggttgggccggtagttgggccgcgcgccgccgtccagcatgtagaggaagttctccgcgtagcccaggcgctggttgggcggggcggggcgccgcccgctggcgacgtggtaggcccaggcgccgagggtggggatcttgccgatcaggcgcacgatctgcttgtcctgcacgtcgcgcgaggcgtagatggcctgccccgccagcgcggggttctgctccgggtggcaggtggacagcgcggccaggcctgtgagcagcacgcccatggggtgggcatcgtggggcagggccgccagcgcagcctccacggccacaggcagcgcggagtggcgcatcaccgcctcctcccaccgcgcggcctcgggcgcggtggggagcttgccgtacaccacgaggtgcgcggtctccaggaaggtggaccgctccgccagctgctcgatggggtagccgcggtagcgcagcacgcccctgtcgccgtcgatgtaggacaccgcagacttgcaggcggtgacgttgaggtagccgttgtcgaagggacgcaggcccacgccgtcgccgccggccgtgatcttcttcaggtccgtggccaggatggtgccgtggtcgctgatggggatctcgtaccgcctgcccgtgcggttgtccaccacggtcaggctgccggggccacccgccacggcgggcctgcgggttagcggaggagggcggggtctgagatctgagatcctggatccatcacacccatgcttgtcgtgcgggatctgggctcccgccgcgggcgcacatgaccgcggacccacacggggtggacacgacccgcgagggtgcacgccgcagcccccgccgtacttcttgtgcacaccaggcccatcacacccacacacctcccggtctgatcatgtggggcggaggtgcccaccctctccaagccatgctccgcttcggaaaccgacaccgaggccaggtgcctctgtagggttgcgatgcggtggtgggctgccatggcgaaccgatgactctttttatatctgtcgaaacccaaatataattatcctgtcgacagaccatgcggcaggaaccatctttgataaatcgtgaccaagcgccaaagcgcgctgacgtgggacatgggtgtcgtgtcggagaatctggcgccggtcgtgccccctgcctagccatcgacaaggacacagggagtgctcgaatactggcacacgaacgaattcgtgattttctcaacctgattttctgacacattcaaggacgaccatagtgtctcacagcagcaacagcctatggggtccttggcgctggggaccttgctgacgctttccgtgagattcagcatgcattccttgacctccttgcattgatcgagatagctcccaggtcgcgtacaaatgtctgaccaaggctcctcattggggggtgggcagcattgtcagcagatgtccagaccttgctgtgccagtgcaggagcatcttaacagtgaccaggaatcaacacactgcttgtgactgggcggggcgccaacccgtgcatctttgagcactcacacatgcgcagtatgagtgcaaggcatcaatgccttgcctccgaaaaacacccaatatggcagaggtgcctggcagtgccaactggaatcgtgatatgctgagactggacctgaatctcagacaacacaggggaggggggggtgcgaggcagcaggggtcagggaggagtggtgagggtgcaggacagaaggtaggagatggcatgnnnnnnnnnncgtggaatcatgatatgctgagactggacctgaattacagacaacacaggggaggggtgatgcgaggcagcaggggtcagggaggagaggtgaggtgcaggacagaaggtaggagatggcatggcgagtcggtaaggctccatctatgaaaagcggtgcactcgttcaacattctactactggcacaaaatctcccggggggtgaaccctgtttgctggctggtgaggagggccaggcggacagaaggcagaaaggttgggttggccgtggccggcgaattcatgtttgtacggcggggcccacgcgactcgcccggcccctcgaggtcgcatggcagggtgcgcgcgggagcaatcggcacgcgggggtgattggtacgcaggcaccacgcccccgcctgcactggccactacatgatggcacaggcgcagccgggcagcatcttctcgctcacgcgcagtgccccactctcctcgatggccgccagaacgacgacggcgtgccggatggagggcctgtctgccgggtcaccctccaggcacttttcaatcagcttcttcagctgtgtggggagcttgtctgccaggggcatgcggtagcccccctccatctggggatgagggggcgtgtatgggctgactggcagagacaggaattggcagaagggagcatggcatgagcaagagtgtggcgataggctgagaccaccggcctcgctctggcgctcacgagctatttccgtctgtgcaaccctccccactcgtgcagtgacccacatctcccctgcaccgatgccatccgccatactgtcatgatggtgcccaaaacctgccaatgaatccgtcacggcagccagcgccctgtcccaaccccccaaactcctttggctctgccacgcacctgacgcgcatactcggacgcggcggtggacacgtttttgttctggccgtcaaagtaggccaccaaggaccgcttcatgaagagctcatacaggatgatgccaaacccaaacacgtccaccttctcgtcgtaagactcctttcgcagcacctcaggcggcaggtagcagtaactgctggtgtcggagacggcgctgaacacgtcctcggggtcgtagctcagcttggcgccagggatgattgttctgctcagcgaaaggaggtggagcgcggagtgggtgttaccacagagcttgacaaaaccaacaatgtaaggctcatagcccgggtatgctgatcgcgagatgtgcgagcgccgcttcaggcgtcccatggccatcgaagcacagtaagcctgcttctccctgcctccatccagcaggccacaggcccctccgccgcaccccctgtgctccctccctgctcacgtgtgcgtgcctaggtcgcccagcttcgcaattagcttcccgcccttcccaggcgcggcatagaggagcacgttctccgcgcgaatctgtcgatgcaccacctgcgctgagtggcaggtggagagggggaccattcgttcctgccagaccccaagacacccggtacatcaacatgtgttcaccaggcagtcacgnnnnnnnnnncgggtggcaggtggaaagggggaccattctttcctgccagaccccgagacacatggcacatcaacatgtgttcaccaggcagtcacgtgatcctggagccacacttggcctcaaccagttctttgtcccgcccacgcagcatcgacggcaatgctgtatcagacagcccagggtcaccccttnnnnnnnnnnatgtcccgcccacgcaacatcgacggcgacgctgtatcagacagcccagggtcaccccttggacctcctgccattgaaaccacattcgcccccccccggtcgcccttcagcatcacagcctgccactcaaacccaccctcggcttctgtgcatggagttcggatatgccggagccgatctgcctcgcccacttgatggcatcctcgtagttgtacaggacaatgcgtgggtcctccatctgcgcctccagcaggtcctgcagggagcccccctctgcatactcctgcatgaggcatggagggcgctcttgagcgcccggcatctctgacagtcgcatggtgaccttgaaatcaatcagcacatcccagaaaggctgcctgagatgagtgctggcgtctccacagtggctgtgaccaatgtcagatgccaggtgagcacatggcagctggcacaaagtatgagcatgcgctcagccagcctctgacgcaccacccaacccaccatgacgaggaacatgctgggccacatcatgtcggatcggctgcgctcgcaccctatgccgatgagcttggtgatgcccctgcgcagcgagatgagggtgctgagcgcgggcgacatgggtggcagcatgcaagggagggacaaactgcatgctcatgccttgtaggacctcaacctcagctagccaataccatcccccaggttggtgccgtttactgtttacccagagtgcaacaatgcacaggcattcacaacctcacccctagcctccctccactccatgatgccccttgctnnnnnnnnnnggtgccgttcactgtttacccagtgtgcaacaatgcacaggcattcacaagctcaccctggcctccctccactccatgatgccccttgctgctcaccgaaagtgttcgagctggagaagcagctccgcctcccgggcaaagcatgtgatgtccctctcggtataggcggactgacgcaggcgcttgacggccaccttgatgcccgggtcctcctcctccccgacgcccggcttcctgagcctggcgaggtccacgacacagtaggatcccttggccagtctcttcaccttcgtcagcctcgacgcaggtataagatctatgccctcgaaaaggtccctggggctctgcacccccaggttggcagacactcgcgcggacaggcgacgcaggttgacggggcctcccgaccccgccaccatgacatcgtcccgccggtggccgtggccctgcttgctcatatccggcgagttggcatgtattttggattgtagtttctgcgcgccgtgcacctggggactcgtgggcggtcctccgataccgtcgcggaatgtgacgcatggtgcggtgcgtgctgggtgccaggtgcctcactcctgacacggcagagctggtttgcaagctggtcccggccgccgccctggcgcagcagacagtcacctgcatggtatagcccaatcctgacttggaggcggcccttttacagctgatggagcgagcagctcgcatgtcacaatgctagtgcagcgagaagccagcccagcgcacactgcattcggagcggtcagggccagtcctccctgccgctccgcgcggcgggggctacccatatgcgtatcgtcttgtcgtcggaggcggaggccatcaggtagtggttgaccggattccaggccaccgcattcactgtcccggtgtgacccttgagaatctgcgcagggttgggtggttgggaggagtggcgtgcgtgtcaatgggcagtctgtgtgatgagagccagggctgacaccctgcagcctggtgaggagatcgcgaacagtgggcagcattcgttctggctcgaaatgcccggacgcagggcaagggtcgagcccttcgcgctggacgcatgcgaggctgccagagcgacccggcgcgctcacggcacacctgggcccctgcattgcatcagcgagaggactcccccctcccccccctcttccctcctagggaaccctcctggcaagagtgccccctcccctcatcagacccccccaacctcctcctaccccaggctttcttcccctcggaaaccccagcaacccacctcgagcagattgccggactcacggtgccagatgtgcacggcgccctcctccccgccgctggccacaaagttgttgcggtagccgcctatcgcggagcggatgacgaagcgcccgtgctgcgcctggcccacccggtactcctgcagcggcgcctgtgccaggtggtccaacgggtcgccggggcgtggcgcgtcggggctgccctggccgccggccgcctggcccccggggggcgcctcgccctgcgcctcgccgtcggcgggcgaggcgggcagggccatgtcccccaggggccagaggtggatggcggcggaggccaggtttgccagcaggaaggcgccgtcggaggagggggtgaggcaggtcacggcccccgcctcgcccacgctggcctcgcggccgtcggcgaggcggtggaaacgcaggcgcttgtcctggccgacggagaccagggtcccgccgtcggggctgaccgcgcagtcgtagacgtgctgcgtctgcttcagcctgcgctgcgtcacgccgcgcacatccaccacgtaaagcgccttgtccagcagcgcggccagcaggtgtgtggagtccgggaaccaggcggcggcggtgaccgcaaactcgccgcccgcgctggcggcgaagctgcactcgtgcgccagccggcccgagggcagcgtgtagaggcgcacgcgtccgtcggcgccgctggtcagcacccaggcgtcgtccgggctgaaggccacggtgttgacgggggaggaggagcgcgtgaggtggcaggcgtaggtgacccagccgctcggcgccacgcgccacagcagcgcgcagccgtccttggaggccgaggccaggaagcggccgtcgtggctgaactgcagcgcccacacctcatcgccgtgcatgtccagcgcctggctgcagcgcgttggcagctgctcggggcccgcctggaagtcggcgaacagcgtctgctgcgggtgcggtgcgttcacgtactggcaggcctccgcctgggccaccagcgcctgctccaccagctcctccagccggccctcggggatgagcagggagggcggcagcaggtgctgcagctccgccagcagcgcgtcgcggggcggcgctgcgcgcggcgcaccgccgccgccgcgcgcacccaccagcgcccccgccagcccgtgcagcacgcggcggttgacgcccagcggcgccagctcgcagcgcagcgtggccagcgcggcggccaggtcaccccgcgccacgcactcgccgtacttctggcgagtgagcaggaagcgggcctgggaggcgtcaccctcgctggcggtcagggaggggagcagggccagggcgctggaccagtcgcccccgagcaccgcgtccctgaagtcggtggccacctggggctgcatgctgatgccctgcgggggtgtttgggggggaggggggttgctaaccgacaggagataggaaaagtgacttcacaccgccagcacggtgaccacagggagctatgctgtagcgggggcgccacacgggtggccccttagaagcgatccagggacggtagcacgcaccgactcggcctccagctgactggcgagggcggggtacccgagtccggccagagcctgctccagcaggcggatgtactcggagcgcaggatcatgtggcgcccgcctacatgctgggcatcgcccgagggcaggggaggggccatgcctccggctcctgcaccttcccgggaccaagcggacccttcaatggtgtcgggatcctctgtcgataccattgatgggactcgagggggtggatgtggggnnnnnnnnnnaaaactatatgctgcaaacaagctacaaccatataaacgtcaagaaggatggcactgatgaccattctgactgttggaggatgacgacgtgatgccatgcatctagagtccgtgaccacccgtgttgcacagtcgccactgtggacgccctcgtcccgacagcagtctgtgcgtttccaggccggatccaggatgcagagacctcannnnnnnnnntggccattgacgacactcgtgctgcaaagcacgcgcgacacgcgagcacaatggccgtctaaggaacccatctgtggagcagacgtacccaccatgccgaaactacatgctgcaaacaagctacaaccatatacacgtcaagaaggatggaactgatgaccattctgactgttggaggatgnnnnnnnnnnnnnnnnnnnnnnnnnnnnnnnnnnnnnnnnnnnnnnnnnnnnnnnnnnnnnggtcacgagtgccgctggatcgacagtgcgcagacccatcctcctcatcgacattatggatacagtgggggagcaccctcatgcttggcctcgcccattccttgtacgcacctcattggatcagtcacctccacactgatccactgcagttcgtgatccattctacgagcacatgcctgccttctttgggatgacctttcaagaggtgactgtggggtttgctgtttggagggcatggggagtggcggctggctagcaagttcgcgcagatatcagccacctatcattcccctgtgagatctacactgtcgtnnnnnnnnnntgccctcgtcccgacagcagtctgtgcggtcccaggccggatccaggatgcagagacctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtggtggctggccagcaagtttacgaagttatcaccaacccatcattcccctgtgagatctacactgtcgtcgcttgggaagtagaatcccccatcttgccagcacctcccactccatcccaaatccagttgatggaggccaagcaccccgagtcctgggtcaagtttgagctgggccacatctcagagcaggatctctacgacaacttctggaggcctggggctgccggtgtgccctttgatggggctgcgctccgtgagcacatggtgagtggcgcccgttgcttgcatgcctgcatgctgttgtgttcctggatgcagatgtgctggttcatcaccttgtactgctgtgacatggctgggctgttctttggggtgagcatgccacatcatccacagagagtgagcattctcagagctgcttcaacaccgcatgcaccagcctgcagggcagaggcatcaagcagccgtctgcagcctcatccactctgcaactcttcctatcgcaggcctcccggtacagcctgctcccagggatggccgagctgctgcagcgtctggccgccgccggctacgagctgcacgcctgcagcaattacccgacctggtggcgggaggttgaagcacgcctccgcctcggcgacctgctgccctggaccttcctcagctgcgaggggcccatgcgcggcctgcgcaagcccgaccccgccgccttccaggcagccgccctgcatctgggggtcctgccggcggacctccttctggtggatgaccgggaggtcaatgcccaggcggcacgggttcacggcatgcgggccgtgcgctttgtggacacgggccgcttggaagaagagctccaggccgcgggtctggaattctgagggaacgcctgaaacatcgcgtgttgctgacgcctgctgccggttccagggcatgggcttggtcgtgacgaccccttgcaaccttgccattaccagtctatgttggcccgccgctccttcttcttgtctgacttgaactttttggcattcagccggctctcattgccacgctgcttcctggagggagaggggaaggagattcgaaacagtgagtgctcattcggctgaaaaagggaattgcaggcaggcgtgcagtggggcacgagcaaatgcaaggcacgcccactcctcgagcccccatcaagacgcactgcttctccannnnnnnnnnaaaataataagtgctcattcggctgaaaaagggaatcgcaggcaggcgtgcagtgggccacaggcagatgcaaggcacgcccactccttgagcccccatcaagacgcactgcttctccagcttcttcttcttggccgggtcctcctcgatgggctggatgctctcccaggccccatccagggcctgctgcagcttctgcagcgcatcctcgatgttatccctgcgggtcaatgcgtgagtgaggaagctggtggcgtgtgatgatggtcttctcccttggggtgatcggcgagcctcatacgggcatcggtggaccgcttcacaccctatcaccacccaacgcacgcttgggagcgggtgagctgggaggtgatgacaaactccccctccttgttgatgnnnnnnnnnntgtgtgatgatggccttctctcttgggataatcggcaagcctcatataggcatcggtggaccagtttgcacccccatcaacaccaacacacgcttgggagcgggtgagctgggatgtgatgacaaactccccctccttgttgatgcggccgtgctccagccgccgcagcgcggcacccacatcggggtggagccagtcggcccgacccagggccaggcgcatgtccaccttggtgttcaccttgttcacattctggccgccggcgcctgagctcctcgcaaacttaatctggacgtcatctgcatgggcaccgagcagggacagggaggtggggagttgtagtcttcttggatgagggcatgggcgccgcctgcaggggaatgggactaccgagctccagggaggggcccaggcgcggctgacctctgcctatgcgtttgacggggggcacctccggctcctttgtaccggccatgcatcgcagcggctggcgcgggcggcagctccaaatcgggcacctggccagcaccagggcggggctgggacacggcaggtgcaggccctgggacctgaagagcgatgtgagggacagcatcgaccgcatttgaggtgcgaacggcatccattcaatgtacctccaaagggactgcaggcttatcgctctgcagttgcgctggagcaatttggtggggattaggaccgcgcagcacgcgcctcatccctcccgtgcctctccattcgcagacctgcgtccgtgctaggcaacccaccccgtcgcacgagcgatcccacgcgccagcggcgagccggcccaagatcaagttcattatattgagatcgccacacgattgcccactcatccagatcgggctgcattcccatctgccgggcactgcgcccctccacctcgaggtgccctgcggggcctgttgagaaagcccagcccctccctggacggcagggcgccatggcggatcaactcctccaggccgtgcacgccctgtaccagaaccccgaccccagcgtgaaggagcaggccaacgcctggctggacgcctggcagcagtccccggaggcctgggcggtgtcggatgcggtgctggcccggcccgacgcggggctggaggcccggtacctctgcgcccagaccctgcgcaccaagattacgcgggactacgaggagctgcccccctccgcggtgcccagtctgcgcgacagcctgctgcgcatgctgttggccacgcgcgacggccacgccgccacgcgcacgcagctgtgcctggccctggcctccctggcggcccacctccccgccgaccagtgggcgccggcgggcggcggggtgctggcctgggcggaggccgcgctgctgtccggtcccgtccccgcctggccgctggcggtggagctggcgggcatgctggcggcggagggcgccagcttccagccctccctgcgccctgcccgccgccgcgccttcctggaggagctgctggccgcgctgccgcgcgcgctgggcctgctgggcgccgcgctgggccgccccggcgtcgacgccggcgtgacgctggacgcctttgctgcctggctgcgcctgggcgcaaccaacggcggcgtacccgccccggcgctggcctccgccggcgcgctggtcgacgccacgctggcggggctggatgccgacggcgaggacgaccnnnnnnnnnnnnnnnnnnnnnnnnnnnnnnnnnnnnnncgccgacggcgaggacgacctgctgtaccaggcggtggaggccactgtggagctggtgtactgcggcgcggcgcgcggcgcgccccgccccgagctcgccgatctggctgggcgcatcgtgagccgggtcatggccctgcgcccgcgcttccacgtctgctgcgccgccgcccgcgccgaggcgggcgggggggtgccgggcgccgacgatgacagcgaggaggccaaggccctggcccgcctcttcgccgaggtgggggaggcctacactgagctcatagccacgggtgagcggataggggagtgggggggttacccacttttgatttggggtgtgtctcgtatctgggcatcgagtgggtggggcccggaacgcagcggctgagtaacgccctgagtggaagcgtttgggggggacggtggttgctcaaggaaaggtggctcgaaggatgtttctgccgagcagnnnnnnnnnnggtggaagcgtttggggggaacggtggttgctcaaggaagggtggctcgaaggatgtttctgccgagcagcgtgttgtgtctgaagatggagctggcacacatactgatgagggagatgttgggaccagccggccttactgcccggcgtgcctcatggtgtgccccagcccatccaagtgtttgattcccctctgaaaacaacccacacccacccccttgcatggcaggcacgccgcaggtgatgggcccgctggaggccatcctggacgtggcggcgcacccctcggacaacatcgcctccatgtccttcaacttctggcaccgcctgtcgcgcgtgctgacctcgggcctgcagccgcagcccatcggcagtgggggggcgcaggagggcgcgctggccccggaggagtcgcggcggcgcctcgccgtcttcgcgcccgtcttcgagcgcctggtgggcctggtgcgcggccgggtcaggttcccggacctcttcgactcctggcaccgcgacgagcaggccgacttcaagcgcgccaggtgctgaaaggggtgnnnnnnnnnngggggctctgggaggagctggcgcagaccaggtgaggcgcgggccccaagattcaagtgcccaaaggactccctgtactccaccttcactcgttgcaatccccatttcccacacgtaccaccacgcctgccaaccacatcactctcaccccnnnnnnnnnncggggctctgggacgagctggcgcagacgaggtgaggcgcgggcccaagattcaagtgcccaaaggactccctgcactccaccttcactcgtttcaacccccctcccatttcccacactcaccatcacgcctgccaaccacatcactctcaccccccccccctcaatcccccgccgcgggcagggtgggcgtgggggatacgctgatcgacgcggccaccgtgctcggcggtgaggccatgctgcgcctgctggccgagcnnnnnnnnnnnnnnnnnnnnnnnnnnnnnnnnnnnnnnnnnnnnnnnnnnnnnnnnnnnnnnnnaggtggcgcgcggcgcgccgctggactggcgcggcgcggaggccgcgctgtactgcatccgtgccgtgcaccgcttcgcgccgccacccggcgacgcgctgctggccgcgctgttcgccgcgctgccggggctgccggcgccgccgccggcgctggc

SEQ ID NO: 37672 - DNA, 61 bp, Chlorella protothecoides
gggctcaccaaactcaacatgcaggaagagaaaagctcgatcgatcattgccggcatgcca

SEQ ID NO: 37673 - DNA, 1411 bp, Chlorella protothecoides
  modified_base (706)..(715): a, c, t, g, unknown or other
  modified_base (895)..(904): a, c, t, g, unknown or other
gcctcgcccgcgtgcggcgcggcgcgcgccgcctcgcgccgggccagcaggcgccccgtcagctggcgcagcgcgtccagggccaccaggcccacgccctcgtcggcgtggcaggccgcggagacgaggtgcgcggaggccatggcccagagccgggcccagaccaggcgcgggcgcgggacgttgagcagcgccacctccgtcaggcgctggagcaggtgcaggcgcggcgggcagccgggcgtgcccagctcctcggcccccgccgcgcagagcgcgcggacaaagtccaccacgccgtcccccgtcaggcgcgggctgcgcgagaagacgcggtccacggccgtggcgccggacgcatcgtgccagagcagcaggcccgcgccgggggccgcgcccgggctgagcaacggggatgccgccgcaggtcggacggcggggggcactgggccggaggtgggtgctgccccgcgcccagcgccggccgcggcgccgtccactgcctgcgtcgccgtgccgtcctcggctgcgggccagcccagcgccgcccagaacttgctgctcagcgagccgggcccggcgtcgcctggcgaaggggggcggatggtgccatgcaggtgagtgggctggaggactggcacgcgcaacgggaaaacacagcagtcagccagctgggttctgacagcaggggggtgcggtatgctgnnnnnnnnnngacgggaaaacacagcagtcagccagctgagttctgacagcaggggggtgcggtatgctgtggcgcccactattttctccccctcaggagtgtctagcagcgtaaggacctgccacactcgtcctttcaatgcagctccctctccctcccaaacaacacgcccacccacctgccgcggcnnnnnnnnnncttctccccctcaggaatgtctaacaccgtaaggacctgccatactcgtcctttcaatgcaactccctttcccctctcaaacaacacgcccacccacctgccgcggccgcagcagcggcgtcccccgccggcggcgccaggcgcgcgagcagcgcgtcgagcgcggagagggcgcgcaggagcacgatccagaccgcgccaaagtaggtggcctcggggcaggtggccaccttgagcaggcaggccaggcaagccacctgcttggcctcggcgggcgaccccggcggcggcaggctggcgccggcgaccctgcttgcgccatcctccgcgcccccctccagccccgcgccgcgcgctagcacggcgcacagctcctccagcagctccggcaccgagagcagcgcagccagcgcggcagcgcgctccagccccgccagagcgcgcgcgacctccggcggcgaggccgcgtcggccagtgcggcggctagcccggccgccagcggcgcc

SEQ ID NO: 37674 - DNA, 67 bp, Chlorella protothecoides
ccctcgagcccacgcatgcgttcttccagctgaggctgccactgccagggcaatctgaccttctcac

SEQ ID NO: 37675 - DNA, 122 bp, Chlorella protothecoides
aggggttggggggggggaggcatggaaccgggggggaatgaggccggggcgcatacggtcgccattccagggcaatggtgtcgcttgcccgctgacggagtgtgcatgcgcccgagacgcat

SEQ ID NO: 37676 - DNA, 61 bp, Chlorella protothecoides
tgtgtcgccccggacgcctgccgctccccttctgccgagccccacccctccgtactgcatc

SEQ ID NO: 37677 - DNA, 75 bp, Chlorella protothecoides
cagtgtcaagaaggttgctggagagttcaagcgatcttaggagcagcaactcctcccagggacccatgttctaca

SEQ ID NO: 37678 - DNA, 117 bp, Chlorella protothecoides
gtcctcggtgtcgggcgaggcgatgagcgcattctggtggtaaacgttggaaggggaaaggaaggggggaatggtcggtgagctcgcacagaccagagccttcggtggtcggcaagc

SEQ ID NO: 37679 - DNA, 74 bp, Chlorella protothecoides
gcacgcccacctcccacaatgagcaggcatgagggcttcagcaaggcagggtccacccggacctccaccctcca

SEQ ID NO: 37680 - DNA, 61 bp, Chlorella protothecoides
gtgctcgtcaaccaccaccatcctgcacactcgccgcaggcgccgcaagaagcggatccaa

SEQ ID NO: 37681 - DNA, 61 bp, Chlorella protothecoides
gagggcggcaaaggagttcatgatcaggttcacccacagcagctgcagcacgttcagggcc

SEQ ID NO: 37682 - DNA, 76 bp, Chlorella protothecoides
ccccgtaccccagcatcgcagtggcaacctgagccaggtttctattgttggttcagatctctgtcccctcacccaa

SEQ ID NO: 37683 - DNA, 72 bp, Chlorella protothecoides
ggggaggggaggattggcggcgaggggaggattggcggcgagggggaggggcagggctccatggcccggcgc

SEQ ID NO: 37684 - DNA, 107 bp, Chlorella protothecoides
cagcatccccgaggcccagttctgggcggacttccagacaaaacagtgcaatgggggtaacaaccccatgcccagccgcatcagggaggtcgccgcgagctcgacca

SEQ ID NO: 37685 - DNA, 537 bp, Chlorella protothecoides
  modified_base (152)..(335): a, c, t, g, unknown or other
cctcccagcccacctcctcccagcccccagccgccatccccaccccccagccctccatcgccccccccacctccccccgccacgatgctgggctcggtgtacttcaccggcctgacaaggtttaccgtggacatcacatacgtcgtcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatcgcgacaggctactgggcggccgcctgttcggccttgaacgccgacagcaaggtcctggacagcgtctacctgacgctgggcaccgcagccccgccgcccccgcccccccccgctgccacgtgctccggtgtggtccccgtggacgacaacaccggcgcctgctctgactacacccgctacctggtcctgtgcctg

SEQ ID NO: 37686 - DNA, 94 bp, Chlorella protothecoides
tctgcctcgctgaccttggacccggcatggtgcagctcgcactggctggacaggcgtggcctcccgggctttgcgtggcactccattccatcct

SEQ ID NO: 37687 - DNA, 79 bp, Chlorella protothecoides
ttatggccaggagcggtacgagaccacagacctgcagaagaaggtgcatactgtggaagaggagtggggcggcccgggg

SEQ ID NO: 37688 - DNA, 73 bp, Chlorella protothecoides
aatgcaagagcgcaataaatcaacaaatggaaagcctctacactgggggccatgtgggaggccgcgcttgcct

SEQ ID NO: 37689 - DNA, 108 bp, Chlorella protothecoides
gggtgcagcggacgacatgctgcgctcctcgcaccatgtccacctcacagatgtatgctcattccctgaaaaagatgttgacaaccctgctgcattccaaaactcgcc

SEQ ID NO: 37690 - DNA, 61 bp, Chlorella protothecoides
cgctgtgtgtgtgttgggggtccaggcagcagaaggaatctgagggactgggcgatttttg

SEQ ID NO: 37691 - DNA, 61 bp, Chlorella protothecoides
acgacatgctcgtcggtgacggccagcaggcgcgccgcccagtccgcgccaccggccgcgg

SEQ ID NO: 37692 - DNA, 587 bp, Chlorella protothecoides
  modified_base (242)..(495): a, c, t, g, unknown or other
catgaagaggaagatgatgggtatggagccgtacacccagccggggctggtcaggtaatcggatgacctgaggaatggattgggttaaggtcggtagccaaccagtaagccatgaacacgctctgaggtgcagaaagcagatgctgggttcaggccgcaggtcaggagacgacacacgctatcagccaattttgtgcagctgcccaagaatgcaagactgacgatccccagccctacactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgtagagcggtggtatcagccattgtctgagcgtgtgatgccaactggcacaagttttagcagatgggcattcgcaaccaacgcaccct

SEQ ID NO: 37693 - DNA, 79 bp, Chlorella protothecoides
cctggacacactctgagctctatcatgacctagggagaggagcgacacaatccatgcgcgcccacacggccccgcatgg

SEQ ID NO: 37694 - DNA, 2027 bp, Chlorella protothecoides
  modified_base (707)..(716): a, c, t, g, unknown or other
  modified_base (889)..(905): a, c, t, g, unknown or other
cccgcccccagctcggtgcgcgcctccaccgccgcctccaccaaggccagggccgagcctccggtgccggcgtgcgccagcgcgtagcccagcggcgccttggccgcggcgggcacgatgcgcgcggccgcgctggcgctggcctgcaagtccgcaccggagtgcaccgccttgaggaccttgagataggcgcggaagtcggccagcagcgcgtcgcgccggtcgccgaagaactgcgggtcgacggtgatggggcgatcaaaggactccaggcgctggcgcgtgaccccggcgtccgccagcacgcgccagtaggtgcctggagggtggtttgacagtgggagggtgggtgtcatgtcagaacctgatcgctccgtcatgtgacgggtgttgacatgctgctggcgccaggggcgcgtgccaggaacgtcgccagccctgcaccgtcctgagattcgtatggtaaactccatgccaccctcgccacaccagctcaccctggtcgccgccggactcgaggaaggcgaggtacgcctcgcagatgggcacgtcgtcgggcgtggtgtctggccaggtgtgttggggtgggcgggagtggatgggcgggcatgtgaagtggggaggcatgcgcgcatgaagtgatcactcaggttgtcagcccctcgctacccatatcacaatccccgagccccctcactgttgtgcannnnnnnnnnaggcatgtgaagtggggaggcatgcgcacatgaagtgatcactcaggttgtcagccctcgctacccatattacaatccccgagccccctcactgttgtgcagcttctggtgccactgctccatccacgtgccgcccttctcggggatctgcgcgcagggcgaagagggcgtgnnnnnnnnnnnnnnnnncagcgatcctgctgccgaccctgcagaccccaacaggcacccagttatacccagcccctgagaagtcacccccaagccgggcaactcatctcacttcccctccgattgcccccaccctttctattctacccctcctcaacccaccaccaccccaaaagcactgctcacgtggttgcggtgcatgatgtgcaggatgtcgtcgcgcacagcctgggcgttgccgccccggcccaccgtagtcaatagcaggcgcgcccactcctgggacatcccgctcgtcttggagtagacctgccaggtgttgggagggagagaggggagttggatgtctgatgggtgggcgctccaccaagcagaggaggtccacagtgatctgacagccggtgcctgcagtcagcctcgcatcctgacccagtggaaaagtcaaagacctcatccttctcctctcaggtacactagagggtgcacttcccatacttctcacgacgtgacaaacacctgcgcaggcctggccaaagactactccctcgtgcccgtcacactgcagaccctcttgaccctctcaccggctgcgaaccccaaccccacaccagcccctccccctttctcccacttgcacacaaaacactccacccctctccatcaccttggcgatggtgtgggtcagcctctcctgcgcggcgccgaggatgcggggctgggtattgtagttgcgctgccaggtcagctggcggatggaggagtagcgcagccagacgtagatgcgggccaggctcccctccacgtcctcgaccccgccggccgcgacctgctccagcaggtctgaggcgcggttgaagcggtgcatcagggtccaggcgggcgtggcctccgcctccactatggcgcgggccaccgagtcctgcaacagcggattccccgaggcggcgtccggggcgccctctcccgcgccgccgccgtctcccgtgggcaggggcacgcggaagtcgccgccgccgtcgcgccaccagcggctgccatcgcgggagcgcaggacgaaggccagcgccgcaaggtcggcgtcgacggggacgggcacgcgcgcgcgctgcagcggcagctcttcgccgtccatgctgagca

SEQ ID NO: 37695 - DNA, 61 bp, Chlorella protothecoides
cacgcacactcgactgttttggggggggggggtctgcagaggccgcaggcatggccccagc

SEQ ID NO: 37696 - DNA, 74 bp, Chlorella protothecoides
atggggaccactgcagggagctgaagagtcctaccgattggagcagccccgctgagagcacagcgatcgctttg

SEQ ID NO: 37697 - DNA, 3266 bp, Chlorella protothecoides
  modified_base (749)..(758): a, c, t, g, unknown or other
  modified_base (1002)..(1011): a, c, t, g, unknown or other
  modified_base (1372)..(1444): a, c, t, g, unknown or other
  modified_base (1626)..(1635): a, c, t, g, unknown or other
  modified_base (2489)..(2498): a, c, t, g, unknown or other
ggctcagaaatgagttcttgctgccctggcgggtaactcaaaacgtgggccccgccgactagggcaacaacaacattggcaagggcaatcgctgcttcaacaagactgggaaccggaaggtcattaacgactgcagcctgcttgagttccgcaagtatgcatgggtccttgatgcccgaccacctccctccaagaaggcctgacaccccccgtcaggacatcttcacccccacccatcaagacatcttcacccccacccatcaagatatcttcaccctgactcattagggaatctccaaacatgccctccaaggaatccacaccctaccctgaaggacatctcttcccccgccctcaggcccgaggctccctcccctgccttgcccccaccctctgcctagctccccacctccacccagccccaaggaggggctgcctggccagtgcagcaagaccatcccccttcagagtcgaaaatcatatgggagccatctctcgaattcccgacatccagaccccccgccgcagtttcaggccaaaagccttgtgggtggctctctggaggggtccaggctcttccccgcagccccaggaccccgcttttgctgtcatcggcggcaggacccactgctggcaaggatgttcaggacatgccgggggaacggtctgtgcacatcttaggcgctgaaaccaaacaattcgctaccaatcggacacgtgatcttatgggcaatgggggatgccaagcnnnnnnnnnnctgcgctggttgtggctggatggcgcatgctctctgggggtggggttcaggcgttccctgctcatatctccctcttggggctgaaaggtcgtcggcctagggtccacctgctggctgagaggcattggagagttcatgaaagataccgcttatgcttgataggttgtggtaggtctgccatctgcaccgaaatttctcccaatatgtctgggaacaccatgcccaccgcgccccaaggggttcnnnnnnnnnntcgccctggttgtggctgaatggcgcatgctctctggggttgaggttcaggcgtcccctgctcacatctccctcttggggctgaaaggtcgtcggcctaggatccacctgctgactgagagacattggagagttcatgaaagacgccgcttatgcttgataggttgtgataggtctgccatctgcaccgaaaattctcccagtatggaagagtcacttgcttagattgctacaccatgcccaccgcgccccaaggggttcactgcgttcaagctcaccgggagtcctccgcgggggtactgatatttaatcatcgtctataaggccgtatgagttcaatcagtgggcttgtattttggacnnnnnnnnnnnnnnnnnnnnnnnnnnnnnnnnnnnnnnnnnnnnnnnnnnnnnnnnnnnnnnnnnnnnnnnnnatctgagcgggtattttaaccgggggcgctatatcttactgaaccaacggcgaacctagtagtgcggaggagggcgattacggcagggtgtgggatggctccgccgaccatgaaaactgccatcctgagtggattgttgctgctgctcgtcgaatgcacctttgcggtgagcctgggcgcannnnnnnnnnatactgatattgaattattgtctataaagccgtaggagttcaatcagtgggcttgtattttggacatgtttgctagtagccttccggcggtggggtccgggcaagtgccctccggatgcccgccacggaatctccgtagcagtccagccttgcaccgcaaaagtgggcagtacagaacctggagatgggcccagggatcatctcaaacgcatcacaagacaatagaacagcgcacttgtctgagcgggtattttaaccgggggcgctacatcttactgaaaccaacggtgaacctggtagtgcggaggagggcgattacggcagggtgtaggatggctccgccggccatgaaacctgccatcctgagcggattggtgctgctgctcgcggaatgcacctttgcggtgagcctgggcgcactgcaactgatgaccgtgtcagacccacgtacgtgctattgtgttacctttctatcaccccaacttctggagagcaggccacctgcagctccacattcgtcgcgctacccagtgcaatgtgagttgaggtttgtgtcaattgggagttggggtgaatgcgtgcaactcggacgatgtcgccggtccgtctaagtccctcccgcgcacatgatgttggcttgcggatgcccaccgaagctgtggcatccgcaacccttgctccctccgtcaggcatatgtaaaagtaattttgtcctgtatttatgtcagacgtctacatccgctcttaatctccatctttccgcacatccttgactcctcgtagtttgggaagccacgtgtatctcatgacggtcgacaacgctgacgccatttgcaggtggatagcgtctgagnnnnnnnnnncgactcctcgcagtttgggaacccatgtgtatctcatgacggtcgacaacgctgacaccatttgcaggtggatagcgtctgagggtgtgtacaccacagcctgtgcttgcaaggatgaatcaccatcagccaagcacgggttatcatgggtacaggaccgtatcttcctcactctatgcacgcccatctcccacaatgagcagacatgagggcttcagcaaggcagggtccacccggacctccaccctccagattttggggctctccgtatcagccatccgtgcgagcaacttggagatcctgtcagctcgatccacggtgatccttacagccgtcgagtgcctgaagccgggccagaaggcgtggcggcagacagcaatggcaatatcggctcccgcaacagaggcaagaacaactttggcaccaacaacgtcgggaatgataacatcggtgagcgatcggcggggtgcaaatggcatgcgatatgtgcacagctgctgcagccctgggtggaggctattcagaggtcaaacggttctcaccctcgcaggtaatgccaatatgggcaacgctaactggggaaacaataacaagggcaagggcaatcgctgtttcaacaagactggggatcgcaagatagtaaacgactgtagcctgctcgaaattcgtaaatacgcacgggtccttgacttacagccgcctccctccagaaagcccccgcccccacccactgagagttccccaccaccatccgccaagaagtctcca

SEQ ID NO: 37698 - DNA, 199 bp, Chlorella protothecoides
gcggcaccccttcatcaaggagccgctgtctgccccgcaagcctgacgtgactcatccctctcatgacgcttacccatacaaagacattaccgagacagactgccagggggtgtcgcaggagtagcgagggagggggcccaggtttgggtggcaggatgccgaaggcagcgctgaccagccgcaaggggcgtgcatgtc

SEQ ID NO: 37699 - DNA, 73 bp, Chlorella protothecoides
ctgtcagattatcagggtggcagcacaggctccaagcagatgtgacctgggacaggctgaagtcccccccccc

SEQ ID NO: 37700 - DNA, 89 bp, Chlorella protothecoides
aaacccctctcttccctgcaccgtcccctcctgaccgaccgccacaccttcaggcccagacggtggccaacttctggctggcctttgag

SEQ ID NO: 37701 - DNA, 61 bp, Chlorella protothecoides
ggcccgaattctccttctcggacaggctggtcttggcggcgacccgcgctctcttcccctt

SEQ ID NO: 37702 - DNA, 71 bp, Chlorella protothecoides
ccccccacccccctcacactccaggcctggcccgaggctgggctggtggccgtcgggtacgccggcggaaa

SEQ ID NO: 37703 - DNA, 61 bp, Chlorella protothecoides
gtcgtcgaaggcctcctccaccaccaccgcaatgatctcggagcccaggccgtgctgcggc

SEQ ID NO: 37704 - DNA, 72 bp, Chlorella protothecoides
gacgcacacgctcacgtgtgatctgcgaccggtgagggggacggcgacggcggtgaggagggattggaggag

SEQ ID NO: 37705 - DNA, 61 bp, Chlorella protothecoides
actgactggtccctgtggaggcattggagggacgggaggtgtcggcagcatgcgaccatgt

SEQ ID NO: 37706 - DNA, 121 bp, Chlorella protothecoides
ctcaggtgccgttctgatggggtggagctgagtggggcatatgggggaaatggtcgggggcgaagccagttgccgggcgtcgtcgcctgttgcaatttggcatgcgggcaggagctgggca

SEQ ID NO: 37707 - DNA, 61 bp, Chlorella protothecoides
gcatgcacaccccttccccctgaccccacatgtgcacaccaaaaccacgacaggaaggacg

SEQ ID NO: 37708 - DNA, 67 bp, Chlorella protothecoides
cacccaccaccaccattaccaccaccacacacaaaagtccttttacgagcaagctcctacaatatat

SEQ ID NO: 37709 - DNA, 61 bp, Chlorella protothecoides
agcaaggcacagagagtggcgaggctgggggggctggtcttccacactcgcgatccatcgg

SEQ ID NO: 37710 - DNA, 61 bp, Chlorella protothecoides
tcaggccggcatgctgtggcccagctcggaaccctgcccagccatgaatccctctcagcct

SEQ ID NO: 37711 - DNA, 61 bp, Chlorella protothecoides
agcccacgctgccgggagtggccaggctggggaagttggtctgcgcggggacccaggcccc

SEQ ID NO: 37712 - DNA, 62 bp, Chlorella protothecoides
cgtcaacacctcgaccccacagtccctccccggggcgcgcttccaaaaccatctgatgctcc

SEQ ID NO: 37713 - DNA, 61 bp, Chlorella protothecoides
cccgcccggctgggctttgcacggggttggaccccagccacgcacggcgtggcagctggcc

SEQ ID NO: 37714 - DNA, 61 bp, Chlorella protothecoides
gagggtacaggacgtacatgagggcgggggggagcagcagacacacgaggccaggggcgag

SEQ ID NO: 37715 - DNA, 125 bp, Chlorella protothecoides
cctgcgtgcctggtgatccatcacaagttccctcagcccttgccctgcacacgtcgccagatccccgagggtctgaggcggcatgggggccaggcgaccggtctggtggcagccgcgcagcagtc

SEQ ID NO: 37716 - DNA, 61 bp, Chlorella protothecoides
cgccaccgtgcccaggtacttgagcgccgcatcctccagctcggcggggtcgaagtcgccg

SEQ ID NO: 37717 - DNA, 65 bp, Chlorella protothecoides
agaagaggaagaagaaggggcagcagcagcccgttctggatgcgctgcgttcgaccgtggacgac

SEQ ID NO: 37718 - DNA, 61 bp, Chlorella protothecoides
gtccagccccgaggcgtcgcccagccccagtccggaggaatcgcccagccccagcccggag

SEQ ID NO: 37719 - DNA, 71 bp, Chlorella protothecoides
gtacttatgggtgtgtttcagatatgcagggcggcgggagtgggtcagatctgtcgagttgaggtgtcgga

SEQ ID NO: 37720 - DNA, 61 bp, Chlorella protothecoides
ggcgggacgggaggccggcctgcgaagaggaaggggagtgaaggggtgatcgtagatgagt

SEQ ID NO: 37721 - DNA, 75 bp, Chlorella protothecoides
gcttgacgtggagagtaagggttgaggagcgcttggttggcattcgcatcgtgtgttgaggcccagtattgacag

SEQ ID NO: 37722 - DNA, 79 bp, Chlorella protothecoides
gcgtggaggaccccgacgatggcagggcgcgacgataattcccttcagaacgtgaatcgctcccgaggccaaaactgtc

SEQ ID NO: 37723 - DNA, 61 bp, Chlorella protothecoides
aaggaaagtgaccagcgttggaggctggggggatcacacaagcctttgcgcctctcaaggt

SEQ ID NO: 37724 - DNA, 69 bp, Chlorella protothecoides
gattgaggaattgcagtgcctggggttggcaagatgtgagtggggcgggtgtgagcgacgaggagtcgg

SEQ ID NO: 37725 - DNA, 61 bp, Chlorella protothecoides
cccacaccctccatctcacacgacgcaacatacaccctctcaaacatgccatgccatacta

SEQ ID NO: 37726 - DNA, 100 bp, Chlorella protothecoides
cccctgcacatgtggggtcggagcagggcctgcaagctcgcgagcttgcctcccgcgagtccatgactcacaagccgcacgatgctctccacacaaggcc

SEQ ID NO: 37727 - DNA, 73 bp, Chlorella protothecoides
attcttcgattgtatccccgggcttgcacccatcaggttcaaccatgggccggccttgcaatgggccacaggt

SEQ ID NO: 37728 - DNA, 61 bp, Chlorella protothecoides
cagtagtgatctgtgatgtggtgctgggtgaccagccatacgatgctggctgtgccagatc

SEQ ID NO: 37729 - DNA, 12960 bp, Chlorella protothecoides
  modified_base (1803)..(1812): a, c, t, g, unknown or other
  modified_base (2390)..(2399): a, c, t, g, unknown or other
  modified_base (3617)..(3626): a, c, t, g, unknown or other
  modified_base (4649)..(4658): a, c, t, g, unknown or other
  modified_base (6700)..(6709): a, c, t, g, unknown or other
  modified_base (10712)..(10721): a, c, t, g, unknown or other
  modified_base (11206)..(11215): a, c, t, g, unknown or other
  modified_base (11469)..(11478): a, c, t, g, unknown or other
  modified_base (12262)..(12271): a, c, t, g, unknown or other
ccccccccgtctcctaaagcacaccttgaaggaggtgcccaggaggtccaggagctgggcccagctcagggtggtggcccgcgtccgctcggcgtgctgcctgatgcgggagaagaccgcggagacggggtccacggcgcgttcccgcccgccgtcgtcgtacagcgaggccttggacatcttgagcaggcgcagcgactcgtccacgtcgctctttgagggttgtgggcgtggaaagaggggagtcgagggccggtcatcggcgggtgaggggtgggtgctgagggcactgagcgcatgtgagacccgctcaaaacagacgaaatgatctggcaagcggggctgtgactgcgccgacgcctgcaccaccctttctcataacattgggacaccgtccctgccgccccaatgaccagcccgttcctccaagcctgcttcttcccctcccatccctaccccccccaccccccttcctccacttccccttccctcccacacctgctccacggagtctgcaaagcgcaggcgcgccagcgcctgcgacaggcgcaggatggagagcagggtgcgtgccgtggtgtaggtgtgcgggatctcggcggccgcctcctcgctgccattgcggtgtggacggtgggtgggtgttgagtttggttggctgcagcacccctcggggcgacaggggccagcttcacactgtcacactgtcagcagcagcagtcgcaccacaggagccccagctccttcaccagcatgctcctccccctcctcccgcccccacgccatgggcagcaactcgcctcctcatctcggcgtacacggcggccaggtagtcggtgaggcccgcggggaccacgggctcgtggctcttggcggcggcgatgtaggcgcggagcaggggcgcgggcagtggggcggggcccgtggtcgcggggggcgcgccctcccggtgcacggtcagcacgtgctgcgccagggccaggtcggcgtccagccccggccggtcgaggatgagccagaggacgtcgaagcgggagagcagggccgcggggaggttgatgttctccgccggcgagcggcgcacgtcgtagcggccaaaggccgggttggcggcggccagcagcgtggtgcgcgtgttcagcgtggtggcgatgcccgccttggcgatggacacgctctgctgctccatgacctcgtggatggcggtgcggtcgccctcctccatcttgtcgaactcgtcgatgcagcagatgccgcggtcggccatgaccagcgcgccgccctccagcaccatctcgccggtggtggggtcgcgcatgaccgccgcggtcaggcccacgccggaggagcccttgcccgtggtgtacaccgcacgcgggctgacgtggcagacatagcgcaggagctgggacttggccaccccggggtcgcccatcaggcaggcgtgcacgtcgccgcgcagcttcatgccgtcgggcagctggcggctgacgccgcccaccatgcacagcagcagcacgcgcttcacgtcctcgtggccccagatctcgggcgcgatgctggaggccaggcgcccgtacacgtcgccctccgccgtcagcgcctcgatcgcggcccgcgtctccccgtccagccgcatgtcctggggtggttgtttggggatgggggactgtgtttgcggggtggcgccgagggggagagggggcgtgcttcatcacggggtcctggagactgcagtgcccctccccctccgtgtcccccataaatcaccaacctggtagctctgcttgttctgggtgacgnnnnnnnnnngtgggggactgtgtttgcggggcggcgccgagggggggagggggcgtgatttcatcacggggtcctggagactgcagcgcccctccccctccgtgtcccccatacatcaccgacctggtagctctgcttgttctgggtgacggccatggcctggacgtaggtggcggtgagtagggtggcgcgcatggcggagcgcgggcccgcgtacggctcaggcaggaagatgcctgacacggtgaccgcgtcgccggccttcacgcgcctcgtcagcgcatcccgcagctgcacggtcagcgtgcgtggcgtggagccctgcggcacctcctccggcagctcctgcaccttgcactcctggtaccgcacgaacttggacccgcgcgtctgcaggtgcagctcgctcttcccgccgttcatggccttgaccgccgcgggggcctccgccaaaggggtgaacgtcttgcccgccacctgggggattggttgggaggggcaggcatcagccacttcacagccgtgatgggacgtgcccgcaagagtgcaaagtttacgtggcatgcggccgcagagcagcgctggtnnnnnnnnnngggggtgaacgtcttgcccgtcacctgggggattggttgggaggggcaggcgtcagccacttcacagccgtgatgggaagtgcccgcaagagtgcaaagtgtgcgtggcatgcggccgcagagcagcgctggtccggcggcatggctgttcatgcagaggattgcctgcgctgcaaccagcagcggcgactacccctccccgcagcaaggtaggccatgatgatcccgtccaccctgcgcctgccctcgcactgtcagtgccctcccacgaccactgccctcccacgaccgcttccctcccagccaccgcaaacgcccagcaccgatcccctacaagaatcaacccccccccccaaaaaaaaaggaaaaagaaaacgcccacctcctggtagatctcgaacccggtctggtcatccaggtaggtggcgatggtgagcagtggcctgacgtcggtgacctgcgtcacgatgccgcgaaaggtgaccaggtgcccgatctgggcggcgcccacctggcgcaggcgggcgtgctccgtggtggagcgtggccggatgcagacctcgaagcgcctcgtcagcgcggcggggagcgcaaagttggggtccgactgccccgtgcggccgtcgacctccatttgggcccgggtcagctcctctgcacgccgccgctgtgcggtaggaggagacaagagggtgtgggtgtgaggaaaggtacctggacgtgtgtgtacaactggggcatggcatgtggatccaggcaggaattgagcgtaaagaacattcgtcctacctcctcgtgagctcaacgtcagcgcagactgccccggcaggaagtgcacaggggcattgacgcccaccgccagggccccttcccctccaaataatcccctctctccatccccgtctcaaaacctggtcgagcaggatgtcgaagatgtcgtctgggaggtcggacctggtgggggcaggcatggcctcgtcggcagcagaggccagcagggacaggtactgctgggtgttggtctccattcggtgcaccaggtcgccgtccttgacgtaggaagccacgtcatccaggtccacctccagagtggcgcgctcgcgattcacgatggcttgctgtggtgtgcgcgggaggatgtttggggatggtgggtgcccatactgctctgcagaggcaggatctacacctctgcatgtgcaccagcgcattcaattnnnnnnnnnnagatgtttgggggtggtgggtgcccatactgctctccagtgtcaggatctatacctctgcatgtgcaccagcgcattcaattcattcgaattcatcctagcgcccttgagttgaattcacagccttaccagctggttgcagtatttgaaggcattggtccaaacatggccctccccgtccttctccgtgccgctgtagttctccaggaaatcgaccagcgtctctgcgatggcggtcgaggtggaaaagaatgattaagctactcgggggcagatcatatcccctacttccagtccctcactcttgcactcgcctttgtcccttgcgaagtccaccatagcgacgagactgcagccggtccagtcctcgcccggagagctggaatgcgatctttgggctgagcgacgcaggatatctgccgtgctctatcttttgtgcacagcggtgcgccctgattggtgcgcttgcgcgtcctgacgatctggtctgggtgtcgaatttttgaatgcgcgggggtaccgcaaagcacggtaccgatctgggcacaactcgtagggttcacattacagacaagcgccaatgtcgggaataactattcgcgaaaaagtcgttcccgcttgacatcgattttatcacacagtcgctttgattacttgatcatggcttcccaggttcagtgcaataaggtgcgcggggctttgtcggagtcctccccctgccgctgcgcctttgcgcccagcattgatgctcaaattccgtcacatgccactcgcagttgtttggagggtttgtcaacaaattcacccatgagagcaaagtgctgggctgcaagatgaccttctcggtctatctacctcctgcagccacccagaaggcggtgccggtgagtctgcaccctgcgaagaggcaagattggctgctgcccccaaacttgctcgctaagagcttcagcgaaattatcaaccctgtacttttatctcaaaccgtcaagttccctccccgccccgcccctttcccaaggtnnnnnnnnnntcgaacttgctcgctcagagcttcagcgaaaattatcaaccctctacttttatctcaaaccgtcaatgtccctccccgccccgcccctttcccaaggttgtgtactacctcagcggcctgacctgcacagatgacaacgtcatgcaaaagtcgggtgcccagcgcaaggctgccgagctgggcctggcgctggtggcgcctgacacatccccacggggcctgggaatcccaggggaggacgacgcctatgactttggcacgggggcgggattctacctgaacgcaactcaggagcagtggaagcggtacaggatgtacgactacgtcctccaggagcttccccaagtcctcggcgacatcaagggtctggacttaacaaaggcaagggcgtctaccagcgggtgtacagcgtgggatgtgggtttgacatgcactgcctggaaggcgtgcgtcgattgccctgtgccgtgcgcacctcgagtggtggagactggtcatgtaagcattcgttctttctcaattctaggtagttctgaagctattcctgcaccgaattaagtcctctcatcataatcaccctgcagtcctccatcatgggtcattccatggggggccacggcgcgctcatcatggccctgaagaacccggggtcgtttaggtctgtcagcgcatttgcgcccattgtgaacccttctgcagtaccctggggccagaaggctttcaaggggtaccttggggacgacaaggaagcttgggcacaggtagggtctggtcagggaatcatgtcccttgccctggcccgacagctgaacctacggccccaagcactcacatgcgtctgcgtccggatatagatgtgtgttgatggtccaattggtataagatcttcttttggccacctcatgcttgcagtatgatgccacggagctggtgaaggactactctgggcgcaagcaggccatcctcatcgatcagggtgggtgctgctggaggatgatgtagagcgtgggggttggctggagtttatggccatccaaggtctattctgagtgtttctggtgttggaaccttgcagagtaccaccacagtgcacgaataacccacccccttgcaacccattttcttgcaggaactggggacgatttcctgaacaagcagctgcagccagaggttttccaggaggctgctggtgataagctggcgctcgagttgcggatgcaggagggctacgatcactcgtattataccattgcgtaagttggtgtatgccatcgagtatgggtatatacatgacaaggtgtgggagtgctggctcggccacccagtcctatcaaacactttgtcaatcactctgacgcctgcatcatactctcacgttctgcaggacgttcattgcggatcatcttgctttccatgccaagcacttgcaatgatgccgtgctgacccacactctcgatccccaccccaatgagatgcgcgcatggatcagtccacggccaggatcggcctcaccgatgccatccctctgtgcaatcgcgggtgtgcatgccctcgcgtcaatccctgagcttttctttggatccgaaagggggagggatcgacatcgatcggcccccggcatgcctctggtgccggagaagttgcgggcccggcaggaggtccgggctgccctgggcagccagttctggggccaggaagcggcctcgccccggtccatcgatggcaagaccgtcctcaacccatgcgaacccgtgcccctggggctcatggccccctctggcctctcccgcacccagcagctgctcgctgcccaggccctaggcatcctggccctgccctcctacctgggcgatcgtggtggactggtgggtctgggtgtggggtgtagtttcgaatcgatgaggacaatgttgccctcgcctcacgcttgggttgtgtgggcacaaccccaggcacctgtagcaggttgtgagcacagggcatggctccccctggcctgacctggcacgcacacactcctcccctgccgcagatcctcgannnnnnnnnntgcgccgggcatggctctccctggcctgacctggcacgtacacactcctcccctgccgcagatcctcgacagggtgctggccaggatcgggggccggacgtggtgggccacgctgggctccaggatgcacgcccagcgcgccttccgccagggggcggccctggacgggccagccatgctgcgtcccctgaaagacccccagaactacgccgcctgcctgcgcctccactcccagatcgcacggtgatgcacgggaggatgggaggggggcttgggaggagttgtgtgtggctcagggcctggaccgaaattggtcgcagattcagaacaggagcatgcttgctttgggatccactctcgccagcgctcagcgacgcctgttgcaatggtgacgcaccccctcccacacacacacaccccttcgcagcttcctcacgctgagcgtgctgatggaggcccgagacctgcggccgatgcagcgtcggctggacgccgcgctgcagggcgccgcgccgcccgccccgtcgcccggggacgagggggcggcggcccggggcacgctgcacatggcgctgccggggcacgaactgaccgccagcctgacgtccggccaggaggtggtggatgccaccggggtcgcgtgtgtcgtgccactcaccgcctccctggacctctcctccgccttggaccggggggacggcatgcagtaccgcatcggcctccaccaggtgcggtggtgaggttgaggtggaagggaggagggtaaggatacatctctgcagacccactcatcctcgaccgctccttacacatcgctcatgcacccgcctccaggcgctggcccctgctgacagcgacggcagcggcccgctccgtagcacgcagcatgtgcagggcgcagtggccgtggagggcgaggcgtacttgtggcgcgccggaccccgaggggggaggaaggagcgcgcgggcgccgcgtcggacgcgggtggcgtgatcggccctgaggcgagcacctccacgggcatggaatgttcgtccagagcagaagatgtggtgcaggttcttgaggttgaccctccaagaccagtttcagagtccacacattcctctgcgagtggcccggccggagactttgcgggagaagtcgcaaagggcctggatgttgcacagcccgcattgaattcagttgccgagccggccgctcccatggtcgcggtaaacgcaggtggcccgcagtctccgggcgctcccgtcccccttgaggcctttatcatctccaagcagggattagagcctgaggcgaccacagccccctcaaacagttcccccgcgcccaggcccagccccctggacgcgctcaacgcccaggtcctgtctgcgctgggcacgctgcgacgtgcacagtctgcgctggccgacctccgcgccggcggcgccgaggcctgggacctggacgccttgggccgaggcacgggcgcgggccggcgggcaggggaggcgccacacagcctgctgacgccgggcccccacctcaagctaaacggcgccataggctgcctaggaagggtgcccctccccggcagcaccggcctgccgctgtcacgcagccgaggccagcaggtgggcgaggctgcggccgcgccggcggcgggccagccaggctggcgagcctcctcggccagcctggcatctgcgcgaggcggggacgcatgggagccctacctcaggtctgtcccgtggtggcctggaattggtgcggacctagctcatgcgcagtgcagagggaagtgcaggcgacgctgcagcaggcttggcgctgtgtggaaaggccctgcgtcaaaagcttgggcgcaatagtggcacgaagctccggcgtcgcatacctgtctggcgtccgcccggcggccgctactgctgtcctggcacatgaagatgcagacggcttctcgcaccaaaccgcatgtctcccaccccctcttccctggcaggaacacgtcgctgcgcgtcttcctgtcggcgggcatcagcgggcagctggggcggttcaggcggcgttggctggacttcaccgccgccgcgcttcgagtggacgtgggcctgacctcgcagcatgttttgggcgcgctgccggccgcccccgacgcccacactgtcgtcggaggaggctgggccggcacggcgggcggcgcgtcgaccggcctcggccccggcgccaaccctgaccggcacccggccttcgcgctggaggggcgcggcacctggcacgcactgtccgcggggctggcgcagcaggtgtggggcccgctgcgcgcgaggtgcgacctgcgcttcgcgctggaccccacctacgtccctgccgacgagggcgagcgctccaccgtgcacgggctggtggccaccgcgctgagcgtgcgcgccagcaggctggagacggtggtgggggcggactgcgtgctgccgggatcggggggcgcggcgcgcctggtggtctggtactcgccgcagcggcgggagggcatggcggaggtgcacctcttctgagggctggggcgctttaacatgcctgagcagggagcagcaccccaggcccatatagtaaccgtgagaccgggagggcagcgatggggggacgcgggcgtatgacaaggaagagaggagggaggcacgcccgcctatcattccaccacgctgcggcgcgtgctggactgaatgcgaaacacgcgcgtggacatgcgtgatagtatccaacacatgcttagaggcgacagggcgcatcctactgaaacgtacatatatcgatttcctcttgtcgtatctgagattagcctagaagcttggggcacggggcggggctcccctgtgccatggcggggggcgaggcccacaagaagcccagcgtcgcggccagtgtgctggcgcagcgctcggtgaggcccggccaggcgaagacgaagcggaaagcaacagtgagctacaagaaccagatacgatcagtggagcggctcctctcaaaggtgtgggtgtgtctgggccgggccggggtgctacacctgaaagtgggggcccaggccatcccatgcatcaatatcagctctttcttccacccaggtgccaccccgaccctcctctcctccccaacctccaatgcagttcgaggtggaccccaaactgcgcgcgcggcaggagaagaagctggaggagctgcgggccgcggccgcggctcactcccgtgaggagctggagcgcaagtacgcggtgcgctatcacaaggtcaagttcttcgagcgtgtgaagctggagcggcgcctgcgccagctggaacagcagctggcggccgctggcggggcgggcgaggccgccacagcgctgaccgcccagctggagcaggcccgccgggacctgcagtacgtgctgcactttcccaagggcgagaagtacgtgtcggtgctgaaggacccggagacggaagcggacgcggcccgtgtgcaggcggagcgcgcgcgccttcgggcgctggtggccgccgacctcgcgcgcgccgcgctggtcggcgaggcggacgagggccgcagcctggcggcgaccctgaaacatatgcagggcgccggggcggggcggggcgcggcgcccacgccgacagagctgcccgcggagctggccgccgccgcgtccggcagcgagggcgagggggacgacttcttcctggacgaggcggtggaccccgagctgagcgcgcctggcaggggagtggcggcggagccggcgcggcgccaacccccggccctcctggggcccctgcccaaggaaaaggagaagcggcgggggcgggagagggtaaccctgccggcgaggggcgccgaagcttccacccgcgatggccggggcagcggggcaaagagtcccgccgttacaagagtacccgggccctcacccaagatgaacgaaaagcaaggcaagccggccctcccaagcaggcctgcggcactgcggttgcgaataccgnnnnnnnnnnaaatgaaaagcaaggcaagccggcactcccaaggaggcctgcggcactgcggttgcgaataccggccgagcacaccgcaccggcgccccagcagcgcgcggcccccaagcgcccccctgtgcccgtcgctgtggagcccctgcggacgcgggcagagggcggcaggaaacggcggaagaagtctgcttgactggctgtgtgactgactacctcaggtgcttaaaatgttccgtttcaggtgcagagagttcacagggccttcaacttctttgggggaatcctggcatggcctgtgctcgtggacagaaaaactccagaccccaaaggaaatggaggcatcacagcctccgatctatcgctacagggctaggcaggggggtggacgggggaggaaggggagggaggggggagggcgcggcacatgattggagagaggcagagataggaggggcagggctcacacttccatgggggtcggccccatnnnnnnnnnnaaggaaggggagggaggggggagggcgcagcacatgattggagagaggcagaaatagaaggggcatggctcacacttccatgggggtcggccccatgtccagcgccgcaaaaaggccttgggcggggatggctggcgggactgactccagggcacagggaccacgcatgatggccagggcgcgcagccactcatcggcgtgctcctcatagccatggttttcgtgggacgtgagccatttctggcgcagctgcnnnnnnnnnnagctggcgggactgactccagggcacaggggccacgcatgacggccagggcacgcagccactcatcggtgtgctcctcatagccatggttttcatgggacgtgagccatttctggcgcagctgcatgtactcctgcaacagggagcggggagggaggctttgaagcgcgttggtgggtgctgggagtgacgacaagcacgtgtgcctgttggtagactcaacaggagcacagtcgctgtcgccatgccacagtcagggtggttgcaagtctgcaagctgaccggccttgggatcctcccatcggaagtgtatgctgtgggtcgctctgcaatcctgagcaggccctgcctcccggaggtcgtgaccctgaacccagccaccctccccacgcatcacacattcactcacacaggaggactggaggaaggcgaggcgagcggcacacggctccaactcgtccgcgcggtacacagcgtactgctgcatgctcagaggccaggcgggcttgccgaagaagcggagggcaacgctcagggcggaggccccaaggagggaggcgctgtacgcgctgcattcaagatcaagcaggctgagctggagcaggaaactgcggtgcggggtggtgggacggagtgggatcttggggcactgcaccggtcccacatgagcgacgccatggcagcgacagtgccgagccaacatggggaggcgtgcatcgctggtcacgactactgcaggaacacagcccacccccaaccagcagtcaagctcaaagagcctccannnnnnnnnnaaatcttggggcaccgcactggtcccacacgagcgacgccatggcagcgacagtgccgagtcaacgtggggaggcgtgcatcgctggtcacgatcactgcaggaacacagcccaccctcaaccagcagtcaagctcaaagagcctccacatacctcgctagaatgtagacgtgcatgtcgtcggcgcgggcgacgcccttgaagatggcacggtaccagaaagtgcgcaggaacatcttggggttgggggcgaccttggtcgtgtcgttgataagagccatcacagcctgtgagaggggcagcgaatgttggaggagcagttggcaggagtatgagcatctggcactggaccactggacaacaaaggtcagcaccaacgcgcggtgctgaagagcagggatgcgcgtagattgtgcgaggtcatgtatgccgggcggcagcggcatcgatccctctctgacacgaccagttctgcgctctgcactgtacatcctcaccactgacctgtgtctcctcttctacttcctgcgaggtatatgtatcatcactcagataggcaaaggtggcagcgtccatgtgcttctcggtaacaagggccgtgggctgtctcatgtctcccatagcggtgcgcaagcaggcgattccgacaagctgaaatctgcggatcggaggtgggggggggggggggg

SEQ ID NO: 37730 - DNA, 77 bp, Chlorella protothecoides
ctgtaggtctgtggtgtcgtggagaacaagaggggaagtcggatgagtgagatcaggtgatggtctgcgggtctccc

SEQ ID NO: 37731 - DNA, 91 bp, Chlorella protothecoides
caggccctggggtgagttgcaggtgagcagattgcagatctccagctccgggagactggagaatgggagctccgcgccatcgggcccgagc

SEQ ID NO: 37732 - DNA, 61 bp, Chlorella protothecoides
aacactgcaggaccccatgtacgactatacacccccccaccccatcctccaccgacgtgag

SEQ ID NO: 37733 - DNA, 77 bp, Chlorella protothecoides
ctgctggaagcgggcgacggagtcggccagtggcgagaacgccgccttcgccccagtgcccgcccttccgccagctg

SEQ ID NO: 37734 - DNA, 77 bp, Chlorella protothecoides
ttcaacgcgccccccccaccgccgccgctccccgccgaccacgtggagctggacaagtccaacgtgctcatcctggg

SEQ ID NO: 37735 - DNA, 61 bp, Chlorella protothecoides
tgcacagggccagggcacccccagggcccgaagctcgccgcaactgggcgcgctcaagcac

SEQ ID NO: 37736 - DNA, 115 bp, Chlorella protothecoides
gatgcgctcctgggtgtgatctgagagtgcggtccagatcaatgcatgggggccttcaccaccccgtcttgggaccccgaaacactacccgctcgatctcaccgagggcggggcg

SEQ ID NO: 37737 - DNA, 76 bp, Chlorella protothecoides
gggcaagggcggtgccacggtcagctgcgggtggggccgggacaggccaccgctgcctcgtccagccctcgcccca

SEQ ID NO: 37738 - DNA, 61 bp, Chlorella protothecoides
gttgtcatgtttagccttcacgtaactttgggattgcccctctgttcgcggggcctaggca

SEQ ID NO: 37739 - DNA, 61 bp, Chlorella protothecoides
gggaaccccgtgatcgatcactgcaaagtatgaaataggagggcagccacttacgaaatga

SEQ ID NO: 37740 - DNA, 136 bp, Chlorella protothecoides
agccttgagaacgctctgccttgtgcagaccgccgacggtgaccggggctgttcctcacccccaccctcggcatccttcctccaccccccggacccccgactcccacgctggtaccttgaaggtcaccagcttctc

SEQ ID NO: 37741 - DNA, 129 bp, Chlorella protothecoides
aggcgccgccggctggcctggccgagggcccgcgccccgggcgacgccaagcaggaggggcaacacttcttcctcacggcgcgccgggtcgatggcccgggcctccaccagccagatcagcactctcag

SEQ ID NO: 37742 - DNA, 124 bp, Chlorella protothecoides
ggcgccggggcgcacgccaaggccgaccggggggccggcggcggggaccggtgaactcgcggcgcccttgccggggcgcgggggcaggaaggggccgcccacggagcgcggggcgggggcgggg

SEQ ID NO: 37743 - DNA, 61 bp, Chlorella protothecoides
tactatgggctcagcccgggaaagccgtccctggccactgcgacaggcggaaaagggtcgg

SEQ ID NO: 37744 - DNA, 61 bp, Chlorella protothecoides
acaaaacggatgcccgatcgtggaatgtacacctgccgcagcggcaggcgccggaaaggat

SEQ ID NO: 37745 - DNA, 156 bp, Chlorella protothecoides
gcgagggcagcaggccctgttacacgaacagccaccgaacggcagtcagacccccccaccaatctataaggacatcggctgatgaacagctctcgccgtccttgtcccatctattatgaagaaagttgggatgctgatcaggaatcaacaacaggg

SEQ ID NO: 37746 - DNA, 68 bp, Chlorella protothecoides
tgtgtgtgtgtgtgtgtgtgtgtgtgtaaagggggggtggagattgtggcgaaatgtgatccttggag

SEQ ID NO: 37747 - DNA, 168 bp, Chlorella protothecoides
agaggccttggtagatgtttccctgagggggggtgcggggtggttggggcaaggaaggggcttggggtcgctcgatcatggcgctgggctgcggggtggtgctcctgacgccgtgccccagcgttgaagggggctcctgcccgtgtgtccaggcatggtgaagccacc

SEQ ID NO: 37748 - DNA, 102 bp, Chlorella protothecoides
aacggtgagctgaggtcacaggcagccctctcccccagccggttttctaatcagtaaatagggccaaggcaaccccctctccccgcgcctcgccaccagacc

SEQ ID NO: 37749 - DNA, 80 bp, Chlorella protothecoides
gaccagcgtgtcccagaccagcgcctcgtccccacggcctgggaggttgaaggcccaggccggagggagggtcggagggg

SEQ ID NO: 37750 - DNA, 62 bp, Chlorella protothecoides
cacctcatcatcgttggcacagacccagacaaccgcgtctcgcaagaggccatgcagccccg

SEQ ID NO: 37751 - DNA, 61 bp, Chlorella protothecoides
aggagatgaggctcctccgcaagatcggtgtagccacgggagcgaatccgcctatggatca

SEQ ID NO: 37752 - DNA, 61 bp, Chlorella protothecoides
ggtcttcttggccggggcatcctcggcggccttgaccttctttgcgggcttctcgtcctgc

SEQ ID NO: 37753 - DNA, 119 bp, Chlorella protothecoides
aacagtgggcaagtcctcgggatgccacccaccaccccttcccaccggcgcacctccgtcgtatgagcttctccccggcgtctgttgtgttgtacaggcggactgtgtgccgtgtggtg

SEQ ID NO: 37754 - DNA, 346 bp, Chlorella protothecoides
cgtccggctccagcttggccacgccgtcaaggtctccaatgtaaaagatggggccggcgggggtgcgcttgtacagcacgttacccagcttcaggtccatatgcgcaacctgcaccatgcggcgacgacagaggagggtgaggttggaggggtgaacggcggggataagggcaggggcaagttcttggtggcagacaagattggtgtaggtgttgggcaagggggaggagagcgggaggatgctgcatcgggcggaagacgggcagtgttggtgttgtagacgctcccatcgctcactttccaggtgatgcccccttcccaaccaggcatgcggacactcaccccc

SEQ ID NO: 37755 - DNA, 61 bp, Chlorella protothecoides
actgggcctcgcaccttgcaccatggaaggcatgcctgcctctgttcttgttagtttatgg

SEQ ID NO: 37756 - DNA, 61 bp, Chlorella protothecoides
gtccgaggcgggccagggattccagagcggatggatgtgcctggcatgagcagggcggcac

SEQ ID NO: 37757 - DNA, 75 bp, Chlorella protothecoides
aatgccacgcatgacacgtcacatgtgtgggccccccccctggggctcgtgctgcacaggcctctggtggatgcc

SEQ ID NO: 37758 - DNA, 120 bp, Chlorella protothecoides
tgggtgggagaggattcaggggcccagggtgggacaggccgggcactgggcaatcgacagaagctgtcggggtgctcggtccatgctgctccaagcagcatccgccaagcaggcaggcac

SEQ ID NO: 37759 - DNA, 62 bp, Chlorella protothecoides
gtgggtgggggggaggctcctcatcattgtcgcagctccacagacccgggcacagccgcctc

SEQ ID NO: 37760 - DNA, 150 bp, Chlorella protothecoides
cccgcgcacctgaggccgccccgcgcgcccggcgcgggcagcccctgggcgccgtggggaggcatgcgtggccgccgcacggggctgccgtggcctcccaggggtgaggccacgccgctcggggaaccggctcgtgcgagcgcggcgtcg

SEQ ID NO: 37761 - DNA, 61 bp, Chlorella protothecoides
tcgagtaagaagaggcaaaccgtctcggcccctggctccccttcacgtgcagctccaggcc

SEQ ID NO: 37762 - DNA, 140 bp, Chlorella protothecoides
gtcgggcagccccgcgcccatgcctgggggccacgggatcgatggtcacgtgtgggccagccatccaccactcggagccaggaggagtgagcaggcatgattttctcaccacaggttgctcacagccacaacacatgccg

SEQ ID NO: 37763 - DNA, 135 bp, Chlorella protothecoides
ccgacatcggtgggtggcatggggttgggcctggggggcaggggctgcttgtgccttcagcgtgcatgttgggtgcgacaggcatggaggtggggatcggggggcccaggggggctgccaacaaggtgcctggac

SEQ ID NO: 37764 - DNA, 77 bp, Chlorella protothecoides
gcgagcccagctggaaagggggaaaggggggagagtagagtggttttgggagatgcatgccgtggtgggacgaccaa

SEQ ID NO: 37765 - DNA, 120 bp, Chlorella protothecoides
gtgctggcaccgactcaaatctgcgcaatgcacccaatacgggcgctctcatcacccgctgcactcctacaccctcccccaaagggccctcctcccccccttctgaacccacctgccagt

SEQ ID NO: 37766 - DNA, 61 bp, Chlorella protothecoides
acgaggtcatcctcatctccaacggcagggggagggggaatggaggcacacaggggatgtg

SEQ ID NO: 37767 - DNA, 583 bp, Chlorella protothecoides
  modified_base (198)..(207): a, c, t, g, unknown or other
  modified_base (405)..(414): a, c, t, g, unknown or other
gcgcgcgctgcgggcgcgcggcgcgcggcgcgccggcgaggacgcggagcaggacgcggaggaggcgcgcctgcgcgccctgctgcaccagggcagccgcgccgaggagctcctgcgcgcctacgagagcgtgagttgggttggtgggagggaaaagaaggggggtcgtgcagaggatcgtgggggggctcaacctcnnnnnnnnnntgagagcgtgagttgggttggtgggaggggggagaagggggtttgtgcagaggatcgtgggggggctcaacctctgtgccgctctccactcgagtacctccccaccgcctcctcatcgcgagcagaaaccggtgcctggccccgaggacaccaccttcaacgaggaagtgcacggctggcagagggcggccgccgccnnnnnnnnnnctcatcgcgagcagaaaccggtgcccggccccgaggacaccaccttcaacgaggaggtgcacggctggcagagggcggccgccgcctcccccttgcagacgctcatggtcccgctcctcttccccacctacggctacacggccacgggccaggcctcgcccgggggctc

SEQ ID NO: 37768 - DNA, 65 bp, Chlorella protothecoides
ccctgccgccatgcccagggtgccatgcacggcatttcccccagctcaccaggagggcgctctgc

SEQ ID NO: 37769 - DNA, 61 bp, Chlorella protothecoides
gcaccatgccgcccatgcggcaaaagaggtacctgcctagcccgccatgctggccgtcctg

SEQ ID NO: 37770 - DNA, 106 bp, Chlorella protothecoides
ggggccttgtcgcaccgcagcccaaccgatatcgaagcatcttactcatttgggtaaccttttgcacattctaatttaattcacggctaatcccaatgcccatgtt

SEQ ID NO: 37771 - DNA, 8173 bp, Chlorella protothecoides
  modified_base (195)..(228): a, c, t, g, unknown or other
  modified_base (488)..(497): a, c, t, g, unknown or other
  modified_base (861)..(870): a, c, t, g, unknown or other
  modified_base (1280)..(1527): a, c, t, g, unknown or other
  modified_base (1835)..(1844): a, c, t, g, unknown or other
  modified_base (2216)..(2225): a, c, t, g, unknown or other
  modified_base (3021)..(3030): a, c, t, g, unknown or other
  modified_base (3822)..(3831): a, c, t, g, unknown or other
  modified_base (4108)..(4117): a, c, t, g, unknown or other
  modified_base (4519)..(4528): a, c, t, g, unknown or other
  modified_base (5117)..(5126): a, c, t, g, unknown or other
  modified_base (5678)..(5687): a, c, t, g, unknown or other
  modified_base (6141)..(6150): a, c, t, g, unknown or other
  modified_base (6568)..(6577): a, c, t, g, unknown or other
  modified_base (6681)..(6690): a, c, t, g, unknown or other
  modified_base (7520)..(7529): a, c, t, g, unknown or other
acgttcttcgtgccaaagttgttcttgcccctattgccagggccaaaaattccattgctgtcggccgtgcatgccttctggcccatcttgaggcactccacggccaagagaatcttcgtggagcgagactccaggatctccaaggtgctcacacggatggctgccatggacagccccatggcatcaagggtggannnnnnnnnnnnnnnnnnnnnnnnnnnnnnnnnntgtagtggacgcgcataggctcaggtgtgcaaaatttggtgtacgtcaaatgaaacgccctgttgatatttcttgggtcggtccagtgatgtgcaagcagatgctctgtgacgcgcactcatcattggtgactcacctgcaaatggcatctgcactgtcaactgtcgtgaggaacacatgggctcctagactgtggggattcaaaggtgcgcggaatgatgggaggcatatcggggtgcagtacctgaaatgggctcgannnnnnnnnnttcctagactgtgggaatttaaagatgcgcggaatgatgagaggcacatcggggtgcagtacctgaaatgggctcgagtgcggtttgcatgtgcatgatcgggagatcagattgggcagggctccaggaagccgacaagggcatcggaacccagccggaggtggggccgaggggtccctttggacaaggacatcgtcagtgtcgcactcatgaccccccgatgctttaacacaaagctcgcattgcactgggcagcgcgacaaaagtggagctgcacgtggcctgcgtagcgcgaggaagccgggatgttattgaagccggggttgcacattggacgcttcagcctcaacttcaccaacgcgcnnnnnnnnnnagtttgcatgtgcatgatcgggagatcagatggggcaggcccccaggatgccagccgaaggtcggggcgaggggcccatctggacaaggacatcgtcagtgttgcactcatgacccgccgatgctttaacacaaaggttacattgcactgggcagcgcgacaaaagtggagttgcatgtggcctgcgtagggcgaggaagtcgggaagttattgaagccggggttgcatatttgacgcttcagcctcaacttcaccaacgcgcttggatttaccgcgaatgcgcatctggcgagtagcaacaagagtccagtcaggacggcagtgttcctggatgctattggcatcctactccttgcggcactctcccccttccgcctacttggacgaggactgtcaggatgaggtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaaccctagcggatctgagatcagccaccttgcagtgtcgctgtaattgtcatttttctggatagtctgtgggtcacagtgctcctctgacggtttaacgcccctggggagtcctcgagacttgaagtgggactcgaagaagcgcaacctcaacaagatctcgggagcggtacccccgctcccgttccactgcgcatagcagttattaaacggtccgaaggggcaaccaacgtaccgcggaatgtcctttccaagtgcttctgtcccacgatcgagtgttgccacaacatatccacgcaagcaannnnnnnnnntaacttatgtagggttaatcctattaagagaagccatgccagccctcgatgctgaccacctataagaaatccccgaacccattcgagcacaccagatgcgtcccatactccagatcttacttgttgtagcaggtaaatggtgtcaaagcttgatgcatttcgacagatgaatcaatatcctgctgccacaagccgccacgcctcagctccggccccccttccgagtagggttagtcctgttcactctcgcgaacttgacgaatcagaggatctggccgaaccgccttgtctcggtctccttagaatctgggatcctcagctctagtcaagtagtggagtcagcatcatgctccatctacgtcctggaccctnnnnnnnnnnaaacttatgagggggtaatcctattaaaagaagccatgccagccctcgacgctgaccacctataagaatccccgtaccccattcgagcacaccagatgcggcccatactccagatcttactagttgtggcaggtaaatgttggcagagcttgatgcatatcgacagatgaatcaagatcctgctgccacaaggcgcaacgccttagctccgccccccttccgcgtagggttagtccttttctctctcgcgaccttgacgaatcagaagatctggccgaagcaatacctctcgctctcctcgggatccgtgatccttagctctagtcaagtcgtggagtcggcatcatgctccatctacgtcctggaccctgcacgcgacctgggaatgcctgcttgcgactattcggacaccgccatctggccgcatgccctcaagaaaaccggtctcggggggagcaccgtgcccctccaacattgggagtaccagtacgcagtccatctctggctggaagaggctgtcatcgacaatggggcccggaccgacaggctgtcccgggcggatctggtgggtgggtgtggaggagggactgggatcaggtgcagggcgatccaggtgcacaggatatgttcagggtgtaaaggagcagtatcattctatcagtatcgccagcttaagcttccaggaatgtctcgtctccttccccaaagccctctcatcgagcaaggcgctcaccccaccctttatccctcgtcatgccccctccatcccagatattcgtcaacatgcattgctatnnnnnnnnnnttcaacacatctctggctggaagaggctattaccaacagtggggcccggaccgacaggctgtcccgggcagatctggtgggtgggtgtggaggagggactgggatcaggtgcagggctacccaggtgcacaggatttcttcagggtgtaaatgaggaagtatcattctatcagtattgccagcttaaagcttccaggaatgtctcgtctccttccgcaatgccctcatcgagcaaggcgctcaccccaccctctatccctcgccatgccccctccctcccagatattcgtcaacatgcattgctatgagacttggagggcgggtaagtggtggcagacttataaggaaggcgtgaagaacggagtcgatccggagctctatagagtgcaggcgatggaattcctcaggtcctggccccagtggaggcagagcaacggctccaggtttgtggtggcgcccttcaatccggcacttcccaagaagaccctggatgcgcagaggccttgcaggtgggtgaggtgcagaggcttgtcaatacatgtgtctgtggtcttttcgatcgagaggggcaaaacccctcgtgtgcgcacagggcccccgtacgccagagggtctcaagtcttgtggtacaaagttggggcctgtggctcccttgcgcgagactactagcttcaaaggggaacacaggctcgggccctgcccaccatgcccaccgcctcctaccctactgcaattcctttcccaacatgaccaggccgagatctgccgctcggcagattgcgtggaacatgnnnnnnnnnnaatcgagagggccaaaacccctcgtgcgcacagggcccccgtgcgccagtgggtctcaagtcttgtggtacgaagctggggcctgtggctcccttgcgcgagaccaccagcttcaaagagaaacacaggcgcaggccctgcccaccgtgcccaccgcctcccaccctcccgcaaatccttcccttttttgaccacgccaagatctgccgctcagcagattgcatgaacatgcctgggatccacccaccacccatctgataagccctccataggcccnnnnnnnnnnaattcacccacccacccacccatttgctaagccctccacaggcccttcgacccccgctccccctccctcccaaccccatgcagctcgtcccctttcgtcatcacctctgagcactccatgatgtgcgagcagaagctcgaggcccatgcccgacaggggctaattgtgccctacgtgactggtgtgcaggatcagtcattgggtgcagtcactgctgggtgtgtcgggtggttagccccgcccgcccatcaactgacctggaggtgttgcatggcttctcggcgcgcggctgctggcttcctgggagacgggtcacgctcctggacccgttgtggtgtgccctacatcccagtccgcgcactccctggccttgccacccctcgcagacacccaccaggaggnnnnnnnnnncttcatcatcacctctgagcacaccatgctgtgcgagcagaagctcgaggcgcatgcccaacaggggctgatcctgccctacgtgacgggtgtgcaggagtgatgcttggctgcagccatggctggggtgtgtggggtagtcaggcccgcgcgccctgcaactgagctggaggtgttgcatggcttctcggcacgcagctgctggcttcctgggagacgggtcacgctcctggacccattgtggtgtgccctgcctcccagtccgcgcactccctggcctcgccacccctcgcagacacccaccaggtggggttcgatcccctcgctgccacccgcgacacactgctcttctatcggggcgggtgttccccttcatcctcctccgccccttccggcccacgatattcatccgggtgagccctgctgcactggccgacagggcgcaggcagggacaccagcccgtcctcgccctgctctgcgggggggagactgcacgcccagtgggccctgtcatgaatagcttggcagttcccccgcgtcccctctccccacacccaatccccaccgctgccaccaggaagctgctgnnnnnnnnnntgctcaccccctccccaccccccatccccaccgctgccaccaggaagctgctgcgtcgcgctgtggtggacgcggtccaggcgtccaatgccaccgatgtggacgtgcggtgcggttgcgacatctgccccggcgccctgtcccactcgcaggtgctggcgcgcatgcgctcgtcccgctactgcctggtgctggccggggacaaggcttccagccgccgcggcaccgaggcggccctctccggctgcatcccggtgattgtggggccgccctggcacaccttggtcctggccgacgaaatcgaccacgccgcttccagcgttttcatctccgtgcgccacgtgacctgggtggtggccaacacctcgctggccaggtctgacaatcaccccagcgtgctgacggcctggtacctggacaccgacctaccgcccggacaaatgctgcatgtcgacaccctggacgaggtggtggacgtgctgcgcgcgctgccgcccaaggtcctggccgccaagcaggcggcactggcgcgggaggcctacaagcagtacnnnnnnnnnngtgggtggtggctaacgcctcgctggccaggttcgacaatcgccccggcgtgctgacggactggtacctggacaccgagctgcgccccggagaaatgttgcacgttgacaccctggccgaggttctgggggtgctgcgtggcatgccgcccgaggtgctggctgccaagcaggctgcgctggcgcgggaggcctacaagcagtactggctgccggccccgggggagaccaagtcgcagctcggagagattgtggtgaagaaactgtgtgaccacgcccagacgctcaaggaccgtggcatcattctaccgcaccccaccccgcttcaggggaggaagctgttggccgagtgacccctgcttgcctgcacgtgtttgtgcttgactgtgaacaagactccgatgcacattttgcgtggacttgcctgttacccacaatgcttgttgatggcaatnnnnnnnnnngcacgcccaggcgctcaagaaccgtggcatcatcccgccgcaccccaccccgcttcaaaggaggaagctgttggcggagtgacccctgcttgcctgcacatgcttgtgcttgaccttgaacaagactccgatgcacatttcgcatgggcttggctgttacccacaatgcttgttgatggcaatgttatacagacggtgtgctgtatgaacatggtgaggggtcccgagccagtctttgtgagcgacggagaggaagcctgaggatgtctggtgtgcccccccccctgatggctcgctcgtcaccatggccggcacatggaggaaacggggccgctgtgtgaccctaaatgcttctgactgtttctccacaaccctcaaccacatcgcgaacagaatacgtcgtacagatacaacatgnnnnnnnnnnaagaagaaggggcggtggcagaaaacctaggagaacgccgaagtcgttcgcgatgtccgaatgtcgcacgaaagttttggctgtcgtccgggttctcatctccnnnnnnnnnnagtggccctcccacactgatgactcgctcgtcaccaaggccggcacatggaagaatcggggccgctgtgtgacgctaaaagctattgactgtttccccacaaccctcaaccacatcgtgaacagaatacgtcgtacagatacaacatgaatcttttaagtgggacatttctgtagatcaccccatggagggtgtatcgcaaggcttttggccagtaccgagccgctgggtccgccaggaagaggggcacacctattgcgcgccgtgctgtgagagatatccatcacctgagcggctcgagacgccggccccagtcctgcccttggttgccgttcccattggcgaagtgctgcctgagaagaaggggcggtagcagaaaacctaggaaaacgccgaagtcgttcgcgatgtccgattgtcgcacgaatgttttggctgtcgtccgggttctcatctcccatcccattatgtgactaatgcagcgagcatgttttggggccaggtggttgccatcaagaccactcattgcttctcaagggctttcctcaggctgaagccactcattattgggtctacattctgttattcccgacgttctcatcaaccatctgaatcgctgctcatatccctctcaagcattgtgtcaatctcatcacggttctctccacctgtggcccattgcaaggccggcccatgcttgaccctgacggtgcaagcccggggatacaatcgaagaatcctgagctggctctccaagggggattgacatcgcaaaattgccagagcgacgacaccatccaaatcgcggtatcgacaacaatcgtcctggannnnnnnnnnaattgaaagcgcaaaatttccagagcgacgacaccatccgaatcgcggtatcgacaacaatcgtcctggacatgggcgcctctcacttcccagagccctttttcctcgcccgcccaccgcgcttgcccgccctgggctttgccgaggcggagctgcccctccccaacctggccaagagtgtgcgggcgtgggtgggtcgagtgagtggggaggggcggacacggtgcacaggtcgggcgacggagacaggccggcttgcatggggagcgggcccaacccattcctctgtcgcccggggccggacctggcgcatgccccgttccagaccctgggtgtgtccccccccacccgacgaccacccacccaccaggggcccctttcccccactccctcccacctggcaaaggggttgtcatgggcattgaaggggaagtctcggaggaggtccgcctcgaacaggccctcgcagtgcgcgctctccgacatgtcccacccccgcccctccaggcagcacagcatgcacagcgtgtcgggcgaccagcggttgtaccgccgctccagccagacctcgccctcgcgcactgcgtgcgccgcgccgcgcccgcactcgtcgcagcgccgcgccgcggccgggctccgggccg

SEQ ID NO: 37772 - DNA, 73 bp, Chlorella protothecoides
caggcccacgcagaccccggatggcgccgacgacgttctgcccggcccgcggctggtggagggcgcgggtggc

SEQ ID NO: 37773 - DNA, 61 bp, Chlorella protothecoides
ggctctcaaggagcggcacccgggcgcctatgtcaagtacatcgacccctcctacctcgtg

SEQ ID NO: 37774 - DNA, 15467 bp, Chlorella protothecoides
  modified_base (314)..(323): a, c, t, g, unknown or other
  modified_base (662)..(671): a, c, t, g, unknown or other
  modified_base (890)..(899): a, c, t, g, unknown or other
  modified_base (1140)..(1149): a, c, t, g, unknown or other
  modified_base (1249)..(1258): a, c, t, g, unknown or other
  modified_base (1394)..(1403): a, c, t, g, unknown or other
  modified_base (1689)..(1698): a, c, t, g, unknown or other
  modified_base (2147)..(2156): a, c, t, g, unknown or other
  modified_base (2734)..(2743): a, c, t, g, unknown or other
  modified_base (2959)..(2968): a, c, t, g, unknown or other
  modified_base (3903)..(3912): a, c, t, g, unknown or other
  modified_base (6207)..(6216): a, c, t, g, unknown or other
  modified_base (7780)..(7789): a, c, t, g, unknown or other
  modified_base (8350)..(8359): a, c, t, g, unknown or other
  modified_base (9950)..(10031): a, c, t, g, unknown or other
  modified_base (10926)..(10935): a, c, t, g, unknown or other
  modified_base (11003)..(11012): a, c, t, g, unknown or other
  modified_base (11095)..(11104): a, c, t, g, unknown or other
  modified_base (11316)..(11325): a, c, t, g, unknown or other
  modified_base (11695)..(11704): a, c, t, g, unknown or other
  modified_base (12756)..(12765): a, c, t, g, unknown or other
  modified_base (13010)..(13050): a, c, t, g, unknown or other
  modified_base (14404)..(14413): a, c, t, g, unknown or other
  modified_base (14963)..(14972): a, c, t, g, unknown or other
  modified_base (15149)..(15158): a, c, t, g, unknown or other
caccccctcgccgcccccgcccccccccgccaacatggtgctcaaccacgcatactgcgacgtggtggacgccgatcacatcaagtgcgaggccagcctcaccctggtggagagcgtcccgagaatgaccctggtctacaacctgaacggcgaaaagtattttgccgactgcacctccagcagcctggaggtgacctgcaccaacaccctcaggtctgcggtcgccaccggcacgtgccaggcctcgggcgacactgccactcaccgcttcttccagtcccgaattgtggacatcgcccctttcccggcacagnnnnnnnnnntgccaccggcacgtgccaagcctcgggcgacactgccactcaacgcttcttccagtcccggattgtggacatcgcccctttcccggcacagccaccggcggcgtgatgtgcaggggacaatggaacctttgccctggggtggcggtctcaccaggaaccccaaggaggcttgggtccctccttcgtgcagagatacaatgcctctccctatgcagcgttcgctcccactttttgacgagaagtttcagccccctcatgatatcacgggaccctccatccgaaacactgtgcgacgactacccttccattgccaagtactgttttgcacacgggggaatnnnnnnnnnnaccactgttccatcgctgtttgcctgggtctggttgtatcaatcagcactcggatgaaactgcaatattggtcatggtgagtgtggtgcacttggaaggggctactgcagtccattcccccgtgtgcaaaacagtacttggcactggaagggtagtcgtcgcacagtctttcggatggagggtcccaagatatcatgagggggctgaaacttctcgtcnnnnnnnnnncgggagcccggaatgcaggcagggcgacaacctcaccgcaatgcggttggttgactcagatttgcagcaaggaatctccgtacacagagagatacgaccagcagtattccgcaagttttgcctggagccttgccaaacaacggcagttcaaaaggaccagggaagtgttccttgtccaaggtcggcagacctcactggattggggtcaggcgtgaaggatgtctgaggcactccacatgcnnnnnnnnnntgcagttcaaaaggaccagggaaatgttcgttgtccaaggtcggcagacctcagtggattgggttgagacgtgaaggatgtctgaggcactccacatgcnnnnnnnnnnactgcattgggagaggccttgcatctctgcacgaaggaggggcccaagcctctttggggttcctggtgaggccgtcaccccagggcaagggttccattgtcctcggcacatcacgccgccggtggctgtgccgggnnnnnnnnnnttgaccaagttggtggcaagcagcgaaccgacctccctatgcgttgagtcacccagattctcagctgacaaaacagtggagtcacttgcagagggaaagcaagacgtgctgatgccgccttgatcaccgttcgtccagcatctcccctttccaaactcccagtcccaacacccgggatttccaccgcgcgctaacagaaccgggtcccttcgtacagagctccaaaagtgtgccgttgccatcctctgcagtgaataaccacttctcaaaacttctcgctatcccnnnnnnnnnntcaccgcgcgctaacagaaccgggttcctacgtacagagctccaaaagtgcgccgttgccatcctctgcagtgattaaccacttctcaaaacttctcgctatcccaaactcagcgctgctgccccgacgttgtgcgtgacagaccaagcaagcgccttactccttggtgcagcctgtctttcctggcactcttgccctccactccagctttcaggagcagttgcaaacttgcaaagcgtcttgattggggactggatcacactcctcggcagtgatgctgaatggaggtgctgcgaacggtcaggccagcccggaacctgcgcccatacaggcggcacgccagcttcaacggcgagcccaggtactgcagttggcagcacattaagatttaatgagcaggggggacattgaattgttccttcgagcattgacactgtgtcgatccgtcnnnnnnnnnntcacattaagatttgatgagcaagggggacattgaactgtttcttcgagcattgacactgtgtcgatccgtcttccctcgcagacgatcctggaccgcaccacgcctcatgtcctctaccggtggctggcatgggcttttgtgtgcgtcgtgtacgccatcagggtcttcaatctagaagggtgagcgtccctgccccgccacccagagggagttgcactgggggcgctgagactgtatttctgttttggttgggacgcgcctcccgcccaccggccggcttacagaacctttccccctccttggcgcccatgccacaggttctacattgtatcgtatgcccttggcatctacaacttgaatctgctgctgggattcctcactccccaagtggatcccgagctggagggcccaacgctcccttccaagtctgacgaggagtttaggccctttgtgcgcaaactgccggagttcaaagcctggtgagctgactgcttggggggtcatcaggcattctgctcgctcgcaacaggggcgactcagtattagaactcagagccctccatgctgccgtgatgnnnnnnnnnngctgcttgggggatcatcgggcattctgctcgctcgcatcagggacgactcagtattcgaactcagagccctccatgctgccgtgatgcggacagggcgggattactgacgaggcagactctgcactcgcatcacaaaggcactccgagtggttcagcagtgctcccatgggtagcatcccggctatgccccccaaacttctaattcacacccctnnnnnnnnnnagcatcgcaaaggcactccgagtggctcagcagtgctcccatgggtagcatcccgaccatgccccccaaacttctaattcacacccctatgtgccttgctctttccaggtatgcgagcatccggtcgctgctcctgggttttgctgccaccttcttcgcagcgtttgacatccccgtcttctggccgatcctggtgctctactggtttgtgctcttcttcgtcaccatgaagaagcagatcctgcacatggtcaagtaccggtatctgcctttctcatggggcaagaaggtgaggttcgctcttgcctcttgggcatcgggggtgttgggtggggatactgtcctgtacagcacttgtaccactcccttccctgcactgatttgtctgagagctgacaactgacctgtgctggtcttggaggatccaagggtcacgccggtggcccccttactcaccctcccatgacccgatgcagacttatggctcaggcaaggcgccacgaaaagaaactaaatgacatgcgatgttcatgctgacgtggcacggcgcagctgggcctgccagcgtggcggccgggccaggccccattgtctgtgcggtcccgtcaaacccaggtcctgccgcgtgccttgcacagcgtggtgcgcaggattctgactcgtgtatgacactccttttgcaatctcgataaaggcgcagccttacaaccgttgtcctcacagagcggacagcctgttgccagacagtcgaattcagcggacacaggctcctcgatcgcaaggttcagattggcagacagggactgtccacaagtacgccctgcaatattcctcatccacccgccccctgctaccgacatcgatgctcgtcctcgctgccgtgaggaggcgagcgtctgtttcgctctccacagcggcggggaggatcccgggannnnnnnnnnctacgccctgcaatattcctcgtccacccggcccctgctaccgacatcgacgctcgtcctcgctgccgtgaggaggtgagcgtctgtttctctctccacagcggcggggaggatcccgggaccggctgcgggacccaccccgccgtttcctgtgcatgagcgtgccaaagggggttgaaggggttgagtctggcggtgtgtgtcagcgcagccactccgccgggcccatcacgtcatggcggtgcgcttggtgcatgcagaggcgaaggcatgcgcagagtgagggggcggggcggctcacacgacatgtctcgtcccacaaaacaccgccagctcaaggccacgcaggtgcatgacttaatgcctttgtcaactgtgtggagtacactcatgcatagcaagatttcctcgttccttcccatgcgcagtgccttgaactccacgctgttgcagcatgctgtaacactcagcctcgcagctccatcctggcgagcccaacacattcccaaaacagtacctgtggccgcttggatctgcattcccgcctgccccagcccggcggggggcctgggaagcatgggccgctgaaagagcagctgcctcgcggacctcctgcacaggagtcggagggaggcgggcaggtggagtgtgagagcttatgggggaggggccccctggaagtcccaggcctgcatcggatcaagcgccgccccagccgaacacttgccggcagctcatcgcacgctccctgcatggggcggcgcgctgtcatcccacgccacgggcacgcaggtgcaccatcacctgactccggcgcagggcctgggccgccgcatcctggtggatcttcttccccagctgcgccgccatgagacgctgcaggcgctccttgggtgtctccctggcgggcggcggggcagggccaggagactgctggtgcgcctggggcgcagttcgggaccccggcagggctgtcggcccctgcgcccccgcccgtgcgccgaggtcacggtcccgtgcctggccccgcagcgagggcccggggcgtgcccccaccccactgaggcacgggcgcaaccccacctccaccgcctgctgcaccgggatccagtccaggctgcccgcatgggtgccgggcccctcagagcacctgtcctgccccgcagggacgctcagcctcagcgcccgcttgcgcgcggcccagccgccgaccggcccacgcggggccaggcgcgccgacaggccggccgccgcggccgccgcctcacgccgcacggcccagcgcagcatggccgagaagtccgcgacgccgtaggcgcgcgccagcgcgtccattcgcacgtcggcgccggggtcctcgcctcccccctcgtccccgctcccctctgacgcgctaaccctgtccccgtcggtgggggcgtcgtggccaagcccccccgccgcatatccagggtcacggcccgcaggtcccccgcccccccgcatccccgccgccaggcccaacgcggtgcgtcgctgcgccgtgcggatggcaacgtcctcctgcgccgcgcgggccaggccctcgtggggcgccaggccctggcaggcccaccggatgacgtcgcggtaagactcgaacgccagctgctcctccagctcggtgtcggccgggccccgccccgcgcctcccggcgcggggcccgccgccgccagctccgccgggtccagcagcatgcgggcgtcaaagcggtccacatcttccccgggtgcgccgcctgggagctggaccaagccctgcgccaggtcagctgcgcagcacgtcctgctgtcgcccggcacggcgcaggcatggcccctgagcctgagggcatgcacggggtcctccctctgtgtggagatgggtcggcgacagggtacacagggtttgcttgaagcaatgcccggatgtggtggaatcatccagcccatcgcactcaggagctgcgaccaggctgagggtgttatatccagtccctcacctgcgcctcctcgtccgtcagtcgtcgttctgaacgggctttatttgccgtggtgcgatccttgagggccctggcctgggcgcgcgcctcatggtagtagcttgccatgcgccgggagtcgaaaggtgctcagccaggtggcgactcatcacctggggaagcacctttccatggcgatctctttgcgatgcaggtaggtgtctaaatgaaccggggattgattgttccccattgccttactttgtagagagggggagaggtggtaacctcaccggatcgggcggtggtgtctctnnnnnnnnnngggggaagcaccgttccatggcgatctctttgcgatgcaggcaggtgtctacatgaatcggggattgattgctccccattgccttactttgtagagaggggagaggtggcaacctcaccggatcgggcggtggtgtctctcggagttggtagtaccgggacatgacggccgccgtgaccagtcttcctacgtctgtccttcccaatctccgtgtctgctgtacatgcatctcatttgtataacgggcactgcgtcacttggagtcagaggagggcctgggtccatcagcagggcagtctgcggagatcagggggtctgaagctgcatgctcgcaggctcgttgtgccagtcagggctcctcgccaggctgagcacgcttcggtgggtttccccctgcaagcaggttgtacaccaggaaaacgaggagcgagcctgcgattgccaggagcacgccatgcacaatgcgggcggcgggcttggcggaggccaggaagacacgatagagccgcagcgagaggaatgcagcgatgcctgcgacaatggagtggcggggcgacagagtgactcgctgatgcagggcatgcagcatggcacaggccatgttaacaactcttctgttcgatttccgcagcgcacctgtttgcagggaggtgatggcggccccaactgagcggcgtcccttcttccaggctttcaagctcatggcggcgaggagcagctccgctacccctccccatgccacgaccgcggcgcccctgccggagccagccaggaggccggcgacgccggcggcgaggaggagaccgccggcgggcaggaccatgcagaagtcgtgcaagacagcatgtctggtgggcgttagtccgcctgccccgcaaaccacggtctgccgcgcctgttgggggtttgaacggcgggctcttgtgtttggcccatgctccaggggtgactcaggtcgtctgactccagggcagagcattgccgagtaatcttacctttggaggacccgggcccatacgagctttgcgagcagcattggttgcatgttttagacggtgtgtcggactgtgtacaccgcaggtcgacaggacgcgcacaggtccggaagaggtggtcggagcgcgacctgccaggcaggacttgctgctgctcgtggcgcgtgccaaggtcgtcggagtcaccgacattgcatgctgcatatgtcgcggtcttataattatcctagcatcttgctgtgattgactgtttacaagctgagcgtagcctggcacagcaccgcatgctccgcatgatcggatggcatcgctcccattgtgcatgtgaagcaccactatgcgtgtaccaacactcctggattactcatttaaaaagggcttgccatgtattgcgggacaagtgtgcgtccagcgaggctgacgaccggtctacaagccggtgttggccggacccgttcccagccttgtcgggcattcggtgcctccagaacgcgcggatattcggcggtccaggccagtagcgccactgcttctagtagcgatgcagtgcgtcttgtatccaatgcgtnnnnnnnnnntggagcctccagaacgcgcggatattcgccggtccaggccagtagcgccactgctcttagtggcgatgcagtgcgtcttgtatccaatgcgttcggagctgtgcgttgcaggctgaccggggcctggcttgccagcatccagaaggcccaatccgcaactccagaggtgcgtgtgtgggtgggtgctccatgcgatcttttcgtcccttcgcatacctgcactctagtccttctcccatatgcggttgcatacaggatgtaagccagcagatcaggacctccgtgaagcagatgaagcttctcaccctccttgcgccctttgccgccgtgtctgggagcgcgggctccctcctcgtcatgaccaaggcggtggcgagtttcatcaaggtgcgcgcacagagcggggattggtggtcgtgctgggtaaaagaacatgctgtaaaggctgttcctgcctgtgcatggtgcaaaccccacatgcatgccgacctgcttcaaggtctgagtttgttcccaataaccacctcccatgcagttgtacctgctgctcctcttcctgcnnnnnnnnnntgcgcacagagcggggaatggtgggcgtgctgggtcaagggacgtgctgtggaggctgttcctgcctgtacatagggcaaaccccacatgcatgccgacctgcttcgaggtctgagtccgttcccaacaaccgcctcccgtgcagttgtacctgctgctcctcttcctgcgagtgctgctgagctggttccccaccttcacgtggtgggaccagcagccctggctggctctgaggcaggtcaccgacccatacctgaagctcttcagcggccttgtccccccgctgctgggtaccattgacctgacgccgctggtcggcttcttcattctccaggtgtgctgggctggaagggtgtaagacaagacagcatggttgcccctggtgcttgtgggagtggctgtcctgagcgcatgccacggctcccagtgctttcctcactgaccaaccctccccctgccttgccagtttctggccggcttcctggtgacgggcaccgctgacgacatgttctggtagactgctgacatccgatgctctgtgcccctccccttgatgcttgtgccggtacccatgtcattgcagccatggcaaaatgccgacacaggcagggagggggattacaaagtacagacgtcctatgccagaaggagattcagtgcggatccattgattggggaaggagtgcagtgttggaattgaaacaggtggacaagaaggtggcttcggccatccagagcgcccatgcctctcaaatcaaagtgtggggctctcaaagtctgcccgcaacctcttaacggctgggtgcaggtcctcggagggtgccgtgtcgcatcgggcgggtcggggtgccttggagggcgtgagtgtctgcaccttgcccccaaatcgcttcaccagccaggcgccataagcctcccgcaccgcctgcaccacctccggcgcactgttcttggagtagacacggagtgtgttttcctgcgaccggcgcgggtgtgtactcagggggtgtgcctgggcactcaggggcgctgagtgctggctgagcatcttccctctggatgcccagccattgctcgacgaaatctgtgcggccgatcggaggacggccccccgcatgtcggttttgtcgtccagaagcctctccctcgatcccatcccggatcgtgtgaccccaggcctggcggcgcacctggaagacaggggcgaccatggagctgatctggttggtccgcagcacccgtttctgcgtggactccagggagtcgaagaagtggacgctgtccaacggattcagattgcgcatggagaagttgattcggttctcctgcgggggacgtgggatggacagggtgtctctggtacggggatcggtgctcgatgccccgcaggagccagcggtgggccggccacaaatctggatcgtgcagactctgggggcctgccctccgcccgtgatgcaaaaccaggggtccctgccctcaggccgacctcacctggacgactatgtcctccggccgcatgcgcacacccgagccacgatacgagttcaccacgtctgccgcggtgggggggacccactggccccgctcnnnnnnnnnnnnnnnnnnnnnnnnnnnnnnnnnnnnnnnnnnnnnnnnnnnnnnnnnnnnnnnnnnnnnnnnnnnnnnnnnntctgcggcctgagggtcggcctggagtaggcagcccggcacttccaaacatactctgccacagtgagaagacagcatcgccgtccaggctggaccatgcagacccatgctctggggcatgttgcgagagtgtgaggagaacagacagccaggactcacagctgggatgagagcctcgtcgcagaatttgtagaggtctcgtcgacgcaggcggtcgatcaggacctgcgtccacatgttgtgagggggtggtgcggctggatttccgagcaaagtcccagcgggatgtgtgtgcgcaacgcccatcacaaccccctcgcatagcacctgcgccctctcgatggcacaaatgttctcgtcctccacggtgaacaggtttccgaagagccggtagttctccacccactgcgcaggggtgtaaggggtgagggtggggtggaaggctgaaggccgggaagcatgcgcgagacacgcagagcccgcgtccggtcaaccagcaccccagcgcagctctccactcacatccaggatggagtcgtccatgaggctgaactctgcggggtcccagatccggtcggagagcttcagggcggcgtcgctctccagcagcgcatccacgaccatgagttcgattgccttggccttcctggcggtgtcaagatgtgttgcagggaaatggtgctggtgtgttgacagcatgagttggcatggacccagcagtgggcccccccctgcagcgctgggcacactccttcccctcaaccacacacacttgtgggtgtagacttggcggtgcatgatggcccgggagtggaacagctcatgcaggttcatgtactccgagtagcggtagcagatctcatcatcgatgacctgaatggagagggagcgtgcannnnnnnnnncccccccccctgcagcgctgggcacattcctttcccccaaccacacacacttgtgggtgtagacttgnnnnnnnnnngaggagtggggtcggcttgcggtcggatccccatcgcaaagcttccgtctcggcactgctcatcaggttggcgcactcttcannnnnnnnnnaaggagtggggttggcttgcgatcggatccccgtcgcaaagcttccgtctcagcactgctcatcaggttggcgcactcttcagcctttcggggttccaagatgtctcatgagggcctgcagcgccttgcccaccgcccggcttgctgtgtttcatacgatgttgggtcgcaggccgacattcattgccgacaatcacccccccccccccccnnnnnnnnnntgctgaactgcatgacccggttgaagtcgtaggacagcttcaccccgcagtacagggagtccctggccaggtagtcgaacttgtccacatcgatgccgttgcggccattggccacgatctcgtgcaaccaaagcttctcgcggtgcggcgcggcccctgctccaaccccgccatgcgcggccgtgatcatgctctgcacgctgcgcacgtcctcggcggggatggtgtccaggtgcttggtgtcgatgatgtggtccagcatggcgccagacatggcctcgtggtccctgccaggaggggagccagacagtgggcaggtttgcgaatgcgtgtgtttgtcagtgcaggcaggcggtgaggcccgtgacannnnnnnnnngagtgggcaggtttgcgagggcgtgtgtttgccagtgcaggcaggcggtgaggcccgtgacaaagctggtcatgcagtgctgggtgcgcatggccaggctcatcacagggtgtacacagcaagcacatctcccatgcattcgctggcccgaaacctctccaggcccctcaccagtcggtgatgcccttggccgccagaaacccgcggtcaaacacgtggctaaagggcccatgacccagatcatggcacaggcctggggttgggttggtggggggggagagatgtggcatgcctggagatgtggtatggatgatggcgtgggactggatacaaaggacaccacatcaatgcgcctgttgatgtttcacaaggtctcactgagcgctgcccaccacacatacacccacccgccagctccacaatgcgcaggtcgcgctgctccacatccagctcgttgccctggatggtctggatgtggcgggcaaagcggtaggcgaggtgggcgacgccgaggctgtgctcaaagcggttgtggcaggcgccggggtacacatggtaggtcaggcccagctgcttcaggcgccgcagtctctgaaactgccgcgagtctatgatgtcggtgcaggcaggtccgaggcggaaggcggagtgcaccgggtcgttgaagagcttaccatggcgggggggaggggcagtgggaggtgtgcgggctgccggggggtgaaggggccgcaaccctcccgcgaagctggttggacccgtcacgcgcggtgcggtggcatcaaaatagtcgttggcgatctggctcaggggtaccagcccctcctcaccgcaccggtccaccatggcaggtggcgccttgtgcgacacgccctgggcccccaagggacccggttgctaatgagtagggttttgttgaagtggactccttatgaatctatatgcgtgcattcctggtagcaatcaggggtgcactatcgggaggacaaggaatagtttattcgcgcgcgcgcgcgacaacgtccggaccatgcacgtcagcgctcttatgnnnnnnnnnnaatagcaatcaggggtgcactgtcgggaggacgaggaatagtttattcgagcgcgcgcgcgacaatgtccggaccatgcacgtcagcgctcttatgcaaattcatccgagacattatacaatgtcagaccttggccgacccagcacacatacatccgaatgtacttaaaaactatccgatcgtcacctactcgagtcccgtgctgaccgaaacctggcctgaagcctcaatccctgggggacccnnnnnnnnnnnnnnnnnnnnnnnnnnnnnnnnnnnnnnnnngacacatctagcgccctgcgcgccgtcagcccagcgatgaggttggacgaggtgagatattagattttcacgggcatgaatcaccctctcgcgggattgccgtgtcccgtgatcacggcatctcacgacatggtccccctccccacaccgcaggctgccctgtcagcctacctccggaagacattgggaagcaaagcgccggcaggtcccctggagatatcacagttctcccacggtcagagcaacccaacatacttcctcaaggtaaagccctgtttgggtttcgcattgttggaacacttcctgagaaggcagatggctggtgaaggtcctctcgcctggcagggtaggctgctgtctttcacatcattcgagacacccacccttgccatccgttggctacccgcactccaatcctgcatccctcgaaatgctcaggccggcggacagcgctttgtcctgcgcaagcagcctcccggcaaagtgctgcagtctgcgcatgccgtggatcgtgagcacctcatcatgtccaggctggcaaacaccccagtgcccgtgccgcgcatggtgaggaggggatcgagaggtcagaggagtatgtcactgatgaattgatcttgttgtgttactgccgtggccaatgagggcgcgaagtgggagtgccgcgctgtcacctgctcttgagctgtaccaaggcccttccccttcaccctgatcctgtcctgtaccaaaacacattccaacagatggccatgtgtaatgacccgtcggtgctgggcacgcccttctacatcatggagcacgtccagggtcacatctacgagagccctggcatggagagcgcccctcccgagcaccgcagcactgtgtaccaggtgggtggctggcagggatcctgcacattgtccacagcccgcacagggtggcctgctggctggttctgctatgaggccgtgcaccggcggcagagcaatggcggatgcaggcccaggggcggtgcacagctgcacacccagttttcgctccctcgcctcggtgatgaagccttctctccccatccctccaggccatggcagagacgctggcggcgctgcacagcctggacccagtcagcctggggctcaaagactttggccgtgcgggcgggtactgcgcccgccaggtgaagcgctggagtgcgcagtaccagcagtcgatcctggtgcgtcgctggctctgtctcgttgagtccagggggggcttgagcttggatgcctgaccccatctacaagcaccgcccagcgcttgcttgcgcgatgacatctgacccacctccaccacccggacgacagcctggcgagtcggcgctgcccgnnnnnnnnnngcttgagtttggatgcctgggccccatcttcaagcaccgcccagcgcttgcttgcacgatgacatctgacccacccccaccagcccgacgacagcctggcgagtcggcgctgcccgagatggtggccctgagcgagtggctcagcgagaacatccccgctgcagacgcagacccctcccgcacccgcatcacgcacggcgacttcaggcgagtggatgagtggaccgggagtgatgaggctggcaagcgcggcgatgacatcctctcacccctcattgccctgccctgcccaggctggacaatctggtgctggacccgtcgggtaaggtgctggcagtcctggactgggagctgtccacgctcggcgaccccttctccgacctggcatacaactgcctggcctaccacctgccccaggtaggcggctgtgtggagagggaactgtgaagtgctggatggccattgatggacctggcagggaggagcagaggggggcatgcagatcgaacagtggcgcttgtgtgcaccagctgatgcatgctctccgtgnnnnnnnnnnacgagggaggcatgcagaccgaacaggggcactcgtgtgcaccagctgatgcatgctctccgtgacgctctgtcggtcatggaccgccacctcccaccacaaaaacacacacacatgccccaaacaccccgatgcagggcacccctggcctggccccgctgcccaagcccctccccnnnnnnnnnntcccaccaaaaaaatacacacacacatgcccccaaaaccctcgacgcagggtacccccggcctggccccgctgcccaagcccctccccctgggcatcccctccgaggcgcagtacctggagacgtactgcgcggcgcggcgcatccccgtcccacccaaggccgagtggcacttctacctggcgctgtccacgttccgcgcggccgccatcctggcgggcgtgggcgcgcgcgcggcggccggcaacgcctcctccctccgcgccgccgctgtgggcgactcggcggtggtgcgccggctggccggcgc

SEQ ID NO: 37775 - DNA, 61 bp, Chlorella protothecoides
tgctctgtgggtgtaatcctccattctgctggtctgaaggatgatagccagcctcacccct

SEQ ID NO: 37776 - DNA, 61 bp, Chlorella protothecoides
actacaccatttgagtgtcatgtgattgtatctactgcctgcggacactggatggctctgg

SEQ ID NO: 37777 - DNA, 115 bp, Chlorella protothecoides
ccgcgcgctgggcagcgctgcgccgccttcgttttcttgcctttcactggtgagagaagtggaggggtcgtgcatggtggtgatggatctggtcaaccagccgcagccccaggtg

SEQ ID NO: 37778 - DNA, 78 bp, Chlorella protothecoides
gttcacgagctggctgaagtcgcccatgatgtgtcgataagtagttttgcaataaactcagcctgtagcgaccgcttg

SEQ ID NO: 37779 - DNA, 66 bp, Chlorella protothecoides
gggcatctgactctttgacaaagcgccgcgagggacactgccgctgccaatcccctggctgtgtcc

SEQ ID NO: 37780 - DNA, 150 bp, Chlorella protothecoides
gggacagcgcgcccatccccgccacgctggtggaggtggcgcccaggagcatagcgttgaccccggccaccacccctccgcgcacctcgcccagcgccagcgcgacgtgcgcggcgtgcgccgccaccaggctgctggagcaggcggtgt

SEQ ID NO: 37781 - DNA, 79 bp, Chlorella protothecoides
gtaggtgcgggcctgtgacttcttgccgctactgttgtcctcgaccttaggcccgccgacggtggcgggcttgacgggg

SEQ ID NO: 37782 - DNA, 70 bp, Chlorella protothecoides
ctcccgcgtctgtgagtgggaagtggacagggggaggctcgagagggagcctcgacgtgcatcttgtcat

SEQ ID NO: 37783 - DNA, 72 bp, Chlorella protothecoides
gggagggacagggcccatgcacggcttcccgcagcagcatgcgcagcatgcgcagcatgcgcagcaggtcat

SEQ ID NO: 37784 - DNA, 61 bp, Chlorella protothecoides
gtgctgacctctagcactgccagccacacggccctgcacctggtcacggagggcacctatg

SEQ ID NO: 37785 - DNA, 61 bp, Chlorella protothecoides
gtcctggatcttgatgtcgatcttggggccatagaaggcgccgcccccctcgtccacactg

SEQ ID NO: 37786 - DNA, 120 bp, Chlorella protothecoides
ggttgctggctgaaatgcaacgcttgattccggcagcaacatcactggcccctccaagccagaatatccaacaatctgtcagcgcagtctcgatatcttgtagcttctcaacctcattcc

SEQ ID NO: 37787 - DNA, 62 bp, Chlorella protothecoides
gtggggcggcggcctgacctttggtggggcaacggcctgaggatgggcggagtggcagcctg

SEQ ID NO: 37788 - DNA, 82 bp, Chlorella protothecoides
cccccccccccccccccccaaaaaaaaaacctttgctggccgctcatggaatcgaccatgcggcctcccacatccttgcctg

SEQ ID NO: 37789 - DNA, 111 bp, Chlorella protothecoides
attgggtggtagtatgaagatcagagaaagatgatgagaaagttttatagctgttttgcaagatttaaattgtggtgtgtggactggatcttattgcgatcaggatcatac

SEQ ID NO: 37790 - DNA, 91 bp, Chlorella protothecoides
ggcgaggcaccgtcacctggtgttgcttgaagtcccggcgagcctgcatccaacaccccttgctacctgaacgtgcaggagtgtcgctgta

SEQ ID NO: 37791 - DNA, 17452 bp, Chlorella protothecoides
  modified_base (615)..(624): a, c, t, g, unknown or other
  modified_base (979)..(988): a, c, t, g, unknown or other
  modified_base (2056)..(2065): a, c, t, g, unknown or other
  modified_base (2246)..(2255): a, c, t, g, unknown or other
  modified_base (2657)..(2666): a, c, t, g, unknown or other
  modified_base (3562)..(3571): a, c, t, g, unknown or other
  modified_base (3766)..(3775): a, c, t, g, unknown or other
  modified_base (5603)..(5612): a, c, t, g, unknown or other
  modified_base (5733)..(5742): a, c, t, g, unknown or other
  modified_base (5941)..(5950): a, c, t, g, unknown or other
  modified_base (6643)..(6652): a, c, t, g, unknown or other
  modified_base (7191)..(7200): a, c, t, g, unknown or other
  modified_base (9328)..(9337): a, c, t, g, unknown or other
  modified_base (9841)..(9850): a, c, t, g, unknown or other
  modified_base (10366)..(10375): a, c, t, g, unknown or other
  modified_base (11755)..(11764): a, c, t, g, unknown or other
  modified_base (13011)..(13020): a, c, t, g, unknown or other
  modified_base (13620)..(13629): a, c, t, g, unknown or other
  modified_base (14270)..(14279): a, c, t, g, unknown or other
  modified_base (15928)..(15937): a, c, t, g, unknown or other
gggtggggttgggctgggagtggagtgaggatgaggtgggatgtggagggagggtgtcattgatccgatgccctttcacatgcacaccatcaaggccgttcctggccctcacaggcagtgcccttctaccccccaacccaccccctcaacccctcaacccacccgacccaggtggggcgcggcatcgacatcgagcgtgtgaacatcgtgatcaactacgacatgccggagacggacgacaagcacggcaacggcgccgacacctacctccaccgcgtggggcgggcggggcgcttcggcaccaagggcctggcggtaacctttgtggccagccccgccgacagtgaggtgctgaaccaggtgcaggagcggtttgacgtcgacatcaagcccctgccggactcggtggacgccagcacgtacatgaacacggcgtgaggtgtgttgtaagcaccagacttcagtttcatgattgctgactgaagaggggggggggagcggggggacatggacgcaggcagggacggagcgttttctggggaattaaataaggagcagcagtcagtgaaatgaaaatcccttgtggatggcttcctggagaccgtgaggtcatgnnnnnnnnnnttgaagaggggaggggggggaggggggggacatggacgcgggcaggaacggagcgttttctggggattcaaataagaagcagcagtcagtgaaatgaaaaccccttgcggatggcttcctggagaccgtgaggtcatggaacccctggctgtggctgagcatgctgtgtggggaggtagattccagttggctgaacaaggggggtcctggacgccgcatgctgccgagcagcatgcgcggcgcaattagacactgcaggggtctcaacgagcagtaggcgcgatgcgatcagacactgcaggcatttcgatgagtgagtcgatcggcaagcctacgccctacctccctaacaacnnnnnnnnnntagtaggcgcggtgcgatcagacactgcagggatcccgatgagtgagtcgattggcaagcctacgccctacctccctaacaacaagacaccaaccagtcacttggcacatacgacttccccacattggcaccatcccttcactcgtctgtcccttcctttcggtctgtcgctgtcaacatagaggacatcgtcacgcaggaccgagcaagtacccaaggtgtgtgataagttagtgcagcgtgtggaaagggcgggcgagggtaggcccggggccgggctggggcaggggatgcggcccaacccttctccagaccaaccccgggaggggtgacatgccggggctcgggtagcgtggggcgtggcgcaggcaggcaggaaaggggggggagagggtgcttcagtgtgttccaaggttagcaaatgacaggcatggcaaagagagcgtaaggggtcgccagtggggagcagcggagggagcggttggcacccttgcccctgctccacggggaagcgatctaattttgagaaaggcgaggtgcagcttgtggccctggcaatgctggaaagggcaccctggggcagccgtccgcgtctggaattccattcagaggcttggtcgccactcttcaacctccatacccgccgctgcctgctgtggaacagaggacggggtgggagcatgagcaactcgtgagctcacctccatcacgcgcctctgcccccacctggctgcatccccgaagcaccccgaaggcgtcggcaacgcatcagtctgcctccccacctgcaccgtcagacgctggggaaggcaccgcccccagcaaagcgtccgggctcgtaccggattcgaccgagagcgccaccgggggcgagtcgccgctgctgctgcttgcgccgccggtgacctggttgcaccagcaggactgcacgacgttggcggtgctgacgtacgccgacaggcctgccagggtgtcgccagcactgcaaggagggcggggaggtttcttggacggaggaaccccatacccaggcagccacaggcagccagcgccgtcgcaggcgtggcnnnnnnnnnnaagggttcttggacggatgacccccatacccaggcagcaacaggcagccagcgccgtcgcaggcgtggcagcggcgcgcgagatcagactttgcaaggcggcgtgcgagagacgaggctggccccaaggcctcgacacgctcccatggcgtccataccccagatcactcaccacaagcatnnnnnnnnnncgcgggagacgaggctggcaccaaggcctcgacacgctcccatggcttccataccccagatcactcaccacaagcatgccagatagttggtcctggcggatccagccgaggggatggcgctgcagcagctcccggaggtggcactgggggacagagtaccaccacagctgctcactaaagtgttgcgaatatcagtctgctcgctggatgtcagtcctgagcagacggcagcagctgcgatggatggggagcgaggaggcaaatcgtcgccgagatccacgagcccgtacagagtgaggttgacctcggtgcgcatgacgacatgcgactcctcaagggcacgtaacacccctgttaccagcatgataccctcatagcgcgcaccgttggatgggcaggatnnnnnnnnnnttcaggggcacgcaacacccctgctaccagcatgataccttcatagcgcgcaccgttggatgggcaggatgagcaggactgttgcaagcgcctggtcctggcgctcgccaggtatcccgccgcgtcgtccggtagggagtcctccagtcttcgcccactcccgaaggacagtgtcatgcatacaaatagcacaagaatggtatcatagcgggccatggacacttcttgcctcccgcttggcctttgtgccggcagacgcggtcgaggggcaagggtcaccagtctcacagatgcgggtgtgggttgcgcatgagccttgctcgtggcttaaagtcgtagatagaccgtcggtgtagctgcctggcttaagtggagacctctcaggggtcaacacggccagcaggcggggaggcattccgcatggttgggagctcatggtccacgcggcaatttctcaccggatcgtccgtgcacgtggctcatggggcgaggggaagtctaggcaaagtcatgggaataaatgtagatctgaacaaccgtgtcatggccccaaatactgctggaggtagatcattgacctgcccgagtgtcccatgaccgtgagacgcgagtttacgcggtgtcctcatgaagagattgtgcacacgtgggccccgcacaaccttgcatgatctcgggacgtcgtggataccccatgtgcgacgattacctggctgttctattttcctcatagcgagattgacagaccgcttgcatcacccatggaaatggtccagcacatgcacctctggatctcgaccgtgctggtttctgccatgcagtttgaattgtacgcccgggcatgaaacctagaaactggatctttaacttgtgtcggaaggggggcattgcatgcnnnnnnnnnngcccatggaaatggcccagcacatgcacctctagatcttgaccgtgctggcttctgccatgcagtttgaactgtacgcccgggcatgaaacctcgagattggatcttcaacttgtgtcggaaggggggcattgcatgcctccggagcaacccaaagcatgcatgttagatcaccatccaggtcactgtgcctctnnnnnnnnnntgagcaacctaaagtatgcatattagatcaccatccaggtcactgtgcctcttgcaaagaaagcttacatggaagatgttgcttcgggggattcgctacaacctacagcatcactctggtgtgattccttatcaaggcatggtagtcccctcacccaaacttggcatcactgcagcctaaagcttcaaaggtgcgcctgtctctgagtccagtagcagaacctcctgaagatctggaaactggtcccggacggctgctctcacacccactgcaatggccggtgggccgttgtaaaggagcttgcacacgccctcgctgactgtgcatggcagggattttgggaggggtgatgtgggcaggacgaggtgagagcacgcctagctagaggcctgctgtatttcccctgcttgcgctgccccgagctccttgcccttgcaccatcagctgagactcaggaggggcatgcatgctgagcgatcaaagcaccaaaacccctcgggtcgaccccgacacacacaagggggttgctctcacacacactcggcatctgtcagcgcccccccaaacatgaaaaagagaaacaacactcacccgacttgacgaccacgctgccgccatagctctggatggcccccctcagcatgttcaagtggtcgtccaccctggcctccgtggcccccgtgtcttgggcgttcacctgagtgatgtgggtgtagagttctgggacatggcgggggtgtcgctgcccggcagactccctggcccttccccccgttcctcatgtcgctgtcggatcaacctcccgcccggcctcacgggcccctcaaccacacaccacacgcgcacacctggacaatctgcgatatctgggtgccaaaggtagccctcaggcacctctcgatgcccatgctcatggtggccgaggaggaggggcaggtgccgcaggccccctggaactccagggagaccaccccgccgctgaccgacaccacctccacgttcccgccgtcggcaatgaggaaggggcgaacctcgttcagcgcatggtccaccgtctcggcattgagcgggatctggggctgcggctcctggttgccgacctgtggacgccacggaggcagttgggggggttggatgagggagggaggtgggggggctcatggggaagaggataagggtactatatttgctggtgcactggagggggtgcatgcaaggaagagccataggaccttcatattgacacaaaggaatgccctatgctcgtcggtgacagcacaagctgggtgcaccacgccttcacacagcgcttcctcttcagatcccttggccacgagacagtgtgatcactcccctcagtacgcccaccccgtggcctcacttggcgatgcacggcagcttgggtgaagggtgaggctatcggcggggggggctgtgcggcgccatgtgcactgccaccttcagagctctggctctggggcgtcgcggcatccgccaggtctgcgctgtgggacgccgccacttcctcggtctgcctgtcgatcacagccgaccagtcgtcgccctccacggcctgcagggacgatacaggcatggtgtgagacatgattcactaaggggggtgcaccccctacgatcgggagggcaggcaatcctcccggcagtgcatggcggcggtcctgccatgcatgcctgcttgaacccatctcctgccatctgcccctggccaaaacgggcgccaagattcatcgaagtctcagcccagagagccccaccgcccaccttcagcagcttcagtcgccggacggcatcgtcatctgtggcaggnnnnnnnnnngtgattcactgagagggcttgcaccccccacgatcgggagggcaggcaatcctcccggccgtgcatggcggcggtcctgccatgcatgcatgcttgaacccatctcctgccatctgccccnnnnnnnnnntggagtgcatcgggttggctggtggactgctgctgggcacctgtggcacacaccatttcacacacgacccaggaacgtttaggactggcaatgcagcagtgcgcttgctcgtcgcattcccgcccagcaagccgcctgtgcagtcctgcaagccaaccatctcccactcaccagcctgaacttgagcttgtgctccagnnnnnnnnnncggagtgcatcgggctggctggtggactgctgctgggaacctgtggcacacaccatttcacacacgatccaggaatgtctggaactggcaatgcagcagtacgcttgctcgtcacattcccgcccagcaagccgcctgtacagtcctgcaagccaaccatctcccacccaccagcctgaacttgagcttgtgctccaggtgagcctcccgagcctcctcagacatcaggctcacatcgagtcccgtgccctcccattcgttacgattctcgccattccctgcagcgccgacgtcgttgcgaagggggtgtgggagagggccgtgccggcagggttcatgcccaagggtgtcttgttagggagctcgcgcagtcgtgctcagggatggccccttttccaagcccagcgaagggcagaggcatgacaaaggcattgagtttatgggcgcgcacacgcaccgaagatcaacgtcccgcacctgggggcaggacatcagcctcctcgatccaacgctgggcctcggcgctcagggcggccttagactggaggctggtcctctgcacgaccttggcacgcacgtgggcggcaagccgcttccccacccgggatctgtggccctggtgatcattgtcgtgggtttttttggtgggtggaagggtggagcgccacggggaacacattgagggggcggtgnnnnnnnnnnggatcattgtcgagggttcttttggtgggtggaaggggagcacgccacggggaacacattgagggggcggtggatgatgcgaggaggggtcctgggtccatgcagcaggtactggctgcagtactgcagctggtgcttgaccacactcgaccatgatgcatgctcaggtccgctggtctcccatgcgccacccttcccccccgaggagcaccctcagcccaccttgattgccaggcacatgttcctggagaatccgacatactgcagcgtctcgctggcgtcatacagggcatagacgccgaggaggctggcatcgttgcggtgcacgaggtaggcatccacgggtatgagcacgtcgccgtcgtcctcgccctgtggacgtcaggacagccagtcagggggggggaaccagcacgtgatagggatgatcacatggcaatccacaagggccactccacaatgcaacatggggaacggcaccgagatcggcggctccaccatgcagtgacccctgtgagccggtgcccggtgtccgaaannnnnnnnnngatggggatgatcacatggcaatctacaagggccactccacaatgcaacatgggaaacggcatcgagatcggcggctccaccatgcagtgccccctgtgagccggtgcccggtgtccgaaaataaaccccatggccgtcctcaccgggatgagctggtatcctgccttgcgggaggagtgcacctccgcacccccctcaccatacagcgcgccatgcagggacttgtgaccctctggcacggtggcgtcagtcatgactgcgggcctgggacccgtggcgtggttggatcctggctggcgaggctccgacacagcacggggcaggtgtgggacccgcctcggtgccacgcagcagcgccaggtgccccaaggagcgggcttcaatgatgagctcattgccgacagcggcatgggttgcatgtgtgccgcgtcttcaaatcgggggatgccaagggcaagcctgtgggctgttacgtctgcgaaacccgaattccagactgaatgcagcggtccttctccgatcacggcgatgcccagtaacaatcgtgtcgagtaagtagtagttgcatggactgaaagcaatataaatccaaggcaagtaggtccggtggactgacatgcccagaactagattacagtccagatcctcgcgccagtttttgcccgtagaatctgcccctgggtacatgcgggggggggaggggggtggccctgcatgaagcaagcacctttccatgctcccgattatcatgcgaggttgacgatgtgagaccgcattcactcatgcatctcgccatgccttcctccctgagcgtcatgtgatcccccgccgtgcctgcgggcacccccctcgggcatcccgccacaccaccatcacacatgaagcgctgacgctgctggccttcgactcgcagtgggatgagaccgaggtaaggatcggagggaggggatgggtaattatacacactggtctcatggcatcccgcccggccagactgatctggagctgggacccctggacacttggggccgctcaccccatggctgatgggccggtacgtccgccaggccaaaagagcacccttcactcctatgctttgctaccgttaaaccctttcccccaccccctcctccttcctgcagaccacgccggtggccacccgtgacagcctgtggtccctgcagtacatgctgccgggccccatcaccgcctgcgccggctcctggaccccggccgggggccccggctccacgcccggcgcccccgccctgcgtggcgcacccttccagcacggcgtgatgagccgcttcgccgacccgcagcggcgcgcctcctacctctcccatccccgcttcgccaccgtgctggagggcggcggcggcgccccggggctcgccgccaccgcgcccactctctgtgcctggacgctgacctttgacacccgggtgcccagggacctggagaccctcttccgccgcggcgaggagtgggaggcgggggtcgagctggtcctgggctttgccctgcctcagggtgcgggcggcggccatggtgccgcggcagccgccaccgacctgctggccggcgtggccgacctggcggagtcctcggtgtatggcgcggtgcaaagcgtgcaaagcgtcgggccggtgcgccacagggcacatgggcccgagcaggtgcggtctggccctgcaggaggcggcgccggggagctggcgcccgcggccatcctgccagacgtagtcttcgtcacccgcttccccgaggaggagcagctggagggcttcctgtgctccgaggcgatgcaggcgctgatgggccggtcccccgacctgccgctgcgtgccctctgggcgggggtgctgcacgtcgggcagtcccagaccagcaggagcaaccggctggggggcgggctgcgctgaggtgtgcctcccgctgggttgggttgtgctttgaaggaggttcctgggtcctccctctggatgactgcagggtggcggtgtgccgctgccacccgcctgatctccgacatcaggcaacacaggatgtcatgaacagacacgtgcgagggtcagacgaggtacgcagtacaggggcgcagcaggcagcaccggccaagcaagnnnnnnnnnnaatctccgacatcaggcaacacaggattgtcatgaccagacacgtgcgggggtcagacgaggtacgcagtacaagggcgcagcaggcagcaccggccaagcaagctaagcagccacgtgcagccagccggccagcgtccagccgtacgcgactgcggccaccagcgctgcaaggttgagcaccgaggagaagccatgccacgcgccaaacgtcttgtacagagccttgatcctgtctgcgattggtttgagggtggggagtgggagtttggatgtgtgaaccgcgtcgccggagggaagtcttcagggcacctgcatgggctctgcggccacaggataacgactggacgcaggcataccatgcatggttccgattctctacacggtcgcacaaaagtaaggctcacacccctcgctgcctcctgtccctcaacaaccccccaccccccccacccaccattgtcacgggggccctctgcattctccagggcatatctctcaaacnnnnnnnnnnagccacaggataacgcctggacgcaggcattccatgcatggttccgattctctacacggtcccacaagagtaaggctcacacccctcgctgcctcctgtccctcaacaacaacccccccccacccacccacccacccaccattgtcacgggggccttctgcattctccagggcatatctctcaaacatgattccggtggtgtgtggctccaccaccagccagtttgccagccccgccgcgattcccacggccagctggatgaggggggtgcggggcaggggcgctcccccgctgagcacggacagcgtgcccagctggagcagcgtgcacagcgtggtgagggcaaagtagaaggggaagaggcgggcctgcaccttcccaaaggtctgtcgaggcaggttcttgaacatgacgatgcctgttgatgaggcacaagcacgtgtgtgtgtgtgtggggggggggcaattcattggctcatgtaacaatgtatgtgcatacatgcatagtctacgtcnnnnnnnnnngagcacgtgtgtatatgtgggtgggggggacattcattggctcgtgtaaccatgtatgtgcatacatgcatagtctacgtcggttctgtactctagaacacaggttgtagtcgctctggaaggcaggcccaaacatggggtccttgcgcaagattcataccagagtcgttccctcttcccagggctggcgatgcatcgaggcgaccggtataccagggccctcagtgcgtggccatcatgcccatccacttaaagcaccctgcccattccccgccttgcctgcgatgaaggtgacccacgtcagggtgccaagcgatacagcatacgtgctgaggtggaggaaggccaggccacgagggcccagcaccgacccagacttggcgcctgcaagcacggaggcggccagtgccacgactctgaagactggggtgttgaccatgctgggcttgagcaggtcgccctggaaagaaagggagaatggggtatgcgtgctggaccaggctgcagcgaccttcatgtgcaaaaggcacccctagagattcagtggcactgcagccccagacagcacggaagaattgaagcagggctgcctccacacggcatcttgccttcacgtcctcgttcctcactgcgccgctggaggccatggcctggactcgcagggttggagcacgtggccgttcggatggggcacgtagcctgcgaggtggagaaaaaggatgatcactgcccaggtggaaataaatctgccacgatgtcatgaagcagcacagaagattgctcgcctgcagctgaagcgcgaggttgtcgactggagggggagagggagagctgtgacaaggggtcgaacgccttctggggcgaggtaaagggcagggctacaagtcgagcacttcatgtagatattcaatgtgttggagtttttaaggattttgtgaagaaggagtgcacagtctggtcggatgtggacacatcgcgtgaatctgaggggcagaatcaaccaaggcgcagaatacgatgcgatccacagaaggaccatgggtgcacccagtcatctcacagtaccaaccacttacaacatgtgcacactttacatgatacacttgtatcgcactgctgcgatccatgccatgggtgggtgatgctctaatgtgacagacttggcggagactgctgtccggcacaaatgacgacgatgtacaagtgctcgacatcaaggccctcaatctcttgggatgatctggacgccgctctctaatgtaaacacacctctcacggcgcgagtttacacttcacatggatcccacaatttcacaaagtaacgggaagccgtggcgccactcaactgtaccaaccggaaccgacgcagcacagctgctnnnnnnnnnntcaatctctcgggatgatctggacgctgctctctaatgtatacacctctctcacggcgcgggtttacacttcacatggatcccacaattgcacaaagtaccgggaagccgtggctccactcaactgaaccaaccggaaccgacgcagcacagctgctacccccttcgccaacaagcggattcacgccctcccggactgcatgacccccgcacaccatagtaatgaggatttgaatgttcgtagatgagaaagctcgtcgcgtggaactgtcggactcccattctctgagcgtccgaaagcgactcgcatgacgcgtcaattagcgaggtggtgcgacaggaagtcaccattatgccgtcagatccctatgatctagaggaagggatccccaaaccagagcctgggaccgccggcggcttctacgatgctcagggtttctggcgcaccggctggtggaacggccagagctggcaggagggctactttggtggagaggtctgggtgaacgcggcatgggatggagaggtgtggcgtgacgggattcgtctctacatcgttgacgaatccctgcgagcggcctaccggcggaggttcatcatccgaattgatgatggcgcgctacagagtggtaagtgtcgggcgcgcgctgggggttgtctctcagggcggacgagccatggcacaccatccattcaatggccggcacgcactatccaccaagcctggcctcgtgagttccttgcaagatgtttccgcccgcataaatcgccatagacgaacatcacctgccatcgatcgaggcgggaaccgctggaggattctacgacgcgaatggcacctggtgcacaggctactgggacggccgtcgctggagggaagggtactgggacggggagcgatggatcgactcctggtggaatggcttcatgtggtacgatggacctcggcggcatcgggaggtgcaaagcgtggatgtggcatgaggagccaaactgggccccctggttcagcgcgaggattcatgcagacacaacgcctgctcatcgccacgactcttacggatatatttgatcttctacactgacgaaccacaaggcttgacgcccatctgcagggccgtgcatggccccaaaatgaactggccaacattctttgtaataaccgcgaaccgcaatctttgtggatcctggtcttccatgaggttccaagacctccggagtggtgatggggcggaaggactttctacnnnnnnnnnntgtagatgtggcatgaggagccaaactgtgccccctggttcagcgcggggaatcatgcaggcacaacgcctgctcatcgccacgactcttacggatatatttgatcttctacactgacgaaccacaaggcttgacgcccgtctgcagggccatgcatgacccccaaacgaactggccaacattctttgtaataaccgcaaaccgcaatctttgtgggattctggtcttccacgaggttccaagacctcccgagtggtgatggggcggaaggactttctactgtggcttgaatcacacccttgagttgggtctatgcagtgccaatcatcctgccacagataagcctaaccggcaacgaagggtaacgtgagcttcggctgcacaagcatcgtctctgcactccgatgatgttgagacgtaagcccacgagacaagcatgcgggcgttcgagtcgcaagattgagctgcaactgcctaccctgctggcagttggggcagcgagatggcgttttccgagatgtggcggcgcgctacagcagcgttgatgaggtgtcgagttacttgttcaacccgaacactgttcgctcctccaggctcacnnnnnnnnnntcatcgtctctgcactccgatgatgttgaggcgtaaacccacgagacaaacatgcgggcgttcgagtcgcaagattgagctgcaactgccgaccctgctgtcagttggggcagcgagatggcgttttccgaaaggtggcggcgcgcgacagcagcgttgatgaggtgtcgaggtacttgttcaccccgaacactgttcgctcctccaggctcaccaaaatttggtaattaggctgcaagctgaatctcgagagtgtatgttggtgtctcatcctgcccattcacaccttcacccagatgccggagccttcccaggggaccgcacagtgctcctcgtcggagacacgtcgcgaggtccatgaggtcagcgacgcgcactacatctcatgttggcactgttgacatgccttggctttgcatgcggccatgggcccgtcactgcggccccgtttaaccttggcgcagctggggttttgcctcgtggcctgtgagtgcgggctggaagacgggcaccgcatggtgggctgcgggttgcaaaatggcattccagtgtcttcttattccccttcataacccacaggctcagcagcaggtcggggagtcctcgaggatatggatgccagtccatcacccccgacgacnnnnnnnnnnccttattcccctttataacccacaggctcagcggcaggtcggggagtcctcgagggtatggatgccagtccatcacccccgacgaccatcgtggacgccgtctccgaaacaaagcaggttacgcccatcccctctgtggccttggtagacctgacctccccatccctcatcccggagccgagcttccggggcgctccggacaccagcatcaccccttcgccggcgggtgcgtgggtgggcgctgtgtgaaggctaccccaaaaccgtgtggtagggattctgctgccacagaccattgggagagcattcactggtgcttactcagaaccccacgcaaatcttcaactaccagctcatcatcacacacatgcaggaggagaaccaccgactctgccaagcagtcggccaacagcaggagactccgccccagccctggctgctgacccgctgcaatcccaagctgccatgggcttgcccaccgagacaccacccatcagcccggccgagggtctcaacccttgctcgccctatggctgcaacacctgccgttatgggagggaccccagcacctccaggtgctaccccaccgactgcgactacggccgcgacgcatacggcagctgcttccccactgactgcgaccatggtcgccagccggggggcacctgctaccccaccggctgccagcatggcaggtgcccaaacggtacctgctgcgccacggcgtgccgctgggaccgccagccctcgggggcctgctatacctctccttgcgcctggggtcgggacgcgagcggcgattgcttcgcccagtactgcgagtttggtcacgacaagcggggcgcctgctacacagaggcatgccagtaccctagggggcccggcggcgagtgctacccatacccctgcaagtatggctatgatgcgaatggcgattgccatgcttcacagtgccctgcatgggacgccaccggcctccagtgctgcagcctcggcacagacgagaggggtcggtgtgtctcggcctgacgacgcctcgtatctgtggaccctgaacgcaacccggggtggtgtggcagctttttgggaacatcagccacatcatgccctgggagatgccccttcagggccccctgcctctcctgcatgaatcggtgcatggaaacacgccggcctgactgcagacccctgacctccatgcgaccctaactctgaatgaaatgtgtatggtcgttgtacctttgaaacgcgtcgcactgcacgtgcattttcctcgtgctgccaaggaggaacagcaggtgacacgtggcgctgccatcgccgtgctgtccttccaaaggcagttgcgagtcgttcacccagtcgcttccgcgccgaattattcttcatgagccatgcatcgtgccacggctcttcgacgtgctcgaatcacgatgcgtcagttggtgagtcggccggcgtacactcgaaagatgcgatactggggcgatggtacggaggcaggatgttgtcataaggagtgtgctgtcccggctggtacgcacgctgcgaatcagccgtttgagagcttggagccgtgtatgggttgccccggaaggcagttttaggttcaagcgtagtctcgagcatgttagcgtctgccagtaagnnnnnnnnnnatgtatgggttgacccggagggcagttttaggttcaagcgtggtctcgagcatgttagcgtctgccagtaagcttgagcaccggatcactgcgactgccgtggcgggcagctggtcgagtgggactggcgctcgacttccattaccttcaccgacacagaatctcgcgtggagttgcgcgcaaacgactcaaaacgcacaatgaagtggtgatatctaactatcctggcttaaatgtctatctgggatggtaatgcgctgcgcgcattgccgaaggacgcggcggcgtatacttcgccgacccaagttctcgggccgaccgaccgcatcctgcgggagtcatggggcggatggacttcgaccgcttttctacatcctctcaatgcgcttgacatctggaggttcatgctaggatcttaactccacctttatgcatgagacgcaccctatcgccggtctggagtgcatcactgctgctgtcccagtcctatcccaggatgaagtctgctgagccagtcctcgagctacaagagtggtgaaaagctttacacgatgctgcatgcagtcaacatgctccagatttgctgagtctggcgtcaggatggcttctcgcctacatgccaggaaggtgtcgatggggtgacgtgtcatctgggccacggtactaacagggagtctgccgcctctgcgtccgtgtctccctccaaattagtggcctcagccgtaaggagtatccctgagatgcgcattgtcaggttatctcgatgctgggaccccacagactgcccaagatctttggatatacctactgccaggtgcagattcacattcctgcaggttcaggaaatctaaaggaccagcattataaatggcacgtttccgatgcgatgagtgtcatatttcagaggaactcattgcatccattcgagctcaaggcaggcgtcatgaaacagcccctccagtacatattggtgtttgcggtccttacagctgtgatccttccatcgagatgtgagtttcggttgcgcatagcgtgcgtcgcttataaaccctatgcgcgttgcatgcaatcaatgcggactacatgcgcataactttctcgctcagagtcctcatattcggctcgttttccccaggtgagtctgctggtcgcgaactcctgcaaggcacggagacgagtgccgacacagctgacatcaagacagctacgcccgatctcacaagagacgccctccgccccaccattgggacttctacgtcgggaaaatctggtggtacgtcgtcttaggagcccaaatgctaactgaggttttcaatcgcaaatcttcctgtgatattccctcactccatctccccatgtggcactctaccaggcatagccaccttgctgccatcggttgtcgtccccaaggacactggtgatgcatccctgaagctccctgggaaggattcgggcctgccctcggacaaagacaagcccaagcctcactgcgagcacggcaaggacagggacggc

SEQ ID NO: 37792 - DNA, 67 bp, Chlorella protothecoides
gagatgggagcgctgaagggcaagctcaggggggggtggcaagggtaacagtcagctccgcaccacg

SEQ ID NO: 37793 - DNA, 61 bp, Chlorella protothecoides
aggattctctggatccgagatagtgaaagacctcaaagctctggatggccctgatgggtcg

SEQ ID NO: 37794 - DNA, 72 bp, Chlorella protothecoides
gcgttgctcagaatcgtctgggggtgggcggaagggctcgcggacagcgtcggcgggcgtgctagaggttca

SEQ ID NO: 37795 - DNA, 93 bp, Chlorella protothecoides
tcgagccttcaccggccaggccaaccggctagggggcgagaccgcccccgcccccgcccccgtcgctgcgcccgcgcccagccagcccgcgcc

SEQ ID NO: 37796 - DNA, 561 bp, Chlorella protothecoides
  modified_base (292)..(339): a, c, t, g, unknown or other
caccccccctccccctcccccttcccaggcacatcacggcggcggacttcgacgtcgggggcccgctccacgcggtgcaggtgcagctgctgctctgggcctcctaccgcggccagctgctggcgcgcacggtgcgcggcatgatggcctacgagcgcgggctggcgctggtggcgcggctggagagcccgcgcccgccgcgcctgagcgaggtggcgtacgaggcgcggctcaaggacctggtctcctccaagttcacctacgtggtggccagccagcgctacggcgacannnnnnnnnnnnnnnnnnnnnnnnnnnnnnnnnnnnnnnnnnnnnnnncgccgcgcctcggcggcgcgcgggcgctggctggcgcgcggcctggacacgctgatgcaccagtacccgggcctgcgcgtggccaccatcgacagcgccgtggcggagggcggggcgcgccagtgcgcggtgctggtgcgcgccaacgtgggcaccgtggtcaccgacccgcgcagcgtgcacgagctgtacaggtgggtgggtgcctgggtgggcgggtgg

SEQ ID NO: 37797 - DNA, 80 bp, Chlorella protothecoides
agggttaggtttaggtttaggtttaggttttggttttggtttggggttgggtttgggtttgggttagggttagggttagg

SEQ ID NO: 37798 - DNA, 61 bp, Chlorella protothecoides
tgtggcagagtgcatcccctccgaccccttccccggccgggcagccaccccggtcaggtca

SEQ ID NO: 37799 - DNA, 76 bp, Chlorella protothecoides
tggcaagcctaatccacggcgcagtgccaacttcccacccacttcctggaccccagcgttccaccagctcgctgcc

SEQ ID NO: 37800 - DNA, 4963 bp, Chlorella protothecoides
  modified_base (1346)..(1445): a, c, t, g, unknown or other
  modified_base (1561)..(1570): a, c, t, g, unknown or other
  modified_base (1680)..(1689): a, c, t, g, unknown or other
  modified_base (1800)..(1884): a, c, t, g, unknown or other
  modified_base (2615)..(2624): a, c, t, g, unknown or other
  modified_base (3056)..(3206): a, c, t, g, unknown or other
  modified_base (3273)..(3282): a, c, t, g, unknown or other
  modified_base (4478)..(4487): a, c, t, g, unknown or other
ggtccggggccggcctcggccatggcgcgctccagcgcggcggttcccgcctccacgcgccagtccagcaccgcagcgacctcctcgtccgtccagcgcggcgcgtcggcggagagggtcggcgccgccggctcggcgcgcacggcgcccctgggccccagcagcgcgcgggccacctgctgcatgagcacggtgttgtcgccctcgaaggtggcgtccacgttcatgtcgttcagcagcgggccgatgcggttggcggcggcgaagccctgcccgccgcagcactcgcggcagtcctgcaggcaccggatgcgggcccaggaggcggcggccttcagccccgaggacgcgacgtggatggccttggcgcgggccggggtggggggcgccgccagcagcgccttcacgcggtccagcgcaaagtgcagcgcgtaggtggccgccagcgcggggtagagccggcgctggtgggtgaggtagtcgccgatcagcgtgtcgccgaactgggggcgcgcgtgcgcgtagttgatggccacggtgaggccaatggcgctggcggtgaccgccgcgccggcgatgagcaggcggcccatggtcaggcctcccacggtggcgccgaagcgcgcgccgcggtcgggcagcgcgctggagtacagaccctcgggcgacaccgtcgccaggcggctgagcatggcctcgcgcgggacgcgcacgtcgtccagccagatctggccgttgtccacgccgttgaggcccatcttggcgccgcagtcggcggtgcggaccccggggtgggggcgccccgcctcgtcgcgcagcggcacgaggaaaacgtgcacgccctcctccctccccgccacctccagctgcgcaaacacggcgcagatgtgggcggtgcccgccgcgccgccgatccagtacttgctggcgtcgtcgtcgggggtggtgagcacgaactcgcgagtggcggcgtcgtagctcgcccgcgtgcggatgctggccacgtcggagccgtggcccagctcggtcatgccaaagcagccgcgcaggcggccgacgtccatggcggggacgtgggcggccacctgcgcggcgctgcccagcttggcgatggtgccgccgcagagggtgtagtgcacgcccgacaggatggccaggctgtagtccgcccaggccaggcactccagcgtcgccaggaagcggcgcgggttgtcgacgtagtcggtgatggtgaagaagtgggcggcggcgaagcgggcaaagcgctcccgcgtcagcgcccggaagtcggcgatggacaggtagtgctccggctggtagatggggtcctgcgagtttgtttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggggaatcagagtcggcggtgacgagcatgcgccagtggacccaaaggacactctcccccctgccctcctcccaacccccccgctatactacccacaagcagaatcacgtacnnnnnnnnnnagggggggtggctgggagtctcaacgacaggagctcgctgctggctggcatgcgcaacgagggtgctcatgctgaggcattgcaatcatggcatgttcattatatatttnnnnnnnnnngggggggggtggctgggggtctcaacaacaggagctcgctgcaggctggcatgcgcaacgagggtgctcgtgctgaggcgttgcaatcatggcatgttcattatatatttnnnnnnnnnnnnnnnnnnnnnnnnnnnnnnnnnnnnnnnnnnnnnnnnnnnnnnnnnnnnnnnnnnnnnnnnnnnnnnnnnnnnntcccccctgccctcctcccaacccactgctatactacccacaagcagaatcacgtaccttgaggaagtcaaagatcttctgtctcagctccatgttgtcgcgggtgatgaacttgtagaggacagccgcgacctcagggtccgctgaggaggcccggcacagggccccgctgaccacaggcgtccttccctccccatcgccctcctatacacataacgtgaatgtaagggcaggcgtgaccgacacatacatgcaaattatgattaaaatagcaaatggttctggtacccccaaggtcctggacgtcacaccgccaggatgcttgccgaggtccacaaccgaaacgcaccaggtgtcgagtgagggcagcgacacggcgctgggcagccatgattgtatgatataagatttgggacaaactttatccagtatgaacgcttgggaaggtgaagctcctacacagtcctgtttgcgagttccgtttcgggtttataagtttgctagggatacgagacgtgcgcgctgacgtcagcagtgccaggcagtggctggacaccgccatggcagttgagtcacactgacatgcagggcgaccttttgaggtctgaccactttgtgcagtgttgcttgctcattacttgagcagacttctgggtgcattaggtgaatgagcaactatgtcatgtacagcacccttgcggacaccatcggcggaagctcagggtccagannnnnnnnnnttggcagctgtgtcacactgacgtgcagggcgaacctttgaggtctgaccacttattgcagtgttgcttgctcattaattgagcagacttctgggtgcattaggtgaatgagcaactgtgtcatgtacagcaccctggcagacaccatcggcggaagctcagggtccagatgccagcgttcagcgcatacttgattatgtgagaggccaaagccttatacacaccatcaaattgttatggcttgagggcgtctcagcctccctccatattgttgggagtgctggtattaccaattgttccgtatcaaacagacacagcatcatgtacatctcacatcttgccaggataagggccaatcactttgaatcctttgatgacaatgtctgcgtgccgtaagcatcgagggccgagcgtgatggtcttgggtgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaatgacaaagtgcgcacagacccgcgagcccatgcatctttatctcggctcatccctgctaccnnnnnnnnnnaaattgtcccgtatcaaacagacacagcatcatgcacatctcacatcttgccagggtaagggccaaccactttgaatcctttgatgacaatgtctgcctgccgcaagcattgagggccgagcgtgatggtcttgggtgtctcggtgacctggcatccatgagggtaggaggcgcctggaatctctcgagtccacccgcgcgctactccggcataattcatgagtccgcctggaaatgacaaagtgtgcacatacccgcgagcccacgcatctttatctcggctcatccctgctacccacactcctcagcccttccaacggctccgtagactgagagatccttcgtgagagggtcttcgacccgctttccccaggttgtgaccatggcgttcctgcagcggctcatgaactactggctgaatgaggtcctggtcaacactctggccaacaggtgacactggaggggtagcgctatcactttacgccacagcgtcttacaagcttgtgtaaagactgtgccccgacaccccgcaccctacgccctccccttgcagccggacgttccagaagttcgctgtgcggtccagcgcctccgtggaggagctggtgaagaagactgcggaacacaaggagcggatagcgggccagggtggcgatttcatgaaggttttccgggaagaggtgcggttccggggcaggctggcgagcaggcgatggatggcatgtacaatcccgcgggtctgtcggcgtggtgcaacccaccgcgtgaccccgtgcacatctgcttccctcacagatgaccaagggcctaagcgatctccagaagaagggcgggaagttgtagtcgacctgagagacagcttgaaacctgtccagagccgacggggacatccccagactgcgctcacacgagaccacgccacgaggtcccccctccccctccctcctaccaaccccagccctcgcagggatgtgtaccagtccgcgctccctcgtcccccgagcagcccccggggggtccagggtgccggggcccgcaggatgtaatgctccctgtgtacactgcattccctttgctcttgtcgtgagacgtgcctgctacacagggcttcagcgctgcacagggtcacgcaagcgagcagcaggaacagggggggagcaggggcacccaggccaggcaccgaggattcgtgtggnnnnnnnnnngcacgtcccccgagcagcccccgggggtccagggtgccggggcccgcaggatataatgctccctgtgtccactgcattccctttgctcttgtcgtgaaacgtgcctgctacacagggcttcagcgctgcacagggtctcacgagggagcagcaggaacaaggtgggagcaggggtacccaggccaggcaccgaggattcgtgtggcaagccgccggggacggcccgttgcgcctttcttccgcgcctcgcccggcgccccctagcacgaggggaaggggcgcaggggcgcgagcacccagggcgccgggaggagggccagtccgccccgcgcctcgcgccagccccccgcgccgccgtcccccgccacccaatcgtccacgacgagcgacgcgcccgtgccggcaaacagccccgcgcagggccagcgctggtcgccccggagcccacgaggggcgggcggcggggcatcgggcgt

SEQ ID NO: 37801 - DNA, 75 bp, Chlorella protothecoides
gccatccctcacggatgctctccaaacctatactgccaccaatcttatccctcaaccccctctttggctgctgtc

SEQ ID NO: 37802 - DNA, 61 bp, Chlorella protothecoides
gaaacccagcctgggagggccatcctcctgcggctctagcgtccacacccattccttgacc

SEQ ID NO: 37803 - DNA, 195 bp, Chlorella protothecoides
tgtggagtgtcctttttttgggggggggggtgcgggggaggaagtggaaaacggcgggagacacggggcgggagccgctgctgctgctagtggcaccacctgcactcgcggccgcccttcgccgtccctgacaagcaccggattggctacgttcaaactctccctcaacacctcctggttaccaacacctccctc

SEQ ID NO: 37804 - DNA, 99 bp, Chlorella protothecoides
cctcccacgccctgctctagctgtttcttcgtcaaccacttgccctcttgcaatcgcattccacgcacgtgcactcgctctacgcgccctttcttttgc

SEQ ID NO: 37805 - DNA, 116 bp, Chlorella protothecoides
gcagctcgtaaaacatcacgaggccgttcattatataacacccctccaaacccacacacagcacctgtgccaggtcttcgcccagggcagcggcgagggccggggtcaggccctcc

SEQ ID NO: 37806 - DNA, 14045 bp, Chlorella protothecoides
  modified_base (134)..(143): a, c, t, g, unknown or other
  modified_base (569)..(578): a, c, t, g, unknown or other
  modified_base (1497)..(1506): a, c, t, g, unknown or other
  modified_base (1993)..(2002): a, c, t, g, unknown or other
  modified_base (2273)..(2282): a, c, t, g, unknown or other
  modified_base (2598)..(2607): a, c, t, g, unknown or other
  modified_base (3426)..(3435): a, c, t, g, unknown or other
  modified_base (3530)..(3539): a, c, t, g, unknown or other
  modified_base (3630)..(3639): a, c, t, g, unknown or other
  modified_base (6311)..(6320): a, c, t, g, unknown or other
  modified_base (6462)..(6471): a, c, t, g, unknown or other
  modified_base (7016)..(7025): a, c, t, g, unknown or other
  modified_base (8039)..(8048): a, c, t, g, unknown or other
  modified_base (8348)..(8357): a, c, t, g, unknown or other
  modified_base (9338)..(9389): a, c, t, g, unknown or other
  modified_base (9677)..(9686): a, c, t, g, unknown or other
  modified_base (9781)..(9790): a, c, t, g, unknown or other
  modified_base (9877)..(9886): a, c, t, g, unknown or other
  modified_base (10141)..(10150): a, c, t, g, unknown or other
  modified_base (12079)..(12088): a, c, t, g, unknown or other
  modified_base (12599)..(12608): a, c, t, g, unknown or other
  modified_base (13141)..(13150): a, c, t, g, unknown or other
cgcgggggcggcgggggccggcgcggcggatggcggctgggggcgtgttgcgggggcctggacgttggcgcccctcaattctgccttgctggccctggtcttttgggtgcccggacccctggtctgcagcccgnnnnnnnnnncggtggctgggggcgtgttgcgggggcctggacgctggcgcccctcaattgtgccttgctggccctggtcttctgggtgcccggacccctggtctgcagcccggagtctctggccgaggcgcttggacccttggtttgaaggccagagtcgccagccctggcgcccgagtccccagccctggcgcccgagtccctggccccggcgccattgccggccttgcgagcgctgtgctcacgtttccgtgcctccagctgcgagtgggagtaaaggaagtgggttggattcgtggcgggagtcagggcagtcattcaagcactcttggggtgcttggggggaggtcaccaatacttatgagcgcagatatgagggagcacccccgagtgtctcactgccatcgatccatggccccatggacatgcctgccnnnnnnnnnncggtgggaggtcaccaatacttatgagtgcagatgtgagagagcacccccgagtgtctcactgtcctcgatccatggccccatggacatgcctgcccgctctgagatcccgcagcaccctctccaccaaccttggccagcagctcctcatgctccttccacaagtcgctgctgccggacgactgcttgccaggctggctggacgatcgcacacgtacacagggcccaggccgggagccaaatgcccggccatagggagacgctgcatgggagcaggtatggaaggaggcatggcaatccaacaaaagcccccaagaggcatggtgctgactcaggtgttgatgcctacacttgtgccgatgaataccagcacattcgggggcgcacgaaccaaagccttcaaacatggtacattcactgtgacctcgcaacccatcgcccatgaggccctcaccatgaagtcggtgcatgtcccgtcctcccgccagtgccgtcgcagccggccctcggtgggagtcgctggagaccgcaccccgcacttgcagacctagcatagacatttgaggatggtggggtatctatgtcgatgtcgggtgccgccagcgtcggtcgttacgacactagcacaggtgtgtgtcgagcctttcggactccctcccgctgagaggcggtgatgtcaccagcagggatctcgggtctacggatgcccccctacgtattcagaatgctgcaatggcccaatgcacctcggccttacgatccaagatcgggagtgattggggttggcaggtgagaccccacctcagcatgcaccgcatgaactccgggcctcgcacagggtgccaccttgctgcggaagggcttgtgattgggaatctaacagcttaaactgcctgcacatgttcggagtgtcgtacgcnnnnnnnnnncgtgctagggcttgtgattgggaatctaatagcttgagctgcctgcacatgttcggagtgtcgtacgcagactaggaaccgttattaagctgtcaacccgatcaattctggattagtcagcttcagagatctcattgactgttagggtcaataatccttttggagaggaatatgcaacattggccattgggcaagtgaggtcttcggtgatggctgcgcaggtacacaagcattggtagggcaccgatcgtgcaccctgcaggcagtcctgtgtgggggccagatcttagacgtgtgttgatgcattgccatcacgtttttaatgtaatgctttcttcgttcactttaaatcacgtcaccttgggaatcggccttgacgtattcagtaataggtccttataataattgaaccttgtgttggtatgcttggcgagagtgcattattggccagcgcttagaaggctgccatagaggccatctgatccannnnnnnnnnatttccaatctaatgctttcttcgttcacataaaatcacgtcaccttgggaatcggccttgacgtattaagtaataggtccttggaataattgtactttgtcttggcatgcttggcgagagtgcgttactggccagcgctcagaaggctgccatagaggccatctgatccactgtgcaggcatagcctgatgcgttcggaggcaccctaccacgagagcagtcacgaaaccatccctcctaatgtatggcaagctgggaagcttcgtactnnnnnnnnnntttaccacgagagcagtcacgaaaccatctctcccaatgtatggcaagctgggaagcttcgtactggcttgcaggtatcgcagcgttgacaaggatcatgagtgcccattcacagtgtgtcttgtatccatcaccagggaggatctcaacggaagttggaatcccagagcagcaaaacatggagaacgttttaaaaatccatgcatttgagactcagtagtccgtcagtacgacctgcatgcttggacctggacggatattgagatatgcagcgcgcccgggttaacattgcaacaggactcccgatcgatgtggnnnnnnnnnngcatggagaccgttttgaaaatccatgcatttgagacttagtagtccgtcaggacgacctgcatgcttggacctgaatggatattgagatatgcagcgcgcccaggttgacattgcaacaggactcccgatcgatgtggcaccctgaatcctgggatcggacgccccatcatcggaattgtttccttccgtcgctctgacgagcagctgtcgctgcggctcgtgaagtgttcacccgccgggtatccttgtactcgccatttgtgttcgggcttgggacgatgcccgccgtccagcctacagcaagctcggcacgggcgggtaatccatgcataatccgatcgtaccctgcagcatgcgtgcaggcagcctctcgtggcctcggaagacgtcaccccccgcagccggatgccaggccccagcgactaggtggcagttttccaagcaggcccaggcacaccgcccgcggccccacccccaccccgtccgccagcctctctcccgacgcacccctcgcgccatccagcgatcctggctttggggcgcgcctggcatccctggccatcgcgctgaccaatgccttccccgtctttgtcgtgggcgcagccgttctgggcttgatgcgccccgcgtcctttgactggttcagggccgagtatgtcacggcggggctggcggccaccatgctgggcatgggcctgacgctgacctttgaggtgcggcacgaggagtgtcggtgtgtggggagggacattaatgtatgaaagaggatggaatggcaatgacatgggccatcatgttgctgctctggctgtcgtgnnnnnnnnnnaagtaatgtcggtgtgtggggagggacattactgtatgagaaaggatggaatggcaatgaccctggccatcatgttgctgctctggctgtcgtgnnnnnnnnnncaggcagccgcggaagcacagaattctggggcccccctacatcacctccttcccccgtgctctcccaacctggcgcaggagctgcgccagnnnnnnnnnnccccctcatgggtcatgctggagtgctctgtattccgtgtctttggccatcctaggcagccccggaagcacagaattctggggcccccttacatcacctcctccccccgtaatctcccaacctggcgcaggagctgcgccaggtgctgtcccgcccgcgccagattgcggtggggttcgtactgcaatacaccatcatgcccggcagcgcgtacctcatctcccgcctcgtctccctccccctggaccacgtcatcggcctgtgcctggtgggctcctgccccggcggcaccgcctcgaacgtggtcaccttcctggcgggcgccgacgtcacgctcagcgtggccatgaccgccgccagcacccttggggcagtggtcatgacccccaccatgaccgggctcacgctgggcacgttggtgcccgtggacggccctgccctcctcctctccaccctccaggtggtgttgggcccggtcctcctgggcacggccctcaattcctgctttccacgcgccgtggcggccgtggccccggcctgcgcgctgtccgccgtcgctgtcatcgccctcatctgcgggcgggtgattgccgccaacgccgccgctgtcctcgccgcggggccccggctgctcctcgccgtcgccgccctgcacggctgtgagcctgggaggagggcagttcttgtaacttgcgtggcagagattcagggagcgctggcttggccaggctgaggtagatccctgcgctccggcctcatgccgcaagcctgcgcgcctgagagcctctgctgccgttgccatccccacagctagaaaggcctctctgccttcttcacatctcagcctcactcctccacccacccaaactgcagtgggattcgcgcttggatactccctgagccggctggtggggttgccggagcgcgccgcgcgcactaacagcatcgaggttggcatgcagaacagcgcgctgggggccgtgctggccgctgcgcacttttccgcgcacccgctcgcagcggtgccctgcgccatctccgcctgcatgcacagcgtcatgggcagcctgctggccgcgtactggaggggcagggacgcctgagggctgagtgccttgcaacgtgctctggtaaagcagtccatttcaatttgacagacatgtagtttccagactgagagtcgggagctactgctgtgactgatcccaacctgtcgcgagctgcggcggagcccctcaatcgctaaattttggcgggaagcgaatccggtgcgcgaattgaagttcccgacagccctcagaagtaaggacctggccggaccttggaggctgtggacgtgttgcagttccaaactcagctcgagccaccctcttgcagcggctggcgaccgatcgcgcgatgggtgtgctccagcccagcaacgctttgccatccctcaaggactcgtacgcgaccgtcaaggatgaccaagcgtacaagcgcaagacgctgcaggtcagggttataagagagcgtatggggtactttgaagatgcacttgaagtcataaaccgtgcggtccgagcccgattagacgccgtcggggcctgaggtcctgagttcggtgctgtctccctcccccgcccaactcgcagcaacgggtggttgcggcccttccaaagcgcgccaagcttggcgttcagaccagtcgccccagcttcaactccgctgccatcgatgacctcctagaaacacggactgcccatgcctcgactgtcgcagctgacttgccacggtgaggggagggttggtgagccaggaacaggcctccttgcccctcacaggccagtcactaagccctcctcatgccccacacgcctgcaggggacccactgacttttctggactcatcccctcgcgctgcggggaggatgcagctcaacctgggtgtgtgctgtctggctcagggcgcaggggatcattgcaaagtgcccttgccaggcgtatgccagatgttaccagcacgttgcatgctcaagacaaacattactctcccacctccctgcagacccgagagctgcctcaggacattcgagcacgtcaccacccagcgccatgcctccgccccggccctggtgcggaaggctcccgcatccaaaatcctgagcagagggatgaagaaccggcatgtaggccctctgcttgaccccacaccctccaacctcattgccccgccccgccacagggccttccctctgccggcaactggctcccgcccgcgctgcccttgccaggggcgagcggccccaccgctggcgacgccacgcgaagcggggtcgcacagggactcgaccccagcaagctcccgccctcgacgtgtgcgcccatggactggagcatgaagaccaacctccgcctggtatcgccccgccctttcctcctggcccaggaagcgctccgagccagtgccagggacggtgagcggcgagtagtcgggggtgcaggggagggggccccgtgtgtgatgaggaggaggcgcgacggcactgccaggtcgctgatgtgtccctcccggggcgaagacagccggctgctgaatgtgggagggagcatcgcgcggcattccctccccctgcgggccgatgatcggtccctcacctcactcgccccccccccccccacacacacacacnnnnnnnnnnggcgacggcactgccaggtcgctgatgtgttcctcccagggcgacgacagtcggctgctgaatgtgggagggagcatcgcacggcattccctccccctgcgggccaatgatcggcacctcacctcactctcctccccccccnnnnnnnnnngtgttggaggcgcagcgctgcgtgctggcgcggtcagaccccgccctgctggcgccacatcagcagtacctcgcagccctgacctccttccagtaccccttggacccgcggggcgcagccaggggcgggcacccggacaccgcggcgcggcgcggcgcctggcaggccgcgctgtgctcgctgtacgacgccctgcgtgccggcgcctgcgacgccttctacgtggtccccgccgagggcggcaagcgccccgccctcgccttcttcggcgcggcgggggtgggcggccgccggcagccgcacggactgctcacgcgctccaccccgggcctgcgctccatgctttccaacgggctgggcttggcctacgacgcgcccctcctgccccagacgggtgcggcgccccaggaccaggcgagtacattctgtgcgagggtccatgctgggagaggggctggtgcctgctggcagtggacgtcgccaccccacagtcatcccccccataccctcatccccgtgcagtccgcgattccggcagccgggannnnnnnnnnacagtggacgtcgctaccccgcagtcatacccctcatcccctcatcaccgtgcagtccgcgattccggcagccgggacgtgctccctgctctccttccaggacgaggagggcgtgcacggcctgtttgacttcctgctgaacgaggcgttcagggccgccggggacgaggcggacgtgcccctgctcctcgcccccgtccctttcctccacggcgccatggtggcggcgcggcccaaggtgcgaggtcgagggcgcctgagtgtctgagcaatggcgctggggctctgtagccagcagagtgcttgccaacaggctccattgccactgcagcgctgctccaacgagggccagtgcgatcccctgccctggccttgcaggcctttcgacttctgggtgtgacatcagcatgaatcaacctcccttccccgaccacacaccccacagctgctgagcagcgtggaggtacggggcggctccgcggcctcctctcagcagttccgcatggagctgcggggcctgacccccgcctggacggtggaccgggtggtgcagcttctgggcagccgccagcccctgtccatggcctgcgacacccacccactgaccctggccctgaactggccggggccagccgacgccgcgcgggcgcgggaaagcaaggcttcaagggacgtgggcgcggcgctcgtgcgcggggcctgcagcgccgaggagggcgagcggtgggcgtgccgcggggccgggcagccgagcatgggctgcaatgtgctgcggggcatggaggccgacggcaggggcaccttcacgggcctgctgtcctccaagtccgcggagcacatgctttgacaggctggctgttctgcggactgtgtgccccaccgttgaccgtgttgcaagggtaccgccaccaggagaagggaaagcagagggggggaaggatgcatgacctctccacgtcacaagggcgcatgcattcatgggccgggaagcaggaggggtgtgaagggaggcannnnnnnnnnggaagggaaaggagggggggggaaaggatgcatgacctctccacgtcacgagggcgcatgcattcatgggtcgggaagcaggaggggtgtgaagggaggcaaggacacgtccaaggggccattcgagatgcaggctccagcgcaggcttcatgctcgcggatctgctcctcctgtgcgtccctcctcagggggccgtgtgagacatcccctaggctagcccccacacacgggatcccccccagccccacagtctccccctccacccgcgagcgccgccctccatcacagcaggtggtgcnnnnnnnnnntccccgtgcgtccctcctcgctgcgcacaggggaccatgtgagacatccccaaggccagcccccacacacgggatcccccccccccggctccacactctccccctccacccgcaagcgccgccctccatcacagcaggtggtgcatgccccggatcatcatctcccgcagctgccagcgcgggggctggtaggtgccgtcggtgcccatgtagccctctgcctcctgctgcagcgcccagaagtagtagacgcggtgcacatcgtccggcgcgccgtccacgacgttgccatggctgtcgcgcgcgcagttgatctgctggcaggtgaactggaccactacgcagggcgcctcctccgacagcttcaggtccaccagctccacgtcggaggtgtccagcagcgtggggtccggcacctgccccgactgcgcggtggcggccatgatccccgtcagccgctccaccatctcgggcgagcagtgctcgcggatgacgtccgcctcgccgcgcaggtaggcgccgatgatgacggggacgtcagccctgacgcgcgcgaggaagcggaccatgtcgaagtcggggtcgcgggcgcggatctcgcgcagcgccgccgcgccctccgactcctgcgaccacgagtccgcggcgtcctgcaggcggtgcaccaggggggagtcggaggtctcccaccgctcgcgcagcgagcccgccacgtcgcgcccgcgtgtcagcacctgctggtccaggtgggaggacaggcgggagaagagggggtgcgagcccagctggaaagggggaaagggggaaaggggggaagagtagagtggtttggggagatgcatgccgtggtgggacgaccaatttgaaggttgaactgccaagccagcaacaagttgcaacactgtacgtggtccggccacgtcacacaacgagcaaagccctcccagtcatgcaaagtacatggcacgctccccagccctnnnnnnnnnnnnnnnnnnnnnnnnnnnnnnnnnnnnnnnnnnnnnnnnnnnntctgccacgccggctcggccacggagtggtgggccagggcggtcgtctctgctgtcttcaggctgccgcccttgggcgcgccgcgcatggccgaggtggagggggtctcggccgacacggccgccaccatctccttgatcaccacggtcgcagtggatcgcacgcggtcaaggaggcccggcttggttggagcttcccggtcgggctggggcttttcgtcggagccgccgggggcagcagccgcggccgcctcctgcgccgacccctgctgctcctgctgctgctgcnnnnnnnnnnccacccccccgactctcccaaggaagctcccaatcccgctgcgctgtcaagaccacacaaccccctaccttgttctggagctcgcgccactgctnnnnnnnnnntgggccgggacttttcgtcggagccgccgggaccagcagccgaagccgcctcctgtgccgacccctgctgctcctgctgctgctgcnnnnnnnnnntatgtctcagcggctctggagcagaagggggaggagggcaatcccatgccagagccggctggtcaggagagccctggggatcttcacaccaagccctcccccctctggcccactccgccagcacctgttcagcggcctgccgggcagctgccgccgcttcatcggcctgctttggggcgccggagaacgatcgtcgcatctgcagcgcctgcacccgtgagtgtcgtgaaagcgtgaaaggctcgagaaggtgcnnnnnnnnnnctccgaggatcttcgcccaaacagctccttcacggtgtcctgcgccagccgctgtgcggcggcagccttctcagcgatcgcagcctttgcctgtgcgtacagggtgtgaatgtctcagcggcactggagcagaagggggaggagggcacacccatgccagagccggctgggcaggagagccctggggatctccacaccaagcccttcccccctctagcccactccgccagcacctgttcagcggcctgccgggcagctgccgccgcttcatcggcctgctttggggcgccggagaatgaccgtcgcatctgcagcgcctgcacccgtgaaagcgtgaaaggctcgagaaggtgcggcaaggatgcaggatccatgcatgcatttgtgactgtcctccaggtacatgaagttcttctcacatccacgcacccgtgaaagggccctgaggctggacatgctgctcagaccccgagaggctacagtctgcgatggtgaccactcctgcccaggctacggtcggagtatgtacagaggcccaaggggttacatcaacagattgaatgcagggtcgatctccaagtagtgtccctgtccactttcgtacattgtagtcacccaactccttgtcgcgaagcatgctggcccggcccaatgctgccgacgtgtcgttctggtcagtacgcgacccccgacccgcggcatggctggcaagactggcccgcatgaacgggatcccgcactttagtgttgcgatggcgtcactccggcgagcctggctgctcaaggcccgatggggcctcggcattcgatgcacttctagcgtcgccgacggggctcaggcgtgggagacgcgggctcgcaaggaggccaagggcaaggatccctacgagaccttcggatctaccaatcaggatgtaagtggttgcattggacactgctttttgcgctcatgccctgtctgggccctgcatcgcgatatttgttgcattcttccctcgccaggggatcccgcaaaagccggtctacactgcggcagacatcgccgacatttccggccttgacaccgaggtatgcggattactatcagccatcattggagggcctgatgcaaggcgttgacattgtctatggcgccgtgcgggtgccggaaccccaagatgcacccttccccgctcctccgacaccgcagtatccaggggtgtacccattcactcgtgggccctacgccagcatgtacacgggccgcccctggaccatccgccagtatgccgggtttagcactgcagaagaatccaacgccttctacagggtgggtggatgagtgggtctttgcttgagctgtcatcagcctgtgacgatcaggggtggaggcgtgggccccaagcgatgctgcaaccccgccgctgacggctgttcccactcacccaccgatgcccacacaaacacaccgtcctcgtatccgtagaaaaacctggcagccgggcagcagggcgtcagcgtggcctttgacctggccacgcaccgtggctacgactcagaccacccccgcgtggccggcgacgtgggcatggcaggcgtggccatcgacagcgtggaggacatgaaggtcctgtttgacggcatccccctggaccgcatgagcgtcagcatgacgatgaacggcgccatcctgcccgtcatggccatgttcatcgtggccgcggaggagcagggggtggcccctgccgcgctcatgggcaccatccagaacgacatcctcaaggtgcgtgggcttgggttggagcattctgtatgctcttgttgtgggaggaggggggaagagctggagaggggggggtgatgtatgcctccgcgagtatctgcagttctccctgcacaggacagggagcatatgcatcgagacctggcgatgcctccaggttttgccannnnnnnnnngtagggtgggagcattctgtatgctttggttgggggaggaggggggaagagctgaagagggtggggtgatatatgcctccgcgagtatctgcaattctccctgcacaggaccgggagcatatgcattgagacctggcgatgcctccaggttttgccagcaaaccccttcaacccccttcccccatcaacacctatgcaggaattcatggtgagaaacacatacatataccccccgcgccagtccatgcgcctcatcggcgacatattcgcctactgcgccaagcacgtgcccaagttccaccccatctccatctcgggctaccacatgcaggcacggggtggcttgcccatgagcagtcttgcttgggaatggagactgcatttgtgatggtgaagggaggtccgggaccttcgagccatggggcacggtgacgtgctgctggccggcttggtgcatgctgttcctggggtaacaatgtcccagactccatgcacctgcaggaggcaggtnnnnnnnnnncggcttgtccatgagcagtcttgctggggagtggagactgcatttgtgatggtgaagggagggccgggaccttcaagccatagggcacggtgacgtgctgctggtcgccttgttgcatgctgttcctggggtagcaatgtaccagactccatgcacctgcaggaggcaggtgccacgcccaccctcgagctggcctacaccctggcagacgggctggagtacctgcgctgcgcgcgggacgcggggctgagcgtggacgacgtcgcgccacgcctctccttcttcttcgccatcggcatgaacttcttcagcgaggtgtgtgagggggtgcttttgttgggaaggatgatgagggtgcagggcactgcgacgtgacgtcagtgtggcagtggtgacgacttggcgcatggtgccatcactatttcgacacgttagcctcctgacagtggacctgaggaacagacccactcgtgccactgaacctgtgctctgcaactccccgacccatgacaggtcgccaagctgcgggccgnnnnnnnnnnaggtgacgaccgggcgcatggtgccatcactctttcgaaacgtaagcctcctgacggtggacctgaggaacagacccactcgcgccactgaacctgtgctctgcgactcccccacccatgacaggtcgccaagctgcgggccgcccgccgactctgggcccgtctcgtcaaggagaaattctcccccaaggacgagaagtgcctggccctgcgcacccactgccagacttcgggctactccctgactgcccaggagccacacaacaacatcatccgcaccaccgtcgaggtgggtggatgggtgggcggaggtatgtggctgtcggatggcgaacgctgattcggtcctgataccccctcccccccatccctgccctaccccaccatatccattgcaggccatggcggcggtgctcggcggcacacagtcgctgcacaccaactcctttgacgaggccatcgccctgcccaccgacttctcggcgggcctggcgcgcagcacgcagctgatcctggcggaggagacggggatctgcgacgtggccgatccgctgggcggctcctactacgtggagcgcctgacggcggagatggaggcgcgcgccggcgcgctgatcgacgaggtggagggcatgggcggcatgaccgaggccatcgtggcgggcctgcccaagctgaagatcgaggagtgtgcggcgcggcagcaggcccacatcgacgccgggcggcaggtcatcgtcggcgtgaacaagtacgccaaggagggcgaccagggagaggcgctggacgtgcgcaagatcgacaacactgccgtgctgcgcgcccagaaggcccgcctggaggtgaggcttgcaggtctggggttggttttgggggggggggggggggggggggg

SEQ ID NO: 37807 - DNA, 107 bp, Chlorella protothecoides
gagctcctcgcggggaccggaaagcctcgaacccctcagccccgcacacgcgggagcctgagtgctgttaaagcaggttcgcgacaatgcaagtatcacaatacaca

SEQ ID NO: 37808 - DNA, 106 bp, Chlorella protothecoides
ggaggggtgggtggcagattcctttgggggttgaagctcagagtgcctgtcctcgttaccctgccttctgtacaagaggagagcctgcaaatggtggggcatctcc

SEQ ID NO: 37809 - DNA, 61 bp, Chlorella protothecoides
agcttcatcctggcaagtttccaggaacccatacgactttcatgcaggcacccactctcaa

SEQ ID NO: 37810 - DNA, 79 bp, Chlorella protothecoides
gagcgtggggccgtggaggggctgcaggcaatgcgcagggtgcatgcaagggctaggcaggggatggagacgtagttgt

SEQ ID NO: 37811 - DNA, 15735 bp, Chlorella protothecoides
  modified_base (560)..(569): a, c, t, g, unknown or other
  modified_base (1852)..(1861): a, c, t, g, unknown or other
  modified_base (2123)..(2132): a, c, t, g, unknown or other
  modified_base (2531)..(2540): a, c, t, g, unknown or other
  modified_base (3477)..(3486): a, c, t, g, unknown or other
  modified_base (3690)..(3699): a, c, t, g, unknown or other
  modified_base (3866)..(3875): a, c, t, g, unknown or other
  modified_base (4644)..(4653): a, c, t, g, unknown or other
  modified_base (6719)..(6728): a, c, t, g, unknown or other
  modified_base (7042)..(7051): a, c, t, g, unknown or other
  modified_base (8303)..(8312): a, c, t, g, unknown or other
  modified_base (8775)..(8800): a, c, t, g, unknown or other
  modified_base (8970)..(8979): a, c, t, g, unknown or other
  modified_base (9031)..(9157): a, c, t, g, unknown or other
  modified_base (10194)..(10203): a, c, t, g, unknown or other
  modified_base (12218)..(12227): a, c, t, g, unknown or other
  modified_base (12941)..(12950): a, c, t, g, unknown or other
  modified_base (13239)..(13248): a, c, t, g, unknown or other
  modified_base (13736)..(13745): a, c, t, g, unknown or other
  modified_base (14256)..(14265): a, c, t, g, unknown or other
  modified_base (14968)..(14977): a, c, t, g, unknown or other
gacccggcgagcacgtcggcgccgaggagggcgcccgcacgcgacaggacggccgcggcgtcctccgacgcggtccccaccggcccggccaccgcgacccgccacagcacgcccatggccccctgggtgcccgtcatgtgcgccctctcctcctccccctggcgccggccggacagcgccgccgcgagggcgtggccccagagcgccgccgcccccgcccggtggtccgacgccggccggacggcgtctgcgccgggctcgtctgtcaggttgcgcagcgtgcgcagcgtggcggccaagatttcatcgtcgccccggtcgggcccctccagcaggtgcaccagcgcctgaagcgtgggcctcgccacgtctggggtgccatgcaggaagaagggagggggcgatccataccaagggacggcggtgcggcatcgaggggatccctctcggtgccacgctgcagggtgtacggacggcacggaacggtgcagaagacgccagggttaagcccctggcaatcgcatgacgccctcctctccatcatcctccctgctcacctnnnnnnnnnntggtgcagaagacgccagggttgagcccctggcaatcgcaaaacgtcctcctctccatcatcctccctgctcacctggctggccctgcagctgctcggcggcctccagaccgagcttgaggagctcctcacgctcgccccccccacccccctgcgccagctgttgcgtcgccaggcggcggaacgacgccgccacgacgtttgccagcgcagcgaccacccgctccggcgcgcgggggcagggcgcggtgcgcagcgcgtgggcgctcaggcgcagcgcggcacgcagcgcgggcggcgggcggtcgtccgaggagcgcagcgtgcgcagcatggcactgacggcgccgggctcgcgccaggcctgccccgagtcgccagtcctctgcacctccgccagggctgccgcgacgctcctcgaccccggcgacgacggcgacggctcgagggtgtcgcctccggcgtggggcacatgactggagcgccccgcctcggcgccgagtcctcgatgcccggactccgaaacggtctcccgttcctgggcaccgacttccccgccgctggcctcccgctcccgggacctcatctcctccacgctggccccaccactcccacgggggccgacgccctcggcgctgcctttggcccccgctctggccgcgggctcgttctcgtcggacggggcactcctcccccccgccgcaaagtccagctgccgccgctcgggggagggcgcccacgccgcgccagggtccgccgccgggccgggcggggaccgggtggccaccgcgccggggaccctgtccggcaggccattgtcgccgcggggcgacagcaccttcctggcggctgccgggcgtagtgctgtggccgccggggtgaccagcagctgcttgggcgtggcctgggcggcgggcgtggtcgccgtggccccgctcgccgccgaagggctggtctctgccgcgtgtgactccggcccggggccggggatgggaacggcgtgttgcacctccggcggctcgggcggcgcgggggcccggcgcggccccgcctgggcaacaaaggggtggtggagcaggtctggccagtccagcctcctggacggctgcttctccagcaggccctgccaggccggggtgggagggtgtgggatggcgatgaggggagggaggcgagtgggaggagggaggtgaggcattgttggcgtctcacaaggagagcacagtgcgtgccatccggttctttccttccttgagagccctgcatccaggacacgcccagctnnnnnnnnnnagagggaggtgaggcattgttggcctctcacaatgagagcacagtgcgtgcaatccagttctttccttcctggagagccctgcatccaggacacgcccagctggggccgagcctgccactctcctttgatggaaagcaactcattgccatcgaaggacagcctccaccctcatcgccatgggaggacgggctcctgcgtggcctcaaacacagagcctcctccaactctattccatcaccttgaggaaggacttgaagtcgnnnnnnnnnnacgccatggaagcacgggctcctgcgtggcctcaaacacggagcctcctccaactccactccatcaccttgaggaaggacttgaagtcggggctcatcgaggaggggtaccgaaccggctcccgcacgatctgcttgatcagggtgtagatggaggtggtgtagaagggcggctgccccacgtacagctcgtacaggatgacgcccaggctccacaggtccacctgcagggaccgggggtgggaggagggctttcatgcggctgggtgagcgtgtttgatgggtgcctggcgcaaaattcaggccgccctgcagatccaggatccgctgtgctgaaatatctgcgtgactccacacttccctctttcttcgcccacccacccaacccacgccagcccannnnnnnnnntaaactcaggccgccctgcagatccaggacccgctgtgctgaaatatatgggtgactccacacttccccccttcgtcgcccacccacccaacccacgccagcccaccgtgtggttgtagggccgttcctgcaccagctccggcgccatgtagagcggcgtgcccttcacgctggtcaccatcagcgtgtgggccgacaggctgcgcgcaaagccaaagtcgcacagttttacggtgccggcggcggagagcaggatgttctgtggcttcatgtcgcggtggatgatgcggtgggagtggaggtagtgcagggccgccaccagctggcgcgccacgtccctcaccaccccctccgacaggctccgatcgtcttccaggatctggaacagctcgcctgggcaggtgcgggagtgggagaggagaagtggtggccgggggtccgcaggggtacccagggagaggcaggggtgtgtgcacagacgcggtagcgtgcgggggagggcggcgaggaggcagccagcacgccacacctccctcccagactcctgaccagccggccccgcaccctgggcaaactcggtgaccacgcagaagtcggtggccgtctcaaaggcatccagcatctggatgatgtgctcgtggcgcatggtccgcaggatgtcgatctcctggcgcaagcccagcaggtctcgctcattcttgccgcgcttggtgatgagcttcaccgccaccgtggccaggctgccagtcttgcgggccttgaacacctgtgcgcggggttggatgagggccgggggtggtggggtgcgtgagtgggatgtgcagccgcgacagatacctgctgcgcggggaggctggcttcccctgctcgttctgccaatcaactgcacacatgccagcatcctgacgatacaatgggagctgcgacttgcctacannnnnnnnnncgggtgtgtgagtgggatgtgcagctgcgacagatgcctgctgcgcggggaggatggcttcccctgctcgttctgccaaccaactgcacacaagccagcatcctggcgatacaatgggagctgcgacttgcctacatcggcaccatgcccccccatggacttcatgctcataactctactccctgctcagcagcggcaggcccnnnnnnnnnntcaccttgccgaaggagccttctcccaccagctcgagcaccctgtacctgcccacaaaatccggctgttgcatggctgcctcagccttccttgcaaatcatgctcgatcccactaccccaggtctgtcaccggggtttgtcgcagaaccagccaaagcgatcgagannnnnnnnnngtccttgcaaaccatgctcgatcccactaccccgggtctgtcaccgggggttgtcgcagaaccagccaaagcgatcgagataacgcagttggggcagagaatcaaggggatcgaagatgctcttgtatcgcgatcaagctgagcggagggagtctgccaaccacgcgaggtcttggctcgcgctgcttgtacaaaatttcaagaagccagaacggaaggggtttcaggaaagggtggagctccgggcgcgcgctgtgatacctatgcgcatgaagacatgcaagggaaactttgagagtaaaggcatcgatttacaagttgtttcaaaatggccacgagcactcccagctcctcctcgtcctccagctcatcgtcagaagacgatgccgcgacggccatgttccgcagcgtcgctgtgtctgccgagaccctgtccgcagcggcaactgccagtcaggaggtgtgtagagggccagtgtatattcctagagcagtattctggttaaattggtactgagcatcttcaaacactataccgtacaggcatcgaaacgacgccatgcacgggcactgcaacgggccaagggtgggggtgccagcatcgctcgggcatgcgctgccacgcagaacagcgacgacggatcggacactgagtatgacggcatgggcatcacacataagaaggtgggtgccatgagcaggaatccagagtacctggttgggaccgcggcatagatatcgtgacactcatcctgttcggcttgcctcnnnnnnnnnngcctggttgggaccgctgcacagatgtcgtgacactcatcctgttcggcttgcctcctcaagaatgtcctggcatcttctgatcccccaccctcaccgcttcgccaggtggctgctctcctgcatgctaggctgggccgccagctggatgagatgatggcatccccctcttcgtcgccggagcggccctccccaacccctccgaccaacgatggggcgggggaggcagcggctgcgttcgccctcttcacccgcatcgtgccttccaagagggaggcctcgcccccgccacccgttcgacggcccgctcccgagtgggtagaacccgacctggctgcctgcgctgccgtcgcggtgtctgcggcgagtctggcggcgggggccaccccgcgagctcgctcgaccgtcctcggtccgacccggtggccggacgagacaggcgcatgcatgggccaggggaaagcgcacgtgagggcagtgctggcacggatgaaggccggggaaaaggtggcgtgcccccacttagcacagcgcggtgtgcggggttcgggcgaggcagcgccggcccgcggggcgccgcccccgccccctccagtgtcgagcaagaaggagtcgcagaagcgacggctgaagcgcgcggcgcagcgggccgccaagcggttggagggagccagcagcgtcccccaggctgcaccggtgccatccgcctgagtcggctgcctcttttcgctcttctgggcgcatggtctatcaggacctgcttcaacactgacctgtgagaatcaccccttgctaccctttctaacttacgatttcattgtgtgcccgcttgaacaagagggcgtaacgcacgtccctcaagcgggatgattcgagaacttctcgtcctcggcgggcgcagtggagggacgaggtctgcccgcacaggcaaggggcatctaccagggtaaaacaaagacgccgctcagtatgcatcctcgtccgccttgtagctcacaagtgtggccacgctgtgaacctgaggagggggcccatggcgtggggtcgcgatggatcgtgggtttcaggtgagatttcacaacatttcggctgcgcagaggatacaaatgcgcgcgccctccccctccctactccttgccttggtcgagaaggagcggagcttcacgtcggctgcattgctgatgtagcgaggatcgctctcctccctgtgtgtaagtggagttgtggcaccagccgagggaggtgacatgtgggctttgagcttgcgcacgcaggggttgcctgtagctcagtttcagcaaggaagtacacaggcatgtgccaagtggttgaggcttcccccgcagcctctgatggcgcaccattcaccaggaacctcgcatgcacggtctgtgtaggctagtaggtcgattgtgcctgcacagtggacagcgacggggcaggatgtgatgaataatgaagcgtgggcttttggagactgaagcagcagatgatctggaagggtgcccagggcaatcaagactctgaagtcccatcccgatgtactcaaagtaacctcacagaacccccagcaggtacccagctacgcacaggcgtcgctgagcaggggcaggaaggggatgctggcagtgatttggcgaatgatagcctggatctcgccggtgatctgggcctctggtttctcagggaatactctgtgattgggacgagggggggaagtcgggcagattctagcgttcaagagagcttcagtgacaccctgaagtggtattgggggcaagcctaacaaggccatttctagctcaattctttcatcgagtcctgcagagtcccccagccctcttgctcactgtgtgctgatgacatccttgtcggtctggatgtcgaaagcccacctctcctgaacttgttttgtcacgcgcgatgcgatgaccaataccacctgctgcaacgttccgagggcgagccagtctgcacatggggaatgggattggctatgaagctactcgcctcgttgcggcataggtcattttaactgtcgtgcgtccaacccagaccctcagtcannnnnnnnnncatgaagctactcggctcgttgcggcataggtcatttcaaatgtcgtgcgtccaacccagaccctcagtcacctttgaattgggtgaggaccgaatccagatagctctccagcttggagtccttcaccgccatcacggtgagtccatactttttcctgggctcgaatgactcgggagggtagacgccgcgctggtataggatggaagacagggcagtctggaagaattctgtcaccgtcgccgtgctcccccggagtgtcacggtgtttcgggtcgccaccgcggtcgccattggacgggaagtttggacaaannnnnnnnnntacggtgttccgtgtcgccaccgtggtcgccattggacgggaagtttggacaaacaagaaccgcgattaaatgtctacattccgaggcgggcgcggttggattctaggcgtcgtcactgggagcccctgcgcaggctgccgaaatctgtgcagcgggatgatgtctgtcggagtgcagatcaaaatttccagaactccacgttctgaatgccagggcgcgacagagacttatctaccccgcacattcgcacccaccgatctcgaataatcatacattttccgagagacggcggtggtataattccacgtgcaatgagctctatgacggaggcctcggcccctcacaaggagctgcaggctcgggggcagcgctgcgtcacctcctggcaagaacacctcgcccgccagtctgcgaccctgcaagctgcggtgaatcagcatgtggaaggggcccaccacgggatccaagcgctcggtcagcagctggccaggctgagggtccctccccctgcccagcgaccccagccgagcgtgctcctggcggtgcgtgtccgggttctgttttggggtgatgaaagtgtgcatggaggtggattgtgtgctacaaatgagtacatcacaccaaagtaggatggcaccggctttgtcaaccgccccacgagttcttgactccctttggggtttgtgctctccttctgtgtggtgccccctcgccccatgcctgtgcactgcctcaatctcctccccttcccccccttcccacacagtccatcaccaccgccgcgcgcgtggtgtcgggctcggccccgcagcccgccttcgacctcgccctcgcccccgaggagatcaaggcccgcctggccaatgtgccggtcttcaccgtggtcaatgggaaggaggagttcgtgttggtcactggggagcaggcggaaaagcgccagctgggcctcttcttcttcaacgaggccgatgcacaggccctcgtggccaccgtgagcctccagaggggtttttggtgggggccacgaggagaggggaagaaagagagggcggtgctgatggttgcggtgtgcacccccagcccgccccgcgaacaatacaatccattctcatagagcttccccgaatcccaaatcatcaccagacgcagcatcatacatcgcaccgcacacccggttccagcatgaccccctccgacctccacaccacgtcgcagatgagggcgtcggacgcggcgcagggccgcgcggcnnnnnnnnnnacacacaccgcaccgcacacccgcctccaacatgaccccctccgaccttcacaccacgccgcagatgaaggcgtcggacgcggcgcagggccgcgcggcgcgcgtgctgcccaccagcctcgcctcggtgtacgactttgcgctgacgccgcgcgcctccaccggcttggagggcgtgaccttccgcttcgtgcccgagcctggcgaggtggcggcggcgctgcagctgtacaacgccgccggcgtgtcggccggcggcttcatgggcgtgcccctgttccaggctgagggcctgacggtgatgtccgagggcaagcgctgcacccccctcttcttcagcaaggccgacctggatgtggccctaggcacggccgcgggccagaagcacgaggagatgctgggcctgacccggcagcgtgcggaggaggccaggaaggatgtgcagcgcatccgggacgaggtnnnnnnnnnnnnnnnnnnnnnnnnnnatcttcgcgatgtgatgcatgtcctggagacgctgtgagggaggacttgatacaccacacttcgtcccaccaggctttggcactccagcttccactcacttcctgaatgtgcttctgggacccccatctgcaggttgcaagtgcgggggaggacaaggccgcaaaggccnnnnnnnnnnatgggttgatggttgtgcggggggggggggattgtgggtttaggagatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcactcacttcctgaacgtgcttctgggtccttcatctgcaggttgcgagtgcgggggaggacaaggccgcaaaggccgcagcagagcgccagctgaagccggcgctagaggcgcaggcacggtaccaggcgcgcacggctcagcttgaggacaagaaggtgaggcgcggaagaaatagggagtggatcccttgccatggtcgatccaggaagtcactcagatgggggtgcaggggggggtgcaaggcaatcgcatgctttgctctgggggtagctcacaatcaagctacggttctgactacccatgttgatggcgccgcattccaccacatgcttcctgcacacccggctgccatcacacacaccctcttgtcgggcaccaacaggtcaaggtgccgcgggtagacctgggcagcctggaggaggtgctgggcaggatggaggcggacgcccggggcgagtgggcggacgtgctcttcatcccctctggaaccatgacggtgacggggaagaagaagggccggtgagaggtagaatggaatgcatttggcaagggccgcgctgtggccctcaattttctgtgtctgacatcgacccgagtccgtgcgtgcacaccaatctttgcatgacacatgtgtgtaacaaatctcaggaagggctggtgtggtgagcagggctggtgttgcagcacggcactcggtctcactgtgcaggccacccagccgatgccggccagggacacacgagcgccggcgcgcgcagagatttgccaaagtgccgatcccacccccgcgtgcgaggtgcacgacgggatgctttgctgaaatgcctccgccaggccctttcggtgacccgtgacctcagatcatggcgctgtgagtcggctgtctcgccttcgtatacgtcgacatcagcccttcatctggccagagactgtgcgcaggccgggaaggacaaggtacctccgctcgatgcagagatcacgagcggcatgtgtgattgatttgtaatatcacctgatcacctttgcatacgnnnnnnnnnntcgctcgatgcagggatcacgagcggcatgtgtgagtgatgtgtaatatcacctgatcacctttgcatacgccacatatcacagggatcgaacgtgcgttgggcacagatgccagtgatcattccaggtcacggcggggagccacgcccacacccctgcggcacatttgagtgatctggggacaggttccctcaaatccagcaatgtgctctggcttggcagacccggtattgaggtccaaaaggaaggtatccaccaggaagcccgtggattgcgccgcgcccatcctagcccaggtgggagaggagggagagggtagatgccatgcctccagcaaacgtgcagccaatagcttacgtgccatgacgcaatgcaaagagtgctgtttgtttgatcttgtcggtcggcgcaggaagggctcgaatcacctgttcgtcgtccaaatcttgctgtaaaacccctttcccacatgcaggtcaagcagctgagcgctgccagctaccatgtctgggtgcactcccccgtcccggggcagccacgcttctttgccagcgatgcactggagtgcctgaccaaggttcagtggtgggtggtcccgctgctctggatcccggtggcctgcgcttggctggcggtggccgtgcgggattggggcctcccaacttcggcctgctatgccgcggcgggcgcgctgagctggcagggcgtggagtacggcctgcaccgctgggtcttccacgcccggccgcactcccctgcggccgtctgcgcacactttctcctgcacggctgccaccacaagttcccccaggacgttgatcgcctggtcttcccacccctgcccgccgccctcatcgccgcaggcctgtactacatgatcaggctcgcactcccagcggtgggtgtttggcgtggggtggggcaagcagggcaaatcggctggtaccttactcggcaagcaccggtgcctggctttcttgaggagacacggaagtcgtggcactactccccccccttcaagcctcctctgccatcacccaacgcttgcagggtgggagcgacgccttctttgggggcctattgctagggtatgtgcgctatgattgcatgcactacctcatgcactccggtaggctgggcggccgactcaaggccgcacacatgcatcaccactactcgaacccggaggaggcgtttgggatcagcggcggctcattagactgggtgctgggccccccggctgccataggagctacccgcaggagcctcgtggataggtgatgctcctgggactgcctgcctcaggtcgagttcccagcccagtccagtggggaatcactggcgaatgtccaggtagtagcttccacactttgaggcctacagtccaggctccaggtacccatgaaccaccccctatgactatttgcttggacccatcagggacacacatcattgtgatgttgtacaaagcaagtgctgaccatgcgagagcacaacagaagaacaaagtgtggctggccactgtcaatgctttggccgccgtggcttcttcttgagcctggggttgtcagtcttgcgccccttgcgcgagaacctggacttctcctcctgcatcttgccataccgtttgaggcgtgcctgcagcggtggaccagggaggggttcgggtgattttagcatctttgtctgcagattctgtaactaaaccgccagcctcaccccaggtgctactcccatgcatgtacacactcctgctacaaacaggcagcaaaccagccggtcatgtgcccccatacctgtgtcagccggggatctgccccaatctcctctgcaaacgtctgcttccgctcagaattggtcagccggcctgcgtgggagtacagtggagatgagctcatgctgatgtttgactgccatgcagtacctgtgactcttccagcttagaggaatcaccacacaagagcgtagagctgccatagcaaagcccatcccctgccacgagcctcacttgagtnnnnnnnnnnaagcttagagggatcaccacacaaaagcgtagagctgccacagcaaaacccatcccctgccacgagcctcacttgagtagaagtcagcagcaccctccacaactgtgcccatctggaagtacttggggaacttcgtgttgtcaaacttcttgtaaaaggccttgggatcaaaggcagacctgcacatgacagatttcggtggggtgagaggtggggtattgctgcgactaatcgctgcaaaagttcaagggccatccactagcgcagaggtcacaagaactttgcagccaagacgtagctttgccagcagagtcggtcatctaatactccgcaaacatgccgagcctagctcacctcaagcgcagcatgcggaggtccctcttgacctcctccgtgattctggtggctggcatgtcaaaccacgacttgccactggtgtccggggcggcagcctgcgccgcacgtcgagctttcttactatccagagggggtatggtcaactggggggaaggagggaggccaacgagaagtcgtcaggtcatccactatttatgtgagatgctgttcctctacctctgctggtcgccagtcgcctgtgcatcccctgcacaggctgaagcacccactctttgcatacactccacacctgcttcgtgagctcgtccactcctcttgtagcgagtattggctcctggggaccactgaccggcaggnnnnnnnnnnttattgatgtgagatgctgttcctctacctctgcttgtcgccagtcgcctgtacatcccatgcacaggctgaagcacccactctttgcatgcactccacacctgcttcgtgagctcgtctactcctcttgtagcgagcattggctcctggggaccactgaccggcaggcgcaagtctgggcgccatttgagatgagcattctcgagtgcttgtgccgcgctgccactgggtccggctgcgtcctccacttcgtcccgtggagccagaccaagagcagaggacatgcctnnnnnnnnnntgcatgctcgagtgcttctgccgcgctgccactgggaccggctgcgtcctccacttcgttccggggagccagaccaagagcagaggacatgccttgaagtagctgttccatgaatgcgtcgccggaggcagccgcaggctcctccgactcgctgcctctggaccgggtggccaccatggctgcctcggaggacacgcaggcaggcggtcgcgatgtatatctggtttataaggagagcgattcaaatatcttgttagttcctgaggcacatcacacattgcatctcgcggtgcccttgccccggttttctgagtatcgcgccctccttggaggcgcgcgctgctctttggtcctccagccaggttccagcgtgtaaaaacagacagaaaggtactcagtagacgctgcactccggtacgacccttaaaggacagagtggcagccgttctatggcgcagcggcgggcgcagccgcctcctcgtcagggnnnnnnnnnncgtgtaaaaacatacagaaaggtactcagaagacgctgcactccggtacgacccttaaagagcagagtggcagccgttctatggcgcggcggcgggcgcagccgcctcctcgtcaggggcggcttccgccatgcggagacgctttgctgcagaggctggcacagcgtcaccatcccccgcaggctctgccgttccttccttctggggcgtattcaatgcagaggataggccggcggtattggccgcccgcaggcggcgccgctccttcttcacgagctcctctgcttggcgggtggcatcctgggcggggggcggcgcggcccagaccccggtgttcagagccccaagcacttgcaccgtcctgcgtatggtcaggagatgctggtacgctgggcgagagaatgccgctgtgtggctcttgcatgctgctggtcctccagctcagggcgggactagggctggggaacctcgtgcagcgatcctgcggctggcacggacaagtgctgaacgnnnnnnnnnntgactagggctggtgaccctcgtgcagcgaccctgcggctggcacggacaagtgctgaacgccagccaagccgccacaactccagggtggatcacaccaaacatatcccgggcaagctggcctatccaggcagcctaccttctcagcagcgacatggcatgcgcggccgccgccctgcatgcctgggcatgcaccttggagccagcatccagttgctgtacgggaggcagtggggctgaggtcgaagctttcttcagcttatccttgcatgcaagtcacgaatgtgcattgcatgtttgcccctgcagagtactgcggtgctcatgtatatttcctctgtcccatccatatcgagccacaaggtgccccccctgtccgcagcttaccaggacccaatgctcgttcttctgcagagcgacgatgcgcctgaggaggtccagggcagcggcctttgctgcttcggcctcctccccctccggcacggcgacgggccgtgcgggggaggccgaagaagctgcggttcctaccgccgtcgccgcattaacgctggcctcaggggcagtcagagccccctccccggcgccctgcctgcctcgtccttccggcgcgggctgcaccaccacgtttgccgctgcagccggccgcgccgccgccgccgccgcctccgccgcgtttgcctgcgccgccgctccagcctgcgccnnnnnnnnnntgccgcgccttcgccacctctgcctccgccgcatttgcctgcgccgccgctccagcctgcgccaccgctccagcctccgccgcctctccctcggcggcctggcgccgcgcggcagccagggcggcgcttacggcctccctgtcccgggcctgggcttggagcagggccatgcgctgcgccagcacctgcccctgcagcgcctggaaggcgagcagggtcggcccggtgtccgcaccggcgcgctgcaggtctgccaggcgcacggcccaggcctgctgcgcgggcgcctgctgcgccgccagcgccgcctgttgctgcgtgtgcagcgcggtcagctgccgcgcagccgcctccagcgacgccagtcccagccgggcgcgcgccagtgagtctgcagagggcgcggggacggcacgcggagagggctgctgggggtcatgccgcatggggcgtggcgggctgcagctggggttggggccgggctgggaggttgggctggctcccacaggcaccattcccagcgtggctgcggccccggcaggcaccgcgtagccagggggccggcctcccaccgccggcgctggggcagctgccacctcgccgagcagctggggttccggcgccgcaccgaccggccccctcccccgcccccggggtcgcggcggcagggcccgcaccccgggcatccgggccactgcgcgcatctccgcctgcagcgcggtgccgcgcgaggcctgcatgccgcgcgccaggcgcgc

SEQ ID NO: 37812 - DNA, 79 bp, Chlorella protothecoides
ccctggctcattaagatgcttgaggggaacgttaagctcacccatgtcacattacatccatctggtgcaggtctgaacg

SEQ ID NO: 37813 - DNA, 75 bp, Chlorella protothecoides
aagaggcaagcttggtcagagctctgggctatggttttcgtggcccggcgtgaatacctggcccggcacgcaccc

SEQ ID NO: 37814 - DNA, 74 bp, Chlorella protothecoides
caggcccagcgagggcgccgaggtcggggctgccgcgacctgggccgcggcgccgcaggccagcccgccggcca

SEQ ID NO: 37815 - DNA, 68 bp, Chlorella protothecoides
aatcatagagcgcgggttgccacgggcgggctttcgcttcccagggtgttagcagcgaggtggtgcgg

SEQ ID NO: 37816 - DNA, 183 bp, Chlorella protothecoides
agggccacgagtctggggccgcaagggctggagggaaggggggctggggcgacgtgagacctgtggaaggcctgagtgcattccattgcctggggagggatcacactcgagagcgcctaggagggcatgccaggtggtgatagcctccagcgcaattgccagaattctgagcatgggtggttt

SEQ ID NO: 37817 - DNA, 6101 bp, Chlorella protothecoides
  modified_base (179)..(292): a, c, t, g, unknown or other
gcccgcccgccgcgcggcgccgggcaagtcggccgggtcgcgggcggggcacccgctgcagcgctgcctgacggtggtggaggcggcgctggagcgcgccccggccagcgccggcctggccgccatccgcgaccgcctcgccccaggccagcgcaacggctggggcacagtggagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcgcgacctgcgcgccgccagcgccgggcctgaccagcccgccgtcgtggcggcctgggcggccgaggggctgggtgcctgggcgcctgccccggggccgacggcgcaggggcaagaagccccggcgctgggctcgcccaccgtcccctcgccccactccggctcggaggcggggccctggtcggcctttggcgcggcggacgccacgacggcggcgcccatcgaggccgacggaccacccgcgccgccgcccgcccatacctactcgctccgcaccggcagcctgacttccagcctggacctgtccggggtcaagccgggcgcacccgggcatcggggccggggcaagggacgcgcccaggtgggttgaggtttttgtatttgtgtgtggggggctgctgggcgtcgtgcagggtggcgaggtggttgtgagggaaacagacggttgacagggggctgagtggcctgcagtcgtgcgcttggtcgccatacgctcgttcgccgtgtgctcccccaccctgcgggcctggcccgcgtcagggcccagtcctcgccacaccccagatccccgagcccctggctggcccccaccgcagagcttgagccgctgcgaggtgtgcgtgcggcagaagcgaggcaactgtgggacccccttggcgcacaaggggtgcctgctccggccggcgaccgcggcggcctccggcagcccgcgcacgcccggcggcgagggcctgcccgcccccctgcgcaacccgctgagttcattgaagccggggaagaaggggcggggcgcgggcgtgaacgcggtgggtggcttgttgggggggaggagtctgagtcctggggaggcagaaagtccaccctgctctcatcgcaagggcgcccgctgagccgcccggcggggcccgtggcgcggtggtttgcagactgaggcgcggcatgcgatgcgtcccaggtcatcgcgtcattctccccccctgcgcagaaagtgctggccaaggagcgggaggcgatggcggcggcccgcacgctgcagcgcaagcgcgaggccgccgcggaggccgcgctgcagctgcgcgaggccatcgcgctggagcaggaggcgcgcaaggtgggtgtttgtgagcgtgtgtgctagggttcgactggggtgggcgtgcatgggcgcctgcctgcgctcacaggtggcgctcgccgcgcggcgagcagggcacagccttccacctgtagcagcctgcagcccgcaccctgcctcgcccggggccagtcgtcgaccagggaacaaccccatcacatcacatcccttgaaatctaaccctccaaacagttttgggaggaggtggccgaggtgcatgcccgcctgcgccagccgccggagacctccacacaggacgaggcctggtcgccgggcgcgcggttcgtgcccgccacgtacactgccgaccatgccgctgcactgcagccgcgctgggacgcactgcgggaggcgggggcgtactgggcgcaccgctgcgcctggcagccgcgcccctgcgcggcgtgaaggaaaggggcgccgctggtcccaaacccaacacggtacattcggggctccggccatattcatgctgggcagcactttcccaatgtgtctcctttgcatggtgctgagaggagcagtgtgtcccctcccctgcctcgctgtacgtgctcttcaatgcagtgccagtcccacgcccctccacgtcgctggctgccggtcgacgagcatgccctcccctattgtaagcttcctccacacactgcaaggcatgcatgcacacgcatggctggaaggggacgaatttggtcacccagccgtcccctcgtctgctccagcgctgggatcccccaaccttgcccacaagcgtcaaatatgtcgcggatgcatgctggggctcaggggctgccggaggtaccctgcgcagcgtcggccacgccctcgaaattgaagcgctgcaagccgcgccgcagcttgtcctccagcgaccccgccgccggctccgcggcgcggggcttggccgcctgagggttgacacggcgtagcgcagccgcttgcgtcgccagcgccgtctgcgagatggggtgcagcggggcgcgcggggcggtggtctttgatgttgcgccgtcggacgccccgctttccagcgcggcgagcgcgacggcgcgcgccgccgcccgcgaggcggccgccctcgccgcctgggcggccactccactgccttgcggccccggggcagacgagcctggggcatcagttgatggcgagaccgcggccccaggaccggggtccggcgtcccagcccccccgcctgcaagccgactgggccccgcgcctgtcatcacccccctctgggccccatcgcctgcctccgacccgccgccccgcgccgctctgcccacgctgcgtgtgctgggcagctgcggggacagccccgcgctgagctggctgaacacctgctgggagagcgtggcgagctcctcgccctccgcgcccacccccgcccgcgccagcttgagcatcaggcgctccagctgctccacgctgagctcgacgcggccgcggcgcggcgcgggggtggcgggcatgccgccggcgccctcgggcgcggccgtgacgggacgcaggaaggggtgtgccagcagctcgcgcatggagacgcgggtcttgggctcgcggtccaggcagcgccgcagcacctctgccagcgcggggttgggcaggggcgggaaggcgatggcgtgactcgggtcgatgatggcgtgcatcttctggatgaagggcaggtggctgaagggggtggcgccgtataccatctgatacaggatgcagcccaggctccagatgtcggaggcgcgaccgacctgcgtgagggcgggggtggtgtagggttggggtagggcacatgcgggggtggaacttggggtgttcaaggttgggagatcgagggaatcgaggtgtgcggcagagagccaaacccatcacccagcccccgattccttttgaggtgaagccacaacacaaacatggtccaacagacagagtgcattgcaacacgcgaggcaccgttccccagccatgagcctggaacccaccctgcgctccacccagcccaccttcatgggcgggccacccttgatgttgttctgcccgcccaggatggcttccgggctcatgtagttcagcgtcccgacctggctctcacgagcgatggacgtcgtgtctgtgcatgtgtgtggcacggggagggatgggagtgaggatggcgggcatgcaggccagccagagggcggagtgacaggaagaggctgcacgccactgcttgggtgacgccagggagaggggtgggtcctcaactgaggccgaaggacgctgcccaccgccactcggcgtggcctctgcgtcatgcacgctcctcccccagactcagggcgaagcgggggcgtcccaatcatacatgcatggcggccatgagagcggccctccggacccctcgccccccacagtcgcaagacacacaccggactggatggcctttgcgatgccaaagtcgatgagcttcagctggccctccaccaccaggaagttggcaggcttgatgtcggagtgcactatgcggacctcatggatcgtgtgcacagcctggggtggtggaggtgatgaatgaatggtaaatgtggtgggagatagcggtgggggagggcttgaagaggggagtggccaggcgtagggcggcctggactgcaccattggaccacgctctcacccctgcacgccaaggcagcgccggaaccctggctcctctgccttggctgtatcctccaggccccccctcccctctttccgatcctcactcgcaacatctgctcccagtacagccggatgaagttctcgtcgagcgatgcagcgccgccgtcgtgttccttccgcgccgcctcgcgcttctgcagcaggcgggcgaggtcgatctccccgcactccagcaccatgaagattatgccctcggcccggtacacctttgaaagacggggggtgggaaatgggagggttggggagggttgccaaccttggatcgagaagacagcagggtggaaaatggccggatgcagagctgaatatcagccctgccttgccaggcggccggcacagggcctgaaccatccctctctccctgggcctgtgcgactgaagaggccaccgcttccctcctccctcccaactcacctctgcatcgatgagctggatgatgttggacttgccacgcagggagttgagcagcgtgatctcgtcgatgaagccggccgccgcctcggagtcgcggccctgttcctcgaggggagaactgatggtttgtgggtgacaccttggcgcagcagaacctcaagaccccccaatccatgcagccctcgcccttgccacggcaaggaagtccatcgtagctggattcaccgcacccaaacgaacacacactcacggtgagcctgatgcgcttcagggcgaatatcttgcggttcggggccatcaccttgtagacctgcatgagagtggtagagggtgggggtgggttgtcagtggggtgttccctcgtcctgctcgggattcaacacaatcttgctgatctcgtccaagcctcggggattcagtaacaagaaacctgcgccgccccgtgaccactggggtcgcaccttgctgctccccccgcgtcccacacactccagcttggtgtagctgatgcccttgaccaccacggtattgtcgtcctccaccaccctcctaccagaggagaccaggctggcattgttccggtccctgcgtgccggagggaagcactggttggtgggagccggtggcgggggagggaaagtgcggggccctgatcctgcatgctatcagacactcttctctcggtgcatcgggtgcctggtcttcacttcgcgccccaccccccacacatccctcaccgctgggatgcgggggctttggggggcggagggcccatgggctgaccctgggagggccgctgcggcgccgtctccgcagcggccaggcgagcgtcgctcgcggggtccgggcgcgcgtcgctctccgcggcggggccccggggcaccgcaggccggcccccggcggctgcggggagggtggtgccgccgcggacgacgacgtcgcccctgcccgccgggacggcattcacctggccgcgccgtgccgcgccaggctgcagcggcagcgtggcctcctccgcctcctcgccccccgaccccggcgtctgctcgccagcctccagcaccacctgtgctcgtgagtgggcgtgcggtgggggggcacagaggtgtggatgcttcacggagggtccagcgggtgaagtcacgacactcgtgggctgatgggcgtgcgaggggaggacctgtgaggtctagaccgaggacggcgcagagcagacacattcgatcccattcaaggcacgagtcccaggcccccctcccgcgccgggctcagaccagcctcaccctgtgcatcttggccggtgccaggctctgccgcccaccccgcacccgcgccgccagcttgctgaggagcacgggcgcggtctcttcctcgtccaccgccggcggctggcgccgcaccatcgacccgccgccgggcccgtccgccggcaggtcgcccgcgtccagcaccagctggcccggcctggggcctgcgagcgtgcggagagggggcccggcgccgggccctgcgtctgctcgccccctcgcctcgagcgcgggcccgcggctgccgcccggcgcgt

SEQ ID NO: 37818 - DNA, 8914 bp, Chlorella protothecoides
  modified_base (360)..(369): a, c, t, g, unknown or other
  modified_base (2221)..(2308): a, c, t, g, unknown or other
  modified_base (2530)..(2539): a, c, t, g, unknown or other
  modified_base (3564)..(3621): a, c, t, g, unknown or other
  modified_base (4287)..(4296): a, c, t, g, unknown or other
  modified_base (4788)..(4797): a, c, t, g, unknown or other
  modified_base (5925)..(5934): a, c, t, g, unknown or other
  modified_base (6236)..(6245): a, c, t, g, unknown or other
  modified_base (6699)..(6708): a, c, t, g, unknown or other
  modified_base (7372)..(7381): a, c, t, g, unknown or other
  modified_base (7910)..(7919): a, c, t, g, unknown or other
  modified_base (8414)..(8423): a, c, t, g, unknown or other
  modified_base (8684)..(8693): a, c, t, g, unknown or other
cggccggcgcggcggcggccgccgccgcgcgctccaccacgacgcgcaccaggtcgcgggagagcgcgtagccccagcccgacgcccagcgcacgcccagcagcggcgcggcctgcgcgtcgctcaggtcggcctccgccaggtaccacttgttggcggggtcgcgcaggggggcccagccgggccagaccccggacttgttggagtccagctggcccacgtacatgcccgtcagccagggcgccgcgcgcgggaggccggccacgccgtcgaagcgggccgcggcgtcggggggggcgtcgatggccaccgagaagtcgttcgcgcctgtggcgatgacgtccagcagggcctgggggnnnnnnnnnncgccgcggcgtcgggaggggcgtcgatggccaccgagaagtcgtgcgcgccggtggcgatgacgtccagcagggcctgggggcgcaggtacacgtcctcgtcggtcttcaccacgtgcgtgaagttgcagggcgaggccagcgcgtagcgcagcaggcgcagcgtcttgttgggcagctcgcggtagcgctcgcgcccgggcaccaccaccacgtcgccgtgggccgagacctcgtcggccaacagggccagccccgccgccgcctcggcggggtcggcgggctgcgccagcaggaagcgcaccgccacgccgggatgcagccgccgggcgtcggcggcccaggtggcgcggatggccgcgcgcttggcctggctctcggggctgcagcagcggctggtcacgccgatgaagacgcgcaccgccccacgcgggcaccaggccggcagccgcggcgcggcgtcgctgtccagctcgggggcgcgctcgccagctgcgcggccggcgagcgcctcgtccgggagctgggccgctgcgtcgcctgaaggtgaggagggagtggtagggtggaggtaatcaagggcgtgccgacaagaggtgaggggcgagggggtccagatatgctaacaccgcgcccatcgacgctgggcggctggacgccctcgcctggggtccattcatgcgagggagctgaccaaagcccatgagttaacaatcaacccgagaggttcgttgaccattcccacaatacccaaagcattatcccgggcccctgctcaccgggttggtagagggagatgtcgtcccaggcggaggcgtccagggcgtcggccaggttcacgatgtagcctgcgcgtagggttgaggggcatggccgccgttgaggcagggacagccccgatcacggcactgatctcactcgatccaccctcgtccccgcctcacctgcgtccctaaactccacccggggctgagcggccttcccggacccttggcggcgctgggtgagccccgtctcgggccactcgagggtctgcagggccaggcgtcgagacagggaggccctaccccccgcgaccccaggctccgttcggccccccaggctggtcggggagccgccagtgagtcgcaggtaggctatcgggagggtgaggaaggccagcccgtacaggatggccaccgcgaccagcaaattcctccaggcgcccatgcccggccgaggccagccggcgctgtgcgtcagaccgctgctgctgggggtgcgggaggagcagcccagtccatcgctggattgaccgcgggatgccaggaaggacagcccgccggtgaaggggctgctgcggctggtcccgccgaaggaggggcaggtagcagaacggggtatcagggacatcatgtccctgcagaaagtgcgcaggccgaagggaggtgccgtttgtcaagacctgccagcggctcgaggaggggggtagagggctcgtagcggccttttcaatgtgacagcggtggggaaggtgcgggggccgagggcttgctggcccctttgcgaggttgcagggatgtgcagcgattgagagggcaagagcgggtcgaaccttgttgtaatggtaacaggggttgatctcagcagagccaatgtcctcggacgggctccttctgccctgcgtcgaagcaccttcaaaataccgcgtagcacttccctacgttttttgggcccgctttccaatccctcatggggaaggtgcccggcgagaatccgttttctcgatgctcccacccatgcaggggctgatgcgcatcaggcactcttcccagcgaaagccaaacaacaatttcacacaaggtgaatgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggccccgtcatcagctccgacccggtaagtgaccccgttgcattcgaggatttacatggtggtacaatgaaacttggggttcttgatttcaaagtggctgagaatgaagaaggactcagagcaggggcgaggctgggggagtccgtctaagcaaggatccctcgcacgccgagtgccgccgggcggacattcagtacgtctccgccacgcgacaccgggnnnnnnnnnnccggccccgtcatcagctccgacccggcaagtgaccccgttgcattcgaggatttacatggcggtacaatgaaacttgggggttctcgatttgaaagtggctgagaatgaagagggactcagagcaggggcgaggccgggggagtccgtctaagcgaggatccctggcacgccgagtgccgccgggcggaggacgttcagtacgtctccgccacgcgacaccgggtgtagtgacgcatgcacacgctctgctgcacatgctcaaagtcgtagcgctccaaaagtccgactttctcctgcagacataagggtcggtgtaaaggctggggactctggggcgaatactcccacacaagattatctgtccaaccgttgggaaccccgcgctccgcacccgcagcgccaggttctcgtccttgatctttcggttccgctcctccagggcctgtgccctcttcttggtagcatacaattcttgttgcacctagggatggtttggggggagggagatgaagggggtgctggaggtggagctgggtatgaacagcggcatggggagcgcaggcgacccgtgtacagtcagccaacaggcatggcgttgtgtactgaagcagccgcgcggttcacacatggtgcatgcactccttttccatgaggcgaactgcctccgtctcgtgagtgaccgtggccacggccccgactctgcagcttctgcttgggtgctgcccagggccccctccctcccgactcctgcaccgccccacaatcatgcccttcctccccatcccacccccactgacctggcgcagggccttcagggtcttgctggtcttggccaggttctccttggatacggtgcgcgaaaggtcggcgatgcgctgcatgcggtggtactccgccgccagctcggcgtgcttctcggccagcaccgcgcgcgcgcagaccgtcttcacgcgcccctccgacagctcgcgcaccacgcgcgtcaggttatcgcactcggcgctgcgccgcgcgagcgccgcnnnnnnnnnnnnnnnnnnnnnnnnnnnnnnnnnnnnnnnnnnnnnnnnnnnnnnnnnngccagcgcctcgcggtcggcgtccggcagggggcgcggcgcgggcgaccgcgcgcggcgcggcaggcgcagcgtcatggtcacctccgagtagcccggcgagctggggcaccggtcgctcgggtcgccgtcgtcctcggggaagtcggggcaggcgtcgtggtcggggaggggggagtcgggggcggagcaccgcaccagggcggtggtgttgctcttgatcagggcctcgaagaaggcggccttggcgcgcacgccggggctctcgcgggggcggggtccctgcaggctgggctccccttcggagcactcggaggaggaggggggggtgcagggttgcgacgtgcaggagctgccgcccaggctggcgcactccacctccttggggccgggcgggggccgccaggaggtcatggaggtgaacatgggcctcagcgggggcggatcatgcaaggcggagcgtgtggacgccggttgggcgggaccgcaccgcgcctgcgggcaccgtgtcggggggtgtgaagtttgaattcggcgaggcaagggggtccgcgagcgagttgagacggctgtcaggaggccaccacgacttgcgcagggtcgggctggggtgggaaggcagcacgcgctccctaaccggcttgcctccactcctcggacacccagnnnnnnnnnngggggggaagtttgaattcggcgaggcgaggggggccgcgagcgagttgagacggctgttaggaggccaccccgacttgtgcagggtcgggctggggtaagaaggcggcacgcgctccctagccggcttgcctccactcctcggacacccagtggcgggctgacttccatgcatctcacctggcgtgatcgagcgcgtcggcacctgaatcagccttgaatactcttgaaatgacagagtatggcagaaattcgcggctgtgccgggcctacggcgaagaaggtcggggtgcacactcctgaccacggtcgcccgccctccgagtactcgggtgcgaagagcacctctctggacgatgtctacgccgcaatggccatctgctcatgtgtgattgccgttggaggggttgagtcgagcagatttggctccccgagaaagtcgcctcggcaccacccaaactaatcccgacacgcatttcgcgggagcaggttnnnnnnnnnntgagcacctttggcttcacgagaaagtcgcctcggcaacacccaaactcatcccgacacgcatttcgcgggagcaggttgaccctgcagggtgccacagacatcgaggcctatcggcgtgacttgtaaatctcttggcgctcatcgtgcctcactaggtacacttgtaccccagtagttgaccgtatttaccccgaccacgcaccggtgatcacacaaccttctcccagtgcaagtcatatactacaccagcccgctcgcgatggaatcccgtcacgatgcagcatcattcctggaccaacctgtttccatgggggtgagtgatggaggctgtgtgctgcggggctcaggcgctggtcccgctgcttgttgcagggaggcactgggggcaacgcactccgagcctgccagctgacctgcatcccgcccctcaccgcagactacgatcatggctgcaacattcgacggcggagtgatcctgggcgccgattctcggacgtcaacaggtgactatattgccaacagggtaacagacaagatcaccccgctgtccgattctgtctacatctgccggtcgggctccgcggccgacacgcaaaacatgtcgcgctacatctcctggttcctggagcagcacgagatggacctcggggaggggccgcgggtggagacggccgccaagctggcccagagcatggcctaccagaacaagaaccacttgcaggcggggctcatcgtggcggggtgggaccgagtggccgggggcagcgtctttgccatacccctgggtggtaccatcgtcaatacccccttctccattggcggctccgggtcggcctacatcaccgggctctgtgaccgcctctggaaggtgcgcagggcgcggggcttgcgtttaccggagagagggtctggcgagggacggcatgcagggcattcaccgcatggatgggtgacgtcacgagatcctggaaagaccacgtcgaggctggcaggcatcccctggtgtgggtgggtagccagggccacgcggacgacgtcctgcagtcgaggggctcgctgtacccatcaccccctggtcagcgcgccatgcaccaacccctgctccaggcaaacatgacggaggagnnnnnnnnnnatcacgagatcctggaagaccacttcgagacgggcaggcaccccttggtgtgggtagccagggtcacgcggacgacttcgtgcagtcgaggggctcaatgtacccatcactccctgctcagcgcgccatccaccaaccccctgctccaggcaaacatgacggaggaggagtgcaaggcgtttgtgatcaaggcggtgtcgcacgccatggctcgggacgggtcctcgggcgggtgcatacgcaccgtgatcatcaccaaggagggggtgaggagggacttcctgccgcacaaccgcatcccnnnnnnnnnnttgcatacgcaccgtgatcatcaccaaggacggcgtgaagagggacttcctgccgcacaaccgcatccccataacgcatggcgagctacctcatcccgagccacaatcggtggctgctgcatgaccgtgcggctgcatgtgctgtcaaagctggaggcaccgtgatcatgaagcagggatggatgtcaggtctgtgaagtgtcgcgcttcacgctttcacggcggatacaagtcctcgaggtacgtacagcacacatgtatacacaccgtatcatgtgtacatcacttggagtaagcatcgttactattgggactctctcttcttgaataatctgcgcgacacttcggctcacctagcgaatgggtacctcgttggccggtaaatccctctctggaggctcgattcaggacagcgaggtggccaggttcggcatcgttacagtgagcgatcgcnnnnnnnnnnccatccttaccattgggactctctcttcctgaataatctgcgcgacacttcggctcccccagcgaatgggtacctcgttggccggcaaacccctctctggaggctcgattccggacagcgaggtggcaaggttcggcatcgttacagtgagcgatcgcgcctcggccggcgtgtacgaggacgccagtggaccggccatcttgggttttttccacgacgccatctcgacaaggtaggtaccggagcatatgggcgggccaaaccgcgcaccatcgcccaaggggccgtggagtgactgctgacagtcgccgcatcagtctctgggtccatcccagtacactctccacagatgggaggccgagtaccgctgcgtcccggatgaccagcccaccatagaggccaccctcaaggagctggttgatcaagcccgctgttccctggtggtcacaaccgggggaacggggccctcgccccgcgacgtcacgccagaggcgacggcgtcggtgagcgggtgcccggctcggtgccaggggcacctgcccgcgccagtggcggctgggaaccactcgcctggtcacccaggggcgttggtgggcagggtttgagggtgcctgccccacctgcccgaccatcgtcacctggcctccacccccacccgcccacnnnnnnnnnntggctcggtgccaggggcacctgaccgcgccagtggcggctgtgaaccacctgcctggtcatccaggggcgttggtgggcaggttttgagggtgcctgccccacctgccccacctgcgggaccatggtcacctggcctccacccccacccgcccaccccaggtgtgccagaggatgatgccggggtacggcgagcagatgcgggccgtgtccctgcgccacgtccccaccgccgtgctctccaggcagaccgccggcctgcggggcaaggccctgatcctgaacctgcccggcaagcccaaggccatccgcgagaccatcgacgaggtgtttgcctccatccccgcctgcatccgcttgctggggggcccagacatcaggacggacgactccgtcgtgaaggccttccgcatgcccgacgccagcctgccacccagggaagggcgctgagggagcgcgtaccgcaagggcgctggccccacaccctttctggcagtgctccctgtggcgagcgttcgtggcttggcccnnnnnnnnnngcccagggaagggcgctgagggagcgcggaccgccagggcgctggccccataccctttctggcagtgttccctgtggcgagcgttcgtggcttggccctctggagtggtgccgctccggccgctctcgtgtcacagagccggagggagtgcccatcttgcacgcatgctgggcgccagggcaccgcccctgccagccactcggcctgtgctgcatcgagcgcctcgccgggatccgttgtacaggggaacgcagtcaggcaaattgccatggcatacagaagcgtgaggtcatacagcgtgggcgtcctcagaagtgaacccccacaagcgtggtcatgtatgatgctggcgatgggtggagcggtcagccggctcaagctgccggtgccgtgcagcactgagtttgcaccgtcccactcctggcgggctccagccactgacagcctggcgccagctcagcgagggctccccattctcgccgccgctcccgcccnnnnnnnnnntgctgggtggaggggccagccggatcaagctgccggtgccgtgcaccactgagtttgaaccgtcccactcctggcgggcttcagccaccgacagcctggcgccagctcagcaaaggctccccattctcgccgccgctcccgcccggccccacgacggtaggccgcccccgcctgggagccggtctgcgtgcgcgcctctcggcacgacctaaagtgcgcgacgaatttgaccccggcgcgcttagccggcgacgacgcgcnnnnnnnnnngcgacggcgggccgcccccgcctgggagccggtctgcgagcgcgcctctcggcacgacccaaagtgcgcgacgaatttggccccggcgcgcttagccggcgacgacgcgcgccgcggacaggtccccccccacgcgcaggaaattgcagtgggccaggcgcgccgcggtccagcgccgccccggccggcggcgcagcaggcggcgcagcgcgcgcgcggcg

SEQ ID NO: 37819 - DNA, 108 bp, Chlorella protothecoides
cccagtagacaatgcagtccccgcgaccagcagctgtcactcttcaaagcagcctctatcccttgccgtccccacaatcgtcagcctccagcttgccgcaccgttcaa

SEQ ID NO: 37820 - DNA, 100 bp, Chlorella protothecoides
gccaatcctcatcacagccacactgtccaaataaattcagggtggaaggcatcggagtagtccacaccctggcatgcacctccatcgctcaccatactga

SEQ ID NO: 37821 - DNA, 78 bp, Chlorella protothecoides
gagcaggcgctctggcgccaggcccgctccatgcacctcgtgcaccagccggtccagcaggcgccgcagcaggccgtg

SEQ ID NO: 37822 - DNA, 64 bp, Chlorella protothecoides
atacatgtgtagctgtgccacccatctgtcaaaaccctggccgccccctccagggtgcaaggaa

SEQ ID NO: 37823 - DNA, 63 bp, Chlorella protothecoides
atggcccacgtgccggatttcgaaacgccctcactccgccctcgatacccccatcctatatcc

SEQ ID NO: 37824 - DNA, 233 bp, Chlorella protothecoides
tacactactccggtgggcggggcgacgcggtagcgcagagtgcaggggggggaggaagtctgcagggcacccgccgaggtgcctgctgggctgtgccctgcgcaggcacatcaggacgggccttgcagctcgatgggttctacatgttccaacccccagccaaaacaggcgtcgagtgttggttcaccccccatcacccgcaacttgcagtcgtgtacctggacatggccgcc

SEQ ID NO: 37825 - DNA, 21021 bp, Chlorella protothecoides
  modified_base (606)..(615): a, c, t, g, unknown or other
  modified_base (1188)..(1197): a, c, t, g, unknown or other
  modified_base (3134)..(3143): a, c, t, g, unknown or other
  modified_base (3750)..(3759): a, c, t, g, unknown or other
  modified_base (4918)..(4927): a, c, t, g, unknown or other
  modified_base (5098)..(5107): a, c, t, g, unknown or other
  modified_base (5659)..(5668): a, c, t, g, unknown or other
  modified_base (7416)..(7425): a, c, t, g, unknown or other
  modified_base (8647)..(8656): a, c, t, g, unknown or other
  modified_base (8735)..(8751): a, c, t, g, unknown or other
  modified_base (9469)..(9478): a, c, t, g, unknown or other
  modified_base (9557)..(9692): a, c, t, g, unknown or other
  modified_base (9952)..(10072): a, c, t, g, unknown or other
  modified_base (10307)..(10316): a, c, t, g, unknown or other
  modified_base (11358)..(11367): a, c, t, g, unknown or other
  modified_base (12144)..(12153): a, c, t, g, unknown or other
  modified_base (12550)..(12559): a, c, t, g, unknown or other
  modified_base (13766)..(13775): a, c, t, g, unknown or other
  modified_base (14103)..(14112): a, c, t, g, unknown or other
  modified_base (14294)..(14303): a, c, t, g, unknown or other
  modified_base (16941)..(16950): a, c, t, g, unknown or other
  modified_base (17989)..(17998): a, c, t, g, unknown or other
  modified_base (18821)..(18830): a, c, t, g, unknown or other
  modified_base (20018)..(20027): a, c, t, g, unknown or other
  modified_base (20333)..(20342): a, c, t, g, unknown or other
  modified_base (20543)..(20552): a, c, t, g, unknown or other
ggccaccgcgcggcgcggcggcggcggcgaccgcccctccgccacgtccaccagcgcgcggtggcggtccagcgcgcgctgcgcctcgtcgttcagctccagcgcggaggagagcagggcctcatcggtcacgcgctcggccagcgcggccaggcgcgcctgcatcgcgcgcgcctggtcggccatgtcggtgatgtagtcctccttgaccccggcggggtcatccccctcctgcaccccccccagcacctcgcccagcagggccaccgtgttgcgcgccacctccaggtcggcctggatcttggcggggggctggtcgggggagagcagcgccaggccacgcccgggcgtgcccagcggcgagcctgggtgcccgccatcccctgcgccaaacaggtcggcggcggggttggtgcgccccgacccggggggcgccgtgtcgggcggcgggccgggggacaggccggggtagggctggaagttgccgctgggcgcgtgctcgccggaacggggcgggaaggtcatgccccgcgactgtcattcggtcgttggagggggtggagtggttggaaaataatggcatgcaacaagtttggtgctccaagnnnnnnnnnngttcgatcattggagggggtggaggggttggaaaacaatggcatgcaacaagtttggtgctccaaggtgcaccgctgctgggctgtggtggaagcaagacatgctgcaggtctgggtcaacatcttccaatcccaccgacacccggtttctccccttcctcacgaacacaagaatgaagaggcatgcgctccacccccccaccttgagcttgttgtagctgttcacgaactgggaggggcgcagcgtgtaggcccactcctgcagcagtgccagcacgtgctgctggacctccggcgggcaccaggccgagcggtcggagaggcggaccagctccggcagcagttcgctcacggccagctccttgtggaagggctcgccgcaggtgcgcacacaatgctccagcagctgcgggtgggtggggagggggaggtgaggatgggccgtgcccagggaccaggctgggctaggctgggtacctgcaatatgattggctgccaggggctacaccagacatgcgactctagacggcagcgctgcacctacctgcagggcgagggtctgcacatggcccnnnnnnnnnnttgtgcccaggggccaggctgggtacctgcaagatgattggctgccaggggctacaccagatatgcgactctagacggcagcgctgcacccacctgcagggcgagggtctgcacatggcccctcttgcactgcaacctctttttgagctgcttgcaggccttgttggccatgtacctgcaaggatattgttttttggggggggggaggggtgatcaaggagaggtcaactgaagcagaagcactcagcaagggctggggcgggcgctgcactgcggggtgatcagggcctgccacaccccaggaagacatagtttcctcaagcatgggcacatcctgaggcccagtccgatccacggtgtgaaatccagcgccatgcacggcaaatgcgggtcgccatcctcatcatgcccccctggcaagggcacaaacccaacatgcgcagaggtgtgtcactcactgcggctctgtgcccccagatatggcggaggcgatgtcggtgtacagggcaaagttgggggcagagaggttctcggcggtggcgtggtcgatgatggcgtacatgcgctccttcgccatcctgagcgccttcttgttctgccgggaaggtgcctggaggggggtgggagcgggggggtgggactggagggacaggagggcatgtgcgacgaacaaggcggctcgaaagatccatggagatatcagaaagctgcggcatcatgtctccagctgcgggcaatgcacgcggtgtcttaccatggtgaacattgtccccccgggcagcgagcagagcttctcgcgagtgcctccaagggtttcggtggtctaacctcacgagatattaagatcggggccaggctgctctagtccaccgcagcctcactcttgcatgggcccgtccagattccgctcgaacaaaatacgcgcggacagaggcacgccgaggagggttttcgcaacagccgcgctttccagcatcacaaactcccaaaacagctcgggttacgacaggctctgaacgacgagcacagcgacgtgctgacccgatgaaatctgaatttgtacaggcataataatctcgcggtacacatcttcttgctggagcaccagttccgctcggcaccgatgcagaggtctaaggtcgggaggtccccaaggcgcagctgtgccgacgagaaaggtaccgacaaggctcccttgcctgaaaatgttagcttaatgcctgtttcgcctaaaattagcagctggacacccctgtaggtggcaggggaggtgagctggggttagtcctcttggctggtgcagctgccctaggaggcgcattggtgcaccgcctgttcacgcgacaagaggtcctagcacaaatctctcttcggcaaggtaaatcacgaggctggggggctgcatggtacttggtcctccctcggtgccgctgtcccagtgtgctttcaccccaaatattgctcgcacatgccaagaatacacgcctcttggcagcctcatcaagcggcttcctattccccttcaccttctcacagaagagctcatccggactcagtccgcgctgtcgtccaccacctcccagctgagcgacatggcagacgagctgagctgcacgcgcgcggtcctccgcacaacatcccttgacctggccgccaaagtgcaggagctggaggcaaggcggcgcgatgccgaggagttgcagcaccggctcgaggaggccaagggagagctggggctgacgcgaagccgggtgctgagcatagagagggagctccaccgcacacgcaggtgaggggccagtcacatgcgccatcgattgagggtgccattatcgaggggatatgtatcaacggccgggttgtttcatcacgggacagggcctacgtcgatgtcaccgcagtaaagtccctcctcatcagccgagtctgatggccgnnnnnnnnnntcctacgtcgatgtcacagcagtgaattccctcctcatcagccgagtctgatggccgcccctctgcatttccatgctgcagctcgctgggaacctaccagagccagctggatgcggctcgctatgagatggtagagtcgaggcttgccacggaggggagttggtaggaggtgccagagttcgtcgtgcggatactcaataccggtcgtgtcggctgtgatgtgttgtatgtagcagagcattttcattgtttccccctccatgctgggaagtgacttcgtggctatgtttgttcaaaaccctgcttcccgggaccaaggctgacaatgtctcagcgaaatgatcaagctcttgaatcgtcagaataaattgtagagccgctagaacgctgggagctcccggcagggtgtttcacaagatctcatgggcaaaaggttttcaggctttggttctcgggagctggtctggggtgaagtttgtggggcagtagggaaggagaaaaatcctttaagcccagcagggatcactctcttgagcggagaggggaatcgaatcaattttgacgcattgcacatcggcttgcgggggtccgcaagtttgcgcgcctnnnnnnnnnntgaaaaatcccttaagcccagcagggatcactctcttaagcggagaggggaatcgaagcaacttttgacgcattgcacatctgcttgcgggggtccgcaagtttgcgcgcctgtgtcgtccgggtcaccggccagctcggccagcacgtttcttagtcaagcagtgctatttttaggtagccgcaggagtgtgaaggctcgatgggaaggttttgttcttgcgaccttcacaaatatcgtgtttgatattttacttgttttttgaactcaatcgaagcgtcccgccgttagccatacagtacgaccggggccccagtcagccctggtcactcctcacaccagcgaacagcggccgtgattcgatcctgcaaaccaatggtgacctccacgagcactcttttgtgcaccggaagatccggcatcatccttcaagtgccccatgggtcctttctcacgcggtcaggagctgctaaggctttttcttctcgtcccgggcgggcgcgccccgatctggggagacgagtgcaagcgattctagctgaggtacaatgcagtctgcagcgcggctcaggcatgtactcctcgattacactaccaaatcttatcagtttctcccacctcgacctccccagcccctcaatctcgagaccatgaagccttccagctcggtcatggatgtcaccaagcccggcgacgagcgcagccggggagaagggatcaaggccgtagaggagctcggcagcatgcccatcatctacactccctggctcaataagggtgcgagggtggggtcttgggagcgggcgggccaggtcacgtttgtggtgctgggtggaagttcccagggttaaaccgcacgtcgggtgccctccggcgaccctagggcatggacaccgtcgcttaataccgtttgtccccatccttacccctctcataggcactaatttctcggagtctgagcgacgagagaagcacctggatgggctgttgccacccgtgattgagaccttggacgatcaggctgccaggtgcgggtgggagatttagatcaactggcagatgatttgttgaatctggggtaccagattggtaacatttcgattgtccagtgcttgagtttagtatatcaattgtataggatgggcaagtagcctagcannnnnnnnnntcgattgtacagtgcttgagtttgatatattaattgtataggatgggcaagtagcctagcatactgggatcaatgctagggtggatcgtgcttctgtcccttcattgcccacgaagctcatactggagatcacatttacatttgatattctttctgcaatgttcatgccannnnnnnnnnttgtcccttcattgcccacaaagctcatactggagatcacatttatgtttgatattctttctgcaatgttcatgccagatcatggcaaccatttccgctatcttatatgacctccagctctccccttgctgcatggatggcactctggatgttcccacccaagggcatgccttcacccctccccagccccggcaccaaatggtgagcaggttgatgacccagctacggaacgaggacctgaccaacctgcagcgcaacaacatcctgaagcagatcatggcgacccacaccaccctcttctacaaagctctgatcgagaacatcgaggagctggcccccattgtgtacacccccaccatcggcgaggcctgccagcgatggagcaccctcttccgcgagcccctgggcatgtacatctcggccttccgccaccgcggtcgctttgacgaggtgggctggggaacgtttctgtgggggccaggggtgggggtggggaatcaagggctgggtgctttcttgtcgtgagttggcgtgaggcaagcaagcaccagnnnnnnnnnntgttttggtggggggcagggttgggggtggggaatcgagggctgggtgctttgttgttgtgagttggcgtgaggcaagcaagcaccaggcggcggtggtagggtgtgctgtaagcagaggcctctggggtgataagcctcctacctcccgcatcctgtgtgtccattgcctgtgtcccacagcacctcatcacatctcctttctttcctccacaggtgctgggcaactggccaaacaagaatgtccagatcatcgtcgtgacagacggctcccgcatcctgggcctgggggacctggggaccaatggcatcggcatcagcatcggcaaggtgtgccaggatatggctgcgcgcactggtcctgctcttcctgcagactgacggtcttgtctttatggtgcgtgcctggggtggggccagctcttccccccctcaaacacctcccctcgactccccgccgcagatcgcgctgtacgttgcggcggtgggcttccacccggagcactctttgcccatcgttctggacatgggctgcaatcggaaagaactgcgcgaggacgggctgtacctgggcgaacgccgcgagcgcctggagggcgaggagtactacgctgccgtcgacgagttctgcgccgcggtcaagcggcgctggccgcacgcgctgctccagttcgaggactttgagacgagcaaggccttcaagatcctggaggcgcagcgcagcgccatgctctgcttcaacgacgacatccagggcacgggggcggtggtcacctcggggttcatcaatggcatgaagtaccagggcacgcgcctgcgcgacgcgcgcgtcgtcttctacggcgccggctcctcggccgtgggcgtggccaagagcatcgtcacctacatgcacaaggtatgcgggtgggtggggtgggggaaagaggggggggagagggagggggcgaatctgggcggggtgagctgaagggggcgggctttgacagggacgaacctccgccattctactcatcctgcaagtcagtgcagccttccatcgccctgccaccttgaactccccctctcctgccctacaccccttgcgtcagactcaccccacctttcctcgacacagtacccccccaaacccccaccccccaaacattcacagacggagggcatcagcgaggaggaggcgcgggcctgcatctacatggtggactccaaggggctcatcaccgacactcgcggcgacgagctgccggagcacaagcaggagatggcgcggcgcgatggcgtgcccgacatgaaggacctccgggagatcgtggagtatgtcaagccgcatgcgctcatcggcctttccgccgcggggccagtctggaccgagcccatcgtgcaggcgctgtgccagggcacggagtcgcccctggtgttccccctgtccaaccccacgcccaaggccgagatcagcgcggagaacgcctactcctggagcaaaggcaggtgcatctttgccggaggtgaggggcccgaggggagggtgggtgggtatgttgaggtccccgagggtagggaccttcctgttgctcgtgcgctcgctggtcatggggttccagagtgtggaggtggaggccggcgaggggtggttccgtgggacggggtcagccgggcttggggtcggcaaaccatttgaagaaaacagatggcgcgtttgtgtttcaggttcagggcaggcggctggaggtaccagccaggcatggcacnnnnnnnnnnccagccgggcttggggtcggcaaaccatctgaagaaaacagctggcgcgtttgtgtttctggtttaagacacgcggctggaggtaccagccaggcatggcacgaccagcccatgccttgcgccaccgctccctaaccccacatgcacaccgaccccccctcctcacccttgccacaggctccccattcaagccggtaaagtacgatgggcagacctttgtccccggccaggccaacaatgtctttgtattcccaggtgggagctactgtgcagaatggggacaactcccagacccttttgccatcgctgccgccgcgtttcacttgccagcctgtgtgcacgctttgtcaagccctggcgctcccatcccccacccaaaccctccctctccacccaaatcaggcattgggttcggcgccatcatggccaaggcctcctcggtgaacgacgagatgtttgtggcggcagcggcgggcctggccgacgcggtgtctgaggcggagctgcggggcgacaagcgcctgtacccgcagatcagcaacctgcgccaggtgtctctggacgtggccgccgccgtggccaaggccgcctgggactcgggcgtgtcgcagctgaaggaggcacctgccgactggcgggcgtacgtggaggagcggcagtggtggcccgaccatgcctccaagcagtcggccgccacggcatgaaggtcactcaattcttggaggtgctcaaccagacgactcgcacgctcatgcatcgggcggggtcggatccgtgcaccgcccactctcagtcatctgctacatttctcgggctgggtccgcaccccttgtgcttcctgcctcctcctggtcgtccctcacaatctcagcgcttccacgcatgcatgtggagttcatgacgacgtcagtcttaccctcctgcactccccttctccttaatctctgcttgctagcactgactttagcccatcatttcaggacactcaatctggaagacatggataccatgtaccccactgtaaggcggttggtcttggaccaaagggttctgccagagcctgaacggacctcaccgcacatggggcagtgatggcgcaagacgctgcacagcagccgaagcagcgcttgaatacaaacgccatgatgcgagcagacgacatgagcgatcattgcccacttcaggatgctcctgctttaccgaccccggcgacacacgatannnnnnnnnnaggggcagtgatggcgcgagacactgcacagcagccgaagcagcgctcgaatacaaacgccatgatgcgagcagacgannnnnnnnnnnnnnnnnttccttcatgatgggggcgctgggtctccaccccacccgcccgcgaactttgcagcatggagaggcggtgcgcaaggaccttcttctccttgaactggacgatcctattctagacgagcttctaaccgatgggtgagggctgcatggtagctccggcgctcagatctcagttgaggatgccccttgaacgatggtgtctgggatgccccactggtcctcctcctcaccgagtgtacctcgctcccgccaagcagcctgcagataaagggcgaacaagatggtgatgcggtactgtgcacgcgtgacaccaccttcgtgctgaagactgttgggacgacaaacaccatctatctggctcgcgatgagcaggtctgtgctccttgatggctgtggcgcccagctgatggcagatggtgtgctgggggtgctgcatgtgcagcaggatcccaacagattgtgggctgcgggctggtgtttgtgccaggtttgcagtgcaagctcaccaggcacatggtttggtatcgattggagtcaaccatttgccacaggtgcctcttggggagctcacacagaaccagactccctgtcccccgaccccacccggccagacgctgggcctggccacgcagagggaaaaggtgtacatggccgtggcgtggttgtaacccatctgatgcatcacacctttcgtggtttgggtgtccagtgtctgcacagnnnnnnnnnnaagattgtgggctgcaggctggtgttcgtgccaggtttgcagtgcaaactcaccaggcacatggtttggtatcgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacatggccagggcatggttgtgacccatctgatgcatcacacctgtcgtggtttgggtgtccagtgtctgcacagctcacgactcgcacgcacccaaagaactgccctgatgccctaccaagcaggaccaacgttactgcatacaaacccgctgcatggtcacctttgagagagtctcatccctcacctggccatgctccggcacccgacccaacccctcccttcacccgcatgccatgcaggactccgcagcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgcgctgctccaggttagcaggccgtggcgggaggcctggactgtgtctcatgtgggacactggtcgtgggaccagtgtgaatgctgcaaatgagctacggatcctccatcagccctgctgccaggctagatgatttggcaacacatggggttgggggaatccctgtatcaagtctttcatctccgcccctccccacaccggcgtgccggacaggcagccccgtacatgggcnnnnnnnnnntatgctccggcacccgaccccccccctcccttcaccgcatgccatgcaggactccgcagcttccgcccggccaccaatcaaggtaatagccacagtggagacccacatggagctggtccccatcgcccctcgcacccaccagctgaatgcgctgctccaggttagcaggccgtggtgggaggcctgaattgtgtctgatgtgggacatcggccgtgggaccagtgtgaatgctgcaaacgagctgcggagcctccatcagccctgctgccaggctggatgattttggcaacacacggggttgggggaatccctgtatcgagtctttcatctccgcccttccctacaccgtcgtgccggacaggcagccccgtacatgggccccgaggaggagggcgacctgcgttcgaccccggcgcaggggcggtgcacgctggccgacctgctgtcgcacgtgcagatgagcgagggggagctggccgccgcgctggcgcagcggggcgccctggagctggacggcaggtggtgcgcgctgcacccctcctacgcagacaccgcgctgcagctcatcttcctctgcgccggggagcggggctgggacctgggcgcgactttgccccgcgccgacatgcacgctgcgctggagcagagcggcatggacccccgcgtggcaggccactgcctcgaacgctttgggcgggcgggggtggcgggggaggactgggcgctggatccaaaggaggcgtgccggcaggaggcgcggcgccagctcagcgagcggccgacctggagttgtggggactttgaggcgtcgctgcggcacgcgctgccagaggtgcgttgggagggggctttgtggacgtgggcatggaaggccgccgacagggtgactgcgtgaaatcacagggggtgggtgggtgaggcgctaccactcaacggagcaggctcacctccctttgcatggacacagccttgatccttgtcagaaagtgttgccacaatttcctcgcccaccccccacccccttcctccaaacacacagannnnnnnnnngcagggggactgcgtgaaatcactggggggtgggtgggtgaggcgctaccgctcgagggagcaggctcacctccctttgcatggacgcggccttgatccttgtcaggaagtgttgccacaatttcatcgcccccccccccacccccttcctccaaacacacagagcgtccccgccgacctctcctgcctgggtggcattgccgtgatcgacgaggcctctgccaccctccagtacctgcccctggactctctccccgccgacccagcaggccgctttggcgccctatttgccatgaggcccaggtgcggcctttgtccgatggtgacccagctggcctgggagatgtgatgcaggcccctgcaggctgggtgcagtgcatggccatcaaccatggccttccgggcaccctccctcacgcccgcgcaaccccgccccgccacaccaccgtctcaaacacaggtggcgactggaggagttggagccctacctccagggcctggcggacccgggccaatccctggaggggctgctcctcaagtatacacgagcaatccaggcccagccctcatgcccagtgctctacgccgcgcggtgatgaagattgctcattcttctggttcatgcaacgggttacaggcggcatgcacgtcctctgcctattgacaaggcgcggagaggtgggagtgttgagggacccacaccccagctcccttgattgcgatgttcgcacacagccacacatcaaatcagctgacaaagctggccaggtacctccnnnnnnnnnngttcacaaggcgcggagaggtggggttgttgaggcacccacaccccagctcccttgattgcgacgttcgcacacagccacacatcagatcagctgacaaagctggccaggtacctccccttgtcaatgccgtcaaggcacactgccgcggtgtagttgttgacgtagtggaagaaggccatggtcttctggttgcccatgcctgggatgtgtgcaggtgctggtcagaggtttttgggggtagggcaatgcagggctgcacgcaggggtgcttgcctgggtgctgctgtgccagtgcagagcctgttgtactacaaacccacatgtctccccacaacacacacaagaaggaagtacactttcaaatccaccagctcacccgaccctctcttcatctnnnnnnnnnncgcactacaaacccacatgtctccccacagcacacacaaggaaaaggtacactttcaaccccaccagctcacccgaccctctcttcatcttggcctgatactcctcctcgctcttcagcgcgtagtggtacagcgccagcctgtccgaggcctggcgctccgacttcgggccgtccacgcggtcgtgcgtcgtgttgacggcaaagtacggctccacgtacttgaggtggtggggatcggtggtgccccccgccacgcgcgccggctgcacaatggacttgacgtgcagattctcgctgtgctggtccggggcgcacatccagaaggaggccaggggctccagcggggagcgcacctggcgaaggaggtgggggtgggaaagggaagcatgggggaaacagtgaggcagaggtgggaggacaaaggctaggggctggaagcagggtgcacttgtgtgtgcaggaacactcttgccgtttgccgtcccctgctggcaggcggcggacttcatcgcgcccgatcagcccctcggagggcaatgctcagggcagatgagacttcaatcaccaaaaagcaagcaatccctttccccctatcattgatgccaggccccacaccctcctcaccgtctgcccggagctgccaaacaccacccagttgaccaccagcgccccagccgactcgtagtcgtggaggagggtggggaggtcaggcgtggcgtccctgatcaccaggaattcgtccaggtcgatcagcgccatccacctctcattcctgtgcaggagggcacgtgttgggggagtcatgtgcgggtgcgaggtgtggtatgtgatcctgcatgtcttccattcactccctccccgaattctccctatttattccttctcccctcccccccagctctgaaccacacatcccaccactcacctcttgctggccttggcgatgcactgctggtaaacgccgagctgagggccatgggtgcccctggtgggcaggatgcccgagtcatacgtgaagtccaccaaccccgagtcgatgtggtcctggagcacactctgcatgctctcgccggaccccgtgtccaccaggtagaacttgcccacgccgatggcgcggtggtaggccacccagcccctcacatctgtgtgctggtccttcatcgcggcacagatcgtggcgtaggcggggccgtctgtgggagtgnnnnnnnnnnaccccgcacatctgtgtgctggtccttcattgcggcacagattgtggcgtaggcggggccgtctgtgggagtgtgtgacgggaggaggaagtggcttgggctggtggtccaaggagccagcttggtgtctcagcactcctcatgcccagggggggggtggattatggaggcggtggactgcggtgcccaagtgggtcaacctagcagagtaaaacgcaagagtggtcagcgctatataggcaggatgcgccagccagcgatgtcaacgccatcctcatctcaaaaatgcatgcttatacccaccagcggcttgaggggctgcccgggnnnnnnnnnngcagcgagcgatgtcaacgccctcctcatctcaaaaacgcatgcttacacccaccagcggcttgaggggctgcccgggctgggctgggcggggaacttgcgctcggctgtcctccgcccggcgcggccctcgtagcagctgcttgcaccaaccccgctatgattggcacgggatttgcggcnnnnnnnnnnctgcgctcggctgtcctccgcccggcgtggccctcgtagcagccgcttgcaccacccccgctatgattggcacgggatttgcggccttagcagccaggctgttgctgggtgagatgtggggcaaggggctggttgcagattttgccccagcccccacacgtggctcattgccagggctcactcccccagaggcgggccccggtccagccgatccctgcgggaataggatcacgagattgaatcgttacgacgtgagctgtgcggtcaaggttgccagaggaagggcgctctctccccctcccccggcacctgctcctcggcgtacaacagtgaccggaaacccgacacccctcggcgccgcaggtctgttcgagcacggtgagggtcggacagtggggcagtttctgatgtggtggactggaggaagaagcaagtggcttggtagcccagcaggcacagaaagatggctacaggccacgaccaggaggtccgtctcggcattgcgcgtccttaagtcatgggccgtgatcttggtgcaccgggccgtcctgagtttgttacgaatgatgtctactgggcatcgcatgcaatggccatagatcgtcgccctggcgtttcccataccacgcggatctgggctccgcaaccaccccgtgctgcgggtgctgggatggtcatcgtgactcgtggtgtctacgaatgttggcaacagacgcatattgagcaaccacaataaatagtcttcgagatatatatcctgttccgaccttggatccaggttcccctcagccgtatgctctcggcctccagatgatactggtgagttacagctgaggcatgacagcacatgtgtaattgcttgacatggacgccaaatggatgcaacgaggtcatgggcatgtttgtggggtggggtgtaccatgctcaacatagttgagcagtgctgtgctctgctcctaggaattccaggcgaaaacgtggcctcatggagtgaacagagaagctcgcctaagagtgcagagcagtacatccctgtctcagaggcaatacgactccgtaagagtgcgttctgtaggtgtgcgaggctgagaatggccctggcacaaagcaaagagcacagaattggtaggcgggactccccccgtcgaaggctgcgcgcacgaatctcaccagcgcgcatcaacctcgacctgtgattacctccgaaaagtcggtgggcccgacctagggagatgatgcaaatattcgcgcttgattagatatatacaccacgggagaggcttcccggccgtcttgagactggggtcagcagacatggcgctctgtctacggcgctctgtcgcggatttgccaggcttaatcggtctagcatcccgacatgcatcctttcaatttcacaccagcactgtagcgccccagatccctgaagtacccaaggagaccgtcgatttcggtgggtgaccaagtccccgtcgtgctcgtcccccccattcaagcactacagggctcgtgctctgatcaagggtatttgatcccacaacgcaggatatcagtctgttcctcgaacggagaaggagaccctggtaggaggggtcttccgcagtgtagcgcccagctatgatgtcatgaacgacctcatgagtgcaggcatgcaccgtgtctggaaagacaggtgatggtagggttgaagcgaccctggcttgggtacctgtattctgcacgcctcactgctgcgttttaggggcttgctgttccgggtatggctcccgtgcagctgccagagctttggcaggatgaggcattgtagtccccttgcgaggccaggtcatgggcttgcgaacctgaccttgccaactattacccccttgattcctccaccttgagtcccttttgacctgaatccgcaggttggtagagaagctgcggcccttccccggcatgcgccacctagacgtggctggcggcaccggcgacgtggcctttcgtgtcctgcgggctctgagggaggcggaggccgcggcccggcctcaggttcccgggcccggcccaagcaggagcgcgccgccccaaaaaggcacggtggtgatcgccgacatcaaccctgccatgctgctggagggccggaaacgagctgccggcgagggcattggtgaggtggtgaatggatgatggtgtgaactgagtttccagggaggttgccattgcaaggctgagggcgtggttactgccgttattaaattgcgtaagcagcatgtctcatcctgatctcaaccacttgagcacaagtccctgttgccggcttgaattgaccctccaaactccctcgcccagactcgtacgatctggagtgggtggaggccagcgccgaatcgctgcccttcccggacgacagcatggactcctacaccatctcgttcggcatccgcaacgtgacggatcgggacgctgctctgcgggaagccaagaggtagctgggtgggttgtccggtgggcgagggtgaggatgcggaattcttccctgttaccccagggtgctggagggtatgatgtgctcagctgctgagggtcaaatcccctgtatgctgaggtttcctcaccagactgtctgcaggaccaacatgtgtaatagctgcctcnnnnnnnnnntattcttcccctttaccccagggcgctggagggtatgatgcgctcagctgcagagggtcacatcccttgtatgctgaggtttcctcaccaggccgtttgcaggaccaacatgtgtaatagctgcctcggcgtagttcaccactttcttgtgtgtgtacctgccctttcgtgaccagactgtcaaattgtttccaggctcaccttcccccctccccgcctggttggatacttgcagagttctcaggcctggcggccgcttcttgtgcctcgaattcagcaaggtagtggtccccgggctgcagcagctgtacgacctctactcctttgccgtcatcccccagatcgggaggtgggtgggaggttgttgggaggactcttcttgtccccggggggtgggcagcccacgaggtggcccctccaagagtgctgttgcagcctgctgtgatgttgagcgatcctgggcctttccccctgttcacaactttcccaccaacgtgcagactggtggcaaatgacggcgccagctaccagtacctggtggaatccatccgcatgttccccgaccaggagagctgggcgcggcagctggaggccgcggggctggtgggcgtggagtacgagaacctgatggggggcgtggtggccatccactccggcttcaagctgcactgaggcttaattgcctactcgcatgagtgcataccatgaaaggtactggctgccgtcgtcacatgtggtaccgatggggtctgagcgcatgcgaggaagccatgcctgtccttccctccatcaagcgcacttgctggggcagactcggcgagaactcacacagaccagcatggctgtgaggggcatcgccgccatggcagtgcactgtgacatggaccaggggtacgcacctgcgctgcatgaatcacccagcagtcacgtgccctgctccaggaagctccactcgacgcgtcactgaccttaccctctcctgccagacaatctgcctgcacctcatcacgcacaggccatgttacagcctggcaggcannnnnnnnnnagaagctccactcgacgagtcactgacctcaccctctcctgccagacaatctgcctgtacctcatcgcgcacaggccatgttacagcctggcaggcacgctggtcatcaaccctcggcaggccacccctatgcggcggcaacggggttgggcggcggggcctctggcagcgcggcgacgaggccccgcggcaggcgtgcggcgccaccctttgccgcgccatcccccgccccctcctccgcgcgatacagcgtgatctcctgctgcttgaagtagcgccggtcctcctcgtccaccagcaccaggttcagaaagtacttgacgctgaagcggttgtgcacgctgtccacgctggggctaaggtcgtagggtgcgagaaagaggcggatggggatgacctcgccgcgcgcgggcgcgccgtccatgatctcgtacttggccacggtgtcggactcggagcgcgcggccgcgccggcgcccactgactcgcgccgcttgatctccagctccatgtgcttgatcttgacgcggacgaggaggaagaagatgcggccgatgaccacatcgtccagatggaaagcggggctgtcgtactcaaactcgatgtgcaggcagtcctcgatgcccacctccatctgtgcagggcgaatgtggggtgggggggtgggggggagatgcgctgtgggtgcgtggctgtgagtgcacgtgtgcacgactgcaatcgggtgggggaggaaataggaagcatcgcctggacagggtaaaccatgcattggcgacacaaggacaggcaagggcagtggggctcgagggggtaggaaagnnnnnnnnnngtggtggtggtggggaagcgctttgggtgcctggctatgagtgcacgactgcccgaccgcaatcgggtgggggaggggttagggagcgtcgcctggacagggtaacccatgcatcggcaacacgaggacaggcgagggcagtggggctcgagggggtaggaaagcgccgcgcttcctcctcccaggacacaagccagccgaggccccgcgctcaccttgatgggctcccctcttgggggggccggggagtggttgcgcacccagaaggggaagtccttcaccgtggactggcccaggccccgggcgacggtgacgcgcaggaggtacctgagccggaccttgaggcccaggtaggagtcgtgctgcatctccacgttgtcaaaggagaaggagtaggcctgctgggagggcaggtcgccggggggggccaggtcccgcaccagcgacaggaactcgtgggggtagcctcgctccgaggccagttcgatctcccccaccagctgcacgcggatgccggcgtggtccacccgcttgccggggatgggagtgatcttgacctgagggagggtagggtgtggagcatggggggggagggccagaggcggtctgaacgaccagcaacccagtccacccctgcccatgccagcaggtcgcacctccccctccacggtgtccttggaccggtagacgggcagatcctccgtctcatctctcctggaggccgagcgcgtgctcttcaccgctgcggttgggactccacccccccccgatcgccggaactccagctgcacggagcaggagtgcccgatgcccaggcccccaaacagcttgttctgtggaatgcgagcaagttgagcttagtgtgaggtcttcaaatgggatcaccctgtgtccagccgacgctgcaggggctgaaaggtgtacccaccgcaccatcttggaggaggggtttcagctcccagaggggcagcgctactggtcctgcggaaccgatgcgcgcacctcctccaccagcagtgtaacccacgacccaacaatcccggggccaacccccaagcctcgtcgacggaggtcaatgcccgacacactggggtgtcggggattctgggggaagggatacacttttgagccaggactcagggtaaaagaactcgccgcagtgtatgctcatagatgtatccactatgnnnnnnnnnntttctgggggaagggatacacttctgggccaggactcagggtaaaagaactcgccacagtgtatgctcatagatgtatccactatgagctgtgtacaatgatctctcaggtggttgcttccttcacgttgaagccccaactccgctcagcgcgcccgattggcgctcgtcagccatcggcaggaagcaggcgagtgatcaacatcaaaagtccagcagtcgcaaatgtcgttcagggaaaaaatcctcgacccaaatacgttcagcaagcttgaaactgccctgtgatgtccttccataggctcannnnnnnnnnccaggtggttgcttccttcacactaaagctacaactccgctcagcgcgcccgattggcgctcgtctgccatcggcaggaagccggcgagtgatcaacatcagaagtccagcagccgcaactgtcgttcatggataaaaccctcgacccaaatacgttcagcaagcttgggactgccctgtgatgtccttccataggctcannnnnnnnnnttgcaatggcatacctaacacgacgtgaatgtttcagtgctaccagatggcatgaagagacgctctgcagctttgtgaggatatcccattcctcacatcaaaatcttggcaaatagtagccaaggactcctatgccttacacctggacgctgttgtccgtggtatatactgggagctttaccattcacaaagtgaggatgcccgcgaggtccacatcccagcaattctgtcagcacgtcgtggaccaggaatcactcaagtggtagtggtgggatgacacctgagggagtgccccgaaagcattctgtcggggacattgggattgctcttattttcctataccttcatgccatcattatgttcggatcagctataccagatatagggagcccctgcattacccaaagaaatctaaccacacttgtgcattatgagatagcccatataccccatcgatggacaggatagt

SEQ ID NO: 37826 - DNA, 65 bp, Chlorella protothecoides
gttgtgggtcatgagcgatggaacccggggagatgcacatgaccaagaccctgccgcggcgatgc

SEQ ID NO: 37827 - DNA, 16695 bp, Chlorella protothecoides
  modified_base (1883)..(1892): a, c, t, g, unknown or other
  modified_base (2160)..(2169): a, c, t, g, unknown or other
  modified_base (3881)..(3890): a, c, t, g, unknown or other
  modified_base (4439)..(4530): a, c, t, g, unknown or other
  modified_base (4981)..(4990): a, c, t, g, unknown or other
  modified_base (5081)..(5090): a, c, t, g, unknown or other
  modified_base (7095)..(7104): a, c, t, g, unknown or other
  modified_base (7187)..(7196): a, c, t, g, unknown or other
  modified_base (7407)..(7416): a, c, t, g, unknown or other
  modified_base (7610)..(7619): a, c, t, g, unknown or other
  modified_base (9512)..(9561): a, c, t, g, unknown or other
  modified_base (11053)..(11062): a, c, t, g, unknown or other
  modified_base (11264)..(11273): a, c, t, g, unknown or other
  modified_base (13660)..(13669): a, c, t, g, unknown or other
  modified_base (13879)..(13888): a, c, t, g, unknown or other
  modified_base (14355)..(14364): a, c, t, g, unknown or other
  modified_base (15394)..(15403): a, c, t, g, unknown or other
  modified_base (15860)..(15869): a, c, t, g, unknown or other
  modified_base (16380)..(16389): a, c, t, g, unknown or other
ggccgcggcggcgggtggacgtccggcaagcgcgcgcccgccgcgttcaccatcgccgcgtgcacgatggcggcggcgggccccgacccggccgcatgccgtgccgcgccgcgtctggcgaccagcgccatgacgccgccggcccccagctgcgcgaggaggaggtagcccagggttcggtaggagggtcctcccccggcctcccgtcccgcggagatgtaccgcacgcccgccaggcgcttgggcagcgcgtagtaggcgccccagacatagaacagggccaggtggaagcgcaggagcgcgccgccgtgctcgcgcagcgtggagcgcagcgcgaccatggcaggccgctccgccagggagccggcggcgccctgcgcggcgcgcagggcctctcgcacacgacgcgcgagcgcagcccacgcccggcgcgccggcgaggcaccccggtgagtatcttcagtcccgcgctcctcgtctgcgcgcgcggccagctgcgcggactggcgcaggcggcgccaggcttcggcctcctcgtccacgggcgctcccagccgctccaggcagtaggggcccagggactggaggagggtcagggccccgcgctggagcggggaggggggcaggccgcggccgccagaagactgcaggatgtcacagtactcctcgcccaacgtctgccggcccgtgccggtggtgcaggcatagtagaggagctccgccagaacccgggtctccctgcaaggccggaggtggtggggggaagcggtttggtgggggtgggggaggggttgaggggaaagagtgtcgaatgggtagaatgggaagggtcagacattgcattaccctcagtcatggaaggccaggaagacacagatgccccaatcgacatgcattcctccaggactcacttggcccacttgagcgcaggacctgggccgagcaggcgcctcacactgtcgtgacacgcctcgctgagctgctggaggtacacctcatcctgggaacggcgagcaacaaggccttgatgagggctgctggaaagtgacggtgcatcgcacgcaccatgcgccagacgtcttactgctcgctcatcacaggcccaaactcactttttgagtagctctgatgaggttggcctggccagcaggggggaaggcgcgcggggatggtcccggagcaggctcggccattctcccgtgtgccgagtttatgcaagagcgaccgagtagggtcccatcttgggaaggagcgtgataataaagtactatttactgtaagattaggaaatagaatgtatggctagtcgccacagcctgcatcgttcgtaacaaagaggtatgtaatgcgggattcccgacaccctgcgcgcttttttgacacccgtggtgcaggcactgcatgatgcggtgaagcccatgcgataaggaatgatcgcatgtacaaactacagatgatctaagtcgcaatgtgttgataaaatgcggatccgcgcactcattgtgcggaggagtggtggctgaatgattctcctcaggctgcctccctccctgggcagcctggcctgccggcgactgagggcgtcgcgatgggtgagcagcgttcggtgcatgcatagcgatgcaagaattgatctcatatccaccggcccagaggccagtgacaggctcgcggagttcatcgcctctgccagtgctcctggggatgcgtttctcctgtatggcgaagtgggagccggcaagtcgcacttcaggtgcctttggagagtgaaacttgcctcaggcggataatgggctcgttcatgtatgctttgaggttgaggacatgattggtcttgcaactaatcgagtccccccccactgcgcagccgcgccttcatccgnnnnnnnnnngggtcctaccactaatctagtccaccccccactgcgcagccgcgccttcatccgcgccgctctgaaggaaccctgcttggatgtgccgtcccccacctaccttttacagaatacttatgaagatgcaacaggtgttgtgctgtgcggggatgtcgtcttggggctaacgattttgcctcagtatgggctgagatggcccctccttgcgtcgcgccccacacctcctccatgcacgctggaccagtcgtgacctgcacaccttcgcacnnnnnnnnnntattgcgccccacacctccatgcacgcgggaccagtcgtgacctgcacaccttcgcacatccctgctgcccgccgtccccgcccttctgcgcccaacctggtaaccccccccccccttacactacctgcaggtcgcctgtaccaccactacgacctgtaccgcctgacagacccctcctccctggcacggttggacctgccctccgccctcgccgcaggcacctgcctgatcgagtggcccgagcgtctgggcgcctgcgcccctgcccaccccgtcaccctgcgcatcgcctgcgtggcgggggcggccgaagagcgacgcctgttctcgctttccttcccggaccgggacgcggcgcgctgggtgcaggtcgtgcgggccctgagggccctgggccatcgggtcggcctggatgtccaggatcaatccggggacgcccaggcgtgagcccgcggggcactaccgttgcattcatctcccttccttccgtccttcccaccccagcctgaatttccctgcgttggtcggtggcggtatgtacagtgtggcaggggcgtcgcgcgtctgtccggtcaggagtcgtgtggcgtcccgagggcatcagccagcgccgcggcagtgcacgggaggtggggttccccgggtaaggggcgcaagccgccaggcacgtcagtgtcagtcagggaccttgggggcccagaggggcctgcaattgtcaggccccgccgtccccgtttctagctcactgtgcgtccgtatgccacgccagagatgtacaggttctttgcccacttttcctgcaagggaggagggtggagcgcatgggtatgaggggccaagtttgtgtttgtgcagggtatcaaggggtaaatgagggagagtaggatggaagttgtgtggcccgccaagctcaaggcctttgtggaaggacactgtggattgaggccacatggtagcatgcgagcttgatccaagcaccttcgtgccacccctcccattgctgcacactcgccctgctgtacagcttgtcctgccactcgcacctgcattcccaaccatgaatcacgccaccgtgccacccccacccccccaccactaccacacaaacagaccgccgcgcactttgacatgggaggaggggaaggcggaggtgcgcagcgtctcctgcgtctcgtccaccggccggcgcttgggcacggagagcacaaaggcggcctggtcgcaggtggcggcggcggcggtgatgcggtaccccgcgtcccagcgccggtggatgccctcggaggagtactggaagtccagctccaccacctggtccacgaaaccggcgttgcgcgacatgaccaccgcccagcgtgacccggcgctggccatggcggtgacgaagaacccctccttccacttcttgttgatccacttgaaggggaaggagtcggagaccttgtacgactgctgcgtgtaggccgtgcccttgctcatcaccaccagcgagctgccgcccaccgagcctgggagacggggtgggggtgggggggtgttgggctgggtgggttgggcgagacggggaagaggggccattcctgtaccatgaatcgcgcaggtccatgcagcgttccggggaccggagcttgctgaatcgaggaccacccccctcaccggcacccccatccccccacaaaccacccacctgccatggtggtgatgtagtacnnnnnnnnnntgtccatgcagcgtcccggggaccggagcttgctgaatcgaagaccaaccccctcacccgcacccccatccccccacaaatcacccacctgccatggtggtgatgtagtacccctcctcccaccgctccatgatccagtccttaggcaggaagacggggttcagctcatagacctgcgcgatgaagccgccccctgcgtccatgatcagcgcccacaggtcctggcagcaggccacggtggagatggccagcccgtcctccacacccttgtcgatgtgctggcgcacccggttgtcggccacattgtagtggtagcgctgcttcatgggccggtgggcgttgtacaccgtcacccactgcgtggcgggcatgcccagccgcacacgacggcccggcaccagggccggggcgggggaggcgcgctcgccgccgccgcgctcgccgccggcgccgtcgcaggagccctcctcgcgcgagcgcttggagccgacgcgcgtgggcggcagcactgggcgcgagggccctgaggggccgcagagaggctcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgtactgcggcacctcgtcgaagcgcaggttgatcaccgtctcggtgaacacgcggaagggcgcgggcgcgtagcggctcagcgcctcgggcgaggtgctcatcttcttgcggcacaccatgaagcccttgttctcgccctggggatatgggttgggatgggtgggtgggtgggtgggtgggggcatggattaaagggggtaataagagctgccagtgagggcctcacagccttggaagcaggcagggcatgaggatcagtgacttgacaagaagcctgtgacgcagcctctcctttcccaccatgtaaaccttggcgccttgccaggactgggcctctatagccaccccccctcccctcaaacaataccctccccccccaaataacctggtacccctgccagggcaggcgcccgcgcagcaggaagagcagggtgtaggccagggacnnnnnnnnnnggtcgctgcgcgtgaggggaggacatgggggaaaggattcgactggattcgatgtgcgtaggaggggagcgccgggttgagtggggccggnnnnnnnnnngcggctggcggtgcggcccaggtgcgcgtgcacgctggcataccgcaccgtgccgcggaagacgtcggggcgctggtcgtactccacatgggtaccgcagacggagccgcgccagcgagtcgctgcgcgtgaggggacgacatgggggaaaggattcaactggattcgatgtgcgtcggaggggagcgccgggttgaggggggccggtgatgggactggtcaagccatctgcagttgcgatctgggtatgaacagagcaagcttggggaagtcgcacatcccacaccccaccctccccagggagccacacataaatacgtagtacttcagcccttccttcaaaaatgcacccgcctacacaaatgtcgcccctgtccctttccactcctcgtaccaagcccaaggtcgacgaggaagagcttcttctccaccggcgtccccgccaggcccatgagaaagttctcgggcttcacgtcgccgtgtacatagcccttctcatgcagccgctccaggatggcgatggcctccagcgcgatgcaggccaccatctcctgcgacatggcctggccctgtccgttccacaggtcccacagactggggcccagcatgtccatgaccatgatgtagtagtcgccctgccgccccttgaagtggaccttgggcacgccctccacgtcccccagtgccctgtgtgggtgaggaggaaagggggaaattgagagggcggacattcgtggggcaagcgccccaggttgtgggtgggagggcatcggcaggtctgggaagggtagttctaagagacgtgccccagcactgaagaggtgtccactcctcatagagacggcacttctctgcgctgcagtttgcataagtgaactccttctaccccttgtagacgattgagaaactcagcctgttcacgccattgtcaaatagatgcctcaacgcttacccatagacagaccactcatagggcgggccatagttacaacccttgctgctgcgatgctccagtttcagtgctacctgcaaggaaccagtcagcggcagaggtggccatatgatcccatgtgtctccaatcgccatctcaatcccacacccccaaatactgcgcctctctccgcccagtctgcccacctggttcactcccgccagctcagggtctttggaggggggcgtcctcctgcccaggtacacctggccaaagccacccttgcccagctttcgctcgactacatacagggggcttcccccaacttgcacctgcagggatcggtgggttcgattccagggttcaggaaaattaccacagcagggcacaccccctgcagcgcggtgaagatccctcacctcgtccgggatgggcgcgaccccagtctgggcagcatccttcttctcctctgcctccgccagtgtagctgcggccagcggggcctcccgcctactcgattgaattcaaggacgcaatctaggagccatatgtgcactccatgtgcgtgcgagggtcagggatcgcggcgttggatttgcctgagcctctatccgtgagctgtttgtgaagtagcgtctcacgcccgatacgaaggtggtcctctcgtcaccatctgccggtatctagtttgccttggatcagtgtgagtggaagtgtctcatctgagggtcctggaggaacgaagaggtccacttgtcccgattccagctctccgatgccttgcggagaaagtttgaaatgctgtcgatcagcgaagccaggagcccaagacacatgaggctccttcgcctcattcgctggagctcaggcctgaacccaaatgcatgggaggatggaggtgcagatcggatagcatggtggccccctcctccctcctggacgcctcgccgtccgttacatccctgtccagtgttcagctgcaaagtgggtgctgagggggtttggggccggtgctggactgccaagaaactttgcattcgaagacgaatacttttctcaaagccctcatttcnnnnnnnnnngtcacacgcagcatgcctcactcaccacccccctgctcccttgggacaggggttggacacccggcaggatgtgcccacacccnnnnnnnnnnggggcccggtgctggactgccaagagactttgtattcgatgacgaatacttttctcaaagccctcatttccccgtgggtcccacaggccagccttcctacgtgtccgacccccccatcgagacagtcgtcttcgcctggggcgcgtcagaggatggccagctggtacgccgcctgggcccggcatccttactgtagcatatttcagtcatnnnnnnnnnnaaggtggtggaagcgctgctaggcacccgtttctgcgggcggcaggccggccgcgtgcccctggtgggtatgggggggttgggggaagttcagtatccagggggctgcaaggcatccttgcattggccccttttcttgaacgctgccgacgggcgctcgcgccgcacagcctccctgtgaccaacccctccctnnnnnnnnnnaccccttttcttgaacgctgccgacgggcacacgcgctgcacagcctccctgtgaccaacccctccctcttctccgggcaaaacttggcagatagcaggcagccgcgcctctgtgggcatcgacgtggacggccaggtgctcgcctggggctggaacgggcgcggcacgctgggacgcggccaccgcgaggccaagggcgccgagcgcccgcagcgcgtgctggggctggaggggcggcgcatcgtgcaggtggcgctgggcggctggcactgcctggccctggacgcgcggggccaggtctatgcgtgggggggtaacgaatatgggcagtgcgggctggaggaggggttgaaggacgtggtgacggcgcggccctgtctgcagggcatgcgcttcaggcgcatcgcggcgggggggatgcactccctcgccctcaccgacagcggggaggtgtgtatgcatggttggttttttgggggggaagggggcgctgtaagcggtcatgtgctggagggcctagggtaaaacccttgcacgatgttattgactctgaaaggcaagagttcccgaaggagatgagcaggtcggcaaggaaggggatgttccttgcctagtactgtacatctctcccaagtaccccactcatcatcctcgaaaatcaccccgcccctctccacaccctcagatctggatctggggcgagccctggggcgacttctccatgaccgtgagccggcgaccacggcgcatcgacacccggtgcgactacgtggaaatcgcgtcgggggccttccacaacctggccatcacctcggaggtgcgctggagagggcagcggagggatgcggggagcatgaacctcaaatggaatgatggagagaggaaggacaaggttgctgggaaccagggccatgaatgaagctctcattccccacacacgcccaaacccaaccctctacacaaacgaatccttgcacagggccagtgcctgacctggggcatcaacgactttgggcagctgggcaatggcaccaccaattacgccactgtgcccgagccggttgtcggtctggagggcgtccacgtcaccgccatcgctgcggggggctggcactcgctggccattgccagcacagggggtaagagaggcttgggcgggggtggcgggcatctgcacgctcctgggccccgccggcaagaatggaggggacgagagtattttgctaggtccattcagcacctcctcgccgttcttttgggggggcccaagccccttcccctgcctcccaacccctggaactccccgtcgcagcagcagtgccgacctgttcagtagatatccttggcgctccccctctattaaccgcttgcactgactgtactgcaagcatcccctccaccaacacacccaccctcggctcgcagaggtgtacgtgtggggccgcggcgagtatggccggctgggcgtgggcgaccgcagcgggaccagccgcttgcgccccacgctgctcacccagggcctggagggccggcgggtggtgcaggcctcctgtggcggcacccacaccgcagtggtgacggacgaggggcgctgcttcatctggggccgagccgcctttggccgcttgggcagcggccacgcccaggacctgctggcgcccgccgagctggcgctgccgggcgggccggagcgctggcgcgtggtggcggtgggcgcgggtgggcggcacagcctggcgctggcggtgccggactcggggcgcctggctccgcggctggagcgcgaggccacctgggcggcgggcgaggcggacgacgaggccaccgagggcgcggccagccccgagggcggcagcgacgacggcggcggcgcggcggggggggacgggggnnnnnnnnnnnnnnnnnnnnnnnnnnnnnnnnnnnnnnnnnnnnnnnnnngaacccgtgcccgtcccgggcgaggaggagctgcgcatgtatgtggatcgggtgcacgctgcgggcgtgggcgccagtgtcgcgttgctggagggggaggaggacggcgcggagctggaggctggcctcctgctcgagctgaaggaggaggaggaggaagctgaagaggaggagcagccggaggaggaagaccaagaggagggggtgcaccccggcgctccaggggacgacctcggcctcgcgatctcgccatagcgcagctgcctggcatcgcaggcttgcaggtggtgtcgcgtgtaccagtaaaaagctgtgcagtgcgagtgaggggctggggcggggggtggtccaccgaaatgcctcttgttgacaggcctagaaaagcgtggccaagttccgcgcgcggtcgaaggttgcaattcgatcccaccatcggcatgccttgggcaggcgcacacgcagcgatggcatgttgggatttgcaatgcattgctgataataatttaccgatgtagcgccgtatccaactcgcaagggcgtgatcggcactgtcgccccccggtgcggagtgatctgggcacggccatgtgctcggcattcacccccctcctggagcggcagctgccctgttctgtgcgacatgcggcatggtgcaccaccatggacctgctggccctggtcctggaggacaaccgcctgcttctgcaccggctaaactggcagcggctgtgggtgaccacccaggacccccaaatatcggccctggcctggtcccaggacgggcgggagctgctggtcggcggggaggatgggtctgtgaccctgctggccgcagaggatggcgcggtgatgcagcgggcgcgcctcctccccgccccacatgccgtggtggcggtgcagtgggtggaggcccctctccccaatacaacacccctcttccccgaccgcgtgcgccgtttctttccaccccagaaacacagcccggccctgggcctggcgggcatgggcagccgcccggcggttggatggcccgcggagccggccagcgtcagcctgctgctcgccctctctgcccccggcgacctcgtcatcagcaccagcaccctgcagcccttgatccagctgacacagacgagccagccggcgggggatgcagcgatcactgcgtccctgtcgccggatctcgcccactgcgcggtgatgtgcaggagcggcgacggcggggggacaatgacgatacggggcactgcctgcctgtctgagaacctggcgatgctgcacaggtttgggacgatgtctgctctctccaggcagcttcttggaggtgggtggtgcgggagtttgggaaggatgtggagtgtgaggtgttgcagtggaaacgggcccggtagtggaaatctctcaagcgcaacgtgatacatacatagcccctcgcctcgcatacctgcagcatgcatgacggctgctgggaccatgcatcaagaatggcagnnnnnnnnnngtctctcaagcgcaatgtaattacatacagagcccctcgcctcgcatgcctgcagcatgcatgacagctgctgggaccatgcatcaagaatggcagacgcaggccacagagtggaaggcttttgctgctggtctggtgagcagggcgaagtattatgatgcagtttgagaaaacaggaacatcacgaccgctgtccacattnnnnnnnnnncagtattatgatgcagtttgagagaacaggaacatcacgaccgctgtccacattgctcatgctcagagtcattggggactacatgatccaaaacctacatccaccattcccaattccactttctccctcaagagacaaacactggacaagtttggagactcgacctccgtagtatgcaccctggagcgagtgctccgcgatgggaccatctcagatggcctgcagcagtacctctccgtagattttggtgaggagggaggggttcactgtggctgtgtcattggatgctcaacccacatgccacaccttttcattctctggtgggaggggggcatgagacatgtctggaccaaaatgctgtcacccagcagtgaccatgctttgaatggtgcttgcgggttcgtggcatatactgttgacatgcctgtttcccacaatttccctcccacgtgcgctcaccccaggagagaccggtctgaagaagctgtccagggcagtggatggcgccgtgctttcgacacatgccctgatgctggacaatgtggcacccaccctggagcaattggcgttcttgatgggcgagctacggggtgccagccagctccctgcctggaaggcagtgctgagcctggatgtgagtgcttgatggggaagaaacctggatgcctgccctctgatgtcagtggtgcatgtgagggaagctcctgggcatagcgctgctttcatgtgttacaccttgatcccctcctcgccacagacggtggcagtgaccaggctggaggagcaggtcctcctcctttgcctgcacgtcgacacggagaggcggcgcttgctgagcagaggcgagaccctgcgcatgtttttcgcctggctcctgaccgtcatgaggaggtaggcgatgggaagggagagtgcagaaagtggtgccaagtgccagccgcatgaagaaagcaggtatgttcctggcctctgcatctcagtgatgactggtgcacagggacgcacggatgcccaagctgcaccgcccttcgccaaccgacatccccttccgctcgctgcctggcagggtgcatcagacgtccccagacgcaatggcctggttcccggagagccatctgaaggcggtcactcgattcctcatgggcaaagcatttgaccaagaccctaccgcagactttctcctgcccaaggaggtacattgggaggtatttggtgatgaccaaatgggtatcaatggcaatgaaatattgctatgtggcccccaaacatgcattcaccctttgcctggtgaaacctagtccagatccgtcccatcatccttccgactcagcagggcgccgaagccagtcacatgcccaactgggcagactttgtcctggaacaggcgcgagcatggtctgcacaaggccaggacgtccaggcctgcgccgcctcccccccgctccagccgtggctcatacagctgcaggggcggctggaccgcatcctggaggctcccgtgcgcacactgtcccagcaggtcacgctccaaggacatcaccggtgggtggcagtgagccaacagcgtgcatgaggatgtttggattggggagagacgggcactgctcctgcttccttgcaagcacatgagctggtgtccctggggcgtgagggatgcagccagcccccacctggttccatctgtgccatactgtgtgcagggccagcaccccagtcgaccctggctcagcgtcgctctgctacctggcggcaacagatcgatgggcggtagccctcccctctgccaccccgcatgtttcaactgtgatgcgggggcagggtgccggcaaagcagggccgggcaaggacgcctctggtcaagacatggaggtgaggtgtcatgcccgcttgaggtcccgggctattgcaaatgggaggggctcgtgtgcgccctaccatgtctttgttgctgacagagatcaggtcttcctttccatcatgccgtgcgtgggcgccttcacttgcttgctcggcatggcctgaaccttcacccttcttccctgttggcagcctgtgcgcggctgcaagcctcctacacctgatgggccagtcctggactgcacattcttcggagactccctcctggcctgcatctctggcggacccgcccctgccctgtcgctggcgccgctgtttcccgacgggcccgaggcaccacaggagacgaggacacggcacctagggtgcctgcccaagcgcctggccgtttctcactccaggaagctggcgtgcgtgctcaccagcgaccaggtaggtctcctgctcacagggcaaggccagggaaggctgcaggggtgtgcacgcccgggtgggtgatccttgtgcccttcatcgtcctctgacgcgcnnnnnnnnnnttccggctcacagggcaaggccaggggaggctgctgggggttggcacgccccggtgggtgacccttgtgcccttcatcgtcctctgacgcgcctgccaccaactctcaccccctcaacgagtgctgccacgattttgtgcccctcacagcgcgcactcctctttgacctggcagctgatgaggaggagggggaggaagaaagggaggagnnnnnnnnnncgaagccatggagctggcagacgactgacatgcatgagcttgtttgccatcgaccatgcaggcacctgttactggcatgcctgtgtgggtgtgccaggcctgtgggtgtggtttacgtgtggcaacaaccgcctgctcgtaccggagcaggtgcagcaccacagctgacacggctcaggttgcagctgggacactgcaggcaggggcttccagggcggtcgcgtcggccactctgggccacgctgtacccttcagtctgagtccatcccgccgacctctaccaccgcttcaatggaacgcctgggtcactcggtgcagcagcccccccgcccccgagcgcagcaggcgctgggagtcgatgaccacctcccggatgctgctggggctggtgggcgaggccagcgcgtcccggggggaggcgcccagctcgagtgcggccagggggctctcctccagcgtctggctcnnnnnnnnnncggggaggcggccagctcgagagctgccagggggctctcctccagcgtctggctccgggacagcggtgagttgcccccgggcagcagccccgtctggccctgggggagtcgtgggggatgggaaagggtgtgtgcctggcgcagggatgggctcggctggaggtgtcctgttgccaccatagcgcagcaatggggagcagtctgcataccacctcatcctcctgacaccacacgtcccgctgcgctccagaaagcctgcgttctccctgagctcgctgcgctacagacccccctaaaacccccctcgccaatgccccaagcccacacaccggaacgaggggcgcaaaggcgtcgagccgggccgccgccgccgccgcacggtactggggcgtgctcagcgtctccgccctgcgggcataggacaagtcgacgccggagccctccgggcccagctccgaccccggaaccagtgcaaaggaggtcttcagcccgctgcccgcccggcccgcctccagcacctcgttctcggtgaccagccgccgctccgccacgaagccggccaccctgaaggggtggagagaaaggaggaaagggagatcggtctgagttctgctgccagacgacaatcgaccatgattggatggccaggcctgagcgctgctgcacggagcatggacaaccgcgcaccccagcatgcgcactccccgcccgcgccccgacagaccccatgaagatggcgcccgccagcgccatcaccagtcccgtcatgagcagccagatggagctggcggggaggtggtccagctcctggaagtagatgccgccctccagcaccgacatgcacatccagaaggcctgcaggggggggcgggttgaggggagattctcagggagggagtgagatggaggggctctcatgtgatgcggtggggaaccacatcttgcccgtgcacaggcagaagcaggggcgatgctgccccacccgatgtccagccttgctggctgctggctccccatcccgatcctggcnnnnnnnnnngtgtgatgcggtggggaaccacatcctgcccgcgcacaggcagaagcaggagcgatgctgccccacccggtgtccagcattgttggctgctggctccccatcccgatcctggcccaccaacctgcatgaggggcatgatgagggatgccgggtacagcctgaggccctggttgctctgccggatccaccacgccgcggtgcccaggaaggcggccgccacgaaccagccgtaggggtcggccagggagtctggcagctccgacaccacgtacgtcagcgacttgctgaagagcacggaccaggcacctacagagattgagggtggaaacattgaggagggcgaagatcgcagaaaggcagctcaacaggtgttcagtggcatggctcctggctctgcaaagcacgccggggatctgcgaaatgcatcctccctgccaaacatgcacgcacctatcannnnnnnnnnggagattgagggtgggaacattggggggggcgaaggtcgcagaaaggcagctcagcaggtgttcagtggcgtggctcctggccctgcaaagcacgccggggatgtacgaaatgcaccctccctgccaaacatgcacgcacctatcatggaggccacggcggagtagaggagcgcgccggtgaacacctgggcggcgtcggccgtgacccatgtcccgctccagggcagggcgaagcccaggctctcccgccgagcgagcggggcggggccgcccgcggggtcaaacgccgccgcgccgtcggcccagcgcgcggcgtgcgccgtcggcgctcccagcatggcgaagggcccggtcaagcgctgggccttggccgcggcgcgcagctcccaccagatcagctgcagcgccgtcagcgccagcgccatggccaggaggaaggcgcgcatggtgcgtgtctgccacagcgctcgcagcgcagtcaccgagtactctacgtcgccggggccgtgnnnnnnnnnncgcctgccacagcgctcgcagcgcggccaccgagtactctacgtcgccggggccgtgccagacgatgagcacgttgccggccacgaccaccagcacgcccagcgcggcagaacgatccgcacgcacaccgagcaatgcctgggaggcgacggggatgagcacgaactggagggagccgagaccggagagcacggtctgggaggcgaagcgcatggacacaaagcgcaggaggttgccgccggcgaacaggccccagccggccacggcgtacgcccgggatcccaccagcaggcgccgccactggcc

SEQ ID NO: 37828 - DNA, 86 bp, Chlorella protothecoides
ggtgcctttcgccctcctgcccttcaagtaactgcctacccaattaggagcagaaacctgccaatctgttctcgggcttgtaaaat

SEQ ID NO: 37829 - DNA, 74 bp, Chlorella protothecoides
cacattctttcaagaccagtccagggctgaatgtatgcaggaatataagcttgcgcttctgattttaaggctgt

SEQ ID NO: 37830 - DNA, 3585 bp, Chlorella protothecoides
  modified_base (831)..(840): a, c, t, g, unknown or other
  modified_base (1111)..(1120): a, c, t, g, unknown or other
  modified_base (1319)..(1328): a, c, t, g, unknown or other
  modified_base (1451)..(1460): a, c, t, g, unknown or other
  modified_base (1911)..(1920): a, c, t, g, unknown or other
  modified_base (2455)..(2464): a, c, t, g, unknown or other
  modified_base (2917)..(2926): a, c, t, g, unknown or other
  modified_base (3427)..(3436): a, c, t, g, unknown or other
cgggggcgggttcggaggtgggggggtgggagggggaggagagggtggaggggttccaggtatgtagactgtctcagatgttctgaggtactcgacctgacatggagaatctgcggcccagttattgcagacgatgtggcttcctgtgttattgttgccaatgttgaaattgccagtgttgccattccctgcagtatggtgtagaccaggggaccctgtggattgttatgcagtgccaggcattctttgtggggaaacgaccgtccaatgcaaacctaccgtagttgtagtcgccgatgtttttgtttccggtgttgtaaaagccatcgtcggcggtgcccaagttatgatgaagcagtgtttcaaagcagtagtccatcccttccgggtagcagataactaacttcacatagtcgcaggggccatcgggtgtgggcgtgcagagcccttgagtggctgggttgattgtgccgatggtgaacccggtgaatgggtccccaatagacattgtagcggtgaattcagcccacttgccgccgtatcccctcaatctgcggattggaagagttccaggaggtgtgcctgtgaaccaggccccttggcgcttggacaagcaagcagcccccgggcttcatcgaccgccagaacctctctggccagcatctgcagagtccatgcgacctcggctcaccggcagtaagcctcagaccttccagagccgagcaggtacagcttgccgttgtaactggggagggacaggagagtgagactcgtgctcagcgagtcgtaaactgagacttcgagcatcaagcttggcctagcacccgaatnnnnnnnnnnataactggggagggacaggagagggagactcgtgctcggcgagtcgtaatttaagacttcgagcacgaagctcggccctggacttgtatgctgaaatgcaggcagtacagtttcctggctcggacggctcactcaagggtgggaaggccgtagaaaccaatgctcgggtcgcagtcagcctgcgagggtgcagggctcctgattctatctcaaaaccgtgggagtcgtgtcagctgagatttgagaagcctccgccattcacgcgaggcannnnnnnnnntctgtttccatctaaacaccgtgggagtcgtgtcagccgagtttcgaggagccttcgccattcacgcgaggcaacacactgtcacctcacctgtgcgtctcgcacgcatgcgccagcgagaagcacgccaaggaggaatgtcgcgaatctcctccagcatcccatgtctggcaaagccagggcagagaacactcagtgnnnnnnnnnncctttcagagccgagcaggtacaggttgccgttgtaactggggagggacaggagagggagaatcgtgctcagcgagtcgtaaattgagacaccgagcatcaagcttggcctagcacccgaatnnnnnnnnnnccaacactgtacaaccactccaaggttgtacagactggtcttgaaaggatcccgagttcgggatgtacgtggcagccaccctcctgcccgcattcggggccgacagcgagccggaggccggaacgagcggtccggatgccggaggtgtccatcactgttccgggccctgaccggcacgcgggccctcgcaaaagggcgatatcccttccgagcacaccaggcagcgcagagccccctgggcggtttgcgcctcccaagctcgccggaggacgggcggcacccggagcatggcatcggggccaggcaggtccccgcgctgcccctggttcccaccggccgtccatgggttacagcatgtggagagggctgtggcccctcacgcttcggtgtgcctccccgcctcgacctcacgcagcccccgaatctcgccgcagacgctccaccacctgcnnnnnnnnnngcaggcagcgcagagccccctggtcggtttgcacctcccaagctcgccggaggatgggcgtcacccggagcatggcatcggggccaggcggttccccgcgctgcccctgattcccaccggccgtccatgggttacagcatgtcgagagggctgtggcccctcatgctccggtgtacctccccgcatcaacctcacgcagccccagaatctcgccgcagacgctccaccacctgcgcgcgcttctgcgccagccggtcgaggaggcgctctcctcgggccccacccgcgccgggcgccggcgtccccgcctccgcatccctgcggtcgcctggcaagggcccatcatcggcccctgctcctccctccgctcccccgccctcctccggcccggcccccggcggccccgtgccttcctcgccccgcgccgcgtcgccgcggcctgcccccggcggccccaggcccggcaggcacgcatccacgcctgggtcctctagccccagcaggccaggcagcaggatgtccccaccgcctgcgnnnnnnnnnnccgaggaggcgctcgcctcgagccccgcccgcgccgggcgccggcggcccctcctccgcatccctgcggtcgcctggcacgggcacatcatcggcccctgctcctccctccgctcccccgccctcctcgggcccggcgcctggcggccccacgccttcctcgccccgcgccgtgtcgccgcggcccgcccccagcggccccaggcccggcaggcaggcatccacgccggggtcctccagccccagtagaccaggcagcaggatgtccccaccgcctgcgcaggagggtggaggggcagtgggcggtgcgcaggcggacagggccagccgtgcggcgcgaggtttcccgggacgaaacattccggcgaggtgtgcccgcctcgggcggggcaggggtggcgcggcgctggtgcgcccgcaactaagctgctccaaccccgcaggcgtggctccnnnnnnnnnntgcctcgggcagggcgggggtggcgcggcgccggtgcgcccgcaaccaagctgctccaaccccgcaggcgtggctccccagaccccggccctcccactcagcccccagtgcaggtccccctgcgccaggcccccctcccgtctggtcccagtcccgccggcggacggcctcacccgggaagacaatgttcctggtgaaggccatgcgcacgcgctgctcgatgagggagctgacgcgcgcgacgtgcgcgctgtacttgagcaggcggctgccgagctggggcgcagcggtgaccaccaggcgcggcggcgccaggaaggagtagaacaggcggttgcccggggcgggggggatccaggccaccatgcgcccctccagctccgagaaggtcaggcgcaggcgcagcggcacgcgcccgatgccatccgccgccgactcggccaggccgcgcagcgtcctggccgccgaccggcgcaggccgcccagccgcgctcgcggcgnnnnnnnnnnaatgccatccgccgccgactcggccagcccgcgcagcgtcctggccgctgaccggcgcaggccgcccagccgcgcttgcggcgggcgcggcgagggcggctcgtccccgggggggcacgggcccgccgaccccgggcccgccgcgccac

SEQ ID NO: 37831 - DNA, 92 bp, Chlorella protothecoides
tgggcaatgttgggagtggcaggtgagatgtgtgcttcggggaaagagggcacagactcttacctggtgcaatgttgccgctcatcattttc

SEQ ID NO: 37832 - DNA, 61 bp, Chlorella protothecoides
cctcgaggaaagcatacagcaacaccccagtacgcccgcacctcgcccttctcgcccacgc

SEQ ID NO: 37833 - DNA, 141 bp, Chlorella protothecoides
acatggcctcccgcccgccggggccaactcgggcctgggcccggccccgctgtcgcccctgggcatcacacccctggcaccccattgagaaggaatgaggtgctgtgggctctggccgctgaccctgacgccctttccccc

SEQ ID NO: 37834 - DNA, 61 bp, Chlorella protothecoides
gtggagctaagcactgttctcgctgggagcgttgtgcagatccctgtttccgccaagcacg

SEQ ID NO: 37835 - DNA, 159 bp, Chlorella protothecoides
ccgtccagcgccagcagcgtgtaggcccccttctgacccaggcgcagcgagtgcagggccccctccagctcggtttcattagacacgcctccttgccggcccgccaggcccggcgcgacgtgtgcaccatccagtcgagcggccccgggggcggggaac

SEQ ID NO: 37836 - DNA, 7951 bp, Chlorella protothecoides
  modified_base (216)..(225): a, c, t, g, unknown or other
  modified_base (1651)..(1660): a, c, t, g, unknown or other
  modified_base (1734)..(1743): a, c, t, g, unknown or other
  modified_base (2027)..(2036): a, c, t, g, unknown or other
  modified_base (2432)..(2441): a, c, t, g, unknown or other
  modified_base (2506)..(2515): a, c, t, g, unknown or other
  modified_base (2755)..(2764): a, c, t, g, unknown or other
  modified_base (2847)..(2856): a, c, t, g, unknown or other
  modified_base (2988)..(2997): a, c, t, g, unknown or other
  modified_base (3192)..(3276): a, c, t, g, unknown or other
  modified_base (4119)..(4128): a, c, t, g, unknown or other
  modified_base (4186)..(4195): a, c, t, g, unknown or other
  modified_base (5095)..(5104): a, c, t, g, unknown or other
  modified_base (6050)..(6059): a, c, t, g, unknown or other
  modified_base (6681)..(6701): a, c, t, g, unknown or other
  modified_base (6907)..(6916): a, c, t, g, unknown or other
  modified_base (6991)..(7000): a, c, t, g, unknown or other
  modified_base (7075)..(7200): a, c, t, g, unknown or other
cgcgtcctcggcctcggccgccgcggcggccagctcggcgcgcagccggcccagctcctcctgcgcggcgtcgtcggcggggcggcaggccccgggcgccgtctcaccctccagcgatgccttggcggccgccagctcagcggccgagcgcgccccaacacgcgcttcggtctccagccgcttcgccagcagggcgatgcgctgggagttctcctnnnnnnnnnnggcccgcgcttcggtctccagccgcttctccagcagggcgatgcgctgggagttctcctcctcccgcgccgcgcccatcaccctggcgcgctggacctcggcctgtgggcaagcggggagcctggctcagaaattgatcggatcaggcccaacatccatggcctagaaattctactccaccacactatcactcaacacctggagcgacaacagacctgcagcctcccgatctccagcctggcatcctccatggccgcggcgtgctccctctgggcccgctgcagcgactggagctcggcatcgcgccccgacttggcagccgcacggtccgccagcaggtcgaacaggtctcgactcggcgtgccagcctcagcgatcgtttgctcaaaatccgggcgcctgcccagtggagtgatcagccctagctcctcggccctctggcgcttgctgggcttgtgccagctcatggctgcaagggggccacgccagccccagatcacgacatcatgtcgagcgtctcagcatcgtcgccgttccaaatgaaacactggccgttggcatcgtccatctgtcgtcgtcttcgtgggcttcccgtacttcattcgtgtcgcgcgcgacaccacccgatcagccacggcagcacgcatcggttcaagatctcgtcattaagtaccccccccccccaaagttgcctgcacccctctttacccaaggacccccttccactcccctcctttccaggcctgactgccgcccgggccatgaagaccacatggtgctgaggattgagagcggcgacagcgatgtgtgcagcgagtgctgggacaaggccgtgctgtttgccgcgggcacggacccctatgtgctcatggaggaggcggtgatcgtagccgcggagtgcagcgggaccgccaagcctctgcgcgccaagaccctgcccccaaccctcgactcctttggctggtgcagctgggactcgttctactccacggtctccgcgcagggtggggaacctggtggtggcagggagcgcatccagtgcatgtgtgttgtaggctgctggctcagcagcagcaccagtccgtgtacgtgctcccaaagacttccagctttcaagcaaccattcccttgccctattccctcgcaggcctcgacgatgctgtccgaggcctgcgggctcagggcacgccaccacgctgggtggtcattgatgacggctggcagtgcacacaggtggacgccgcctaccgcgacgacccgctcaaggccttccgacgaggcaacggggaagaggtgggttatgagttggggttaggtttggaaggaggtgggacgtgagtacctttgttgctggagggacacatgcgtggctgtgggctcagtattgggaggagtatggtctccattggcgacaaggctctatccnnnnnnnnnntgtgctcccaaagacttccagcttccaagcaagcattcccttaccctattccctcgcaggcctcgacgatgctnnnnnnnnnntgttacgagtgagggttaggtttggaaggaggtgggacgtaagtacctttgtttctggagggacacatgcgtggctgtgggcttagtatagggaggagcatggtctccattggcgacaaggctctatcccagagtttgcaatagaggttttaagtcgatggccactcaacagaagctctgtgcagacccttggcaaggttgatcaacagtgacattcccaccaccccatacaacacacccacacccacaacccaccccccttcatcacacagtcctccaccaannnnnnnnnnaggtgacattcctccaaccacatacaacacacccacacccacaatcaaccccccttcatcacacagtcctccaccaactcgcgcgagtccttcgtggagggcgagttcgaggcgctggagctggcggcgcgcggcatcccggcggccgggtcggcgggggccatgctgcgcgaggtgcgcagcagcctggaccccgagggcgcgccccccatcgacgcggagatgatggcgctgcagaagacgggggggctggcgacgggggaggaggggcggcgaggcaggcacctctggcgccggccctttgtcatcaggtgctgctgtttgaaggcgattgaggtcttttctgatgactgagatggatggcgtgcctgcactggtgtctcatctccccagctnnnnnnnnnnggaggtcttttctgatgactgagaggggatgacatgcctgcactggtgtctcatctccccagctnnnnnnnnnntgcgtcgtcctccctggtccctcgcccgcagcctgaccctggacctgctggggtacgtcggcggccgcatcaccggcttcttctccttcctgctcatcatgttttaccagaatgtggtcgaccccgcccccaccggcagctggtgtgtgtgtggggggtgagggagggggctgcgttgcgggggctgtgatagtgccctgggctatcgaggttgggggggcatttgcgcatgcaggtgcnnnnnnnnnncgcatcgtcctccctggtccccgtccgcagcctgacactggacctgctgggttacgtcggcggccgcatcaccggcttcttcnnnnnnnnnncacaataatgagctccaaacccccttttcccccccaaaccaaggccggcgcggctgtggacgtgggctgcgctgcgctcgctgcgcgagcccctggtccaattcatggcggacagcaccaacttcacgcgcnnnnnnnnnngtgctctccttcccttcaccgcatgacgtgagagagcggcgggccctccccatcatggccgtcgcccgaccttgcctcttcactctggcccagcaaggcatgttccaaaaggaatgtccccgctcaagagcatgcctcgtgtgccagggcctcccagcccaactctaccccacatcccctttcaccctcttcatnnnnnnnnnnnnnnnnnnnnnnnnnnnnnnnnnnnnnnnnnnnnnnnnnnnnnnnnnnnnnnnnnnnnnnnnnnnnnnnnnnnnncgcctgaccagcgtgcgcgccaactccaagttctcctccccccgcgcgcggcccgaggacgtgtcctccggcgcgcccgccgacctggcctcggtggtgtcccacctgcgcagcgtgcacggcgtggcctgggtggtctgctggcacgcgctgtcggcctactggtcgggcgtgagctgggagtccccgggcatggcgcgctacgcgccgcgcctggtctacggcgcccccacccccggcgtggccgaggtggagccctcggccgcctggaacccggccgtgctgggcggcgtgggctgggtgggggacatgggcgcgctgttcgaggacatgcacgcctacctggcggcggcgggggtggccggggtcaaggtcgacgcccaggccggcgtcggcttcgtggggcacgccagcggcggcggcgcggcggccgccgccagggcgcacgccgcgctggaggccagcatcgccgtgcacttccccgccaacctggcggtgaactgcatgtgccacagcacggagaacatctacgcctgggagggcaccgcgctggcccgcgtgtccgacgacttctacccgaccgacgcctccacgcaccgcccccacgtcgcggcctgcgccttcaactccctcttcttctcgggcgtcgctcacccagactgggacatgttccagtccgagcaccgcgccgccgcgctccatgccgccgcgcggtgggtggggagagcatgaaagggttctttttggcggggggggtgggcccccttcgtggggggtgaatgactgtcggctcagcacgcacatctgccgcgcccctgattccctcatcgggcgtcgttggannnnnnnnnnttccagacccctcattcgaccgccccacccctcaaagccacccgcaaacccacgccgnnnnnnnnnntgtgtgtgtgtggggggggggcccttcgtgggggtgaatgactgtcggcccagcacgcacatctggcgcccccctgattccctcatcgggcgtcgttggacacaatctggggggccgcagtcctccacttctctgccctcgaccctggaccccactcccgacccctcattcgaccgcccaaccccctcaaagccacccgcaaacccacgccgcagcgccgtgagcggcggtccggtgtacgtgtcagacagccccgggcgccactgcgtcccgctgctcaagcgcctggtgctgcccgacggcggcgtgctgcgcgcgctgcgccccggccgccccacgcgcgactcgctgttcctggacgtctgctgcgacgcccgctcctgcctcaaggtctggaacgtgaacccgcgcggcggcgtgctggcggccttcaacctccagggctcggcctgggactgggggcggcggcggtaccgcacgcacgaggccgcgccgccgccgctgcccgcgcgtgccgcggtacgggacgtggagccgtaccgcggcgcgcccagcggcgaccgctttgccatgcacgtggatggggccgagggcgtgctggtcgtggacgccgacggcggcgtggacctgcaggtccccagtgagtcggtggatctgtttgttggttcagtttttcaaggagggggccagaggggaagtgacggtgcgagggccgagggcgccggggatgggcagcacaaggtggccggcagtggccaccaccagggcgcgcaggagagcgtcacgcgctgctgctccgtgctttctttccccttgactcctttccaccacctctgtcgctgcacacatttgagccccccatctgcctccccatcccctccttcaccgacaggcggcggnnnnnnnnnnggtttttgaagcaggggggcagaggggaagtgatggtgcgagggccgagggcgccggggatgggcagcaaaagggggctggcaatggccaccaccagggcgcgcatgagagcgtcacgccctgctgcaccgtgctttctttcccctcgactcttttccaccacctctctcgctgcacacatttgagtccccatctgccttcccatcccctccttcaccgacaggcggcggcgccgtgatggtcaccgtggcgccggtggtgacctcgcccgacggccaggtcagcgcggccccgctggggctggccaacatgctgaactgtgggggcgcggtgcgcgacttccactggcagacgtccccggagaacgggcgccccgccgcgccgcagctcagcgtggaggtgcgcggctgcgggacgctgctggcgtactgcagccgggagccgggcagggcctatgcgcagggcgtgcagaccaactggtggtggaaggaggggcggctggaggtgagcgtgccgcagggcgacggggcgagcacccagacggtggtcatcgctttctagttgggtggctggcgcgggccaccttcccaacagctgccgacagctgggccacgcccggagcggcgccgtgacggagcatacccgcgcgcccaggcagaaggggttggaaatctggcatgcccagggcccccatgctgcctgcatcaaggtatcacatccatagcaagtaatactgactagaccgggcgatcgcagactgggcaaaggaggacgtatctgtcccagatcacttgagcatgagcttcctgtggggtcggcccaaggccgcagcccagcctgccaccccttccgggactgagccacaagctgccaagcagagtggtaaggcacagagcctggaactcgtcaagtacgatgcgcagaccggcaaattcgaggtcgggannnnnnnnnnacccttccgggactgagccacaagctaccaagcagagcggcaaggcacagagcctggaactcgtcaagtaccatgcgcagaccggcaaattcgaggtcgggacagaggccctccggatcctgcgcgccaccgcggggcccgtgggcgtcgtatccgtgtgcgggagggcgcgtcagggcaagagctacatcctgaaccagctgctggggcgggcgggcgggttcacggtgggccccacccaccggccctgcaccaagggcctgtgggtgtggtcggcccccgtgccccgcacggcagcggatggctccccataccacctcgtgctgctggacacggagggcatcgatgcctacgaccaggtgcgtgcctgggacagggcaggttcagtatgggtatgagtgcaccttgccgagcgaatgcgcctggcgagctgacgccatgctcgccactcatcccaaccctcacccccccccaccaactatcacagacgggccagtactcgacccagatctttagcctggcagtactcctgtccagtctcttcgtgttcaaccagatggtgtgacggcagatgtgatttggttttgagctggaggggtgcactacaactgtgctggggcgnnnnnnnnnnnnnnnnnnnnnggcggccctggacaggctgtcgctggtgaccgagatgactaagcacatccgcgtccgcgccggtggaggtgggcggtggttgatgcgtgtgggtgtgcagcctgctcacgctgcaggctctgtagaggggtagagaatgtcgccagactctgcatgcagagaatcccggcaccggtctcctcagccctgccatgcctgggcacacnnnnnnnnnncgcgaccctggcgacctattgccccacacttgagcagtcggctccataaaccttgcgcagggcggcatcgacgannnnnnnnnnggcggccctggcgacacactgccccacacatgagcagtcggctgcataaaccttgcgcagggcggcatcgacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtggaggggtagagaatgtcgccaaactctacatgcagagaatcccagcactgatctcctcagccctgccatgcctgggcacacatttcaccctcgctcctgggcccagtgtccctcagcgacccccccgcgagaacacctcccccattttaacctgcaagctcaggcgaggacgcgagcgagctggcggccttcacgccttccttcctctggctcctccgcgacttctacctgaccctggaggaggacgggcgggtggtgtcgccgcgcgagtacctggagtcggcgctggcggcggtccccggcaccggccccggcgcggcggccaagaacgccatccgcgcctccatcaagtccctctttcccgaccgcgactgcttcacactggtgcgccccgtgaacgaggagcgtgagctggtgtccctggacggcctgcgcccgggtgacctgcgccccgaattccgcgagggcctggcccgcctgtcggccctggtcttcgcgcgcgcgcggcccaagcgcctggacagcactgtggtcaccggcccgctcctggcggggctggtggaggcgtacgtggaggccatcaacgcgggggcggtgcccaccatcgccaccgcctggcaaggcgtggccgaagcggagagccgcggcgcggccgacgccgccgaggcagcctacgacgccgcctgggccggcgcggcgccggggccggagccggcggcgctggacgccgcgcacgcgcgtgcggt

SEQ ID NO: 37837 - DNA, 61 bp, Chlorella protothecoides
gtactgtatctctcgcggggccatcggctggcacctcgcccacctacaggctcagatgaga

SEQ ID NO: 37838 - DNA, 61 bp, Chlorella protothecoides
ggcctcaggtgccgcgagtgtcatgcgcgtacccaccatcttcgggatcgcgagatgagag

SEQ ID NO: 37839 - DNA, 61 bp, Chlorella protothecoides
cagctcccagtccaggactgccagcaccttgcccgacgggtccagcaccagattgtccagc

SEQ ID NO: 37840 - DNA, 157 bp, Chlorella protothecoides
gctggcggccgagccgtcctcggactggtacctgcgcgccgacacgcccggcggcgcggcgcaccgcgacagcgacccaggcgagcgccttgtcctgtgcggcgcctcggggccggcgccggcgccggaacgcgaggcgctgcccctctcctcgggt

SEQ ID NO: 37841 - DNA, 61 bp, Chlorella protothecoides
ttccgcgcagggaccccgacttgctccacaggcaaagcttgagtgcgcggacgatatagat

SEQ ID NO: 37842 - DNA, 19161 bp, Chlorella protothecoides
  modified_base (330)..(339): a, c, t, g, unknown or other
  modified_base (1475)..(1484): a, c, t, g, unknown or other
  modified_base (2389)..(2398): a, c, t, g, unknown or other
  modified_base (2776)..(2785): a, c, t, g, unknown or other
  modified_base (2923)..(2932): a, c, t, g, unknown or other
  modified_base (3341)..(3350): a, c, t, g, unknown or other
  modified_base (4198)..(4207): a, c, t, g, unknown or other
  modified_base (4771)..(4780): a, c, t, g, unknown or other
  modified_base (5543)..(5610): a, c, t, g, unknown or other
  modified_base (6835)..(6844): a, c, t, g, unknown or other
  modified_base (8020)..(8029): a, c, t, g, unknown or other
  modified_base (8625)..(8634): a, c, t, g, unknown or other
  modified_base (8813)..(8822): a, c, t, g, unknown or other
  modified_base (9368)..(9377): a, c, t, g, unknown or other
  modified_base (10383)..(10392): a, c, t, g, unknown or other
  modified_base (10491)..(10714): a, c, t, g, unknown or other
  modified_base (10803)..(10812): a, c, t, g, unknown or other
  modified_base (11045)..(11054): a, c, t, g, unknown or other
  modified_base (12086)..(12159): a, c, t, g, unknown or other
  modified_base (12230)..(12239): a, c, t, g, unknown or other
  modified_base (12878)..(12887): a, c, t, g, unknown or other
  modified_base (13770)..(13779): a, c, t, g, unknown or other
  modified_base (14311)..(14320): a, c, t, g, unknown or other
  modified_base (15066)..(15075): a, c, t, g, unknown or other
  modified_base (16605)..(16727): a, c, t, g, unknown or other
  modified_base (16933)..(16942): a, c, t, g, unknown or other
  modified_base (17981)..(17990): a, c, t, g, unknown or other
  modified_base (18233)..(18242): a, c, t, g, unknown or other
  modified_base (18804)..(18813): a, c, t, g, unknown or other
ccgccacccagctcccctccgccacccagcccccctccgccacccagctcccctcctccaccaccttcaccacctccaccaagcccctctcctccacccccaccaccacgtgcgagcgccacaattgaatatggtgaacctgtagacgggtatgtcgatgtcacgtttgttgtcacttctgcatacattcccagtaagattatatgcaccacgtattcaaccgtgctcgttcaactcgtttacaaaagtgacaacagcccacaagccttggtcaataccctcatccggccctctacgttggtgtcgaatatggagcagtactcctttggnnnnnnnnnncaatatggtgaacctgtagatgggtatgtcgatatcacgtttggtgtcactgctgcatacattcccagtaagattgtatgcaccacgtattcaaccgtgctcgctcaactcgtttacaaagatgattccagcccaacagccaccgtcactaccatcgtgaagccctctgcgtcggtgtcgaatatggagcagtactcctttggctctgcagccatctacatgggtggtaatctcaatgaggtggcgtcgctgtctctgctcaacccttcaccccctcctcctgccatctttccccctcctccaccatctcttggaacactcactgggcgtgttactcatgtcggtggtgtcttctcattctcggtccagtacagcagccaacctccggacaccttcaactacgcttacttcacggcggccggtaccgtggtgtcctctggttccaatccacccaatggcaacccgagcacatggactgatacagtgagtcacgacatggcagccttgatgtcctatgtccaagtagtgtccatccagaattcaggcgggaactcagctgccgtgactctgacttggtgagcttttcaggctgctctgaccccatgacgttcagcaatgtccaccagatggtttgcgatgatctccttgtaaatgaccacgagaaccaccgcagcgtggaccgatgcagtcggtctgaagaagggctatcacgacccagtccccaatcgctgcatgggaagcgggtcgagcaggcatggttgggtggcgagggcacgatgccgtgcacaggtactggtgaaggggggaagaggcccggccagatatccacgcagcccccttgcatgtcggttgcagggatcctgaagcaggtaccactgcgccccccgctgcccacccccaccagctctcacctgtggcgagggcggtcccagtcccaccaagggtcagggcctcactgggggaaacccagtcggtgggtggctgcccatcccgggattccggcagggacaagcggtgccaacatggcatcaagacctggtctgacatgcgtccttgccgaccatctttcactaagctaccctggggtccaagatgggcttcatcgaggaaggccttgaccgcatgtgggcagctgnnnnnnnnnntgaccatctttcacttagctaccctggggtccaagatgggctttatgaaggaaggccttgaccgcatgtgggcagctgtgcaggagggtgaggaggctgtagcaagcagaggcaagctacgaggtgtgtgcatggcccctttgttctattaacctgtcctgcatgctttgtccctgtgccacactggcactccgacgcttttcatccaaaaccaagctgccaacacaaattgactgattacacgccgacacagggttcatcgccacattcaaggccggaaacagcagaaagggtggtgacgggccagtgccagtgtccgacccgccacatggcacctctcctgacctggttccatattccctggagcctgacacccagggactggacagagcccctgatccacaccttgcggacagtaacggcacaccgacaccactgatgggcattcccggcaacttggtcttgccactggactgccagtgagatattgccaagaccacacagacttaggcacccatcataatctccctggtcgcgaagaagggacggtgggggaagcgcgatgcactctacaaattcatgacggaagctgtgctgcctgtgatgcccgcttggctggccaaccccaccccctgaaacgaatactttcagggcagagcacgccgcaatcctttctgtggagaggacatgcagcatgtgctgatggtctggtttagcggagggacaaaggccaaggcaacctcgttactgctgcgtatcttccttttttcaacaactataccatcagcgaggcaggcagtgtgtgaggggcgatttttgccatggtgatggcgaagagtgtgaggagaccccaattggccacccaaggcccaaacggggggatccgccacgactgacatgtgcannnnnnnnnnatgatgcccgcttgcttggccgaccccaccccctgaaaagaatactttcagggcagagcacgccgcaggcctttctgtggagaggacatggagcatgtgctgatggtctggtttagtggggtaataaaggccaaggcaacctcgttcctgctgcgtaccttcctttttccgataactagaccaccagcgaggcaggcagtgtgtgaggggggatttctgccatggtgatggcgaatagtgtgaggagaccccgattggccacccaaggcccgaccggggggatccgccacgactgacatgtgcagactgctctcaatcgcacttgccctcgatactataccgttctcatgctggttcaacccaacactcttcctcgtnnnnnnnnnnagatatcatttaggtgtagtttaaatctgggtcggaccgacacgtactccatacgggttttgcgacacggccgattaaccctgtggaatttcagggtgtttcgggtccaggtccaggtcagcatgttgtcaagttcannnnnnnnnngcggtgcgtatcaaagcccacgggccatggcaaaacccctgaaaggggcgaaggggggtccgacccaaaagtggggcttccggagaccaatcgagcatcgggatatcatttaggtgtagtttaaatatgggtcggaccgacaggtactccatacgggttttgcaacacggcagatcaaccctgtggaatttcaggggttcaggtccaggtcagcatgttgtcaagttcatgccatccaattatcttctgctgtcgaagcattgtcccgaacggtatctggctgcacattgcagcatcgtagctccaatcctagtgcagcccatcggggagctgagtctcgacggccgagccgggatggggtctcggcgagggttcccagctgtagcgatcttgctcctcctgggccccnnnnnnnnnncagccgggatggggtctcggcaaggattccccgctgtagcgatcttgctcctcctgggccccgcgctgtctctggcagcccggactccagatagcgcgcagactgtgctcaggggcgagccccaagcccccgtgtggccggactcgtactccgtggagtacaccttttccctgccctacactgccaagatccagccccatggcatcaggcagggcacggggtatgggcgttgcgattggcgggcattccctgcttgctgcatggcttggtgcctgatgagcagttcggctggggtctgcttggcaatgtacaagatcccccggccagctggccatggcacccacagattccctgagccactcctgccaggtaccccgtcgtcttccatcgcgacggcaaggcccagcgggtccgcatggagacatacaatggcaccaacgtcatcatctccaccaaggtaagggtttggcgtcagcatggaggtggggcgtggcctttgtggacggccgcgcgacgcaccattgggggagggcgtcgatggtgcggcggcatcggtctcgcaccgcccagcacatccccggcctgggtgttctgattcgtgctggctgggccactcgctgccaacaggaggctccttgcctcggccgctgggaccggcgtggcacccccttctgccctgccgctggcaccccccgctgcatacgctcctgaccaggacgccgcccgcccgttgcacgggcccaccccttctcccctctgccccactccatctcctgaagcccccctcgcacgcccccgcttcctccaaccacagtctgtgcagtacgagctgctgccccgcatcgacnnnnnnnnnntgaggctccttgcctcggtcgcttggaccggcgtggcaccccctcctgccctgcccctggcaccccccgctgcacacgctcccaaccaggacgccgcccgcccgttgcactggcccaccccttctcccctctgccccactccatctcctgacgcccgcttggcgcgcccccgcttcctccaaccacagtcagtgcagtacgagctgctgccccgcatcgaccgtcagcagtgtctggtctgggccgagccggggctggccgacgcgcaggcgctgcccgacctggcgggctggtcctaccagggcgccgaggtgctggaggacggcgccgcggttcacgcctggcactacctggcacggcaccaggccaagagcctggcctaccgcttctacgcgcaccccgacggcgcgccccgccgcctggacatgctgggcaccgacgcgctctccggttcccacttcgaccgctgggtgctggactacgcgagctacgtccccggccgcccgcgcgcggagctgttcgaccagccgcggctgtgcgaggggcgggcgccggtggatggcnnnnnnnnnngccgcgcgcgcagctcttccaccagccgcgactgtgcgaggggcgggcgccggtggatggcggcgtccgcggcggcccacgagccggggcccgcccgggctccggctccggtgcgctgcgcatggcgggcctgctcccgcgcgtcgcctaccgcgggcaccacgcggggtacgacgccttcctggactcgccacacggccgggagcgggcgcacggcagcctggccgactacgccgcgcgggcggaggccttcgagcgcaacgcggcgcgcatcgcggcgcacaacgcgcgcaacgcctcctacaccatggccatgaaccgcttcggcgactggcaccgggtgagggtgggagcaggggggtgcaggggggaggcaatcgaacctctgatgcggccccgatgtcacggcggtgggggatggctgcccctgcatctgagttttgcgatagccagagtgtcatgcgctggcactgcaccgtgaggggtggtacgcaggcccgactgcttcggtcggcggcccatgccgagcccggggtgccgtgggcggcggggccgctgaccgtggccgagcctccacgctgcgcgccgcggcgcacgcggcgaaacgttccgggcagcgtggctccgctgcgcaggagggggccgaaacgcccccctctcgccccccccgaccacctgtccgacacaccacacggcgcaggaggagtacctggcggccctgctgccgcggcacgggcgcgcccgccccgcgacgcggcccgcnnnnnnnnnnnnnnnnnnnnnnnnnnnnnnnnnnnnnnnnnnnnnnnnnnnnnnnnnnnnnnnnnnnnacggcctgcggccgcacgagatcccccaccgcgcgctgaccgacccggcccggctgcccgccggcgtggactggcgcgggtccggcgcggacgcggcctgggtcaaggaccaggcctcctgcggttcctgctgggcctttggcgcggcgggggccatggaagccgcctggtttgtggccacgggcgagcgggtcagcctctcggagcaggccgtcatcgactgcgcctggggcgcggcgccggggcacgaggaaagcgcggcggcctgcgacggcggcgacgcctgggcgggcgtggcgtacgcggtgggggcggggggcctgccctcctcgctggagtaccagtacaaggggcagtcggggtactgcgaggccaacgacacggcggccgtggcgcggttcgcgggcttctcgcgcgtccccgcctacgacgacgccgcgctgatggaggcggtgtactcgcgcgggccgctggcggtgtcgctggacgccagccacgactccttcaccttctactccgcgggggtgtatgccgagcccgactgcttcttcaaaaaggaccagctggaccactccatgatgctggtggggtacggcacgagcgcagagggcgactactggctcatccgcaactcctggagcgaccactggggcgacgcggggtacgtcaaggtctcccgcgaccgccatggctgtggcgcgcccgccgatgccatgtacgtcgtggccgacgcagacggcctgaggccttgaggggtgcctgagggggtgcaggggagcgtgtgtgcatgccttgcgacttggagctccgaacctgccgtcgtgtgagtgggcgcacgcagtggcggcatcagaatgtactgcatcaaggatacaaagagagggaggggcgccacgccttggccccggccatcagcacgtgcgcgcgcgcgattcaggttccggggagactcagcagtccacagccgtgcatggcactgagcctgggcggtcattggatccctactgcaagtaaatattcgattgaagtgcacagttccatactttggatcggtttggggaagcagtggacgctgggcacacgcgctgcgcgtcacggtaagcacagtcacgaggagatccaatacaatggcgcttctttcgtgccaggactggctagaaagccatgcactgtagtgagtggtatgaactcattgcagggcatgatgtcccggggggcggggtcnnnnnnnnnnccgtgccaggactggccagaaagccatgcactgtagtgagtggtataaattcatcgcagggcatgatgtcccggggggcggggtcctctcgcaccctccaccaatacctccctgactcctcacacagcacgacccacatggccaaaaagagctggggcacgagcgacaaggtgcaggaggccagggagcgcaagaacagctccaagaaagaggcagctgaggcagaggccaagcagaaggaggaggcatactggagccagcatgccaaccccaagggaagaaaggacgccaagcgcgaggagcaggtgcgtggcagggtcacacagccggcctgccgtcttctgggcgcactttgtgtagccccaagtcgtggccggtgcataggcagatgagggcaggccccgctcctgtcctctgacaggagcggagccgagaggaagctgctgcccggcgtgcagaagccaagcggcttgctgctgaggaggaggctgctctggcggggccctcccgcaaggctgctccaaagcccaagcttacccatcaccagctagcgcagcagagggagcgagaccaggcggcagctgccgctgccgccgccgaggccgccgcggcagcccaacgagcggtgcgtgctggggggtgtcggggctcaggcgtgtgacacagtcacgcaacaacctggctcttcttatgggggtactggacacagccgcagcggcgtgccatatgccgaggcttatgctcgatgcagcagctatttgagcagttgttgtgcaggatgcagcgctgcggaatgatgctctcggtcaaacctccttgaccaactcataggtgactgaggacgcgtacgcggcagcagtggaggtggagaacacaaacgtccaggaggggaacggcgtgaatgcacggggcctggatcaggcgctggagcaactggggattgccgagaaggcacaggatatgcaccctgagaggtgagtgaggggcatgcatcctggcgaatgctttgccacagacgcagcaggagacgtcgcgcaagctctgcttccaagcgggtctcgtgtgcacacagtggcctgcgtcgccagttccgggtctggcgtgttggggatgcctgccataaagcgcccaagccgcgtcctaatgccttccctcgatccaggcgggccaaggctnnnnnnnnnnggctttgccacagatgcagcaggagacgtcgcgcaagctctgcttgcaagcgggtctcgtgtgcgcacagtggcctgcgtcgccagttccgggtctggcgtgctggggatgcctgccacaaagcgcccaagccgcatcccaacgccttccctcgatccaggcgggccaaggctgcatgggaggcctactacgaggagcagctggctgtgctcaaggaggacaagccgggcctgaggctcatgcagtacaagagcatgatattcgagaactggcagcgcagcccgctcaacccccgcaaccaggctgtctccaagaaatagctggcaggatgccatgtgcgcctgcatgcctcctgcaggcccacaggattaatggatgctgttttaatatgactgcggacaaggtatgcccccatggagccacaggtttccgtccccagaatcctgggcttcgtgtcaatgtatggaacaggccccccagcagtaatcccagcactgctgctaacactgcacctgcatgcaagcacgtgcgaacacggttcggggccaaattgtcaccttgtgatcccaagctggtataccgtggagctcatatcnnnnnnnnnnccccattggatcaatggatgctgtttttatatgactgcggaccaggtatgcccccatggagccacaggtttccgtccccagaatcatgggattcgtgttgatatattaaaactggccccccgcaggaatcccagcactgctgctaacactgcatgcaagcacgtgcgaacacggttcgnnnnnnnnnnaaacatgggtggcgattgttgcggaggcaagcccacgcccgccgtggctgaccagttggcaggcctgagcctggacaatctccccaagtccaatggctctgctgcatccgagaggccatgggcagagatcgccaaggagaaggcggtttacttcaataagcgcgtggagctttttgagaaatatcgagagcgggaggtcgcagcgctcgaggctgcccgcgcagccgctgtcccggtgcagatcacgttgcccgatgggcacgtgcgtgatggcgtaaaggacgtgaccacccccctggacatcgccgcggccctctccaagagcctggcgaagaaggcggtggtggcggaggtcgacggcaagccctgggacctcttccgccccctggagcaggactgcaacctggccatccacacattcgacagccccgagggcaaggatgtgcgttgttctggttgtttgtgcctgtgatcgtggtctggctccgtgcaggtgctgcctgacgaggctgggccccgcccaccgtggcgccggccccagcgctnnnnnnnnnncggtctgggcccgtgcaggtgctgcctgacgacgctgggcccgcccaccgtggcgccggccccagcgctcatgtctcttttccccccttgctctcccgtctaccaggccttctggcactccagtgcccacatcctgggccagtccctggagctggagtttggtgcggagctgaccatcggccccgccctggaggagggattctactacgactgctacctgggggaccgcactctctgcgagcccgaccgcgacaccatccagaagcgcatgcagcaggcaggggccatcgttacgaggatcactggtgtacattgggtagaggggagagttgtgccggcctgcatgccacaggagctctgccgccgcagcatgaggtctccgatcagcccctcaccccagatcttttcacccccctccgcacaccattttctgggctctcttcactcactcacgcagattgtgaaggccaagcaggcgtttgagcgcgtcacagtgtcgcgcgcggaggcgctggagatgttccaggagaacaagttcaaggtggagctgatccagggcctgcccgaggacgccagcatcacctgctaccgctgcgggcccatggtggacctatgccgtggtccgcacgtgcccaacaccggcgcgctgcgggcggtggcagtgaccaacgcctcgcgcgccttctggcgcgccgacgtgacgcgcgagccactgcagcgcgtctacgccatcgccttccctgaggacaaggagctgaaggagtatcagcaccggatagaggaggccaagaagcgcgaccaccgtctgctgggcgcgcaacaggagctcttcttcttccaccagctgtcccccgggtcctgcttcttcctccctgccggcacccgcatctacaacgccctcgtggaggtgtgtgcatatgggggggcaaccgctattccaggaagagggagagaggcaggggtctgtcaggaaggagatcccctctgtcgtgttggtccccttggnnnnnnnnnncgaggtctccgatcagcccctcaccctagatcttttcacccccctccgcataccattttttgggctcccttcactcactcacgcagattgtgaaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcgcgagcctctgcagcgcgtctacgccatcgccttcccggaggacaaagagctcaaggagtatcagcaccggatagaggaggccnnnnnnnnnncatgggggggcggcggttattccaggaagagggagggtggcaggggtcggtcaggaagaagatcccctctgtcgtgttggtccccttggaggcagacaggagcctcacacaagccgggcaccctgcactccctccctgccgtcgaggtattgcatgcactgatcaaccgtctctgagcatcgttgtacattttccaagccctgtgaacagacacacacaggtagcccaaccannnnnnnnnntccttgccattgaggtattgcatgtactgatcaaccgtctccgagcatcattctacattttccaagccccgtgaacagacacacacaggtagcccaaccaccaacacccctcttcacaaactctccccccccgcccgcccccaaaaaccaactctctcagtttatccgtcaaaaatactggaagtacgggttcgaggaggtggtcacccccaacatctacaacatggacctgtggaagacttcgggccacgccgcgcactacaaggagaacatgttctgcttcgacattgagaagggcgaattcgggctgaagcccatgaactgccccggccactgcctggccttcggccaccgcacgcgctcctaccgcgagctccccctgcgcctcgccgacttcggcgtgctgcaccgcaacgagttctccggcgcgctgcagggcctgacgcgggtgcgccgcttccagcaggatgacgcgcacatcttctgccgccccgaccaggtggcggccgagatcgagcgcgccctggccttcctggccgacgtctacggccagctgggcctcagcttctccctggtgctcagcacccggcccgagggcttcctgggcacgccggggcagtgggacgcggcagagggcgcgctgcgcaacgcgctggacgcctcgggccacgcctgggagctgaacgagggcgacggcgccttctacggccccaagatcgacatcaccgtacacgacgcgctgcggcgcaagttccagtgcgccaccgtgcagctcgacttccagctgcccctccgcttcggcctgcagtacgtggccgaggacggcggcttccaggtccccgtcatcatccaccgcgccgtgctgggctccgtggagcgcatgtttgccatcctgaccgagaactttgcggggcggtggccgctctggctctcaccccgccaggtcatggtcgtgcccatctctggtgggttgtcgtcggtcgttttctggacggggatccagggggggggggggggggggggggccccccnnnnnnnnnnnnnnnnnnnnnnnnnnnnnnnnnnnnnnnnnnnnnnnnnnnnnnnnnnnnnnnnnnnnnnnnnnctcccacgataaccgattcaccccagaacaacgacccacaacaaacagcagcaccacccactcctgcaacnnnnnnnnnntcgcacaataaccggttcaccccaaaacaacgacccacgacaaacagcagcaccacccactcctgcaacccctcagactcgtcgtacgactatgcgctggaggtgcgggacgctgtgcgtggcgcgggcttccacgtggaggtggacctggccgaccgcaagatgcagaagaaggtgcgcgaggcgcaggtggcccagttcaactacatcctggtggtgggcgccgcggagcgcgagcagcgcaccgtcaacgtgcgcacgcgcgacaaccaggtgcacggtcagcgccagctggacgacgtcctgcgcgtgatcggggaggagcgggaggcgcgctccctgacctccctgttcggcgagggaccgggccaggcgcaggcctgaggggtgggggtggaggggagggatgctggggtccaacgtgactggggccccttgacaggccgcggagcgcggcatgcctgcggtgccgtgcgtgtgtaggaggtgggaaatgcacccagcagtactggagaggccattggagagcttggacgctggtagagggtggggtccgggggacgggagagcagctgggcggtcgtcggtgactgcatgccctcccacgcacgagcgcgccatcacatgcgtctctggaannnnnnnnnncgggtggaggggagggatgctggggtgcggcgtgactggggcccctcgacaggccgcgcagcgcggcgtgcctgctgtgccgtgcgtgtgtaggaggtgggaaatgcacccagcagtacttgagaggccattggagagcttggaagctggtagagggtggggtccgggggacgggtgagcagctgggcggtcgtcggtgcctgcatgccctcccacgaacgagcgcgccatcacatgcgtctctggaaggagtgtgtgcaggggacagggtatggatgcgcatgtgggatatcgtcgaaacgagtgcataccattgattgttcatcagccgatcaataagctcgctcggcacccaacgcattgctgcacgctcgaccagcactctcaccccgctccgcgcccgacactgtgatggccgcagtcgccttgacccacgtgcccttcgcgttttgatcctgatacatctggatatgtcgcgacgaactctcactctgcagcagctcgcctgcttctggcgccaggccggggcagggggtggcaccccctcggctcctgccacgcccgccatgcccgcgggcacatgcgccttcaagcatcccttccactcgggatcgaggcctgacgagaggcaggaatcaatgggaagctccggtcccaggcagccggcgtccctgagaggtggggtagggtgctaggtggtgacagggctgcacagggcgccatgcaatgctagcaccgcatccctgcagctgggcaggagactcattcgtgaccaacgcacccgcccaccattaccttgctgcagactgggtccagggaggtgccaaggccacgacgcatgccgcccagccaccacgccgcggtttcagggcctccgccccgnnnnnnnnnnggcccagaccacgacgcatgccgcccagcccccacgccgcggtttcagggcctccgccccgctcctcaaggactactactccgtgctgggggtggggcgcaccgcctcggactcggagatcaagaaggcctactaccagctggccaagaagttccatcccgacaccaacaaggacgacccaggcgcggcggccaagttccaggaggcccagcaggcgtacgacacgctgcgggacccccaaaagcgcaccgcctacgaccagtacggccacgatgcgtatcgcaacatggagtccgggggaggccccgggccgggcggcttcggcgggccctttgggggtggggtggaggtggaccccgaggacctctttggcgcctttttcaggggtggccagggtttccaggtggggctgggtctgttgcaagggggcaggacggagcgtggtcagaccgttttgcggtctgtggggttatgggtttgaaagcagaagcgacaactctaagggaggcaccctggctgtgcccctggtacnnnnnnnnnngggtcagaccgtgttgcggtctgtggggttccgggtttggaagcagaagcgacaactctgagggaggcaccctggctgtgcccctggtactgatgcaggctgaactacatcctgtgttatgccgtcctcgtccctcccccacccatgtctcccccccacccatgtttgccccctatttgccccacccacaacacacccacccacacccatgcagtccttccactttggccacggctttggcaacgcgggcgggcggactcgccgcccgcagcgcggcgcggacctgcagacccgcctgcgcatcagctttgcggacgcgatgaagggcatcacccaccggatggacctgtccggcacgggcgcaggcggcccctcccaggtggaggtcaggatcccggcgggcgtggacacgggccagcacctgcgcctggcgggcagcggcgcgccgggcggccccggctgcgcggcgggcgacctgctcgtcttcctggaggtggcgccctcccgcgtcttcacccgcgacggctacgacctgtacgtggaggcaccggtggacatggtggacgccgcgctgggcaccactatcgagtgagcacacggggtatcgttgaggatggggtggaaaggggggaggaggggtgtgtgagcggttagagggcgtgttcatctgcatgccagtggctgaggtcgcacaggccgccctcagcatggacgccggtggcccgtcgcggcaccggctgctgctnnnnnnnnnnacgctggggaccactatcgagtgagcacacggggtattgttggggatggggttgaagggggggaggaggggtgtgtgagcggtttgaggacatgtttatctgcatgccagtggctgaagacgcacaggccgccctcagcatggaccgcggtggcccgtcgcggcaccggctgctgctgctgggctgcaaggcagctgctgcgcggagtccatgtgaggccaggcacacaatgctccacccctcgctcccctcctcccgccgcccatgcagggtgcccaccatcgacgggcgggcggaggtgacggtgcggccggggacgcaggcggacgacaagctgcggatgcgcgggtatggcgtgccacaggacgctgccggcctgcctggaaagcgcggcgaccagtatgtggtggttcggctgcgcgtgccgaggaccctcaccccctttcagcggcagtgcctggaggactaccgccgcggcgagcggcaggcggcgccgcagcaaccctccggagcggcgacgggagccaagggcgggtctgacacggcgtcagggaaggcgtcagaggggaagtcgtccgggacgtcggccagggcggacgagccggctgacaagaagaatgcggacaagggatctggaaaggccgggagtgacaagcccaagagcgtgttcgactggttcaaggggtcctgaggctgtgtggtgcttgggcatgcaggctgtaaagggacatcgttgccaggcctgtctgagaccagggggaatggcaggcgagtatcaatccacggctggctgcccgtgactgagctcagcgtcctcctccagatgccgacaccatttccaatcacaatctgcccgcttccagccctggccctgccaacacggtgtgaggttacaagcacgtgacgctaccaaatgcatgcagtgatgcaatgcggcgctgcagcggggtgaagggatggaggactacaagcggtggggttgtcctgcggccttacaatttcaagcagcactcatcgctggtcgggagcagctgcccccggcagaggttgctcgccttaaaaagtctgatttgtgtcctggggagaggctgccgacaaaactgctcagcaaatgggggccttggcagcagggagagggtgtctattgaagtggccatggcccccaggtcccacaaaaaaacttcaagagcaagcgttgcgcggtactctccacgcaagagccatccgagagacgcggcacggcccgtcgcccgaaacggccgccgccctccatctcacgggctcaggcggtgggcgtgagcgcggggggcggggcgggtgtcaccccccagatgtcctttgcatactcgttgatggtgcggtcggaggagaagaagccgttgcgggcggtgtagaggatggagcgccgggtccactcctcctgatccccgtacagctcatcgacgcgccgctgcgcatccatgtaggtggcaaagtcgttggccaccaggaaccagtcgttgcctgtgggttgtgggagtttgtgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaacggtcctctggtgacagcattctggagatctaggccaggccgcggagggttgacagcgggctggcgactgcctgtgtcaaggctatccaacatgaatatatacctcaccatcctacccctctcccgcccccacccttcggcccctccacacacacacacacactccaccccaccccccctccaccccaacccccctccaccnnnnnnnnnngtccaacatgtgtatatacttcaccatcctctccctctcctgcccccaccctttggcccctccactcacacactccaccccaaccccctcccgcccacccccctcccgcctacacaaaccccagaccactcacccttggtcatgtcggtgatggagtcgaccaggtcctcaaagtagtcggcgtcgccaaactcgccgtccttgactgctttcagcgccttggtgtagcgcgggtcatagtcggtgaagtccttgcgctcggcgcgcaggcgaggcacatcctccgccgcctcgccgaagatgaacaggttctccagccccgtgttctccccgatctcgatgttggcgccgtccatggtgccgatgatgaggcagccgttcagcgcgaacttcatgttggaggtgcccgacgcctcagtcccgccggtggagatgtgctggctcagctcggcggcggggatgatgacctccgcctcgctcacgttgtagttgggcaggaagatgaccttgagcaggtcgccgatctcagggtcggtattcacctttgcgccaatggcgcccaccagcttcacgatcttcttggccatgtagtaggcggacgcggccttgccgccgaacacagacacgcgcgggacgacctgggtaaggaggggggggagaggggttagggggctgagggaggggaaggagaggggctgccttcacattggatgggtgtgcgtttgttgaccgggattgaacagatgggtgcagatctttgtgcgatatcccgtgtgtctcctggcgccatcacagcctcgtgctgcggggggtgtcccatcgccagcatgtgcaatgggcagggcaacacacctggtcatgtgcatggcaaacctgcggccacaggcctcagcacagaccatggacccccgggggcccactcgacaccatgatcatcatcacgacggcattccagggcgccacagccgtgcacgtcaccgatcaaatcttccctgccacaccgacgcgcccctccctcccggaccccccgtgcaccttnnnnnnnnnntgatcaaatattccctgccacaacgacgcgccccctccctcccggaccccccgtgcaccttcttgcgctcctccggggacatggccttgatctcctggtaccgcacgatgagggagatggcgttgagcagctggcgcttgtactcgtggatgcgtttgacctggatgtcgaacatggcgtcggtggtcacctcgtaccccgtggtctcggcaatgcgcgccgccagcgcggccttggcggtgnnnnnnnnnnagacatcgtaccccgtggtctcggcgatgcgcgccgccagcgcggccttggcggtggtcttcacctcgcgccagcgcgcgcggaaggccggatcctccgcgcgcggctccagccccgccagctggccagcatccttgacccaggcgtcggagcccagcgcctcggtgatcagcgccgacagcgcggggttgcagtatgccagccagcggcgcagtgtcacgccgttggtcttgttctggaacttggaggggaacacctccacgaactgggggaagaggtcggtcttaatgatctctgagtggatggccgccacgccgttgacggccttggaccccaccaccgccaggtaggccatgttcaccagcatctcccccgccttccaggggttctcctgcacgatgctgtactccttcagcgcctcctccaccgggtccaggggggccttcttggcgggcttcttgccgctggcggaggtgtcactctcatcgtccgcctcgtccgcctcctcctcggcgggggccggcctggccggggccttggccaccttggcctcgacgtgctnnnnnnnnnncccctcctcggcgggggccggcctggccagggccttggccaccttggcctcgacgtgctcgcggatggaggccagccactcgtcgttgatgcgctggatgatctccatgtgccgcggcagcagcttctgcagcaccgccacgggccacttctccagggcctcgggcatcacgctgtggtttgataatgagggggttggtggagaggtggagtgggaatgagtctacggctgtgccccagccggtcagcgcagagggacccctccacctccacatggaagcaccccgcccacccggatcaccagccacccaacataacacaaccccttaaccccccccccaccaccccc

SEQ ID NO: 37843 - DNA, 110 bp, Chlorella protothecoides
agaggtgaaagctgccagggactcctgcagggtttgacgggaggggcaggaagcgtgtactggctgccattcctgtgcagaacgtgtcgccgctcctgattgagcatcag

SEQ ID NO: 37844 - DNA, 61 bp, Chlorella protothecoides
gacggccgcgttggtggcgttggccgcgccggggcggccgctgaggtcggtgcgggcgcgc

SEQ ID NO: 37845 - DNA, 110 bp, Chlorella protothecoides
gacggcctcatcctgtttgacgagagtgagtgtgtggggaggcggcttgggcaggggtaaagatgtgctgccggggctggagatgggctaggcagtgtgaaggtttcacg

SEQ ID NO: 37846 - DNA, 750 bp, Chlorella protothecoides
  modified_base (387)..(641): a, c, t, g, unknown or other
tacctgggtagaagcggtggtgcgagtgcaggcagcagcacaggaacgagaatcatcatcgtgactcctgagatcgaagggcaatgcgcacgagcgctgggcaggctgactgggtaaggagacccgcctaggatgtcccctgaactattcacaaatgaatacaaggtccgcacacaacagaaagtgcattggataaaggaatcatgttgcagtgcccatgcacatcaagctgactgaaatgtcatcagcacccctttccctagatcgccctgtatgctggatttctctgttaccgcttaaaaatcaaggattagatcgatgctcaggcaaaatcctctcgcaaaatcctctctaacacgagcaaaaacagttcgtcacggggacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacactgcatgaacaaaaagacaaggccctcaaggatcgacatgcacgtcccactctgggcgagagagccaggcttgtacggcctccgacctccgctgcatccacggc

SEQ ID NO: 37847 - DNA, 61 bp, Chlorella protothecoides
ggaacttcaaggtgtacctggactgaagcgactcccccgccactgtggtttgtacaccaga

SEQ ID NO: 37848 - DNA, 345 bp, Chlorella protothecoides
  modified_base (88)..(265): a, c, t, g, unknown or other
tgctgtggtgcttgcaatcaacaggataaatttggcaagtatggagggttttggcgcggtgcatccccatgccatgcatgattgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaaacgtactaatgtgtatctcttcaatcaccaatcactacctgatgagtaagtgtctgggcttgggataaggaagg

SEQ ID NO: 37849 - DNA, 76 bp, Chlorella protothecoides
caagataggcctggagaccagcctcaggcgagtgggtgggtgtgtgactgcgtggtggggggagaggaggtgggga

SEQ ID NO: 37850 - DNA, 97 bp, Chlorella protothecoides
tggcaagactcacctaccagcaatgcctcaaccatcatttcctttccaggccgactactccttagacactgtggaggaggtgcacttcatcaacgtc

SEQ ID NO: 37851 - DNA, 73 bp, Chlorella protothecoides
cagccacagcagagctgccaaagagcatggagactacactggcctggctgcatatgtgccgttcccttccatg

SEQ ID NO: 37852 - DNA, 61 bp, Chlorella protothecoides
cggtgatgtgcaggagcggcgacggcggggtaacaatgacgatacgaggcactgcctgcct

SEQ ID NO: 37853 - DNA, 79 bp, Chlorella protothecoides
gcgcagcagctcgcacccctccaggtcgcaagctacctgtagaacgggtggaaggaggggggcgcctcaagcaggggga

SEQ ID NO: 37854 - DNA, 61 bp, Chlorella protothecoides
gtcgaaccccgcgatggccccctcagaggcgcgctcgcgagccagggagagcagcgtcttg

SEQ ID NO: 37855 - DNA, 93 bp, Chlorella protothecoides
cagcttgatgaagtgcttctgtgcatggcttgtcaccgccctatgtgagatggaacgagggaaaggagctgccattcctacctctgaagtttg

SEQ ID NO: 37856 - DNA, 716 bp, Chlorella protothecoides
  modified_base (582)..(591): a, c, t, g, unknown or other
gctctgcctcgcgcgcggggctggtgctgccgccgcccgagcgcccgcccgcgccattcccgggcgcggacccgctgcggtccgtgccgccctcctcctcctcctcctcacgcgtgtccgtcgcgtcgcccgtgccgctgcccgacctggccccggggtcgcgggggtcggccccgccaaggtcgcgccggctctcgccgctccccacgccgcagcgctcggccgcaggcgaggtgcccgacccgcgagcctgcgcgtcgtgcttgttgacgggtgcctccgccccagcctgccgcgcgtgcatgactaggaggcgctgcgtctggaccactgcgtgcagggcgtgcagctgctgggagaagagcagctggtgcgaggccatcgtgctgcgcagctcctgcgcccgctccgcgcccagcgcgcgctccgtcagcgccaggcacggcgcggcgtcgccgtggggagctggcacgggggcggggcgggggccttcggcccgtaggccgggctgccggccgtcctccaggcccttgtgggagggggccttcccagactggggccggaatgtggtgttcgtggccnnnnnnnnnntgtggggagctggcatgggggcggtgcgggggccctcggcccgtgggccgggctgccggccgtcctccaggcctttgtgggagggggccttcccggactggggccggaatgtggtgttcgtggcc

SEQ ID NO: 37857 - DNA, 61 bp, Chlorella protothecoides
tctcccccgacccccactccccacccgacaaccccatcacgcgcgcaggcggcgcagcagt

SEQ ID NO: 37858 - DNA, 77 bp, Chlorella protothecoides
agaagcagtacggctggtgcgtcgaaatgggggtcccttttcacaaccgggagggcggctgggctaccgagcgcctc

SEQ ID NO: 37859 - DNA, 61 bp, Chlorella protothecoides
cccttcgctccatgccaggcaagcaacaattgcctcgagcacacccaccttggtctgctca

SEQ ID NO: 37860 - DNA, 136 bp, Chlorella protothecoides
tctccacggctctcctcagcagctggagggcgaggggggggggagcgagggaggtattggagatgcatgtgcatggggagacagagaagatcaattccaggatcaacggcttgtctaagccagctccacacgcggc

SEQ ID NO: 37861 - DNA, 404 bp, Chlorella protothecoides
  modified_base (114)..(316): a, c, t, g, unknown or other
ggggggggctgcggagtttgaaggccaggtggcagggacccagcccaggttccgtcccagagcagcgcgtggtgcgagcgccatgtgccacccgagtctcagccttccgatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtgagcccggccaaggccgacgccagtggccagccagcggcactgacgctgcgaagagggcctggcaggccgcgcccggccacg

SEQ ID NO: 37862 - DNA, 61 bp, Chlorella protothecoides
tgtcgacggcttcctcccctgcagaggggtaatggtgagttgttacaatggtgaatgtcgc

SEQ ID NO: 37863 - DNA, 80 bp, Chlorella protothecoides
aagcagggtgggctgccctcaggaagctggacaacgacgcgcacaaaaccgccttccaccggcagccatgtgcgcgaggg

SEQ ID NO: 37864 - DNA, 78 bp, Chlorella protothecoides
tgccgttccttcctgagacaggaggaggatgtattgtgtcggagtgggcgcttgagagtttgaataccagccgaacat

SEQ ID NO: 37865 - DNA, 93 bp, Chlorella protothecoides
caatcttcgtccatgcatccgatctgcacccccatccatccaaacccctcgcctgccccatccactccccacctgattctggccgccaggccc

SEQ ID NO: 37866 - DNA, 61 bp, Chlorella protothecoides
tcaacgcgaggtgatggtttgtaggcggaagatttgcgctccacgtagtcgtacaccaaga

SEQ ID NO: 37867 - DNA, 392 bp, Chlorella protothecoides
  modified_base (105)..(336): a, c, t, g, unknown or other
ctggatggccagaggggtggggcacgcggcctcaggctgcgcctgcgtgttggacagcatggacaccgtgaggaaggggtatggcaccgcctgcaccagggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatgctgccctggctgaggaggacggcagggaggtggagcgggcggggtggagg

SEQ ID NO: 37868 - DNA, 7856 bp, Chlorella protothecoides
  modified_base (145)..(154): a, c, t, g, unknown or other
  modified_base (343)..(352): a, c, t, g, unknown or other
  modified_base (726)..(735): a, c, t, g, unknown or other
  modified_base (1585)..(1594): a, c, t, g, unknown or other
  modified_base (1702)..(1711): a, c, t, g, unknown or other
  modified_base (2282)..(2291): a, c, t, g, unknown or other
  modified_base (3326)..(3335): a, c, t, g, unknown or other
  modified_base (3536)..(3545): a, c, t, g, unknown or other
  modified_base (3942)..(3951): a, c, t, g, unknown or other
  modified_base (4016)..(4025): a, c, t, g, unknown or other
  modified_base (4083)..(4092): a, c, t, g, unknown or other
  modified_base (4715)..(4724): a, c, t, g, unknown or other
  modified_base (5117)..(5126): a, c, t, g, unknown or other
  modified_base (5318)..(5327): a, c, t, g, unknown or other
  modified_base (6510)..(6519): a, c, t, g, unknown or other
  modified_base (7042)..(7051): a, c, t, g, unknown or other
ccccggaagagggcttcgaggcgccgcgcccggccgcggtcctgcacctggcacggcggctggaggggagcggctggcttggggccgacggcgagcgcctgggtgacacgcaggggcgaccaccgtgccccgacgcagcgagcgnnnnnnnnnntggccgcggtcctgcacctggcgcggcggctggaggggagcagctggcccggggccgacggcgagcgcctgggtgacatgcagaggcgaccaccgtgccccgacgcagcgagcggcgcccccgcgccgcctgccctcgacccctccctgccctcctcagtcctgcgcgcggccgggctggcggcggcgnnnnnnnnnntggccccgcgccgcttgccctcgacccctccctgccctcctcggtcctgcgcgcggccgggctggcggcggcgctgggccagggcctgccctgcacgggccccacctgccaggccgacgccctcagctgcatgcgggccgcgctgtggacgggcgaggagctcttcgccgctgcgcgagacctggacggcggccgcttcgccgcctccctgctgaatcactgaccttgcaccgttgactgccgactgtccacacttcctgcctcaaggggattgcatcaggggggtggcccaaggggcagaggaggggtgactgacccaaactccatctcgggattggttcccaatcccccgcgcgcgaatcgtgaacaccagnnnnnnnnnncggggattgcaccaggggggtggcccaaggggcagagggggggtggctgacccagactccatctcgggattggctccgaatcccccgcgcgcgaatcgtgaacaccagcgccctgcacgcgcgaggtgtgcaatcataacaattcgacaatgccttggcgtcattcaggcctccaggccatcctggattcgcaaccatccttctcacttgtgcctcgtcgggcccatcgagcatgcagcatgccgcgcgggcctgccggggcgtggggcgcctggtcgcccagtccccgctcgggggggctgtggatctcgccacccgcggcctggcgaccgctacgccagccgacgaggtggtagaccagatgatcgcatatgcacgggatcactacagggtgagtggggtgggagggcccattgctcagggtcgagagcagggggtctgggcagatcgtacgtggtgatgccccaagccattcccgtggccccacttccaggacaacccagatcaggtggacgacatcctgaaaggaggcctggcgatggacgtgtcggggatcagccagcagaggtgaggcggtgtggccttgaggttcagtctttggcgcatggtcggtcatggcctgcccctcctgccatacaccctcgcgccatcgcccgcctggaccgcccctgcagactttggctcgcccgcgccgacaccgcggccgagtggtcggactggcggcagtcggccgcgcacgccgccgcggcctacgccgcgccagccccctccgacgcgcctggggccacggatggcaagtcgatggcggtgtactctggcgtcgccgcgttgctggccgacggccaggacnnnnnnnnnnattcggtctctggcgcatggtcggtcatggcctgcccctgctaccggacaccctcgcgccatcgcccgcctggaccccccctgcagactttggctcgcccgcgccgannnnnnnnnntgcgccgggggccacggagggcaagtctatggcggtgtactctggtgtcgccgcgttgctggccgacggccaggacgtggaggcgggggaggcgctggagcggcccggcgttgggaggctggcgggtccctcccacgcggcgctgctggccatgctgggcaccaccttccgcgcctgcaccgcggaggacatcgccttcttccagtcatgcagcgcggcccagccgccagaggcgcgtgcggccctggaccgggaggtcgcggcggcgcagctgacacaggtgggaggtgggaacgagccgtatcgccgtgcccagcttcccaggcggggcgtgcatgcgagggcgtcgagacatgtcggatgcgaggggagcgaggccacgccagtcagacacccctcttctccctcccgtgtctcattcccccaaatcattcgctctcccccaccgaaaaaggcctggaccgcgggtgcatacgtgcccgcctacctggacggcagtacggtggtggaaagcacggcgcgcgcggtggacacggccatggcggcggccacggcgcagggctcccacgcnnnnnnnnnncctccctcccgtgtctcattcccccacatcattcgctttccccccccccgaaaaaggcctggaccgcgggtgcatacgcgcccgcctgcctggacggcagtacggtgatggaaagcacggcacgcgcggtggacacggccacggcggcggccacggcgcagggctcccacgccgcgctgggccctctgtccagccccctgcgctgcggcgaggcgctggcggatgcacacctgctgcgggcgcaggtgcatggcctgcaggggcggtgggaggaaagcgaggagagcctggccgcggcgctgagtgtggtggagggcgtgagcgcgggaggtcacccgcgcctcgctttcccgctggccctcctcgcacacgtgtacagccgcaccgcgcgcgtcaccctggcggagggcctgtacaggtgcagtggatggggggagaggatggggcctctgtggtcctgtggacctgctcctctgtccctttgctggtggggtccttgaggtgccctgcatagagccacccagccctcttgcatcgctcccttatctttccccacaaacctacagggaggcgaccaagctgctgcagctggatccccggcgggaggcgccctcggtctcggcgccggcggcgcccgcgccggcgcactggaccgtgggcgccatgctgagctggcggtacggccagctgctgacggcgctgccgcgccgaagcacggaggcggcggcctggcaggcgctgggtctgcgcctggccgagcccctgtctgccatcatgcccatgcagaccctgctggggcccctggatgtgctgacgcaaaagggggcccagcctgtgccggggatgctgctcagcctccccttccggagagccgtgcccctggtctcctgcaccatggaccccccgtgatctgaacgtaccacccctgcgcttttctctgcctcttaactggtgctggcgttggccaacatgtgcaaggaaggagacactgcagagcgtgcaaacgggcaacgggtgactttgggcgctgtcggnnnnnnnnnncctggcgttggccaacacgtgcaaggaacgagacactgcagagcgtgcaagcgggcaacgggtgactttgggcgctgtcggtgtcgatgcaggcaaagcggacgctatggcacatgctgctcaagcatgactcaggagagtgagtgacacaaatgcgcctcgggcgccaacaagaatcaaaaaggcgctggcgacgctgcnnnnnnnnnnggtggacgctatggcaaatgctgctcaagcatgactcaggagagtgggtgacacaaatgcgactcgggcgccagcaagaatcaaaaaggcgctggcgacgctgcaactacggctgaaatagtgcgagtcacgccagctcagcgcgggccctggtggcgcagggccccctcctcgcgatcaattcaaaaggggcacaccgcggtcgccaggtctatgaggaagctgggcagcatgggaaactggcggctggtctgtgccttgcccgtcacctggaaagtttgatcgggagagcatggaggggaatcacgcggatgcacacccttggccctgccgccttggcgggccccagtcccctcccccacatggtcgctgcctcaactgcctggctgaacagccnnnnnnnnnntaagtggcacgcgaccccgggcgccagccccgctgcgacgtgcgtgggcgacagcgcgcgcagcnnnnnnnnnnctccctgcccgcaaacatgtgcacaccgacacacaagagcagcccggtcctcaccagnnnnnnnnnnttccccgcccacaaacatgcacacagtgacacacaagagcagcccggtcctcaccagctccagcacgtcgtccatgagctcgtcgcggccgccgcgcatggggtcctccacgatcggctgtgtgtgtgtcttgccgcggtacagcttcaggcgcacacgcgcgcctgcgctttccagcgccgccgcgtagcccagcgcgttgtccacgggcacggagcggtcggcggtgccgtgcaggaggaggacggggggcaggtggcgtgcgaccccgggccccagccccgccgcgacgtgcgtgggcgacagcgcgcgcagcgcgggcgtgccgtgcagcgacatgatgctgccaaacatgtcgcggttgagaccccgcccgtccaggtgcgccgccagggcctccaggtcgtaggcgccagacacgcccacgaagcccttcacccggtccacgtcccagcgcggggtgcccccaatctccacttctgggagaacagctgaactggtggtgccgctctttgaccccggctgcgcgatccctgcagcgccgcccttgccggacgatgccggttcgcgctccctgacatcccccctcccgcgatccccagcgccctctgccgccaggtcannnnnnnnnngctggtggtggcgcccttcgaccccggctgtgcgatccctgcagcgccgcccttaccggacgatgccggttcgcgctccccgacatcccccctcccacgatccccagcgccctctgccgccaggtcagcgcgcgcagcgtgccgggcctgcgccagcagggccaggctgcccaggtggccgcctgccgactggccgacgacaaagaggttggtcgggtcgccgccgtacagcgccacgttgttgatcacccaggagatgcccgtgttgacgtcctgcagcatgtccagggccgtgccctggtggtggtgaaagggaggaatgtgcatggtggtttggtgcatgagcccatgtgtgataccacttgcgaccacagcagtgggacatctggaaannnnnnnnnnaaatgtgcatgccggtttggtgcatgagcctacgtctgataccatttgcgaccacagcagtgggacatctggaaaggcatggagcagactgacgacacataatgtccgacatgaacgtaggctgctgccccctcggcacccagaggagctccccgtttgtgcccacctgcgggaagttgcggtagtccaggnnnnnnnnnngatctccgacatgaacgtaggctgctgccctctcggcacccagaggagctccccgtccgtaccccacctgcgggaagttgcggtagtccaggcagaagaccagcaccccgcgctgactcagcctcctccccagcagcgccccccaggctgcacggtgaaggtggtggcggggtgttggtctgcctcggaaaggagccttgctccgccgctggctggccacgcaggcacgcccagcgcgggcgccgaatggggacccttctccaaccattggccaggtggcagggcagctgcatctctcggcccacccgctgacaccaacccctttcatgcctgcctctcaaacccccttctgcttgcctttgtagccgatggtccaggcgccgccagtgatgaagatgacggtggggagggggccctgacgctgccatctccggcgaggcacaaagacatcgagcctatttcgaggcttggagccaaaggcgatgctgcgcaggagtcggggcgagaagaagtagaagactatcatctgcagtatcgctagagagggattggtgagtgggtctgtagatgtgatatattgagtggtcaacatgcagccctgtaacgtagaaggactgcgcgcctagggatcaaacattcgacgcgcaccatagactgggtggggcttgcaggcaactgccattcgcatgctcccactgcaacatccaaacagcacctgagcgaagccggggaaaaggatggtggcaaataggaccaggcgccagaagttgaggagccacatccatcctgcaggacgtgacgtgggggggtaagctgggtgcgctatgaggcagccgggctctgccacaccaaaggtgggttatattgtcgtccgccccctcccctgcacgccaaaccctagcgcctatctgtcccctcatcccgagcacctttggcgacataggtccacagcctcgcggccagcttggtaacgaggaagatgtccttgatgccaccaacgacattctggcgcaggctgtggcatatgaggtggttttcccgagtatgggaggtgggcttggcacacctgcgcgacttttgttccatcttccagcatacccttcactgcacctgttgcatacagaagcttcgcatcccaggcctctgacagtcggcacacatacctgtggctggggatggtggnnnnnnnnnnaggttttcccgagtgtgggaggtgggctaggcacacctgcacgacttttgctccctcttccagcatacccttcactgcaactgttgcatacagatgcttcgcatcccaggcctctaacagttggcacacatacctgtggctggggatggtggcccgggcgcccggggacaggagggactcctcatccaggctgggctccgccagcagctccggctcctgggcttcctcggtctgcatgcgccccagcagcatggagcccagttcccttaagggcacgctttcttccccttcttccccgaactccacgacctcgatgtccggcagtgggccaacatgggtgatcgtggttagggcctcctcgctgaaaaccccagccctggcctcctcggtggtctcctggaccatgagggccctcggtagcgtgtgcctgcgatggggtgcagtcctagacggtgtaggcaattccctgctgtgtcccgggccgaatggtggggtgcgtctggctgtcggaggtgtcgagagnnnnnnnnnnggatggggtgcagccctagacggtgtaggtaatcccctgctgtgtcccgggccgaatggtgaggtgcgtctggctgtcggaggtgtcgagagtggctggctccacggagcttgaccggtcactcctcgcatgcactccgataagggaggggttgtcactcggattccggctgctcgttgccccgatcatgagaggggcgcagcctgccagtgccggatgcgcacgaagttgcgaggggtcacagggcacgggccgggcataccgggcgcgaggtgcccgggagcttcctgtgggatgacctgggctcggatcatgatgccatgcacaagccttatatcaagcaagcaaggtatgctgacagtgaggggcacaaaaaagcagcgatcaaaagaggagagtggcaaccaggcgcgcgaggagctgcatgaccagcagggccacgaacgcggcggccaggacggcggcgaccgcgggttgctgcagcgcctccgcagcggccgcgacgccctcgcgcgcggccgcaccggccgccgcggccaccagcgcacgaccgtcgggatccctggccaccgagaggagggagcgcgtggcagtcttcgcccacgccggctcgccgtcgggctgccgggtggccgctgctgctgagtccggcgcggcaatctgccggacgtcggccgactcctcgtcgcacatgcctgaaccatgtccagcccggtcgccgtgcgccggtccgaggcggggccgcgcctcggcgaacgccggcggcgtgcgcacggagcgcgggctgcccgcgctccgtgcgcac

SEQ ID NO: 37869 - DNA, 69 bp, Chlorella protothecoides
tggtgcgtgagcacccatttccacctccactggcaacatcaccattatggccaccaagctctatactct

SEQ ID NO: 37870 - DNA, 75 bp, Chlorella protothecoides
acagcgcctgcgtgtcgtggacgtgagacatttgaaggggggatcgcttgggcgatcggcatgggtccggtgtga

SEQ ID NO: 37871 - DNA, 4163 bp, Chlorella protothecoides
  modified_base (744)..(753): a, c, t, g, unknown or other
  modified_base (1496)..(1505): a, c, t, g, unknown or other
  modified_base (1870)..(1904): a, c, t, g, unknown or other
  modified_base (2051)..(2060): a, c, t, g, unknown or other
  modified_base (2113)..(2168): a, c, t, g, unknown or other
  modified_base (2418)..(2427): a, c, t, g, unknown or other
  modified_base (2953)..(2962): a, c, t, g, unknown or other
  modified_base (3203)..(3212): a, c, t, g, unknown or other
  modified_base (3467)..(3476): a, c, t, g, unknown or other
cccccccccccccacccttaccaccctgtcccccttaccacgcccgccgcaccgtaggtggaggcactacaagccaagctgggccagctgcacggctcagacctggtggccctgcggcgcgcctacgcctccctttcccagcatgtcgccgcactggagggcgagtgggatggcacgctggatgccgtgaaccgactgcagaccgccgtggtgtcgcccgagtacgtcgcacaggaggtgagcagagggagctgtgaggttccaccctgcccgggatcgaggtggtgatgagcgtttagcgggagggacgtggcaaccgagtcctccaggcaaatcgcgagtctcttcccgccctcgctcacgcccgtgctttcctgccccgagctccttaccagctgggtgtggccggcgccctggccgtcggcttgaccgtgctccagcacagcctgcggggtgtgatcgggcgcgacgtcctctcccgcggcgcctggctgctgggggccggggtggttgtgttccggctgacggggggcacccttgcccgctggctcagcatggtgcacgccaacatcctgctgaagcgggaactcatacagcgcctgcgtgtcgtggacgtgagacatttgaaggggggatcgcttgggcgatcggcatgggtccggtgtgatggaaagacaggggggtggggggcgcctggatgtgcgcatggcctcttcaagcatgacgtggtgctccactactttnnnnnnnnnngaagaaaggagggtggggggcgcctggatgtgtgcatggcctattcaagcatgacgtggtgctccactactttctctctcacactacctctttctgtgtctcaggtgtctgcgcctgcggcgcaggcgcagacaccctggcgccggtccttgcccccaagccgcacccccttttcacccaccccgccgcgcaggaccgcatccgcatcatggcggccctgcagacgtgggcgccccccgccggccccgccctctcctccgacagctccggcgagccggcggcggcggcggcggggtcccggcacggcacgcccagtgcgcctagcgtgcggagcgcgaccgccagccccgcgggccgggcgtcccccgccccggggacgagcagcgcgggccccagcgcctcctcctcctccagcctagagatggtggagcggccggagggcgaggcggcgggtcgcggtaccggccagggctgctccgagggcgagctgagccgggaagcgctgcgaaagtatgcgcggctgggcaagaagcgatgaggcgggctcctgcgcgggggcggtcttgacatggacacgcactgatcccccagcgctccctccgccgcctaattttaacctgggctcgctgcacggcgccaccaccgtgcaagtgcctctccccttgaacccccctgtacatcgctctagctttcttgggaggaatctcccccacccatgttcctccttgcgctgcgtcatgtcnnnnnnnnnnatctccccttgaacccccctgtacatcactctagctttcatgggaggaaactcccccaccccatgttcctccttgcgctgcgtcatgtcgttctgctcactataatcgtgtgtccgtgtacagtcaagggtttccagggttgtcatgaggggagcgagcacggacggccggcgggggcacaccagacaggatcgaggcaggctcggtcaaggtggcgattcgcggctcaccgctgccacgaaggctgtccgcatgccgcgcacgaaggcacagaagttgccagtggactgcagggcagcctgcagctctgggagctccggtagctcctgagacacgttggacactgcagggagagggaggtgccnnnnnnnnnnnnnnnnnnnnnnnnnnnnnnnnnnngaccaggtctggcgacccagcgcaaaggcatgaggcccagcttgtccgacaaatgagttaattcctgcgacaaggaagccacacctaggttgccctgattcccaccctgtccttgccccccacctgagtacgtgtcgctgccttggnnnnnnnnnnatgtgtggtgcttggacgcgcactcatcaacacctgcaccggaccttggctcnnnnnnnnnnnnnnnnnnnnnnnnnnnnnnnnnnnnnnnnnnnnnnnnnnnnnnnnaaggttgccctgattccccccgtccttgcccccacctgagtacgtgtcgctgccttggatgtggactgcaaaggtgaattcgcgctccggctggcgtggatcaatgtcgttcaggcctatcaacaggcggtgggcgtcatctgcagttggtcatggtgttgggtggcatggcagtgttggggaagtttcaaaaggggggattgataaatatctcaaggaactccttctcagctcctacagactcatcctnnnnnnnnnnaaagtttcaaaaaggggggattggaaaatatcttaaggcactccttctcagctcctacagactcatcctgcaggatcctgtgacacaaggtgtccagaccagccaggctttgacccatacccgaggtttacttccccttactggatccttgccttggcggaagtggagtcccagtctgtctctgtacagtcgcagcgcacgttccagggctcccagcttggcaagattctgggcttcggcgctgacaacgattgactgctgcgcctgcagctccctgtcaacctcctcgaccatgctgcgctgctcggcgagtaggatggggagggctgcctcctctgcggccgcctgaactgcagcggtttgtgctgccagcagctgggccttttcttccgacaggcctgtggcgtgcagcagcgggtgtatgtctctgggatggggacatgggtcggaggctggaatgattaaaggcgaacatcagagtcaccagaccatcgtacgtgtttcgagtgctcgtgctgcgcgctcnnnnnnnnnngcaaaggagaacatcagagtcaccagaccatcgcacgtgtttcgagtgctcgtgctgcgcgctccagtcgagtgtgctcggcctcgagctcccggctccgacctgcggcagtgttttgcagggggaagcgagcaagtgaacgatatgttcacggtctagctcgactccttctatccattccaaccagtatccgggcgcccaccttgcaggtccttgatgcgatgtccatgctcctgtcggnnnnnnnnnnatgttttgcagggggaagtgagcaagtgaacgagatgttcacggtctagctcgactctttcaatccattccaaccattatccgggcgcccaccttgcagatccttgatgcgatgtccatgctcctgtcgggtctggtctgcggtggacacggtgcgttgcgtccagctgtcaattttcccctggaaccctttcaactccttctggagggctggtaggtcgatatccgtcgccatcttggagcggcaatgcggtcnnnnnnnnnncttcccctggaaccctttcaactccttttggagggctggtaggtcgatgcccgtcgccatcttggagcggcaatgcggtcgcgagtcacggtggtgagcccctcgcacagctcaaatctgtcggtgtcatgcgcaggtcgagttttcagcctttccgataccccagctttgtataatcagggcttagtgagagcagccacctcgtccgggacatcactgaacagcctgcactgcgcactcggaagccctcatcccgttgcagtattcagacgtgtgctcagcctgatcagagagcagcagcgacgccgtgcctgacctcggcgagccactggccagcgtcgcgggcagtggacggtcccagcgcatcaggccggtgctcagccaacgagcctcgttgaacttagcgtgcggcacctcgtgtcgtcgtgcgccctccgagcgggcctgccgccccaccctcacgccccgcgtccgagatcccatgctccagtcctgagccggttcccgggatggaccgccccatactgaaggcgtgcattcttagcatactttgcctggcatgcgtgtgcccccggggctcggctgccgccggaacaacattcggcagcgagtcgccgcccccgatcacctcatacccaccccctgccagctctgggggcgtgctggcagccagcgggccctcctcag

SEQ ID NO: 37872 - DNA, 61 bp, Chlorella protothecoides
tccacgtccaccgcaccactggtacaagtaggcctgcaacggccccaccgccactgcagtt

SEQ ID NO: 37873 - DNA, 79 bp, Chlorella protothecoides
tggcagcacgacagcaggaagtctccggcagaataccgagagattgccaccaggggtgccctcgccggtgggccgcaca

SEQ ID NO: 37874 - DNA, 105 bp, Chlorella protothecoides
ggcggagggacgcccacggcgctcggcaggaagggcgccccggccggggttcacttgcagcaggtttcatagcctgctcatcagccctcgtgggaggtcgggtag

SEQ ID NO: 37875 - DNA, 157 bp, Chlorella protothecoides
gcgaattgctcgtgcatggggcctgacaattctggggcacagccgcgcaaatcctgaatgcagaacatgaagggatatgatggtgtcttcaaaagcccacccaccatgctcccctcgtacatccctcgccgcgtggccctccaggtgacgctgaccg

SEQ ID NO: 37876 - DNA, 82 bp, Chlorella protothecoides
cgttggacactgcagggagagggaggtgccgtgtgtggtggttggaagcgccctcatcaacacctgcaccggaccttggctc

SEQ ID NO: 37877 - DNA, 103 bp, Chlorella protothecoides
agacgcgtgaaggagaggggatgaggactggaggctgacatctgccaaacgaacaaggggcacatctaccactcagatccaggcacaggctctccaggcccgc

SEQ ID NO: 37878 - DNA, 122 bp, Chlorella protothecoides
agcggactgctaatgttgaggtcctgcacattgtagcgaggggaagggggactgtgtggtatttgaggcattccagggagatctgtggccaagcagggtcacagccgacattcttcccccag

SEQ ID NO: 37879 - DNA, 7934 bp, Chlorella protothecoides
  modified_base (208)..(217): a, c, t, g, unknown or other
  modified_base (375)..(384): a, c, t, g, unknown or other
  modified_base (812)..(821): a, c, t, g, unknown or other
  modified_base (4199)..(4208): a, c, t, g, unknown or other
  modified_base (4865)..(4874): a, c, t, g, unknown or other
  modified_base (5801)..(5810): a, c, t, g, unknown or other
  modified_base (5998)..(6150): a, c, t, g, unknown or other
  modified_base (6254)..(6453): a, c, t, g, unknown or other
  modified_base (6555)..(6564): a, c, t, g, unknown or other
gctgcgggacgcggcggcgctggcgcagcagggcgctgccggcgccaacgcgggcgcgctcgggctgggggcccgggcggaggcgcggcagtgagcggcgcctggctgcctgggagaaagaatggcgctgggtgcccctcagcaccgcgccctggctgcgcccggagtggccgctctgccgcgccgggctgggtgcatgctccctccnnnnnnnnnnctcagcaccgcgccctggccgcgccgggagtggccgctcagccgcgccgggctgggtgcatgctccctcccataccccacacacagacacaatgtgccggtgacgcaagagcatttccagccacggggattgcttccctctgcccaggcgccggtccnnnnnnnnnnccacacagacacaatgagccggtgacgcaagagcttttccagccacggagattgcttccctctgcccaagcgccggtcctgcgcgggggaggcaggcgcctgggtttcgtgcccgtttgccgcacctcaatgccagccgtgccctcgtgaacttcatgaatcacctttccccttgatgcctcgatcagtaccctgcacgtgacccggagcagctcgactgcatgctccagtgaccttcatgctcatgttttcagcagcgtcagccgagcggaggaacgtatgagagcgtggatcggcgtcccttggaacgttttcatgtgctgtgagtcaagttggattacaaacaatgtggccctgttgcgtcaggtgaaaagcaatgatgagagatcggctcccaccggcgagcactctccacccacccgcctcannnnnnnnnngtgcgtcaggtgacaagcaataatgagagatcagctcccgccggcgagcactctccacccacccgcctcagcccttctgcgcctccttccagcgcttgaccacgttgtgtgcgacgttgaagatgccctgcagggcctggccgcaggccgggcagcgccccgtgcgcgcgttctccttcagcgcgcactgctcgcaaaagtagtgcccgcagcgggtcaccacggggtcgctgaacttgtgccacggctcgcggcaggagaagcaggcaaagggcaggccttcgtcgtcctcggactcgctgcctgcacgggttgagatagcagtggagtgaaggcaggagctagtcctccgcctccgcctcccacccccaccctgcacaggacccacacctcgcctgcagccctgccaccctacccacccgaagcctctgcctcccccgcgcccgcccagttggtcagcagccgctcccgctccctcttctgcttctcctcccactcgcggtccagctcatagccggccttgtagtcgccgcggtcgtgcaggaacttgcaggcgtcgccgaagccgcagtaccccgtctccttgtagtccttgcagatgtcgggctggtagtccacgcgcaccgtcatgcgcacgttggtggaggcgcgcaaggggccgtgcgccccgccacccttctccgcgccgatggtctgctcgcgccggaagccggcgcggtagtcgcggtagttgttcatgcctttgtacgtggccccctccgcgccgccctcctccgcctgctgggccaggacctgctcccgcagcgccctggggtgatgtgaggggtgaaggaaagggtggcggaggtggagaatggacgcctgggaacccggagtacgtggcatggcatgggaatactgaatgattgcctgcagccaggaagcactggacatgcagaccctgactgggagcacgatgctgttccctacacccacatcatgcaacctcccacccaccaacctggcatcccggtcgtgggccgtctccgtctccaggttccgggtggccccaccgtcctgagactgctgcaaagtgttgctgctttcgaatgcaaacggccgcccgcccgatgccggctgttccgtaccctgggccggagcctgagtcctcgccggccgttttatgagcggagcaagtccctcaccagcctccgcgccctcccctcctgcttcgcttgtgggcttcttccggatgctgcccctgttccggcgtttcgcaaacacgatggtactgccttcgggatcagctgatggctttgaggtggatgcatctcggctattccgttcagaagcctcgggaagagggccagcttctgacgtcatgcagatggttcctgagtcctctggccacccagacagtgtcgcgacgatgacagccgtcccaagcaggggcacatatgatgtagattaaaaataccaatggagaagcagacaaagctgagatgtatgtgacctggtccagaaaagttgagatcggaacttctcggtgtgagaccacgtggtgtcaacgggcgcgagagcgttcgtgcgtgcgcgcgacgtccaaaccttcacgcgaccatgcatgtacacgagatggatcattgttaccttttggatcccaggaggtgttctgtatactgatcagctccaaattgcattgcatacgtgcccgagagacgtctctctggcatcttccaaaccccccgcaccccctgacagcgcacgtaacccattcagagtaacgggccgtgcgtctgcacttgtgcgcttaagtgtcaggctctagacgtgaatagatcgccatgcgtcgggcaaggagttgcctggggcgtggtctccgtcaaatgatggccacaccgccactaggtgtggcgcaggccaccgaggtatgcagaggagcggatcttgcagtgacggaaagacagttagcttctcctcacagatattcccacgtgtgatcctcgcagcccctcgcattgtcaaggcccgctgtaagaggcctggcatccggcacgcccatcacctctagaggggtgagtgtgggtggagctccctttgagggtgcaggtgtccagttgaggccttacgtctacgatacggccttctttggccgacattcaagggaatggattggatgctgtgctcactcacacccactgaaccctccatacaacccccttgtcgccacagccggtttcctatgccagcctggcgctcaccctcggcaccggagccggcctaatgtggtactttggccagcagcaggagaagaaggtggccagccaggccaccgtgggctccaaggtggcaggcgctgctgccatcggcggccctttccagctcatggaccagcatggcaagcccttcagcgacaagaacttgctgggccagtggagcctgctctactttggcttcacccagtgcccagacatctgccccgaggagctggagaagatcgtggaggccaagaacctggcaggttcgcggcccggtggcctggcgaggggaagggcagtccctgctgggcatgtgccatcgccggccggctgtgtgcatcatacgcctgtccgcggctgctggtgtctcgcgctggttttgaccacgctccacaatgctctccacttggcaaccacgcatgcagagaaggctacgggcaagagcatcaccacagtcttcatctctgtggacccagagcgggatagcgtggcacaggtggcagagtacgtgaaggagtttgacccaaagatgatcggtctgaccggaaccctagaccaggcatgtttgactcaggggcccttgggggtgggaatggttgattcgaggcttatcattggggcgatggcagattgcaaggggttgatccaggaccatgtggaacatgactagggacatgcacatctccccagcatccacaggcctggctgctgtcctctgtcctgtgcttggtgcatacaccagccaagaccgggccccaccctacctgactcttgatatatccccgccccgcagaccaacgccgcggcgcgcgcataccgcgtgtaccacagcaagacgggggatgagaaggactacctcgtcgaccactccattatcacctacctgctcaacccccagggcgagtttgtcacctttttcgggaagaacatgatggcggcggaggtggctgagagcctggagaagcacctccgggcgcggtaggccggcgagggtggatgtctctggtcgggaggttggagttggatgccaaagggaggccacaccatgtctgcccaaccacatgcccgcgacccctgagtgcccgacctgtgtggcgccctcccggccacgttgcggagagagtccctcccctgacttcannnnnnnnnncctggtcggtaggttggagttgaatgccaaagggaggccacacttatgtctgcccaaccacatgcccgccgacccctgagtgcctgacctgtgtggcgccctcccggccacagttgcggagagagtccctcccctgacttcagatgccaggggctatggcacaccatgtacacacaaacaccatgtgctgcacatgcttccctgcaacggtacatgtccagcggcatcccatgacaaatccttcagcccgccttctggcgtttcttagcagcgccacggaacccctgtcccgcagccctgtccctgtgcctcgccgcagcggctgcaaactcctcctcgctgggctcggggtcaccgctggggttcacaccatattttgaagccagggcgtcgatgaaggatgggccgccgctcctccttgaccttcgcaatgtagcatgggaggggtgggtggaaggagatgggcgagtatgccagctagttacctgccggccgatacagtcaagggagcgcatgctctacccatcaatttaatagattgcttccactgaccacgcctccaagcccccagaactgcccagtccctaaccctaaagactcaccgaatgagggccacaagatccgacgtgttgccctttgtcttctccttcttgctgnnnnnnnnnntgatacagtcaagaaaacgcatgctctacccatcgatttaatagattgcttccactgaccacgcctccaagccccccaaactgcccagtccctaatcctaaagactcaccgaatgagggccaccagatccgatgtgttgccctttgtcttctccttcttgctgccacctcccttggccacgcttgttgccaggtcgggggctttacgcctcctcattttcttctcccaagccgcaaacttcttggagggtgcctctccgctagtccgtaggccgtcggcgatgatgtcggcaaaccggtgtgcatcatgcccagggtccgagcacatcacccatgcaaacacctgacgggggtggaggtgaggtgatcgtagactgtcaactatcagaaaggggaggtttgtgatcgcaagccaatctaagcttgcccaggcaacccttcatctccagaatgaccctgcctccatggcttcactcaggaaccggcacaccttgtccatgtccccggaaaattggtcatagtacttcaagacatccgccttttcctcctcagacccgcgatacttggcctcaaaatcgtcgagatcttgttctgtgacctgcacgcagcatggagcctcttgggtttggcggatcgcatgttgagatgctgcaacccaggggtgcaaattctggcacccttcactccaaatccgaaccgggccaggtcgtttcacacccagctcccccagccagcgcacctccttatacatggagcggtaaaaatcgaataaatcttcaaaagatccggctgaggggttttccaggtcatctgcgacacctgtctcatcataaagcttgcgcctggtccacaatggagacgaagaagtgatgatagcagagtatgcaggatgcaattagcacaaactatcccaccttaacataccttnnnnnnnnnntatagcagagtgtgcaggatgcaatcagcacaaactatcccaccttaacatacctttcctcgtcccctagcacagcatatacgcgcgctagggtctggaacctctcattggccgtttcgtcaccagggttcttgtctggatggaggagcacggccagcttcaaatagctctttcggatcgcggcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggaccgattacccgtcatggtgtcgagtaccagactctctcaccctttcggtaatctattattaccggtcgattacagggcgtagctctggcaatatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccgcaacccttctcaaagatatctcctgaacctaattagcatatcgcgccctggtcctgctgcctgacgtgcgcgcgttttaaacctcccaaccgcagcnnnnnnnnnnagtacttccccatagtgtcgcacaccatttcatacctaaagcctcgcacctgtgtggctgtgctgtccaggcccagcacttcgtatagggaccgattgcccgtcatggtgtcgagcaccagactctcttaccctttcggtaatctattattaccggtagattacagggcgtagctctggcaatatgtcgagctggcaaagagctgctggcccatgcacgagaagggcatggctgtgcattttcttctcgtcctcctccagggcaaatctcgcagtaccctcacaaccaacgatgccggggtatgcgggagcggctcaccgtgtcctccgagcggtcgtccgcccagcgtctgctcgggaatataccgcaacccttctcaaagatatatcctgaacctaattagcatcgcgcgccctggtcctgctgcctgacttgcgcgcgttttaaacctcccaaccgcagctggcgacagcagcgacgcctgcgaggatccgggaaccagctctgcccccgcagctcctgtcaaacgtactagcgatgcctgctggggtggtgtcggatgcccgcgcgtgcctcgcgaccccaacagcgtgatccgcctgacacgtctgggatccctcccacgggaagcaccccagcctgggtgagtggatctgtgacgtctctgtcacaggagagcatcgaattgagtcctttgcatcttgatttcctgagatatatattttcgagtttgtcttgcgcgtgcaggctcggtcctggggcctgcatcccgggcacactcttcagcacaccgaggaggcaggaggcagcgaccaggtcggtcggcatgggaggctgcgtgactgactggaatcaggtggagggcagccacggaatcgatttgagccgggtgtgagttggaatgacccacatgatgtcgtgcaaggggcacagcggctgacatcctcttgccccattcatcccgcatcgtgtagtctcacagctcccaggcctcttcacccaccaagcacgggttgccgaacccaatggcctctcgccatcgatgtggtccgagcgtccacgtcccctccagccccccaatcccgcccgcccagctccaccgctggctgggcgaagcccccccgccaggcgaaggcggctggccccccccgggccgcgcgatggccggggcccggcacgagggtttcgccgcgcccggcggcacgccccagagccgcgcccaggcggcggcctccgaccccgtcacctaccagacccccgcagagaaggaggccctggccgattctagcaaccccaccgccccgccttcggcgcgcggcgcggctcgcgaccctcccgccggcggcagcggcggctggggcggcctcccc

SEQ ID NO: 37880 - DNA, 71 bp, Chlorella protothecoides
ctgccggatgctgcggcgtgtggcttggggagggccagggtgcctgtcagccggctccagagtcgtaggac

SEQ ID NO: 37881 - DNA, 132 bp, Chlorella protothecoides
ggtggcgccgaggctgccgggccgcgcgggtgcggccccggcgccgccgcgcggcagggatcccgtggcgctgccgagggactggcccgagggcgtgagggcgaagggcagcgtgggggagcaggaggtagg

SEQ ID NO: 37882 - DNA, 61 bp, Chlorella protothecoides
ccgacctgcccggcctgggtgggcgcgcagctggtgtgcgccgccgggatgcgctactgct

SEQ ID NO: 37883 - DNA, 88 bp, Chlorella protothecoides
tcatctcggaatgggcaagtcaagctgaggggattcactctgtcggtgtgagcatggccaccagggtctgcattgcatgccccccaat

SEQ ID NO: 37884 - DNA, 72 bp, Chlorella protothecoides
gagggggaggggagcatggggatcattcatgccatgatggcagcgagcagccatgccagatctgttgtgtac

SEQ ID NO: 37885 - DNA, 61 bp, Chlorella protothecoides
gtcgtcattgggattgggagcgtcgggggataatgttgagaggaagggccgtcgagcctcg

SEQ ID NO: 37886 - DNA, 90 bp, Chlorella protothecoides
tgcgtgcgggggggggggggggggggggggtctgggtaaggtcctcagtatgaggaaagtgccgaggagcaggcgcagaccacagtactt

SEQ ID NO: 37887 - DNA, 55789 bp, Chlorella protothecoides
  modified_base (652)..(661): a, c, t, g, unknown or other
  modified_base (727)..(754): a, c, t, g, unknown or other
  modified_base (920)..(929): a, c, t, g, unknown or other
  modified_base (1358)..(1367): a, c, t, g, unknown or other
  modified_base (1916)..(1925): a, c, t, g, unknown or other
  modified_base (1993)..(2002): a, c, t, g, unknown or other
  modified_base (2062)..(2071): a, c, t, g, unknown or other
  modified_base (3976)..(3985): a, c, t, g, unknown or other
  modified_base (4296)..(4305): a, c, t, g, unknown or other
  modified_base (4485)..(4494): a, c, t, g, unknown or other
  modified_base (4860)..(4869): a, c, t, g, unknown or other
  modified_base (5366)..(5375): a, c, t, g, unknown or other
  modified_base (7703)..(7712): a, c, t, g, unknown or other
  modified_base (9075)..(9084): a, c, t, g, unknown or other
  modified_base (9826)..(9835): a, c, t, g, unknown or other
  modified_base (10090)..(10099): a, c, t, g, unknown or other
  modified_base (10757)..(10766): a, c, t, g, unknown or other
  modified_base (11615)..(11624): a, c, t, g, unknown or other
  modified_base (11809)..(11818): a, c, t, g, unknown or other
  modified_base (11895)..(11904): a, c, t, g, unknown or other
  modified_base (13870)..(13879): a, c, t, g, unknown or other
  modified_base (14638)..(14647): a, c, t, g, unknown or other
  modified_base (16782)..(16791): a, c, t, g, unknown or other
  modified_base (18436)..(18445): a, c, t, g, unknown or other
  modified_base (19445)..(19454): a, c, t, g, unknown or other
  modified_base (20164)..(20173): a, c, t, g, unknown or other
  modified_base (20660)..(20669): a, c, t, g, unknown or other
  modified_base (20897)..(20906): a, c, t, g, unknown or other
  modified_base (21291)..(21300): a, c, t, g, unknown or other
  modified_base (22952)..(23048): a, c, t, g, unknown or other
  modified_base (24183)..(24192): a, c, t, g, unknown or other
  modified_base (24721)..(24730): a, c, t, g, unknown or other
  modified_base (26990)..(26999): a, c, t, g, unknown or other
  modified_base (27559)..(27568): a, c, t, g, unknown or other
  modified_base (28216)..(28225): a, c, t, g, unknown or other
  modified_base (28424)..(28433): a, c, t, g, unknown or other
  modified_base (31199)..(31208): a, c, t, g, unknown or other
  modified_base (32039)..(32048): a, c, t, g, unknown or other
  modified_base (32579)..(32588): a, c, t, g, unknown or other
  modified_base (33316)..(33325): a, c, t, g, unknown or other
  modified_base (33671)..(33680): a, c, t, g, unknown or other
  modified_base (34035)..(34044): a, c, t, g, unknown or other
  modified_base (37359)..(37368): a, c, t, g, unknown or other
  modified_base (39423)..(39432): a, c, t, g, unknown or other
  modified_base (39758)..(39767): a, c, t, g, unknown or other
  modified_base (40115)..(40124): a, c, t, g, unknown or other
  modified_base (40287)..(40296): a, c, t, g, unknown or other
  modified_base (40632)..(40662): a, c, t, g, unknown or other
  modified_base (40855)..(40864): a, c, t, g, unknown or other
  modified_base (41447)..(41456): a, c, t, g, unknown or other
  modified_base (41872)..(41881): a, c, t, g, unknown or other
  modified_base (43394)..(43403): a, c, t, g, unknown or other
  modified_base (43494)..(43503): a, c, t, g, unknown or other
  modified_base (43613)..(43622): a, c, t, g, unknown or other
  modified_base (45412)..(45421): a, c, t, g, unknown or other
  modified_base (46173)..(46182): a, c, t, g, unknown or other
  modified_base (46826)..(46835): a, c, t, g, unknown or other
  modified_base (47204)..(47306): a, c, t, g, unknown or other
  modified_base (51383)..(51392): a, c, t, g, unknown or other
  modified_base (53684)..(53693): a, c, t, g, unknown or other
  modified_base (54186)..(54195): a, c, t, g, unknown or other
  modified_base (55538)..(55672): a, c, t, g, unknown or other
ccccccccacccccagtgcacgcccaaccccggctcacctcgatgaagcggagggactcctcgtccgtccataaccgatattcaaagtcggggtgcaggtcgatacaggacttctgggccgcccgccacttctcggggatgtccttgtccttccaggtctggtgaatgatcttgggcaccagggtggcgttcttgggggcctccatggacatgacggggatggccggccccagggcccaccacccgtacgcgtacgcaacgctcgtcacggccgacaggtgggcccagcacagccacagcaggaccaatcccgcgagtagcagggtgagaggcttccgggaggctccgcagcggggcctggaggccagcatggcctcgaccttgccgcgagtgcacccactctgggtcggccggtctgtagtcctccttgctcagtccagaggtggtgtatctgagcgacgacaacagctcgcgttacaccgttcagaaagacagccaaatgcgtgcgtgcctggtctcaggaattcaacaccgcggtctcgtcttgtctggcagcttcaacgtcagcgccctatttcaaggtgcccaaacaggtgagatatacatatagaatgctgtcgttcgcatggttcgttcataccatccagaacannnnnnnnnnttaaacaggtgagatatacatatggaatgcgctctctcgcatggttcgttcataccatccagaacnnnnnnnnnnnnnnnnnnnnnnnnnnnngtataagtgattcgacgcagaaaatacatccaggagggctccttgaggctgcagcgtcgtaggggaagtcccctgtatccactttcgatgccacacgatcccccttgtcccgaccaaggatcaccccccttgtcacccgagctcaggacgccgccggcgggcaggnnnnnnnnnncccccttgtcccgacccaggatcagcccccttgtcgcccgagctcaggacgccgccggcgggcaggggcatggggaatgccgggcagagacaccaggatgcgctgctggcgccgtctctctgcccaccaagatatgtagtacacatcggccagccagtcgccaaagctaccctcgtacaccgtaccgagcgcctccaagccggggtacaccaggcgctggttgagtggcgacgatggccccgtgtccagcgccgccagtgagcccccgtacctgggcaggcatggcgggcaggggacggggcttttgcgtactttgaatgtcaacagagaggctgtcggttctgcagcgcatccccactcacggtactgagcagtcatgtttggcattgatggccttcccacggtcaacaggggtctggtctgctgtcnnnnnnnnnnccgcatccccactcacggtaccgagcagtcatgtttggcattgatggtctttccacggtcaacaggggtctggtctgctgtcgaggagggctgcccccctcctcccagcgcccccaccccagttccaatcccctcacttcccgcccgcccaccagacaaagttgcgccaggccatggtgtctgggctgtactgcaaggtgctgcccgcctgacagtaccccaggtgaacggggaacccctgctcgcagtaggcaggatactctgcggcgtggaagagcaggcccaggccctgcccggcagcatgcgcgcggaagaggtgggcgtggtgcagaccgtggggcccaagggccacgggctgcggcgccgcagcgtgcacagcatggaaggtacgcgccagccaggagttcagggcgcggtctgcgaagcgccggccgggcccctccctgcccagcaggcggcagcgtgggtggctgtgcagggccatgcacggcgcggcgcggggtcgagggtggaggtggccgaggagcgcggcccccttgcactgctccnnnnnnnnnngaggaccacgggctgcggcgccgcggcgtgcacagcgtggaaggtacgcgccagccaggagttcaggnnnnnnnnnngatatcgtgggaggggcaggctgtggcattggctgtcatcgtcactgtccagaaactagnnnnnnnnnntggcgcgcggtggggtcgagggtggaggtgcccgaggagcgcggcccccttgcactgctccgctgcgactgcctctgacagcgcttgccaggagttgggaggcagggggcaggggaggatgcggatgctggcatcatgggctgcctgcaacatggattgagtgtgtaatatcgtcggagaggcaggctgtggcaatggctgtcatcgtcactgtccagaaactagacaacagctcaggaattgacactgcacatggtgcaccatcaagcagtagctaacctctggctgaatattgcttcccatgtgctcgaggatcacgcaagctgctgcctcccccgggctgccattggcacatcggagtcgcccgtgcggcgctgatctatatctttgcggggacatcgtcagcaaggaaatggtgcagggggctgtctgctgcaatcgcatatcatcgtagcatgggaaaggaataggtgtggacgagggactgggcagcgatgggggcgtgtgttgattatttttcgtttgggggcaggagaatcacgcccaccgccaggtatcgagaacgccgtggaacccttcagctgcataccatggtcccacattcaactacaaggttggtgatctgctgagggcatgggatggctacatgctgcatcagggtgcaaggaactgtagtcttgtaccaaagtgtacgcttcaccatcaatttgaaaagtatgcaatgcatgagatttgttgaagggatcatggtcgcaggctgaggtccccgtggatccacactcacatcagtccctgccagtgacaactacaaaccgctcaatggtctcttgagcttcatgcacgctgtagagtgtgttggaagttgcacatcctgagtggtgtggggagtggctccatctgcacttcctcaaacggcctctcaagagtattaggagacaaggccagtgatcaactgtcatgttcaagtgctaattgtactctggttcttgaaaggccatggacttgatgtattgaattgtgacagatgccgggtgcaaatccttgcaactgtaagcaagcccaagcaggtcaagcaaggcacgagacataagctcagctgacatgtactggagcgccgctttcgtagaggatactggatgaagcagacagcgctcacagcaatgtctgtggcatgtcaagagggccaaggctgcaaggcagcaagatcatcagccgcctccagcccactgatggcgcccacagtgtgtcaaaatctggggccctacgaccacaagtgatcatgatgactcatcttcctgtacagggaaacaattatgatcatttgtgtgtgagagtgaggttcgaagatctccttcaacgttttggtccaggcatcacaaccgcgtcaaggcatcacctcgggcttgccgacccgtagaccccagccctttatctaatcttcactaccttggccgataggacgacgtactcggggggtggcgtgggaaggggtgggtaaactgccgggccatgcttcctatcgctcaggttgctcttcttaggcctcctgtgcgtgtgcttcctgcatgggggggataagcacgaccctggtctgcaccatagtcctcaagttcatgcactggaagatgtcccagcagcctgaaatccgcaactcacttcgtcgacttgaactgcggccgtgttgctgccgtgatcgtgcattgccgggcgcaggaggggcccaccaccagggttggagccacgaaagcgcactgcatgtccggcctgtcgttgttctaacaattgaagctgtataaagagatattcgaaggctctatggaggaactcgaggtccactgccagtcgcttatgctgaaattgctggcccggaggcctttcgcgcgtcctcgcccttatccaccaagnnnnnnnnnncgctgtataaaaagatattcgaaggctttgtcgaggaactcgaagtccactgccagtcgcttgtgctgaaattgctgcccggaggcatttcgcgcgtcctcgcccttatccaccaaggctgggcgcatgctttacatgatgtggagcagagatcagggaggtgccctgaccacggctcaaccgaatgcataacattttctcggtccagagtgcataccttctcatgcttacaccaggaaacgccagggatcctccagcatacttgggctgacgtacaagttcccatctggagggcctgggaaagtcacgtnnnnnnnnnnctacaccaggaaacgccaggggtcctccagcatacttgggctaacgtacaagctcccatctggagggcctgggaaagtcacgtggatggtggctgagcagcactgccatcctcgacccgagtgctccatgcagatccaacaaagacaccgatgacctgtgctctggcgaatgagatccannnnnnnnnnagccatcctcgacccgagcgccccatgcagatcaaacaaagacactgatgacctgtgctctggcgaatgagatccaacacccaccactatcaacccaaaaccatacctgagtgggcaggtccattccgacctcctctccccctaccgcctcctccgcggcctttcccccttcctggtcccctttccctccagttctgctggtgctgcggcggaggaggttggggttgccccagtggtggccgtggtggggcccctggaggcggggtcccatagacttggggccctggcagaccaggtctccaagcggtccctggcacgacctggtgtggacggaaggcagggactggctgtgccatcccgggaggnnnnnnnnnnggaggttggggctgcgtggttggtgggggaggtcggggctgcgccatgccgggtggagggggccatggtgaagtggccaggcaggacgggggtaagggtaggtgctggtgcagcactggtcttgagctcgaggaggcccccagaggattgctgtgcagtttggggatcagagtggtgtctgagagggaagaggaatatagtcgagtcaggaggagcagttgactataccatgcagacctgtaaaaggaaaagcctgctgagcttgaagcgggattcttggtcttgacgtcggctaatgggttgatgagtgggcccttaggcgcatcactggcatttgaaatatcattggcactgctggatattgccttcaggcgttttcgtcggtcctccacagcctccatggggtagccacacaagcggggctattagccgttcgtcggatgattgaggaaacgaaaggcgatgtccttcatcaatgctcaggatatgacaggatnnnnnnnnnncagccacacaagcggggctattggccgttcgtcagatgattgaggaaatgacaggcgatgcccttcatcaatgctcaggatatgacaggatgccacacaaacctctgtcgattgcctgtctgcgtggatgggagttgcgagcattccctggtgtgggaaggtttgcatggcgggagccctccttcgaagtgcgacactccacacccggatgcggaccccagccccaatgtccctcgcggatcatcctcgggagaggcaataagtttgacgaccacaggtgtgtccccaccgtcttcataaagacgcactcccgtgccctccacggtttgaacagtgcagctgctgcgctgctagacagcgctgagcattaggcgaagccccaaatcatcgtgatccttcatatctgagaccagcaggcggtcaaaataggcagaatgatggctgtactccccgccgctgcgcctgtcctgggcgacgatcgcttcgtcctggagtgtgagtggctagcagggcattgtcactgatccgagggggcgtcgagcatgatcccagcagattggaggcagatcagcatgtccagggctgtgtcatgatcacaaccatctcgcccccacgcccaggtcctgctgtggacgccgagacggaggaagcctcggaggctgaggaggagttcgaccctgaggacgaagacgaggatgaggaggtgtgattgcgtgggtccagtgagggggcgccgcatggaggtgaaggacactgcagactggatgctgggcgggtttggtgcttgtaatatcacctgtcttgcacccaccaggaggacgagggcgaggagggcgaagaggaagggggatcccccggcggaggctctgctggcgatgaccaggtgaatgggtgggccggcatggggagcgaggctcgtgctgtacttgcatggggggatgtgtggcaacgagagaatcatgccccacagccccgcgctgtgaggtctctggcatagccaactttattgccctgatgcatgccgccctgccgtgtcatcaacccaggaggatgatgaggagaatgacgaggcagcgggccctgccggcgatgacgaggaggaggcagatgaggaggaagaggaggaagaggaggtcagtgctggcaccagggattgatatgttgctcctctgtctcctcgagttcctgctccctttcaggtgccatacttgcatttgcgccccacccacctctcgctcatctagatcccgttgcctttccctccccaggaggagcctggcaccgaagccctgctggcgaaggagcctctgagcgatgacgaggaggactatgccgtgagtgcgggccgtcggcctggtgttgactatgacctgtttgtgcgccccttctcttggcacacgcagctccctaccgccgtaccaatcacggcctgcacgatggcacaggaggaggaagagccggctgatgaggatctgctcgacagcgatgaggacgaggacgacgcccccaccccaccaccttccaagaggaaacgcacctcccaggctgcagaggaagaggatctggaggaaggtgtgcgattcttgattgatggcaaaacatgctgggtgtccaggggatggcgatcgctcagggatgcatggcgatgagggacgtgagaatcaccggttctttgcctgcctatttgtcgcttgatcccctgccacgcctcccaccccacccctccatcatgcccacaagcagaggacgaggatgatgaggatgactctgactttgagggcgacgagtaggcgcctgggggcgaagaacagacagtaggcctgagtcctttgcctgccttccaggtgctgcaatgcttcctgtcgaccttgcttctaccccccccctcgcttcgcatctgattcgtatgcttgctcctcttgccccctttctcgctacggtcgatgttacaggaagagaggtggtcagtacagctccaggacatacccggctgcggcgaggaaggcggcgctgaagagcagcgtgaccgccacgcgctgcagtcccgctgccagcttcccagtcagcgtggacaccagtctggacagggctacggcgcccaggacggcgcccacgcccactcccgcgatctggggtgtggagggcagcgcttgttgtggcatgcacgagggtggcatgcacaagggtggacgtgtgctaagaacagggatcttgcccgtcagtgcatgctgccggagcgagcgccaggcttccttcaaataggatttggcacccctccatgccctcctcaaaccttgttcccgaaaaactccccctccccacctggannnnnnnnnngaggatttggcacccctccatgcccttctcaatccttcttcccgaaaaactccccctccccacctggagggcgtgcttggtgccgtcgtccagcgtggtcaggcccctcacccccgcccgcagggggacggccacggtgcgcagcgcgcccggcagcacctcctcagcgtcggtgatcagcagcgcgctgactgtgcccgcggcggccacggtgctggcgatggtcaaggccgagggccggcgcggcccaggcgggccgatgggcacgtcgccgcgctccaggaaggtgcggacgcccagctcgccgccggcaaagccgccggagaacgcgtcacggtagggaaacttgcgcgcgtctgcggtgatccagcgcccgcggccgacgtagatgcggtcgttcccggcaaaggggtcctgggcggggcggggcggggtgtcggccagcggcgtctccagcggtgcgtcctcataccgcgcgacgtcgccggagcgctccaggaaagcgcggaggcccacttcgccgcccgcccagcccccgatgcccagcgcgtcacggtcggggtagaggctcgggtcatccaccacgatgcgacccgttcgcccccgccggggcttgtagtcgcctgccgagggggaatggggggttgaggttgcgagtgagtttgggtttgggagggagtggtgacaccgtggaccagactcagtgggcacctgtcctgcatgggagaagaacacttgcacaccaggctactcaccctttgggaaccctatgtacagcttgtccttagcctggtctacgggctggggcttgagctcttcctcctcactgtccgtggaggaagaggcgctggcctccaccgtcttgacagcggcctgcagtggaggggaagagtaaatgggatcatgacgacgtcgagcatgggacacagaaagcactcgaccacagaggcatgctcatggccccacgcaccctggttcttgtagtaaagggttgtcgcgtgctcatgggagcgagtcgtgagctccatgccccgctgtgatgtgtgatgctcgacccgggcgcgaccggccgagctatcatgctggtcagtgtctgtgtcatgcttacctcagatgccagatagctttggaaataatatttctcgacttggtacagaagagtgggtcgccttggcgttttgtcatcaatgacatgtattagctacgtgccctcagttccatgcaacttccgtcctttcctcagtgcgaccccgcgttccaacaaagcagtatgtcctgaagtcgatatctgggatgccccatgtccatcctcaccatcacagcttatcaagaaacagtcttggaggtgcgcaactgctcaaannnnnnnnnnagtgtcctgaaattgatatctgggatgcccatgtccatcctcaccatcacagcatatcaagcaacagtcttggaggtgcgcaactgctcaaaataagcctccagcgcggccctgaaggcactcagcttggcctcagtcgccaccgacatgccccctgtcttgacagatagccacactcgagcctcaaaggcggtggcatgggcattgggattgcacatcgcctgaagcgactgcctggaatcagagctcccacctgcaaagatggtgcagaggtgctgttcggtgttttcgaagcttggatggcagccgaggacacgagctgcaactgctgcgtcttgcatgaccgtccaacccatgcctacaggcccagtactcaagaacattgaaaaaagccattatatatgatcaacccaaacccaactaccttccaaagtcacgctcatgctgtcccagcgcttgggtcgctcagcggtctgcttctcctgaaacgttttgagaacattgttgagacctacggccagttgccgtgcttccgcttcctctaatgggatggacagagtggtcgattccacctggataacgaaggggcggatatctgtacgtgtggtgggtgatggggggaagattgggaactcttctgctggttatagtctccatgctggacatccatgcgcgcagagatgcagctcttccccatgcagttcctccacacagcattacgatgagcagagcatgctagctnnnnnnnnnngatggtctccatgctgcacgtccatgctcgcagaggtgcagctcttccctatgcagttcctccacgcagcattacgatgagcagagcatgctagctgcaaggtttggtctagatggcagcataatgcacctatcctcctcaccagtgtgcattatgactcggcaccgtggctgcagcgtgtgcgagcagcggagggcaggtcgccccgggcggcatgtgggtgttagtgagagacaggacattattctgtgattnnnnnnnnnnctcatgctggtgtaattgatgagctaggggccgatcactcccggaaatctatctacgtccgagatgcatagcgttttgcaaagcgcagcaccatgcccgggcgctgcgacgagattgctcatagccaatgtgacgcgactttgtcacgaaaaagacaatccggatccagtactgctattcgaaccaagtgaaatacctctctctgcgattattaagagtggggccacggcctgagagacgggcaaccccgcacgcaatgatcactcaacagggccgacacgcccaggagttcgacttctttggtccgtacctgggtcccataggcattaccctcggacttccagtcgtctgctacctcctgtactttagctgcgggcctgagtattgcttcagcctcaagcatccggccctgcccggcctcacctcctccacaccaatttttagctggcgagccctgggggtgtacctaggctggctttcgtttcaggtgttactgcacctcctactgcctggcaagcacgtccaaggagtgcccctggccaatggcgagcgcctcctctacaagttcaccggtgtgccactggggtgatgacgtggtgtgctgttgttgatttgggtcaagtgggaccccagccggcccgcctcgccggctcaaccnnnnnnnnnncgacgtgttgtgctgttgttgatttggatcaagtggggccccagccggcccgcctcgccggctcaaccccttttctctgccacatcacgtacgcaggtatgcagaacctggtggtaactctcgccctcgtctttggcctgggcttcgccaccgacgtgctgaacctgggctgggtgtacgacaactacctccccctgttcactgccagcctgatcgtgagcgtgctgggctcggtggccctatttgcggcctcccacagcccgtggcgggagcggccgcccctgctggccgcggggggggacactgggtaccacatatacgacttcttcattggccgcgagctgaacccccggatcgggagcctcgacctcaaggagttctgcgagctcatcccgggtgcgtgtgtgtctgggagcacccctgttgtttggtagatgtagcagggatgtggggctgtctgcatccaccccaacccccgggatgaacatcaagcacatcgtcactgacactcaagtctcctccaccaatgtccgtgatttgccacagggctgatcgggtggctggtcatcgatctggcctgcgcacacaagcagctgcaggagcaggggtctgtgtccgtgcccatggccctcgtctgcgcgttccaggtctgtcctggcgaatttaagctgagcttgaacagagttcttcagggtagtatgcaaatacatggagtgtacctgtctgaaaaataagcttcaatgcagcattactgtgtgcttcatgcaggaccccaggccctgacctccctgcaccctcccatagcccccgtccacaatatctcattccaactttctgccactctgcagnnnnnnnnnncaggctgagcttgcacagagttcttcagggcagtatgcaaatacatggagtgtacctgtgtgaaaaacaagcttcaatgcagcattactgcgtgcttcatgcaggaccccaggccctgacctcccagcaccctcccacagcccccgtgcacaacatctcattccaactttctgccactctgcagnnnnnnnnnntgtcgtcactgacacccaagtctcctccacccatgtccgtgcttgcccacagggctgatcgggtggctggtcatcgnnnnnnnnnnggcctgtatgtctgggacgccctgtaccacgaacccgccatccttaccaccatggacattgtgtcggacggctttggcttcatgttggcctttggcgacacctcgctggtccccttcacctacagcctccaggcgcgcctcctggtcagccgcgggcccacgctgggcgcgctgagcatcgcaggcctgatcgcgctgaaggggctgggggacaccaccttccgcggctccaacagccagaaggaccagttccggcgcgacccagggcacgccagcgtggcgcacctctccagcctgcccacggagcggggcacgcgcctcttgacctcggggtggtggggcctgtcgcggcatcccaactacctcggggactggctcatggcgtgggcctggtgcctgcccactgggagtgcggcagggctggtgccctactactacgtaatctactttgcggcgctgctgggtgaggggagagagctatggaggggtgatgggtggggatcagagagcagtgtcaggggcaagcgagtgcaaggggagtgcacgctgtcgctatggtgagttggcctccgcattgccaaataaagtgtgtgagtttggatcatcacagcatgaccccctcaagcatccccattgcagtgcaccgagcgatgcgggacgaccacgcatgtaggctcaagtatggcaaggactgggacaagtactgcaagctggtccgatggcgcatcatccctttcctatactgacaccaccaacactgcaattatttcgtgctggcaacgagcacatgtactgtttcagaggtcgacaaggtcgcaggaaagacaacggaactggaggagatcatcggtgattcggtgcaagatcgtagagggtgagcctggatacattggtccagggcatggtggtgctgggtacggacggacaagctgggtcagagagggagggtggactgagtaagctctccacctggaacatcagaagggtttgccagtgttgacgatcattcagggtttcggtgtctcaaattgcataactgatcggcgaagtaatcatcgaatgtacgaagagaacatcaaagcactggtgtgtccatgtgccgctgctggttgttgggaatgtgtgaagcaagtcgttagccgggcggctggttaaaaatcagtcggcttcgtcgatcactgcttgatttggtggagcctcgcactaaggcagccaagttgatccgctcgcagctctagggtaagacgtacatgcttgaactacatttacatgcacccctgactgtgcgagaggcggcgcagaacttgagattcggacattacttaatgagcttcgactcagctactatcgacggtccggacggcgtccaccactgtccaaaaaccatgctcaaccttgtgcaggcggaaaagcaaggcataataatttctgaaaggtttgaacgagtattaagcgacttcattaagcagaatggtagcccaaagcctctttgcgcggacaattccacatggtcgacagggttgcaatcggagaagcctgctggtcaaggcgattgcggcaccacccaaaccgtcaaaggcaaataataagtgagttctgaacccacttcaatggctttttagattgggtatgcttcgatctttggagctacgaggtaacacgaggtttgaagatgggtggcgccgaaagttgctcaccttttctcatcgcaccctctccaccacaaaaccaggctcggggagagggctctgggatttgtgtccaaggttcaacccaaggtcagaatagtgcagtggggagtctgaaacgggtctatctggatatgaactgtaggctttatcatagtttatcttgttgtcagacttccctcctaaacttgtgctcatacacagcatgcagtcacccccctccactcaatccccttgtgcagcttctgatcggcggcaagttcgtggatgctgctggnnnnnnnnnnaagaacagtgtggttgggagtctgaaacggtcctatctggatatgaagtgtaggcttcatcatagtttactttgttgtcagacttccctcctaaacttgtgctcgtacacagcatgcagtcacccctccgttcaatgcccttgtgcagcttctgatcgacggcaagttcgtggatgctgctggtggagagaccttcacgtctgtggacccccgcaatggcaacgccctgctggagatcgccatggcaaagcccaaggacgtcgacagggcggtcgatgcagcacgcaaggcctttgatgagggtccctggccccgtatgagtgggcgggagcgcgccggcatccttttcaagctggcagacctgctggaggtgcccagggatccgctttgctcatggctgctgccagatgaaatggcgtgtagatctgcaccgatcttggttggtctgaggaatttacacaagttgggccttgcctcctcacaatcatctcatccctccgcctacaggagaatgcggaggagctggccctgctcgagacgctagacaacggcaagacctacagccaggtgggagctgggatctgttagatgactgctgtagcgcttcaggcccgtgatgcttggatcagagtgcctgccacccgacgtctagtcgccaaggctaccccccccacacacacacccaacagagttccacggtggacatcccggagaccatctaccacttccgctactttgcggggttcgcggataagatcnnnnnnnnnncggatgattgctgtggcgcttcaggctcgtgatgcttggatcagagtgcctgccacccgacgtctagccgccaaggctacccccccacacacacccaacagagttccacagtggacatccccgagaccatctaccactttcgctactttgcggggttcgcggataagatcgagggcgccaccatccccgtgggctccgccggggtcacaggcaagggcttcaccgcctacaccctgcgcgagcccatcggcgtggtgggccagatcctgccctggaacttcccggccctgatggctgcctggaagctggcccccgccctggctgtcggctgcaccgtggtgctcaaggtcagccagcacacgcccatgacgggcctgcgcatcgctgagctggcgctggaggcgggtctgccccccggcgtgctcaacgtgctgacggggaagggttctgacatcggggacgccatctgcaaccacccgggcattgacaaggtggccttcacggggagcaccaagatcggcaagatcatcggcggcacggccacgggcaacctcaagcctgtgaccctggagctgggcggcaactcccccgtcatcgtcaccgacaccgccgatctggaggccgccgcgctgggcgcacacgaggccctgttcttcaatgcgggtcaggcctgcgagtgcggggcgcgtgtgtttgtggacgagcgcgtctacgacgaattctgcgcgcgcagcatcgagctggccaagggccgcaagaccggggacccctttgaccccgacgtcaagcacgggcccatgatctcggagcagcagatggaaaaggtgctggagctgatcgagagcgggaaaaagcagggcgccaagctggtggcgggtggggagcggctgggcgaggaggggtacttcctgcagcccaccgtgtttgtggatgtccaggacgacatggacattgcgcgggatgagatctttggccccgtccaggtgtgtgtgtgtgtagggtggggggagttctgcagagtccaagctgggtactgggaatggtaggggtggtgacggcgaggagaaggtcagtagttgttgctagccattgacggctgggatattgggtgagaacatcagcctgcattgtgtgtctttactgccttgcactgcatggcactcatattctccagactctcaccaaccaacatctttatctcccccacatcagatcatcttcaagtacaagacactggaggagggtcttcggcgcgcgaatgacaccaactatggcctggcgtcggcggtgtggaccaaggatatcgagaccatgcagcttgccagccgcactctgaaggccggcaccgtgtgggtgagttctgagccgggaacctgggcatcgacaagataaggttcaggaaaaggagcaaaagcgaaggttgcacataggagcatgcatagatgaaggattggccaggcatatcaagttgtggtatagcgtagcactcgcgacagatttattctgagagtggagcccagacaagctaagccacccgcgccgtacatatcactggatgtttctcagcctttccgtgcccattctacaggtgaacacacaccatgttctggatgcggcggtgccctttggtggctacaaggagtctggcttggggcgtgaacacggcaaggaggtgctggagcattacacccaggtgagggttcaagaggtttgccaaggggggtgtgaagtcgttgagatgaccagcaaagcagagacagcacacctcgttcttgacgccccctgcaccatcctcgctgatcccacagacaaaggcagtgtacattcccctgcccaagaacaacccctggcagatcatgtagagcagctgttgtgggtgtgctgcacaatgtacgagcagagagttcatcagcccggaagtgtaaacccacgtgtccctttgccaaaagcaaccacatgtatacgttttgtgtaactcgagatgaccatcagcaagacactcacgtccctgtttctgctcggtcataccttctggcttcaaacgtcatcacaggacagacgtgcaacagtactgctcagcaggggggtgggcaagagggggggagcaaaagggggagcaggaaggacagggcgcnnnnnnnnnnaaaacgtcatcacaggacagacgtgcaacaataccgctcagcagaggggtgggcaagagggggggggggcaaaagggggagcaggaaggacagggcgcatcgcagcatgagtttaaggagggatggagggttttggcacctagaagaggattgtggccaggagatggcatcacccgtctccctcactgtgcggacgcgggcggtcccccattcccccacctcccctcccgcttctcgatgtctgccagcaggatcttgatgaagaagtcggtctcctccgggttggccacccagatgatggagcagcagtcgcgcgtggccacgtcgttccccgagtcggtgaaccggtccccggcgtgcagggcctggtcgggccccacgccgacgtagcgcatcagcgcctccagcccgatgctcttgttgcccacgtccacgaagacgtcgttgcccccattgaaggcgcagaaggggaggttgggggtcggtcccgccagcaggccggcgtgcacggtcagcgccagctcctccagcacctcgtagatggtgggcgcggaggggaccacgcccaccgcgcgctccttacgcaccacgctgacggggaggcgcaggcgctccgcgccctccagcagcagccgctccgcggtctccagcagctcgtggatgtcgtcttcgcgccagctggccatgaactcgctcttccactcggagtcggggacgaaggccaggcgcccccggtccacgcgcagcaggtagttgcactccccacccatcacgtggaacctgggggttttgggaagggggcggggggcatgtagggggtcgcttggatcgtgcagggagagatgtgcacgtggattgcaggatgactctttggggggggagggctggggttccccagcgactgtcagggagctgcaagggacgctcgctgaggctggccagacccagcccgcctgggatgcggaggctactcccacttgtcagcgatcctgatcctgccagagcacccgccaggccaccccacttgcaaggagcacaggggcccacccctcaccacccacctgttgaccaccgccttgggctggtagcgcagggcggccagtaggccgtcgaagcgctcctcgaaccgctccggctcgttggggtagcccgcggcggtgacgatggcgacgtgcacgcccgcgcgcatgaggtcaatcacatgcccaatcatctcgttgtcgtgctgcatgtgcgcgccgtcggcgtacagcgtgccgtccgcgtcaaaggtgaccaggcgcaggctggtggcggaggcatggatctgggcgatgtttagaatgtggcgcagctccgcaaagttgggggggatgaagtggcggcgggagagggcaaagaactcatcatactccatgaaggcgtctaccagtctgaggggatcagggtgggcgggtgggtgaggtggaggacaaggtttgtttgagagctagcaggtggcggtggcatcccgcaggaggtgttctgaggacacaagttgggcgcttgtgggtggttgtgcacgagtctctgcattgctggtcgaggcctgtacagggcctagccacctgctctttcgtctcagcacctgctcaacaccatgctgctcccacctgaggggggtgannnnnnnnnncgggcgcttgtgggtggccgtgcacgagtctctgcattgctggtcgaggtctgtaaagggcctagccacccactctttcttctcagcacctgctcatcaccatgctgctcccacctgaggggggtgaagaagctgcccaggctggggaccatgcgtttgaggcggctggaccgggggctgcggtggtgctccagagcccactgctccaccttctgcatgacctgtggtggtggggagaatcgatttgaatgggcagccgtccaggattgtgtgcttggcgcgacaacaccttgtggcgaccatgcaagggcgcaagcagtctgcatagcacccccagacgccaattccaatccctgcacacctcaaggcacgtgtgcgttcggtgcatctcctgcagaaaattgatgaacttgtcctgctccttcaggtgccccttccggcgcagcaccgctgcatccgatgcggagcgggccctggagccgaacagctcgctgtcgggagtgctgatgagctcctgccagtattcggaggtgctgctgtccacgccctcctggctggtggatggctgggcatcgccctggagctcggcctgctcgcgctccaggctctgcaccgcaagccgggacgggaagcgggagcgaggagggccctgggggcctttccgaaaccatctctgagagcatgtacggctgtaattgctgtgaaggaccgcggcaggacatcgcaggcccaagctgcgttcgagcccagccatgccacagccactttccgtctcagaatgcgccactgagcgtcccttgcatacagtacaactccgaactagaatctctggagcttgaacgcgcgatggtggggaggaattaagaatttcaggaaagatgttcgcatctcagcgcgccagaccttagccactccggcgacacagctcgggcgtggcgatgtgcaaattgcccatgttctacagcaagtggccatgggagcccatgtatgcacacattgnnnnnnnnnnagtggcgaagtgcgaattgcccatgttctacagcaaggggccatgggagcccatgtatgcacacattgtataagaataaatacatccatctgagcacacggccccccctgacgagatatcctctgtccagtggcactgcttcccgtcatgaccgctgcacacggagctgtgtccctggggaccagacggcccatgcgcgtctcctgccaggccaccaaccccggaggccgtcaaagactcatactcccaggggatgcgcagttcaatcagggccccggtcagcagtcctcccgcctgatcattcccgggcagggcaacagcagacagggcgggtcctcctccctgtccatgaaccaaacacgcgatttccgcccgccccccggcttcatggacctagactccccggacgcagccacccagccagacccctccgacggtccctccctgcccgcggaggtgatgctggagcgcctgtccagggagagcgacgcatggaccaccctggcacggttcctggggcagctggtccccctgggctacgactccgccaccgtggaggaggtggccggggtggagcgccgccgccagcacctgtggctcattgctttgcaggtgggttgttctaggaggcatcaactggctgaggggtggaggtgggtgcaggcgtcggcgactgcagtgtggggttggagttccaaagggacccaggnnnnnnnnnnccgctctgcaggtgggttgtcctaggaggcatcaactggctgaggggtggaggtgggggcaggcttctgcgactgcattgtggggttggagttccaaagggacccaggccccagcaatgcagcgggactacaggcctgtgtccactcccttcccgacaatttctctctttacaggtgtacacctcgctcgccaaggacatgaagaagtcggatctggaggagttcgaggtccctgggggcgacgagatcctggcagagctcaagttcctgacccatgagcagcggctgcccgccgtccgatacatacaggctcgacagatggatgcacaggtagggatggcggcgaagctggtgctggggctggcagtgagtgggggtccatgctgtcaccaggcaggaattggttgctgttgcaggagaaggtcatgtgctgtagttttctctgagcctctgtgtcgctgcttgtttgggtttcctgcttgccacnnnnnnnnnnaggtccatgctgtcaccaggcaggaattggtggttgttgcaggagaaggtcatctgctgtagttttctctgaacctctgtgacgctgcttgtttgggtttcctgcttgccaccatatattggctgcatgtgctgtatgcttgtcgaacctttctacccgcaccagtgtgcggaggggcagcaattacacaacatgctatgcaagcccacccacacccatcctgccccnnnnnnnnnnatacgcttgtcgaacctttctacccgccccagtgtgcgggggggcagcaatcacacaacatgcaatgcaagcccacccacacccatcctgccccggccctacagagcgcccgtgtcctcgctcgagccattaaggagtgggtgcgaagggagggggacaagcagggcttcagcaacgcgccagccgactgcctggccttcaagtactaccgcgatgtgagtgccttggggcaggattactgtggcctttcgagagtttgggctgaggggatgtagccaaccatggtgcgtcgcccaggtgacagagtctgtcgtcgctataggtccttgtgcctcttctgcccacctttggtcaacatgggaaatgcgtcccaaacaaggaatcnnnnnnnnnnaccatggtgcgtcgcccaggtgacgacgtctgtcgtcgctataggtccttgtacctcttctgcccacctttgatccacatgggaaatgcgtcccaaacaaggaatctgcaactcacttcctccatggcgcaaatttcactctcccccttccccttccccgatatcctcccagtccatcgagacccgggacccggtggagtctgccgccctggcgaaatcaggcctggacctggcagtcaccccctcggcacgccaggccctgggcggcctgctggagcccaagaaggagccgacccccgaggaggccgccgccgccaagctgcccaggctgagcacactccacctgatgcccacggacctgggcacccgcctgctgcccattgccggcgccttcgagtccacggcccccgccacgctgcgggcctgcccccgcgcccagggccgcggcgactttttctccaccgtggccctgcccgcggggtccagcgcgcacgactgggtcgcgctcccgctctggccggcgctcgcccaggccggcactcccgccggcctccgggtggccaactgcagtgtgctgcaggccggcatgggcagcgcaaaggcgggaccggggctcctggtggtggatgtggggcccgcctcggccgccggcgacggctggcggttggtggagagcgccacgcagcccggcggcctctccgtgctgaggccgggggaggatgccgccggcgcctcccacgtcgccgcaatcctgtttctctgccggccaccggccattgccacgggggcagctgccaagacgtctgaactcctgtccctttgagcaggggacgtgtattcagagctgtgagcagccccaccttggcgcaaccaccatcgcactggcaccctccctgctctctgctgtgggacgccgactgtacattcgggcacacagctcgggcaccccagagcctcatgagttgctgacgaggactccctgcttcccgctgcctggtgcttgggctttgggagctgcctgattctcgccctccccctgcacaagggggcaaggtgctcgaagggattgaccctggtgcacggaggtgcagaagacctcgcagcgcaatcgctcatccaatccaacaggccttgccttgacgcggatcttgtacttgtcttggaaggccagcacctcggcctgcttggcctctagctgctgctcgtacgtcctcaccagctgcgtgcattgggtgaatggtggaatgacgctggtcgtccgtgcttcaacaatctcttcaccccagcatccacagaacacgccacccaactcaccgataggaggttgttcttgttctcattcacggtggggagcacctcgcccaccgtccgctcgacgaggatgtcccctagcagcttgaagcacttgcggctggcatccaggggctcgagggtcttgacgacgagctcgtgctcggccacctctgaccgccgctcgatggcagccgtggagagggcattgcgctcttccaagagctgctgaaacttatttactatctcctgctctgtcttaagctcttgtgcagccatgaaggtgtgaagttgcgtttaaaggccaccgagagtcaagatggtgtccacaagtctttggaatggctgcaggttggggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgatgagagcaagcacaggttttgatcgactgcttgttgtttgggatcgagggtagcagccgcagcacgccccggaatacgaagcatacggataacatgcaggaccgctctccgaacgcacactcgttcagtatttccccagtacaatacaggatagataatatcaattgtgggcgtgcttcattttcatcttcaaaggctgatgggggcgtgatcgtcagagacgcaatccagcacctgggcaatgtccgtggtcctgtccagcatcaggtggggctctggcttattgtcgcaggtctcgatggtcagacgcttgtcctttgatacaggttttctcattggtgcatcttccattccccacagattgggacctcagcatgccttcagagctcctcgcacacggctggtgtcggtcctccgagccccagcgcggtctctgagcgcggcatcggcccagcccgcctcccctgccaaggattccaagcgcagtgggcctgcctcggagcagagcgtgacacctctgagtgaagacttctccaggtaggcacaagaggcgcctcagcagacaggacgtggcctcctggcccgtaagccttgctggccctgaccccgctcctcagcctatgccaggtggtacctggatgtcatacgggaggctcagctggccgactatggcccggtcaggggtaccatggtcattcgcccctacggctatgccctctgggagcgcctccagtcctggctcgatgcggccctgaaggagcatggcgtccagaatgcctacttcccccagcttattcccatgagcttctttgagcgcgaggccgagcacgtggagggttttgcgcctgagctggccatcgtcacccgaggtgggggtggggtgctggagatgtaatccccggaatggccctggtgttgcagcataagctgggatgggggcagtgcgcactgttcagaacagggtgcacactgttccagtcagagtcgtgccagcatccgccagcgccgcctccttgtctgcccgcagcccatccagccagcctaccagtgtgcagccgtgcaccttgattccccttttccgccccccccccctgcctcaaaatccaggcggcggcaaggagttggaggannnnnnnnnntttgtctgcccgcagcccatccagccagccgtccagtgtgcagccgtgcacctttgattccctttttccgccccacccccctgcctcgaaatccaggcggcggcaaggagttggaggagccgctggcactgcgccccacctctgagaccatcatcaacagcatgtttgccaagtgggtgcagtcccaccgcgacctgcccatgcgcctcaaccagtgggccaatgtgcaccgctgggagatgcgcacccgcccctttgtccgcacgctggagttcctgtggcaggaggggcacaccgcacacgcgaccccggaggaggcccgcgccgaggccatggccatgctggaggttgggaggcggtggggggagtggaggttggtgcgggggcaggcaggaactggagggctgcgaggtcccagggccactctgatcagctgagatgcggtgcttgggtgcctcgtcgtcccacgcccctccacgcgcccccccactgccttgctttgcatcccttcccggccaaccccgacccnnnnnnnnnncctctcatcagctgagatgcgctgcttgggtgcctcgtcgtcccatgcccctccacgcgccctcccactgccttgttttgcatcccttcccggccaaccccgaccccgaaacacccaccaaccaccctcaggtttaccgcgagttcgcggtgacccaggccgccatgcccgtgatcgccgggcgcaagtcgcgcatcgagcagtttgcgggcgcgaacgcgaccttcaccatcgaggccatgatgcgcgacgggcgcgcgctgcaggccggcaccacccacgacctgggcgacaacttctcgcgcgcttttggcacccagttctccgacgcagaggggcgcctgcgccatgcgcaccaggccagctttggcatgagcacgcgcatggtgggcggcgtggtgatgagccacggcgacgataccgggctgcgcctgccgccgcgcatggcccccctccaggtcgtgctcgtgcccgtggcggcgcgcggcgcggccgccgccgccgtgctggcggccgtggatgccgcactggttgcgctgagggcgaagggcgtgcgcgcgcaggcggacgtggggacggagaagtcaccgggctggaagttcagccactgggagatgaaaggcgtgcccctgcgcatcgaggtggggcggtgttttggtgttcttagtgaggagcgaagggtgagggaggggaggactggtaggttgtggagagggtccaggacagcgtccagaggatgagatccgtgatcggtgccccatgtccgtaaaggtttacagtgttggagatcagggccagagggcctaggccttggagcgtatggtggcggctgcagcgctgcacagccacaccagagtcaccctcctcaacccatcaacattgaccccgcagatcgggccgagggacgtggcgtctgggacatgtgccatcgcgcgccgtgaccgtcctggaaaggaaggcaaggagtttggcgtcccgctggctccagagctcctggtgcaggaggtcctgaagcggctggatgaggtccaggctgagctgctggaaagggcgaccaggttcagggacgagcatatcctggatgtgtcctcccactcccagttcttggaggtcattgagcaaggtgaggtgtgtgccagatgggggagtttctgtgctccccatgcatgaccagctgcccagctcggcatgatagcacatgctgcgcacttcccctcacacccacgcacaactcaggcaagtgggcgcgcgggtggtgggcaggcagcgacgagcaggaagtcgccctgaaggaggaaagcggtgcgacgctgcggtgcttccccctggagcagcctgacggggggggcacctgcttcctgaccgggaaaccggccgatcaggtggccctgtttgcaaaggcgtactgagccaccttccaataaagcatgtacttgatacttggacacaagctggcaagaccttgattggaacagggctttgggggtggggaagcatcaggagctgggctctgtgtccagcattcattctaaagccacaggtgcttcttcataccgttaaagctttgatgctgtaaggtgccagccagggcaaggcttgcagggtccgagacgtgtgttgcaggtgtgccactgcctgccgaagcacatttcccgccaccccccaagaagcggatgagatacgcctcgtgcgcacggtagcagcagaggggtgccgacccatgacaagataagacagtttgtggcataagcttcctttgaacgcgcaagtatagcttgtatccacagcgttgcttcattagggaagaacagagctacatccgccatggttgctgcacagtgtctgctgagcgtggcccctacccggcccgggctctgcagcgtgcgtcagggagtggccgcgccgttctcggctcctcgcttcactcgtcgcacactgcggacatgcaggcccctcactcgcgctgcccttgcggtggagatccccccggcgaccggtgacctgaagcccaaggacaagaacgcggagctggccatcaatggtgagtgaggcgcgtaaggattccgaacaagttgatcagatgcatgccatgccgtggcatcggatcgccgtcgggtcacccgggtttcgatgcactgtgcagcccaccccatcgccatgacccccttgcagccatccgcttcctgtccatcgacggcgtcaacgcggtgagcaacgcaaaatagactcgatatgacccatgggggctgcagctgcatgnnnnnnnnnnctccatcgacggcgtcaacgcggtgagaaacgcaaaatatacttgatatgacccatgggggctgcagctgcatgccatgctacctgaagggtgtcacatgtgatatacccccatgcatgggtcagaaaccctagctggggcggctggtggggcttgcgatctgccaggtctatgcctcccccttctcgttctgcatcccgtcctcactgtccttgctccctctcttccacttcaggccaagtctggccacccggggctgcccatgggctgcgcccccatgacctacgtcatctggaaggacttcatgaacgtcaaccccaaggaccccaagtggcccaacagggatcgcttcgtgctgagcgcgggccacggctccatgctccagtacgccatcctgcacttgatgggcttcaacctgccggtgagtatgggggtcgtggggatggcggactgtgtcgggtgatgcggcgtagcactggcagtgtgctgccgccaagtagctctgtccacacatgttccgccctctggcgcctcccctgcagccgctcaagtgacactcnnnnnnnnnncgatgcggtgttgtactggcagtgtgctgccgctaagtagctctgcccacacatgttccgccctctggtgcctcccctgcagccgctcaagtgacactcctccctcctcatgaccttgtgtccacagatctccgagctgaagcagttccgccagtggggcagcaagacccccggccaccccgagaactttgagaccgagggcgtggaggtgaccacaggccccctgggccagggcatcgccaacgcggtggggctggctgtggctgagacgcacctggccgcgcgcttcaacaagcccgacgccaagctggtggaccactacacgtactgcatcatgggcgacggctgcaacatggagggcatctccaacgaggccgcctccctggcggggcactggaagctgggcaagctcatcgccttctacgacgacaaccgcatctccatcgacggccacacctccatctccttcaccgaggatgtggtggcgcggtacgaggccctgggctggcacaccatccacgtcaaggatggaaaccacgacctggcgggcctgcgcgacgccatcaacgaggccaaggtggcgggggaaggagggggccgtggggtcgtggccacgacgctgggccatggtggagtggcttcatcatnnnnnnnnnnagggggaaggagggggctgtcgggtcgtggcgacggcgctgggccatggtggagtggcttcatcattcatgcacccggtctggcggccggcgcagcccaccccgcagctgcctgctggcggcacccccacatgcgctcgggcacccaaaccttgacagcccgaccctgccacacccctccacctcctccgcagtccgtnnnnnnnnnnttggcacccccacatgcactcaagcacccaaacctgaacagcccgaccctcccacacccctccacctcctccgcagtccgtgacggataagcccaccctgatcaaggtgtccaccatcatcggatacggctcgcccaacaaggccgactcgcacgacgtgcacggctccgccctgggcgcggcggaggcccaggccacgcgcgacaacttgggctggccctacggcgagttcgaggtgccccaggaggcgtacgacgagttcggcaaggcagccaaacgcggcgaggaggcggaggcggcgtggcaggccacccggcgcgagtacgcggagaagtaccccgaggagtacgcggagtacgaggccatcaccagcgggcacctgcccgcgggctgggcggacgtgctgccctccttcaccagcgccgacaagggcctggccacgcgcctgcacagccagaccatgctcaacgcgctgagcccggtgctgcccggcctgctgggcgggtccgccgacctcgccggctcctgcatgaccctggtgaagagctccggcgactaccaggccgactcccccgccgagcgcaacttccgctttggcgtgcgcgagcacgccatgggcgccatcggcaacggcatggccctgcactcccccggcctcctgccctacaccgccaccttcttcatcttcacggactacatgcgcaacgccatccgcatggccgccctgtcccaggccggccagctcttcgtcatgacccacgactccattggcctgggcgaggacgggcccacccaccagcccgtggagcagctggcctccttccgcgccatgcccaacatcctcatgctccgccccggcgacggcaacgagaccgcgggcgcctacaaggtggccgtggagaacgcggccgccgtcaacgccacgggcatcaagcgcccctcggtcctggccctgtcgcgccagggcatgcccaacatggactccacctccgcagagggcgtggccaagggcgcctacgtcgtggcgggtggggaaggcacccccgacgtcatcctgatggccaccgggtcggagctcatgtttgccgtggaggctgggaagaagctggagggcgagggcatcaaggctcgcgtcgtctccttcccctgctgggaactgttcgaggagcaggagcagtcctacaagtgagcgcacaggggtcttgcttcatgttgggagggtggggggcggggatcgaggagggagggcttggaaggccgcgcgaatgcatcgatcggggggaggaaagtgggtggccggcctccgtgcgcaagcctgcccgacaccccctcccccttgcaacctgtcacgcagggactcggtgctgccgcccgaggtggaggcgcgcgtctccatcgaggcgggggccacctttggctggttcaagtacgtcggcgccaagggcgtgtccctgggcgtggatcattttggcgcctctgctccggcgcccatcctgtacgagaagtacggcctgacgccggacaacgtcgtggccaccgccaagtcgctgctgaagaagtagggcggagggcaaggaagaaagggaggcgggcgcgcagcgggggcacgcccggcgcgcgcatcttgcccacccgcagttctgggaacaccaaccgctctggccctttttgcatccatccgctgccaccccccaacccctcctggtctgaggtagcatactcttccagggccacatcagcctgtgcacgtgccaagcgtctgacggggggctaggagtgccccccgtccccgctcgctcccctgcatgctgctcttgtcccctatgcgcgctgctttctgtatgcagcaggtcgactgccatgtaagcttggagatgaaggtgtgagtctctgacaagtggcggtgatgggcatgggggatggggggggggggaaacatgcgttcgtcaggagggctcgtcaggtgcggggatcacaggccgccggcatgcagggccacaaggtccgacacctctgcggccagggcatccgcatcctcctgggtggcagcttccgcatagatcctgaccacatcctcggttcccgacggcctcacaaacgcccggcctgtgggtgcgagggtgaatgctgtttacctcgcatccccctggcgtacaggcgaacgagcatgcctggatcgctggcccgcacctcctacttctgcatgtggcacacagacaattggcaactcgccccacactcttgaaacccaacccatcgcaccctgcggcgccgctgccacggccgcgtcgatggcgggctgcagagctgcggggcgggcgaccctccgctccgcgtcggcggtgacgatgacgcttcggtccgccacgctgcgcacgctctggcgcgagggcaggtcgcggtagatgcccgcccagtcctccagcgtccagccgcgccgccgcagggccaccaccaccagcagcaagatggaaagcgcgtcgcccaccgtctggttgaccagcagggacagcgccagcaggtcacgcccggattccacggctcgcgctatcgtggggtcctcatcgtcggcattcgcctggtggatgtgaatgggggctgaggtgcttctgactagcctccagggcccaaggggagggggacgatatgttctttccatcgactagcacagatccgttccttccttgtcgtggcaattgcaaccccccaaccccccctcccccaaccctcctccgacacccgcctgcacaaactccttgaggcgcnnnnnnnnnngggggcgatatggtcttccattgaccagcacagatccgttccttccttgtggtggcaattgcaacccccctcccccaaccctcctcccacacccgcctgcacaaactccttgaggcgcaggaggtaggcgggcgcgaagagcacggtgccatggccgttggcctcgaagtagatgcccacgtcgtgcgcgtgggcggcggcgtgcaggtgcttgaccccggtgggggtcaccgtcaccggcaggcgcagcgcctcggtcaggtagcgcgtggcggcgccgttggcataggcggtctgcaccacgccgatcgccgggctcagtccccgcggcagcgcggcagccaggtcggcgcagagcagcgcggccagcgcggcgatgcggtcgccgtccagcagcgtcaggcccgcccccgtgccggggacgaagaagacgatgcggtcggcgtcgccgtccagggagcagcaggggtaggagggccctgcgccctccagcccgtccggcagcagccgcgccttctgcacgaagtcggcgccgcagcgcccgttcagcgcgccctcacccgtgttgtgtagggtcaggtgcagccccgcggcggtgcagcggtccgccagggccagcagcttgggcgcgcccaccccgttggcgcagtccacgtgcaggacggtgggggtcgacgggaggggggcacggccggtcaccgacacgtcggcgggttcagcgccaccgtcggcgggttcagcgccacctccggtggcagcgcgagagaccagagctgcataggcgccggccagctcggcgaagtagtcgtcctcgttgaagtgctcgcccgnnnnnnnnnnatgcaggacgctgggggtcgaggggggggcggcacggccggtcatcgacacgtcggcggattcagcgccaccgtcggcgggttcagcgccacttccggtggcagcacgggagaccagagctgcataggcgccggcaagctcggcgtagtagtcgtcctcgttgaagtgctcgcccggcgccgtgcgcgccacagcccagtgcagctgcggggtggtgagcagacccaggtcgtgcgtaggcacgcccagcgcagccgcgccgaccctggccgcctcggccaggccagggctgctgggccgcgtgtcgtgggctatgtacacgccggcgtgggactgggatgaggaggacggtggcagcacgatgccctcggcttccagcaaggcagcgaaagcggcgaggaaggcctccgtgctctccgcgcaagccaggctgtcggcgtgggcctgcgtgaggcgggtccaagagagctgggtggtgaggggattcaagtacgattccacccccatcccaggttctcgcctccatggccnnnnnnnnnntctgcgtgaggcgggtccaagggagctgggtggtgacggcattctagtacgatccctcccccatcccaggttctcgcctccatggcccccagccacccacctcccaggaccgggtcagcatctccccggtggactccaccagcttgacaccgttgtcgggtgcggggttgtgtgaggctgtgatgcagatgccagtgggggcatcgagcagcagggacctgacagccatgagcacgccacacctgcatggcggtgagggggccgggtgctgggtactcagcaggacagagtgcggaccccatgcagggcagaggccagaacaccggcttgacatcccgatcgcttcacctgaatacggtggagggcagcaggggggcaagcgcacggtagcctgccgtgccatagaaggggcgaaaccccggaggtttcaggtaggcttgggcagcactccgcagcgcgtcatccaggcgtaaggaagacgccatcctgcctggtgctatttgtcgagagacatgccaatgatatctgatgctgcacggtcctcttctccccagattgttcctggcagatcaatctgagaatgttaactatgatccgtcccggagcgcgcgcgatgcggtcctggacatctgaatgggctggctccgggagcgatccaggggcccaaattagccggccaggctcgaccatgcaacaatgggagcaggccgccgcaaaccgcggcaagnnnnnnnnnncgcccaaatttgccggccaggctcgatcatgcaacagtgggagcaggccgccgcaaaccgcggcaagtgctgctcgaccttgatcttgctggtgtgcctgcagatccaagcccggtcccatgacgcggtttgaggctgtactgaacaccggtcggtgaactagcgcgcttgcccccaatgcagccctcacgtcatcccctcccgcgtcacacctgggtttggtgggccatgctggcctgcgtgattggtggtcccctggtcatgctggagaaggtgtggatggggtggtgtaggggtagtgcagaggggactgaaggcagggttaccttgtgcaggcggcaccaannnnnnnnnncaggggtgggtggtgtagggggtggtgcagggggggacggagggcagggttaccttgtgcaggcggcaccaagaactcctgcgggcttgattcgcaggcatcccgggcacactgcagcctcatacttgcgtggtctcctaaaccccccaccccccctccctctgtccctcgtcctcaccacaatagacggggtacctggagacctgggaggccacggagcgctacacactggcggtgctggccttctcggccgcgcaccccatctccgtccccggcgaggcccccgccgaagacgaggccgcgcacgcggcggcgctccgggcactggaccgccgcctcatcgcctggcaccgcnnnnnnnnnngagacgaggccgggcacgccgcggcgctccgggccctggaccgccgcctcatcgcctggcaccgcgacctggacgccctgtacgaccgcatctgcgccatggccgtggtgtccaccctcaccgaccctggcgcctccgtgtccctcacctacgaccgccccgccggcgtgggccagcgcgcacttaaacgcgagttccacgccaagcgcgacgcctccatcctcctctacctggccctcaccgcggccgtctacttctccaacagcgtgctcctggcctccctggtcctggtcctcaacgtgctcaacctcctgctctgctacaggatcaaggtgcatgcgctggctctcgggtcagtgctgttgcagatccccaggcgggacgcctggcgtccattgccaacagccccaccttccctccttccctcctccctttgcaaacccatatccagggcatgtcggacgcgctggctgtcaccgtgcagcagctggacgaggtggtggggcagctggtcggctggcccctgccggccgtgcctgccgccggccacgcggccgccacctccctcctgctcgccaagctggccgccctggcgcggtactggcagggcacggagctgggcatgaacgtggcgctgccgggcgtgggcgcgctggcggtgagcgtgaacatcatgggctccattgcggtggccaccaccttccgctgcgtggtgtccgtgctcaccgtcttccaccccgccctggcgggcatcagcatccgggccatgctggcctggctcttcgcgtcggcggggcggtacaaattgacaccggcgatggtggaggggaccaacgcactgcccaagggcgcgtcggcgcgggactggggccccgatgattgctgtgaggaggagcaaccaaaggacaaggacagctgagtgggcaggcgtccagctgcgtgagggagtggggacttgtaacccctggcctgcctgtaccgtgcgttcacaagacaccgctcgggcgccgagcacgaggagcgactgccccttcaagatcctgcctttgacatacgcatccccctctttcctcccttccaaatgacctgctctcgtgccagtgtgtgccatgagagtcatgttgcagcctgtgaagcctcgccgcgtccatgcgggagggatataatagctgggatagagtggggtcatggcatgccacgatggggcgcatgccggtgttgtacggagacagggcgttcatacgggtggggacgacaactcatgctcgaggcttgtggtgatcgagggtaatggatgggagaggggggctacctgggtctctccctctcaaaaaggcacacgacttctcgctccgccgggacatggacaggcagagacggaacacgacgcaggttcacgcctgcctcacagcctggagaacccacggacggtcgccgcttcccggctctcaaagggctccaccgaatggggattgaatgtctgacacatggaacggtgcagtgagggggaggggggctgagggactatgcaccagtgggtttcatgcatggggccgactgccgccgtccctgccccgatgcgggccgctcctctgcgccataccgcatcaccgtcgcagatgccaggctttccatgcacccaactcccccatgggcctagctccacaccaccagtcgcataccgtcacatcatcgttgtcgtagtcggcaaacacggtgcgcaaggagcccagcgcgtaggtgccgaccaccttggcgccgacgcgggccgcccactcggtgatgccctcccctgcagaagacaagtcgatggaggggcttggtgcactggcaggcgctggcaatgcgcccaagcattgtcttcctgtaggaacacaaccctacgctccacaccccatgaccagaggtcactgccaaccccctcacccccgatcgcaccttcgttgggtcgcgcgccctctgccctcagcctctccagctgcgcctcctggcgcgcagggttggactgcagggccccgacagagctcaccacacgccaccagggcaggcccgaggtttcgtcgttggcgatcttggcgaccgtgcggccgatggaccgagcggccgtggtcttggcgcccgcggcggtggcgatctgccgcggaggaagagtgaacgtgggtggattctgaccaaggtgagaacatgcttctagttgtgcaggcaacctgggtctgtccttggagcatggcgcaggcatgtgagcttctggaggacaggagcgctccgaatgtgttcagactccgccaggctttcccccccagacccgcaagctcacctcactgaaggtgcgggtttgccctggagggatctcaaggatgatgttgaagtaggcggcattgggatcctcggggtcgatctcaaacttggcggccttggcctctggggcctccccctccacggccacctcctctgccgagcgcttggtgccggcaggctcaggggcaacctggaccgcatctggcttgggctcctcaacgacaggcgcctcggtcgcaggctccacggcaggcgcagccacctcaggctccggtgcgggctgctcctctgcctctggtaccacagcaggctcagccacagcgggctcccctgccgcaggcttggcctctggctcctctgccgcaggctccactggcagtgctggtgcttcatggacctcgtcgacgctcaccggggcggcggcagtgttctctccagcaaaggcgggaggatccacagggattgggtcctccaccggagcaggtacctcggccacggctgcggtacccccagttgcaggagaagccccggccacactcccgacgggctccacgacgggatccgctccgacgtcgggtagggtctcgacagtggcgggggttggctcaggcgcaccctgagccggcccctgacctgtctcctcaggctcatcctccaacggagagacggactggggctcgctcacaggagtgggcacagtcccgatcttgtcgacgggattggcatcggtgtagagctcctgggccttggctgcgacggcctcatcgacagcagcacctgcgtgtttagcagatataccggtgggatgaaactcttcaatgcatcttcagaagccatactcagtttctgcaccaagattacctccttccgtgtggtcgccagtgttcaagacagcatcgatgaccttctgggcctcggcctgcacatgctgctcgtccgccatgcttggtgctgtaaatacacttggacaacagaagttatactaatactgagctgatccagcgtgctttaaaacannnnnnnnnnactgtaaatacacttggacaacagcggttatactactactgagctgatccagcgtgctttaaaacaccgtgagctgggacggcattgcaacatgaagatgcttcgtcccgagttgcgcgcctcgcagggcgaatgcatgccggagaatttgaaaataccaaatgacaggtctggtggtctgagggccacgtggtctagtgagcgagacagcgtccacccttgagcatctcagctgaataggctaaggaggcgaaatcagaacaggaatgctggttgaaagaggtatgtggagggctcatcaggtgcgactgtaccatagatacctccaaggtttgaccagcacgccgtccggtggccagagagtgctaactgcctcagagtccttcacaactcggtgatgacaggcacaggggtggcgggaggcctctgacgggcttcgttctgagccttaatatttgcggtctcctcttccagaaagagggccagtccgtcacccaggctttccagcgtcccgtcgtccagctcgtttgcccaagccaggaagaagaccagcttcttctctactgccgccagctgcctgacaaacgcctttcgaccctgtgtgcagcaaatgcaccgtgactgggattccagcacatctttggggcctcaaccttcaccctccagagccgattcacccaatctctcaccgagcaacgcactccctgccaggcgccagtgcttcggcctgcggcctgcctcccttacctgccgcatccgctccggcactgcgtcgtcctcgaggtcttcggcagcgctgcgcgcacggctcgccatccgagcggcatccaccagggccagcagcacggcactcctccccagccgcagcagctgcacagcgtccccaaccacagccacgaagaaagcgtggggggcgccgccacgaccgctccccactgcgtcggccagagtttggcgcagcgcatgcacaggggagggtggtggtggatctttcgtacccggccagagcatcagcagcgtctcgccggcgcccagtgcgtccacgtcaggctcgccgttgtggcgtcgaagcgtgtagcagtaggcgtagaggagctgaggcaggatgcagggcagcaagggtgagggtgggttcttggttagcgccgacagcggcaggaggggctggctggggggggggggaagacctggctgggaccggctcgaggatggctccgactctgacactgtgacaacatggcgtttgttgtcgagtggtgggggtgaggagaattcaagcacttcttgaaagcagcagtgcccccatagagatcagaaggacctagtcgtgtggttgccatgcagaggctggcccagacacctgcagctcgagcaccatgtggtagatccttgccactgccgtccatccaagcaacatccagccataccatcctcgatgagggacaaccctctcggtcccaagcgcacgtcccgggcagcttccagggtccaccacggcacccatggctgcaccatgcgccccacctcctcagactccagtgcagcgtgaaaggcagccagctctgcgggagtgaggtcttcttccaccacttccagctcacccccagcttcggcctgaaaaggggcagcaaaggctcatgggtttggtctgtatcttcatttcaggaggccaccgcagctatctagcgcagtgaatcagcactggacatgaccacggtcacaatggcttgtctgccctgcagcagtggtacctacacgggccaggatgcgccgaatcgtggcctccgagagctcgccctcccggatctcctcctcgccctcctcctcgccggatgagtgcgaggcggcatcttccagccgggaggcgtgcaggcgctccaggatggcacgcatctcggtctgctggccctcagtagccttgattgatttcaggtcagcgacggcactgtctctgcaggggtagaagcatgcatgtgcaagcaggggtctgtagacgcatgtctgccttcttgcatggctgattaaaaatgcatgatatatatacgttgacactcnnnnnnnnnnggacgcatgtctgccttcttgtatggctgattaaaatgcatgatatatatacgttgacactcgattgaagagcgactgttcgactccaacctaccggaaaaaagcctcggtgcatcgctgggagtgactggagtagcaggtggctgagcaatacttcgacccgcagcgtggacaggtatactcggctgagcggagctcacacctgcatgcacacagtgatctcaatgagaatgagtgtgagttactagaattttggtatatggtagcctgatgatcactatgtgcatgtccccaaaacgcacacttgacagaggacggccatgccnnnnnnnnnntagtgatctcaatgagaatgagtgtgaggtactagaatttgggtatatggtaccctgatgatcactatgtgcatgtccccataacgcacacttgacagaggacggccatgccagggtttgcctcgttctagttgtccgagggtgaggtccacactccttcgattatgtctaatttagttgatgggctgagcaaacttgttcttgaaaagaatgcgtcgctagtctcttaacttggcaaggtctgatcccccttttcggtcggtcgactttgcgcgcgcgacccgagttgcccaatctatatgcttagcattcaacaggcgtgcagcagccgaggaggaagtacacctnnnnnnnnnntttcccctttgcggtcagtcgacgttgcgcgcgcgacccgagttgcccaatctacatgcttagcattcaacaagcgtgcagcagccgaggaggaagtacacctacaagcttaaaaacctacaatacagaggtttgtgcgttggacgccgctgcaagaaggtcnnnnnnnnnngaaatcctactttacagaggattgtgcgttggacgccgctgcaagaaggtcttgtgcatagttcgtgtgctgatgatccatgagcgcctgtacaaggaaaagtatcagcttattgagagctgttgattgggggatgctagtaccatgttggaaacagccagtccacttgtcccctgaccttcaatcaccctcccttggccccaaaccacactcactaccttcatgagttgcatgggattccgacccaggtattccacgtccactgccagttcagctgccacgtcagcgggcgtgagcctcacgacgctgtggcctgcgctctggttccagcgcagnnnnnnnnnnnnnnnnnnnnnnnnnnnnnnnggcatcgccgcaccagatcctgccaccttgcccagcagggacctgtgccgggagaggggccagccgtggcgaactcagaggagggcagccgcaggccggcaggggcggcctcgccatcagcgccagtcccaagcctgaacgatgtcatgccaaacctctggcaaacatgcttccagtcgaaaacacaccctgnnnnnnnnnnccagccgtggcgcactcagaggagggcagccgcaggccggcaagggcggcctcgccatcatagccagtcccaaacctgaacaatgtcatgccaaaactctggcaaaacatgcttccagtcgaaaacacaccctgccacaccctgtcagctcacccaagcgccccaccaaggcgacccacgcccagggaggtgaggaggggcttggcggaaaggaggagccccggcaccgggtccttgcccaggacgtagtgcctcgccgagggcagccccagcatgctcagcatggcatgctcccccccagcgccgtcttcggcgggcggcgccgcgttgagggcgagcacggggggcgagccaaaggtcaccagctccacaccgcgggcggcccagccagcgccgcgctgagccagcagcgcctgcaccaggctgccccccaggctgtgccccaccagccgtatgctggcgggcgcagagtcgagccagggccccacctgggctgccaggtcctgggccaggccagccaccccggagtgcagggagaggcccggcacaccgggcgcaggcgcgggccaggcggccagcaggnnnnnnnnnngatgctggcgggcgcagagtcaagccagggacccacctgggctgccaggtcctgagccaggccagccaccccggaatgcagggagaggcccggcacaccaggcgcaggcgcgggccaggcggccagcagggccttcgccaggccgagggagtcgtggctggggtgggtccaggaaaccccgcggcagcacagcgtgcgcaccctggctgccgcgtcctcggccacaaaccacctttgcggtgccagggaaggggaatggagtattggcattgctcaggacgtggtgttgcacgatgtgtgaagggggaatgcacagggcagtgtgttctcatcacattgttcctctctgatgggaaagatgcccaggagccggcatcgaacctgcccaggatcacctggtgaagggggcggtgccnnnnnnnnnngaatgcacagggcagtgtgttcttatcacattatttctctctgataggaaagatgcccagcagccggcatcgaacctgaccaggatcacctggtgaagggggcggtgccctcggccaccaggttcagccccttggcttggagctgccccgcgagatccgccgggctcctcgtgggtccataggtcaggctactcaggtctgccaggtccgcatcgctcctcagctgctcaggccccagggcccccgcgtgggaggtgagcaagcggtctccccagcacccactccgcaccgcaggccacccggctcgcgccagtactggggcccggcccagccgggatgccatcctggaatcgatgccgcccgaaagacacttgctattttccctcgtcagctgatgaggccctcgcgtggcctgcagggacggtttccctgggattccctccgggcgcttgaccggcatccgcccggcttcctgttctttgcgttggctctagcccccatcaaagccccttcactgcctcggcatgtggcctcacgtccatgtcgttacacatccccgagtacatgtcaccacctatcacacatcgcatgccaaccacccgcatcctacttggcgtcgtaccaggtgtccgcgtacttggcgtccaccgccaggtccaccaggagggggcgctccaccttccccacaaaggggctgcgcatgcaggccaccacgcggcgccgcgcctcctccgcggactcccgcggcccctccaggatcacttcgtcgtgcacctgcagcaggagcgcccagcccaggcgccgcagctccgggtcggcggcgatgcgcagcatggccgccgtggccacgtcggcggcgctgccctggatgggcgtgttgatggcggcgcgcagcgcgtgcgcgcgcaccgcgccgttccggctggccgcctcgggcagctgccgccgccggcccagcagcgtgcagacgtagcccgccccctgcgccgccgcctgctgcgccttctgccaggcgcgcacctcgggccggtctgcataccagcgctccaccgtctcccgcgcctcctccagcgacacgccccagtccttggacaggccgtgcgccgtcttgccgtaggcgatggagaagttgagcaccttggcgcggcgccgctccgaggagaacaagtccttgagcagggggacgggcgggggggaggcgccgtcggggccgccgtcccactccagcaggcactcgcctgtggggtttgtttgagagaggggaggggttgggcgtgggtgggcagacggggtgggccacctgatccagagtgtgggaagggaggttgcggggctggattccaaatcgctgaggcaaggagactcccggccggggacattgatggcggtgtgccgtcctggactgtcctcccaccagcccattcgccgcgccgccgcccccgccccgccctctccctcccccgtgtaccccccttccccccttcatgagaaagcatcttggtcctcccctgannnnnnnnnnccgccgcgccgccgcccccgccccgcccactccctcccccgggtatcccccttccccccctcatgagaaagcatcttggtcctcccctgannnnnnnnnntagtgtggtaagcgaggttgcagggctggattccagatcgccgaggcaaggagactcccggccggggacatggatggcagtgtgccgtcctggactgtcctcccaccagnnnnnnnnnntcaccccaccccaacccgcgcaccgctggccacggccgccttgatgtgatcatacatgccgagcgcggtgcgggagtggaagtcgccccccgcctcgaaggcctcgatcatggaccggcagttggccatgtgggccaggatgcgcagctccagctgcccatagtcggccaccaccagcgtgtgccctgcagcgaggtctgcggtgaaggcgcggcgcacgccgtaccgatccttttccaaggccggctggttctggaggttgggccgccgcgccgacagccgccccgtctccgtgtttatgttcagcgagcagtgcacgcggtacgcggcggcaggggctggtggggggccgtcgactgtcgagtcatgcagcgctgctggagcctggagaccaccccccgagccctgccccatggtcggtccttcccgacccgccagcgacaggttccgcgcgcccagcacccccgcctcgccccggcgccgcgcggcccagtccacggccgcgggcttggcgatggcgtcctgctgaagcggcacgatgaagttgctgagcagcgtgtcgatggcgcccacgtccaccagcgcgtccaccgccgcgcaggcgcgcaggccctccaactccgagccaaacagggggaaaagcgcgccgtggccgccggcggcgcgctttgcctccagatccgccgcgtccaggggctctgctgcgacggcgccggcagggttggcgctggcgtcagcggccgcaccagcacccccgtcagcgtcgaggtctgctgtggactcactgtctcccatcgccccagcctccacaccactcgcgtcgtcccaggcgcccaccgggtccagggaatcccccaggcccagacccgcaccggggcggtgttccagcgcagccagggccttggcggcgcggccgggcggccctgctagggccttcagcacggcggtgttgcaggcgggcgctcccgagggcgtgtgcacggtggggaccaggggtgaggccacgccctcgccccacagcccgtgcagggtgacggcgatgtttttcttcgccttcttccccccctcggccacgcccagcgtgttgggcaccttgaattcgcgggacagaggcacccccgccttggccgggtcgcggccgttgggcacgccggcgaagaggagctgggcgacctgcgtcccggacccaacgttcatgtgtgcggcgccgggcacgcgcgcgaccgcccagtcgcggaaggcggcgcgcgcgcgctcctggtcggccaccgcccggcgctcggcggcggccaggtgcgcacggtccacacccactcccagcgcctccatctccgtcagcagctcgccgaaggggcgccagaagcggaggtacacgtcccacatggaggcgatggggcgccccgccgccgcgtactcggccgccacgccggggtccaatgccacgtcggtcatggcctccagccgctcgcgcagcgcggcgtagaggtcccaggtcgcgcgcgcgtcggtggccgagtaggccacccagcgccagcgcgtgtcctcgccccgctgcagctcctccaccgcgtccatcaccagcagctgcgcgggtggcgggggtggttttggtgggagaccatgcagttgaacaggtttcggtgagggggaggggtccttggagagagcgtgccttgagatggtttgttggccatttgctgacaggccaaccgcattgcagcatcgggatctcatggcacggcctggcaaggcgcccacaccccacccaccacacgtctgtgcccatgttnnnnnnnnnntggtatggcaaggagcccacgccccacccaccacacgtctgtgcccatatttactgcccctttctctcccatgacacaagctctcacccgtctgcccgccaaaacccctgacaacacaagaacacccaacccaatctcccacccacccaccttgccgttagtgccgtcggccctcttgttcggccgcgcaaacaggtccttcatcccgatcttgggcacggcgctggagcccatcagcgcgacgtcagaggacagcgactccagggagtatgtcagcttgccggagcgcgaggagtcccacagccgtgccatgtgcatggtgtccgcctcaaagccagcgtgtttaaccccggcgcgctccacgatgtgccggtcaaatgagaagttgtgccagaccttggggtggtccggggacgagaagaagggggcgaagagggagaggatctccgccgcctcctcctgtgacgtgtgtggggaggggggttgagaggttgcagcatgcttagtcagcctgggagaggtgagaaaagggtgacaggggatctgtgtcgagggctacatgcggtggaaaggagtggcaggcatgcgctatagtgaccacctcagcggcagactccagctctggagcaacgcagcgcgtctggcagcgcccaggacaaagaaggtgcggtagacacagctaggcacccaatgtattcaccagcacccccacctggcatcagtcaacccaccttcctggaggcgtcgccgtnnnnnnnnnncgtagacacagctaggcacccgatgtattcatcagcacccccacctggcatccgtcaacccaccttcctggaggcgtcgccgtcgaggtaggtgtcgacccacagcgtgctctgcacgctgggcgacgccccgcccccaaagtcgacgtcgggcccgcagtggatggagaaacagatgaggtcgccgtggcagcatggggactgggaggtgacgtcgatggcggagacctcggtatcgcaggcaaacacccggcccctgagctcgggggacaggagccgcgcggccgcagcctgcgcccccgccagcgtgttcaccaccaggacgtgggggggcggggtgttggggcagcgctcgtggaattcacgctgggcggccaggaaacccgcgccggcgacctcggacatgcccagtacctttggcccggcggcctcgggctcagcggggggggtggccagctccgctgtggtacccacgggggtcgtcatggcatgagcgcgcgcggctgagtccctagtgacggctgcatggccgccattgtccctgcccgggcccgacgggatgaccgcggctggggcgaggggcgtcgggatgaaggcgggggcgggcaggccgcgcggcgggtaccgtgaggggcccgccgccnnnnnnnnnntgtgtggccagctccgctgtggtccccacgggggtcgtcatggcatgagcgcgtgcggctgagtccctggtggccgctgcatggccgccattgaccctgcccaggcccgacgggatgaccgcgaccggggcgatgggcgtcgggatgaaggtcggggcgggcagcccccgcggcgggtaccgtgaggggcccgccgcccgcccgtacgacaggacggtgaggggctggtaggccgcttgcgcaagccgcgcccgcgccgccttctcctccatgcgctcgctggagccgggcgctcccgcacgggtgcgctcctgctcctcgcgcctggcattcacccacgccgcgtcgtacaagtggtgcccagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggccaccgtatgatgcggcggggcgagcgggagcgctgcggacaagattgtttggcacgtgtgagggagggagcgtgagctggctggctcgagtggggagcctcttggaggggctcgcaccaccaggggaccaagcagcaggccccagcatcgcaaggctccctggcacaccgtatcgtaccgctcatgataggctcgtcggaattctggcaggagagtgcggaaccagcgggctctggggaccatggccaggggcgagggtagtgagcccccgccagcaagtggcgtggcagactgcaagctcagcccgggcggggatgtgccaccgcgcctagctggttgcatgactgaaggctagggctcatgtcttcatggctgaaggtgaggtttgacgagtgggtcgcgcttcacgggactccgacacgagttgggtactgaagggtcgcaaaagcgctcggcgggagggtcgagagcagccagatgctccttgcgccacctgttctgtgatggagtacccactttaaggagctgaaaaggagatttttcgtcagccgtgcggtgcacaggcccggacatcctgacacccgccgagatttgagcttgcgtgcggcgagtttccgcgcgcggagcgagatcgggagttcgcttgaaagcatgcagcttcgacactccacgttctcccacatttcaaggcgatctgcaagtgtactgcgattctgcaaactgagggctcgaagactcgcctgcacgagcagcgggtatggggctcgcgctggcctgggcgtgcctcggactcgtgctgtgctctgggcagctcctcccagcccaggcagccgaagcgttccccggactggaggaatggaataacaaaacaatactgcccagtctaaaggcgctcaaagaggaccagtgggtgctcctggagctgtatgctcactggtgaggcgaggcgctggctgtagttcccccaatccattctccaccatgttctcatccattggcgcttacatgtacaaattggccctgcaatgacggctgcatgcctgggccccagccctgcctgtcatgatcttgttctccctgctgccttcccaggtgtcctgcctgccaaaaattccagccaatctaccaggatctggccgcgcacttccaaaaagatccaggactcgtcgtggcccgcgtggactgcgcagagtatgtgagtgtggcatgcatgcttgccgcaaccgcctgggaactgacctgagtggggccagcctcaacgacgttgctggctgggaggggtgcccacgggattgccactcagcgccacacccctgcccctctcacggcagaaggatgtgtgcgcaaagtacgaagtgaggggctacccgacactcctgttgggtcgggccgataaggtggcggcacatgacgcggcagcgctgaccaagatcgcggccgtaagaatcttggacaacattgtcaaggagctgaaggggtgagagttagcgtgcatggactcaacagtgggtcggagaggggctggctggctgcctgccgtccgcggggagtgctggtggaagcccttgaatctgcagttcaaaccacccccctgctactcctgggcaatgcaacacctcgcatggctgcggccaggcctcatcccaagctctcgcactctaaacacagtgtcatggacgcctccaaggaggcttcggcgctgggacgcaaggccggcggggagggcgcgggccaggggtccgaggccctgcgcatcctgccagctcccgtgaccgccagcctgaacgatgtcgagggcgccacgatggagtcctggcgcgtggtcacggacgcgcccgccgtcctgacgggggctgacgcacgccaggcgctggcggactggctcgcgctgctggcacgcacgcaccccagcctcctgtgagttgcacttggggaggggcctgagggggaaagcgaccgcaccaggggcaaggccagccgtgctcgccatcccttgccaacctgtaggggaccgagtgcctgcatctacttggttcagcaggcggagtccaggctgtgacccctcactccctcgcacgcgcacactgaaccgtctgtgcaggtgccaggcgggcgcggcggccatttccacccagctagataccctctggccgggggaccaggagaggcccctgcctggcctgctgcagctggacatgtgtcctggatctgagttcaaggtgtgtgtgaagagaggagagcgggtccaagagggccttggcgtgcaggaagggatcgacacctgggtcacgggaaagggcacagcacccgcggtgcaggttcctccggcactggggtatcgaggtcacgctccaccccctgagcccctcccaacccacgacacccgccacaagcacaggcgtaccagacctgtggatcggctgcgggggccaagggcgatggcttcacatgcggcctgtggcagctgctccacaccacctccgtccgcatcgccgacgccccgcgcgccggcgccaactggcttgtggccgtgcgcggcttcgtgcgccacttcttcctctgcagcgagtgcagcgaccacttcgtcaagatggccaccgacgcggcggcggcgcgtgtggccagccggcgggatgccgtgctgtggctgtggcgggcacacaaccgggccagcctgcgcctggcggtggaggaggacggcggcggggggcggcgccacgagcagtggcccaccagtctgctctgcacgcgctgcaaggtggaggacagcgaccccacggagggctgggtggaggaggaggtgttcgccttcctcatgacctactttggtgcacagggcgcggcgcagaccccgcagaccagctcccggtcggtgcagctggggaaggcgggagcgggaaatggatggggcgccgctgccctcatcttcctcgcggtggctgtggcgctggctgcggtgacaaagggggtggcgcagtactcgcccgtgaaggtcagagccttctgagcactgggcctgggtgtgctggacctggtccacggggcaaggctgagtcggctgctccggagagcctcatgcctccagattcatatctctgtcggctcttcattgctgttttccctcatcccatatgtattgaaagctcggtgaagtgatcaggtgatggactctgtggtatccgtcggattgttgtggaaagaggaaagagcgacaggaatcctccatgaagtcgttgttgacagacatcattcctcgatcgcaagacatggatcaatgccattgacacgctttcgaattatagaatttgcaacatgaccacacatccgggaatgtgcgacgaggaggctctttcggggacgcgtgtgcacctgcgcattcggccccctctggaggcgcatggctgtttgtccattacaggcccagacacggtcggcatttcagcccaaggctattccaaacctccgtgcaatgtcacccactactcattcgatggggtgcatggcccggaatccagccaggaagctcttttcagatcggtggcccaggcagtggatgcagcctcgaatgggtacaagacaggcttactggcctacggccagactgggagcgggaagacgcacaccctcttgggctcactcacgaccgatgcgaaagctgggatcctccctcgagctgtgcatcgcctcttccaatcctcacagcctggaagcacaaaggtgggtgcattgggtggacctacatgcagatggtatgggggacatggtgagcaccggagatgatacttgctcttctgctgcaggtggtcctgtccgtcgtagaggtctattgcgagagggttcgagatctgctggccccagacaaagataatcttcaggtgctggtcaggcgttactctcgtgcatgctcgaatgtcttgccattaggtgtcctgccattaggtgtcctgccattaggtgcattcagccaagtccaatcatgatgtttaccactgtctgaccgtggatctccttggagctcagatacctcaacgtcacgttcttcagaccctgcaacacaccctgcaatcaggnnnnnnnnnngtcttgcatgctcaaatgtcttgccattgggtgtcctgccattaggtgtcctgccattacgtgcacttagccaaatccaatcatgatgtgtaccactgtcagaccgtggatctccttggagctcagatatttcaacgtcgcgttcctcagaccctgcaacacaccctgcaatcaggtccaagagcgcaacggatctgtcacagtcgtggatgtcacgtgctgcaccctgtccagcgccagggagtgcatggacgtcctggcgccagccctggcccgccgtgccacatctgccaccgccatgaatgccagcagcagtcgctcacactgcgtggtcactctgcagatcgctcgaaagggtggcaatggggagaccaccatgggtaaactctgccttgtggtgagcactggtaccaaagccattgagtcatgggacttgtagattttcctgcataatccttgtgtgccatctcctgggagcagaccccaagctcaccccgctcgatccccggccaagtaacatcagcagcatacctcctgtcgtgtgcaggatctggcaggatctgagagggctggacggactaagacggagggacacagcttggccgagggcagcctaatcaacctgtccctgtcctccctaactcgcgtcgtgagtggactgacggacgaggcccaccccaagacccacataccctacaggcaagaccttgattcgggagcctggcattgttccagatcgaatgtgatggggttgcagtcagctgtctaacaggaggggttctttctgagcagccgtgcagcagcgctatcacactttcaaaccaagcacaccgcgctgaggggaggaccccgcaccgactcgtgcgcccctggctcgcgcaacgaacaggtccagcaagctgacccggctgctgcaggacgtgctgggccccgggagccacacggtgctcatcctgtgtgtgtccagcgctgcggtggacgcccaggagacgctgagcacgctgcgcttcggggcacgcgccaagcacatccccgcccagcccgcgcgacggatcgccgtggagagcgcggccgccgccggcgctgcgccggcagacgccacgcccagcgagcatccggtgactgggcgggggaacaaggggacgtgtccttgagggattctcggggacccggccacgcttcctgacagcacggacccgcacaacagcatccatcgcttccggcacagggacggggacagagcgcgccaagcacgaaaacagcccccaggccgtcccaccggacaacggcgctcaagacggtacctctgcggcgggtgagactggccatggcatgcctcgccgccgtccaggcatgcgcagtgtgctggatcagccaccactactggcagacgagccacctctgcatgctccgcgtttcctgacggcgccgactgtcagtccttgctccggaaatccactggcacgcgattgaaggacatcttcctcgccgtgtggaatgctgctgcattacactgcccacacgcccttcgcctgtgaaccgaccggggcgcggcatgggtggccggcccaggccctggccggcctcactgcttgggaggagcgtcggtgctctgggcagtcagctgatggatgaaatcagtgctgtcatactcctcctccacgcttgatcgtgcctgcattgcggggaaggcgccaggtgctagcaggcggctcagagctgctcctcgtctcgggtaaaaaggcagggcacagatcgcaggtatcgagtgtacgacccgccttcgccccatcagaacacaaacttacccgggctgcgcgccgcatgtcctctgcagcatggaacgctgccctgctctgcacctgttgcctgaatgccttgcccctgcagtgtgcaggggatgcaatgagaaagacctcagcaaggcggccagggaagggctgacccttctcagggacatgacctgcaagcacagccacatgagtggcaccgtcctcgaaatcccagttccccaaagacaacgcactttgcgatgtcctcttcagatggcggttctactcgcgtcctgcgcagccactggttccactctggtgggatgaggtcaggctcaaactccttgccgcccaagtccacctcacgccgctcacgatcactgccgtctgtctgacgttcaaaccacctggatgcagccatgtgggtttcagggtgaccatccaccgggtgtcagtcacaggcacgtaacccatcgcgcagcatcggttcccttgcccacagcccactcacctgtagtannnnnnnnnnctcaaaccacctggatgcagccatgttgggttcagggtgaccatcccccgggcgtcggtcacaggcacgtaatccatcgcgcagcatcggtacccttgcccacagcccactcacctgtagtacgtgttgcccacctcgtccctgccactgacttccctcctccggaacacagcaggcaggcgggcgcggaggccattgtagagtgtgcggagtgctgacattgagatgcaggggaaaacgactcgatgatgatgacctggtcacagggggttctccttgttttagggaagagggctcgtgcaccaagtgaaaggtcccagaggaatatgcaagataacaacgccaagaatcttgaaatttcaagcctgggtctgaaggtctgcgaatattattcgtcgctatataacactcgagcttgcatgcccaacactgaggtgaacctggtaccggcacagtaccacagaagaccccaatacaaagcgctcctgatcannnnnnnnnnagggttcttcttgttttagggaagagggctcgtgcaccgagtgaaaggtcccagaggagtatgcaagataataacgccaacaatcttgaatttccaagcctgggtctgaaggtctgcgaatattattcgtcgctgtatagcactggagcttgcatgcccaacactggagagccaggtactggcacagtaccacggaagaccccaatacaaagcgctcctgatcacatggacattgttgcgacaaagccaaatcttcgtcgctcttctcaataggccaagacacggaaatctagcttgcatggagtggtgagcgcgctcggcgcctgcacaagcgagcccgtcccaggatggtggcaaccacggaggtgaatgggacggcagggcccatcatccccgtggggtccgcccagtcctccctccctgcccctgacctggctggactggatacccagacccggaaaatcgggctcatctacccccctcccgacattcgggcgattgcggacaagaccgccctttacgtcttcaagaacggtgggggatttggattgtgctctttgtaagatgctgtgatttgggatcttacggcatcgggcagcatgttccagcccctcttacacccccccctcgaccctgcaggccccgacttcgagcgccgggtgcgcgccaacgaggctgagaacaccaagttcagcttcctgaagcccggggacccctaccatgcctactaccagcacaagctggcggagcatgccgcccccgcggcagaggaagaggcccctgctgcggccagcgcagccgctgccgccccggccgcggcgccggccgccgcgccggcgcccacccccgccgcgccctccgtgctggcccccacccagcccctggccgcccctgcggaggaggtgtacacggtgcatgtgcccgagggcctcacccctctggacctggacgtgatcaagctgacagcggcagcggtggcgcgcaacggcaagaagttcctcaccgagcttgcctcgcgtgagcacgcctcgccccagttcaacttcctcaagcccacgcactcgctcttcgccttcttcaccgccctctgcgacgcctactccgcggtgctgatgccgcccaagggcctggccgccgaactggcggccgacgccggctcgcgggcgcgcgtgctcgagcgcgcgctgcgccggctggagtgggagcgcgcgcgcgactcggcggcgcgcgccgcgggcgacgcggaggaggcggagcgcgcggccatgcagtccatcgactggcacgactttgtggtggtggagaccatcgacttcttcgaggacgagacgggggcgctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgaggctgcacaggcggaggccgcggcggcagggggggcggcggccgtggacgagcaggcgctgcccatggacgcagaggagcgggcgctggtggcgcaggccgcgggcgcggc

SEQ ID NO: 37888 - DNA, 168 bp, Chlorella protothecoides
actcgatccaggggcctgggcggtctctgcgccgcttcctccctggggcctggggggtgtgcaggtcccgccgggggaggaggcggcttggggcccgccatgtgctggcaagggtttgaaggcggcacgctgaagccaggggggagggggggtggcggcggctgcccc

SEQ ID NO: 37889 - DNA, 9120 bp, Chlorella protothecoides
  modified_base (788)..(797): a, c, t, g, unknown or other
  modified_base (874)..(883): a, c, t, g, unknown or other
  modified_base (1047)..(1056): a, c, t, g, unknown or other
  modified_base (1600)..(1609): a, c, t, g, unknown or other
  modified_base (2085)..(2094): a, c, t, g, unknown or other
  modified_base (2942)..(2951): a, c, t, g, unknown or other
  modified_base (3022)..(3031): a, c, t, g, unknown or other
  modified_base (4438)..(4447): a, c, t, g, unknown or other
  modified_base (4519)..(4528): a, c, t, g, unknown or other
  modified_base (4604)..(4613): a, c, t, g, unknown or other
  modified_base (5120)..(5129): a, c, t, g, unknown or other
  modified_base (5519)..(5528): a, c, t, g, unknown or other
  modified_base (6264)..(6273): a, c, t, g, unknown or other
  modified_base (6344)..(6353): a, c, t, g, unknown or other
  modified_base (6828)..(6837): a, c, t, g, unknown or other
  modified_base (7107)..(7116): a, c, t, g, unknown or other
  modified_base (7893)..(7902): a, c, t, g, unknown or other
  modified_base (8442)..(8451): a, c, t, g, unknown or other
gcggcgcgcgtggccgcggccgggtcgaggtccagacgcacacccgccgcgctgaccgggcgcgagaggggcgaggccgcgcgtgggccgggcgcggaggacagctggaaggggctggcgttgacggggtgcgcgcccggccgcacctccaggcccaggctgtgggccggcggggtgagggagcccgggccgccgggagggcccaggctcacgccgcggtaccggaagccggccaggctgggcgaggcggcgcgcgagggcaggccggccccgtacccctgctgctgctgctgggccaccatgtgcgccggcgtgagcgggcgggagtgtgggtgcccctggtgcgggaggtacccgcccgcaccgccgtcgccacgcagcatgctcgccgccgcactcatgctggccgcccagtcgctggccgaggcggccccggccccgccgcccggccgggcgtacgcgaagccggaggggctccgagcctcggcctcatactcgccgtggcgctgcatgccagcgccgggcagcgggcccctgcccaggccggagccgggcggggcggggtaggcctgctgcacgtatgcttcccgcccgccgccgggggggtcgtaggcgaagatggaggggcgatgggcatacccgccggcctcaccggggttgtgggggggggcttcgccggcatgggggggtaagtggctcggcatctggaggctggcgggagtgggcagggtggaggggaccagggaggaaagctcaggcaggagctgggctgcctggtccagcagctnnnnnnnnnncgacccaccacacctcccgcggaatgaaggaccccacattccactgggtgtgcgcatgggagtggatgctgccacannnnnnnnnnacaggagggaaaatcaaaaaagggggggggctgtcaggtcggcgaggatggcgagccagagcagagtacccgcctttgcgatggttggcccagtgccaggcctcatggtgaagtgctcgattgaaaaaccagtgcgaggggcggcgcctgagcatgcgcgtggnnnnnnnnnngcaggagggacaataaaaaagaggggggggctgtcaggttggtgaggatggcgagccagagcagagtactcgcgtttgcgatggttggcccagtggcgggcctcatggtgaagaactcgtttgaaaaaccagcgcgaggggcggcgcctgagcatgcgcgtggcctcagcaagcggcctggggagacataagcgacccaccacacctcccacgggataaaggaccccacaatccactcggtgtgcgcatgggagtggatgctgccacacggcagcccgagagcacagcggtggccacacccctcgcaggcacatcgtccggcaacaagcaagcacactctcccggcaccttccccactttacggcccccaatcgccagggcggcaccgacctgggagagcctcgcgtcagatgtttcgccatccaggcgctgcggggccatcatctcccacacatcgtccagggttttgctcctacgcaggtgatgcggcggtgtcgagtgtgtcgagtgtgccagtgccactgtgccttgagattgcagctgnnnnnnnnnngcgcaggtcatgcggcggtgtcgagtgtgtcagtgccactgtgccttgagattgcagctgcagggcagagtttcccttgcacctcggtcgcccaactcgcgataagtgtccctagggaaaacgcccgtgcccctgcccggatccatgcctgccctgcccgaaaggattcgcatccgcaccgcacgggtgccgaaaacccgccgggacaccttccccgcccacgcacccaaaggagccggggttgtggcgctgtagggcttcgatggagacccccagggagctcaaggagtcccgcagctcatccgcagcgttggaatccgtgcccgccccctccgcggcactcgcttgcaccagctgttgcaacagcttcccctgcaggagttggggcggtggttcatgcatgcatgacgcggcattggggcgcgggcggttctgtaaagcgagcccaacgcccccacgtaccaggtctgcgggcnnnnnnnnnntccccagggagctcaaggagtcccgcagctcgtctgcagcgttggaatccgtgccccccccctccgcggcactcgcttgcaccagctgttgcagcagcttcccctgcaggagttgggatggggtttcatgcctgcatgacgcggcattggggtgcgggcggttctgtaaagcgagtccaacgcccccacgtaccaggtctgcgggcaggctttcccccccgggcagggtctcaagggaagcggatatcgggtccgtccacgcatctctctgcatcgcgcttcgacaagacaacgcaagatcttggtcgcagatcaaccgccagcagtggccgtcggcacgttgattggccggcgtccaacaagtgtcgtcgggtgccgggtttggggatggaaagcggggcgcggacacgggcacctgacacgtggagcgcgccaaccaaacctccggacgcccctcccatccatcggccactcatctccgtcactcccgcgccacaaacttcggaatgatcccacacttcacatcagatggcatgcaaggggccatgggatgggcacgggctcgcatcaggtcgacgcatccaccgccgccgccacccagtcccgggcggtgatgcgagcgacgcgcagcccgccgccgccagccgcctccagggcctgcatgcccctctcggccgccaggtgctccaggaactgcaccagcacggcgtccgtcaggtctggccccgccggcacggccgcctctggctcggcggcggggggatcgccctcgtcactcggagaaccggccaccctggcagactcttcctccgggccgtccgccggcgcggatgagccgtcagcgggtnnnnnnnnnngggccactgatctccgttgctcccgcgccacaaacttcgaaatgatcccacacttcacatcagatggcatnnnnnnnnnntgtcaggtctggccccgccggcgcggccgcctctggctcggcggcgggggggtcgccctcgtcactcggagaactagccaccccggcaggctctccccctgctccctccgggccctccgccggcgcggatgagccgtcagcgggttccgccgcatttcgtgtctcactgagaggctcctggggtgccgactcgccaccggtgggctgctcggtgggtgcatctccgccagcagaatcctcggcggcgacggccccgcctgccggtggcatgctggcctccagcccctgctccgacacgccaccctccgcacactcctctccggccgtggcggtctgcgcagtgggcccagggacgacctgcagcaccgtgccggcaccctcgcacactccacgcaccaacccgagcgcctttttttgtgtgtgttgggggggagagatgtggttgcgtgggcatggagagattgaaacgatgccgcaccatcgcgccgccggacgggcaagctccccatcaagcttcctcccatgccactgctcccatacgtcccctcgcactccttcacgtcccatccacccgacgccaaacccacacctcccgcccaagcaaggccccacccaccccactccctggactcgacccagcgcaccttggcgcgcgctgcctcgtccgcgcccggcgcgatggcgccccacacggccacaaaggcggagggcagcggcgcctcgccctcccgcgccgcgccctccgtctcggcgtggaagcgcgccagcgcctgcgcggccgagcgcgccgcggcggcggcgtgggtcgggtcgacgtagccgctgggccgcccgatgctcagcgtggcgcccatcaagctgaccacgccgttgagctgcagcgcggcggtggccatctcggtggtccgcagctccacaaaggcataccggccctcgctgtgcacgttgcagttcaccaccgcatccatccctgctcaggcatgcgcaggaggatccacatcgaacgggaggtgggccacaggcaggcatgccttcatctggatactccctggcaaggttgtctgccccccacacccccccccaaaaaaaaaccattaaaccccgtctcacccggcacaacttgtgtggggaaggccacggccatggtggagtcaaacagctgcttcagcatctcgcttgtgatgcctccctggcccaggttgccgatgtagagctgcaagttctcccgccgcgttttgctggccgcctgcaccgtcgaggcggcctgctgctgcagcaccgtcagccgcgcccgcatctgctgatcccgcatctgcttctggactgcaagggcaatcgagaagaaagggggaaaggggggtttggggacacaccacagcgaggcaggaggcccccaacatggacgcnnnnnnnnnnccgagaagaaggggggaaagggggtgtcggggactcaccatagcgaggcaggaggcccccaacatggacgcnnnnnnnnnnagtgggtagggggggccctgaacacaatctatagtggtttgcctactgcagctgggcaatccaccttcccttaccnnnnnnnnnncggcggccttggcggcggcctgcctcagcttctcaaagggatccacaaagttcttggtggggtctgggggcccccgccccctcctccgtgggacgtagccatactcgagatctgcacaatgcagaggtgagagcaaggtgggaagggcgggcgctgaacacaatctatagtggtttgcctcctgcagctgggcaatccaccttcccttaccacccaccagaggaggagctgcggtaccgattgcgcctctccctactcctctccctcctccgatccctcgaccgggaacgccggctgtcgcgccggtcgcgtgatctgcgggggagaatggaagggccgatcggtccgggcatgattatctgttcctcctggaaatggcaaaatatttcaaggagggaggctgtaatagcagatggcagctcctgggcctccatccagttcaaggccacgcctggaagcgcaaaactaacctggaccgtcgcgagcggtcgccgcctctcctgtctnnnnnnnnnncatcggtccgggcatgactatctgttcctcctggacatggcaaaatgtttcaaggagggaggctgcaataccagatggcagctcctgggcctccatccagttcaaggccgcgcctggaagcgcaagaccaacctggaacgtcgcgagcggtcgccgcctctcctgtctctgctcctgcttctggacgatctccggcggcggtcccggctcctgctgcgggaagatctgcgatgcacaagggggcgtgcatgaggaatgggtgcgggttccacacttgaatacttgcaccaagccgagaagggccccttccatgcactgtgaaggaggcatgtggaggcctcagatttaagacaagatgatgtcaactactccaaggcaagcctgctcggnnnnnnnnnnggacctccggcggcggtcccggctcctgctgcgcgaagatctgagatgcacaagggggcgtgcatgaggagcgggtgcaggttccccacttgcatacttgcaccaagccgagaagggccccttccatgcactgagaaggaggcatgtggaggcctcagatctaaggcgagatgttgtcaactactccaaggcaagcctgctcggcgtccttgtgccactcccgcagaaccaccgttccacactgaggtacttccgggtcaccttcttcgctcatcatccctgcgactgctgcggtgcttcttacgatccctggagcgggatcgctcgctgcgcttagactccttgtccctgtgcctgtcccgcctccgttcctcgcccttctcgccagaagctacatcgccagacgctgcgggagggtgagaggcctgcccctgtcctgacaccgcctcttcggatccaggcaccttggtggggccatgttcatcgatggctacctggagtgcgggggccgtacgatcgtcgtccgcggccacaggttgcacgacagggtcgacgtccaccatcgccccgggagggcgaaggaacagatcagcacacagcccttgggaatcgggggggatggagcaaccgagtatcgatgttgtgtaaacaccctcgaagatcccgtcttcaccgtctcgagttcctgtctttgcgcgtcatggtgttgggtcttgattgccagcgtggacaggcnnnnnnnnnnggaatgaagcattaccaagagtggcagcgcgtcgcaaaggccctgtggtagggtgagtgctgggtcactcnnnnnnnnnnaaatcgggcgagatggagcaaccgagtatcgttgttgtgtaaacaccctcgaagatcccgtttttaccgtctcgagttcctgtctttgcgcgttatggggttgggtcttgattgccagcgtggacaggccctgaagggagccccaccaagcaataaaccatgtttgaacagcctcaagcttaggtttgaatgcgcatttcgtagacttacaggagggaatgaagcaataccaagagtgccagcgcgtcgcaaagcccctgtggtagggtgagtgctgggtcactcgtgtctgctgtgcccccagatccacagcctcctcaccaagcacagtgatcagtgaaaggggtgggcagcagctcatggaaggcactgaacagccgcctgtgtcagcatagcagggcgggtgaatggcatgcgaagggatccccgtagctccaccaggaggaggtcaacgccctcccgcacgggatgccannnnnnnnnncaggcactgaacagccgcctgggtcagcatattaggacgggtgcatggcatgcgaagggatccctctagctccaccaggaagaggtcaacgccctcccgcacgggatgccaagaactggttccagctgcgtggctgggcaggtggcttggactgcctgcaatgtccagactccggggcacctctgggcgcggcgggagggtggggcatgggtgacgccggagagggcagccccaccccattgctggccgggggagaaaggagggggaggnnnnnnnnnnacaatgtccagactccggggcacctccgggcgcggcgggagggtagggcatggttgacgccggagagggcagccccacccccttgctggccgggggagaaaggagggggagggggcgctcgggcgtggttggaggcacaccctccggtggacaagctgaagagggaaggggcgccgtccctttctgtccaggagccaaagcatgcggctgccggtgtgttcccgcccgcccgtcctccccgtcatcggcggcggccggggagtggacgtcgatgcccgtaacgtctggcatgtgatctgaagttgcaggcctgagcgcacccccgcacgtgccatcggctcgggcctgcatgctggagagccactgctgccagggccgaagggcgggggtgggggcggcaggcgtggcgagccgcaggtggtgggactggacggccgcctcgcccctgtttgggcctggcagcgcagcagagttatgcctggcagaagtacctgtggcagcgatcacgtttcgaagggttgcgggggcaggggggaagccgggggggggtactccctggtgcagctcctgggccgtcagctgcgagggtgtgtgaatgcagccatttgagcctcgtgctcaggggagtattgttgcccattgcaatctgggcacatgggatccgaggtccatctccatctgtggctccgatgccctcgctttcgtacacaagcggccccatccccaatccatcatcccctctcaatcggcccccacacctgcgcattttgccagcgnnnnnnnnnncttcgtacacaagcggccccatccccaacccaccttcccctctcaaccggcccccacacctgcgcattttgccagcgaagcaggacctcgttggcctccagcttgcactgcgcctccctcgtctcgtggcgggcacgctccagctccgctcgcagcccgtctgaaggagggtgtgcttggcagggctatgttccattgccctggaatggcgagggcaggccgatgcaagtgccagaacaacaacacggctcccacaccgaaatccccctggaacccaccggcctccttgcgcgcagcctccagctcgtgaaccacagcatcatgctcctcgcgcgcgctctggcatgctgcccgctgcgacgccagctcggcctcctgcctgctgatagtgcccctgagccgcccggcctcctcacccagccgcacgaggtcagtctgttgagtgagatgggatcctggatacacgaataacagggatgggtacccaaagtcaagcgttcccagttcttgagtcagcgctccaccctggtcctgccagcnnnnnnnnnntagtctgttgagtgagatgggatcctggagatacgaataaaagggatgggtaccccaagtcaagcgttcccagttctcgagtcagcgctccaccctggtcctgccagcaaaacccttcacctgtgccaggtcgagggccgcctgcgactcccgcagcctctcctcggtggcggccagggctgccgccgcagactcctgcgccctcgcgctctccctcttgcccagctcgacccgctgcagcgtcgactgcagattcgaggagggaggatgaaggggttcggaggctggcttgcattctgccgatccaccttgaaatcgctgtgcatgaaagccccagccacattgaccaggagcgtacccgaggatacctcctcccagcaacctccagaaatcccatcagctcccatgcgcgccaagctccctttccaaaccctctccgcatcctggcctcacctccagggcctcggcacgctgcgcatgctctgccgttgcagcgccggcaacggccagtcgctcctccaggcccgccacccgcgcctccagaccccccgccctcgcctcgccctgcgccagcgcggcggccagcgccgcggcttccccgcgcaggcgcgccgcctcctcgcgcgccgccgctgcggcaccacgttcgcagcccagctggtgagccag

SEQ ID NO: 37890 - DNA, 61 bp, Chlorella protothecoides
gaacgtcctgggagtctttgcggcaggggccgtgggaggcgccctggtcctccagcgcaag

SEQ ID NO: 37891 - DNA, 111 bp, Chlorella protothecoides
ggtgtactacttcaatgctgcggcggggctaacgcagtgggagcacccgggcacggcgggagcagtggcacaggcgagcaccggcgcaggcccgcagcaggtgccggcggc

SEQ ID NO: 37892 - DNA, 130 bp, Chlorella protothecoides
gtcgccagtcctctgcacctccgccagggcagccgcgacgctcctcgaccccggcgacgccggcgacggctcgagggcgtcgcctccggcacggggcacgtgactggagcgccccgcctcggcgccgagt

SEQ ID NO: 37893 - DNA, 70 bp, Chlorella protothecoides
cttcctgcctccctccattcctcttcccccaacacacacacacaccaccacacacttccctgcctcttcc

SEQ ID NO: 37894 - DNA, 61 bp, Chlorella protothecoides
caggggagcgggggtccagcaatggaggagcgtgttgcctggtcgctggtgctgattccat

SEQ ID NO: 37895 - DNA, 78 bp, Chlorella protothecoides
gcaaggagtttgggatgtcttgccgcatgtagtgttatctatccctgttatgcccgtgcacccaagcttcctctctta

SEQ ID NO: 37896 - DNA, 74 bp, Chlorella protothecoides
acccgcaccaggtgcagcggggtgtggagcgcaaaaacatgactgcgcagggtcaggaggcccgatgccatggg

SEQ ID NO: 37897 - DNA, 65 bp, Chlorella protothecoides
ttgtgaatccgatggctatatcgtcgtcgtcgtggcgctgcggccgcgacatgtttgcgtgcgcc

SEQ ID NO: 37898 - DNA, 61 bp, Chlorella protothecoides
tgacgacggcgacgagtccatgagcgactcccagggatccacgagcgactcggaggatgcc

SEQ ID NO: 37899 - DNA, 73 bp, Chlorella protothecoides
ggacttgcgccccagcgtgttgactacaaaagtggtgagggcagggggggggtccggaggtggagagaaaagg

SEQ ID NO: 37900 - DNA, 20687 bp, Chlorella protothecoides
  modified_base (339)..(348): a, c, t, g, unknown or other
  modified_base (1596)..(1605): a, c, t, g, unknown or other
  modified_base (1734)..(1743): a, c, t, g, unknown or other
  modified_base (2164)..(2173): a, c, t, g, unknown or other
  modified_base (3009)..(3018): a, c, t, g, unknown or other
  modified_base (3116)..(3125): a, c, t, g, unknown or other
  modified_base (3793)..(3802): a, c, t, g, unknown or other
  modified_base (3971)..(3980): a, c, t, g, unknown or other
  modified_base (4132)..(4141): a, c, t, g, unknown or other
  modified_base (4979)..(4988): a, c, t, g, unknown or other
  modified_base (5730)..(5739): a, c, t, g, unknown or other
  modified_base (6402)..(6411): a, c, t, g, unknown or other
  modified_base (7179)..(7188): a, c, t, g, unknown or other
  modified_base (8176)..(8185): a, c, t, g, unknown or other
  modified_base (9151)..(9160): a, c, t, g, unknown or other
  modified_base (9973)..(9982): a, c, t, g, unknown or other
  modified_base (12758)..(12767): a, c, t, g, unknown or other
  modified_base (13655)..(13664): a, c, t, g, unknown or other
  modified_base (16681)..(16690): a, c, t, g, unknown or other
  modified_base (17286)..(17314): a, c, t, g, unknown or other
  modified_base (18243)..(18252): a, c, t, g, unknown or other
  modified_base (18876)..(18885): a, c, t, g, unknown or other
  modified_base (19077)..(19086): a, c, t, g, unknown or other
  modified_base (20225)..(20234): a, c, t, g, unknown or other
cgaggccgccagctcggagcccagctcctcgcgcagcgggcacagcgcgcgtcgcgcagagtgcgcgtcgccggccgccgcggccacggcctccgccacggccgcgacgtggcccgaagcgccgaagagcgaggtcgctcgcgccacgctctccctcaccagctgtgtctccaccgtgtcctttcatgacgcggaagagaaggagcaatggcgcatgagaggggtgcagatgggcggagatcatgggaaacccacctgtgcccaggcgcaacacatgcccttcccctccacagcctcgactcctacaaatgccccctcaccaggtactgcgccagggtnnnnnnnnnncgtctccaccgtgtcctttcatgccgcaaaagagaaggagcaatggcgcatgagagatcacgggaaacccccccgtgcccaggcgcaacacatgcccttccccctccacagcctcgacttctacacatgccccctcaccaggtactgcgccagggtctccagaaactgcacccctgccacggggtcggcggggtcaggcacggcccgccagaggtccggcgaatcgaagtcaaagccctcgtcgaagaaaaaggcggggacgtcacgcagggcggtggccaggccctcccctgtcagcgactgcatctcctctgcgcaaggggggggaggggggactttgcaggttgcgagatttggtggcctgtgcggagctgaagcaaaccctcgcattgaatccctgaatgttgctcatccggtcacccaccaagagacagcggctgcggcgaggaagcggcatgggattcacggcggggggcataccccgtctccaagctccgcaggtagacctcaaagtcacggatggtgatctgtgggtgaagcagcagttccgtgatgttgctgcgtaatgaggagattgtggacagcgacagcatcaccgcctgcatcatcgccctccaatgccatcctctacactgccacacattggggtattgatctggaggcagcgacgggggaggcccatcaccctcgtacgatgaagaggcaaatggccaggccacccacgagttggcattgccagggtcgttgatcacggcctgtagttcctgggcagcagcagcggcagcgctgctggggctgatactggggtccgaggaggtgcggtccaacagacgcagcttcctcagcgtcgggtccattgcatgaaccgacgatcacattatcatgtatcttctgggttgccgcctctgatggtagagggcccccaaggaatatgaggccatctgggtggcgccaggggcgccggatgtgatctgcaggagcgcaagcccgacgtcaaaccacagcggtgatagtattgttcagctttctacaaaggcaatgccacaaaagctgctcgatgattgcatcggaatagcatctgggaacgctttcgggtggacaactcccccatccggcctggtctcgcgcgcggactggccagggtttcaaattcgcatgcgagtcagatcagtaaaaaacagactgctctcggctcaggcatacacttgcaaaaactcggtctatcagaatgatgagcttcccaaatcnnnnnnnnnntgtatcttctgggttgctggctcagatggtagagagcccccgaggaatataagccatctgggtggctccaggggcgccggatgtgatctgcaggagcccaagcccgacgtcaaaccacagcggtgatannnnnnnnnncaaaaacagactgctctcggctcaggcagacacttgcataaaattggtctatcagaatgatgagcttcccaaatcctgctggatgaaagatcgatcggtgggcacgagtacaggccccgccctgttggctctcgggcagtcctgcgaggcccaaggatgctactgtgctgccgcccggtgctacgctgccatacctggcaccactcagacagctcctgtgtatgcacaggcagctcttcacctggctcgtctgctcttggcgagatttgagaatgtcccggaggccctgtcggcgctccacaccgcagtgggtgcagcttggcagtgagggggtgcccttccaactttcttgcgataagattgctgtccaatggggatgcactcacctcctatcgtcatcttacctacccctctgcattgnnnnnnnnnnccttgcgataaaattgctgtccaattgggatgcactcacctcgtatcgtcatcttacctacccctctgcattgcagacactgcacctgagggcatccaatgaagaaaccacaaccatttcctgccagctgcacgactgcctggcagactgccaccgagcgcagggcgagcccgagttggagctgaaggctctccgcgctgggctcgaagcatgcgcacgcgccagtccaaaggccgataggtgaggatctgggtgaggtcgtatctatgactttgagggccagtccttgcctgttttcaagagtttgctgctcaatcgcagccatcaatcttgccccgcatctgctatattctatgtaatccacccacccatcccctgccctgcaggcccacaatcgcacgctggcgttcctacttcctgtttcgtgccctggagtgcgcggccgcgggcgaggacgagcctgcgctgacccaggccctgggggaactacagggcacgagggctgatctgactgccgtggagcaggtatgctggctggcaggcctctgttgtggccatgcagatgggcctggagcgtcacgagcaagcgagcgtggttcctatccaagggggtgcttgtttcccccacgggttcctctgacacttttcagcaccatcgcccacctgacagtatcccagggcactcccacccaccctctcccctttgccgatcgccaggtcttggtcgacctctgccactgcactgtgctcctggcacgccgccgcttcgacgccgcgctgagccaggcgggggccaccttacctgctgcgacggcagccgccgccgccctcccggnnnnnnnnnnaagcatgagtggccctcgaatccctcctgatctcagaacctctcaccacccccgccggacagactgccccagcctggtcgaccttcagggcgcgctgnnnnnnnnnntcggtacgggggatgccctggcctggcacgcgcgttttctcgccttggcggccaggctccaagcaggcgagcttgtagcgctgcagccaccaggtgcgtgacgccttgcacggctcacaatgcccgacctgcatgttctggtgctggcggagcaaatgggaggcgtgcagagcatgagtggcccttgaatccctcctgatcttagagcctctcaccacccccgccggacagactgtcccagcctggtcgaccttcagggcgcgctggagattgggagccgggatggtgcgccgcgctggccctaccggtggatcgcccccgccgcgctctccgccctgctccacacctaccacgcctccctcctcctagccagcgggaagacggcggcggccgccgccgccctgcgggaggccggcggtcccgaggcggacctccaaccctgggcccggcgcctcgcgcggcggcaggccgcggtgcaggccctggcctgctgcgacctggccggcgccgctcggctgttggtcgatgcctggtccacagacgacgaggctggcggggcggagccgcagccatcccctgcctggaccctcctcgcaggtgtgtgggcggggccttgtgtgttgatcgactttggccctgcgtggagcgtccaggaacaaccctgggtnnnnnnnnnncgcctggaccctcctcgcaggttggtgggcgggccttgtgtgttgatcggctctggccgtgcgtggagcgtccaggaacaaccctgggtgccgtggcattcagggtattggagcaagggcacagtgcattgctccagtgtgcagttctgagggtctcagtcggctcacnnnnnnnnnnttcttgaagcaagggcacagtgcattgctccagcgtgcagttctgagggtctcagtcggctcacagccctcatggcccccctgcaggcatgtacctggcgaccctggggcatggccccgctgcacggcacctgctggcagcctctggccagnnnnnnnnnngccccctgcaggcctgtacctcgcgaccctggggcgtggccccgcagcacggcacctgctggcagcctctggccagaacgggccgccagccgtgcgccacctggcggcgttccagacatcggtgcactgcctggaagccggcgacctggagggcgccgaggccaccctccgtgcatttgggacagacccggccctgtcacccctccacgagcggtaagtggcagcgtgggtggccaggcggacgttgttgatcggtgcaaagccatgctggagttgccatggtgcagttcccaccaaaattcccctcctcactccacaaacagggccgctcagatgctggcgcagggcctgctcgccctggccaagggcgatgcggtgggcgccaagctggtgctcagccgctgtctgaagctggcacaccgacgggtgggcaacacgcagctggtcgcgcaggtgctcaacgtgctggggcccctcctggcgtcccagcgggaccgcgagggggccacccagatgctcacctcctccgccacgctgagcagggccctgggcgatgcgccctcgctcctggccgccctccgcgccgcctgcgaggctgggatcggtacagatgcggagcagggcgctgcctacctcgccaagaaggaggggcagctggcggagcgcgtgggcgatgtggtggggtcgggagcccatgcagagctcgtccaggtgatccatgcccactggcccgatgctcccctggcgggacatctaccttaacgtatattctaaaaatgaaaattttggtatgcgtgtgcaatgtggccccagagaagtgtccacatgcgaatgcacnnnnnnnnnntacaatgaaaattttggtgtgcgtgtgcaatgtgaccccagagaagtgtccacatgcgaatgcacccggtgggtgttcccatgcgactcccggggcccttcacgacatatgtccgacatgtcacgcctcgccggctcagttggaccgggcatgtctggggtgtttccataagccggccatcacggagaaggcacagacaactcctgagagcgaggtggttccagacctcctctccggcatgaggtgccgtcacttcacaccctgccaggcagcggagaccaggctggcccaccctcccccagccaggccgtctgtcaaggatgccagggtattcatacgccctcaccttcgtaatctggccccttacaaacccatcgtaccgctggacgtcatctccgcacggctgggctttgcggagaaggacatcgtgaagctggacgccaatgagaatccctatgggcctcccccagaggtcacggctgcacttgccagcttggagtatcccaacatatacccagacccggagtcaagggccttgtgcgagggtctgtctcggtggcatggaatccctgtggagcacctcatggtagggctccgagccggagcaatgcatggtggggttgccaggctgtgtggcacaatgccatacctgccggcctgcatgcatgctgttgggagttgaagtgtgtatgaagccctgctctgccagcgtgatgcgttgtccttctgagccactttgtcnnnnnnnnnnggggagttgaagtgtgtctggagccctgctctgccagcatgatgcgttgtccttctgagccactgtgtccgccggtgtcacccagccgccctcccatgccgccgcacgcaggtcggcgccggtgctgacgagctgctggacttcatcatgaggtgtgtgctcgagccgggggagtacatcgtggactgcccccccacattcaccatgtatgcttacgatgcggcggtgaacgccgcgcgtgtctgcaccgtcccccgtctggacggcttcaggctcgacatcaagggtgcgtagcggttggccaatggcgcagatgttttttgctgccgagcatgaaggttctgcatgcgtgcctttgacgacagcttggacgaggccgtgctgtgactgagcacccatgccatgaccctctccaatggacaggtgaccaactgcacctttcagcttcccctcctgtctcactcaggcatcaagaaggcggtggaggaggtacgccccaagatcctgttcctcacctcccccaacaacccagatgggagcattgtgtcagacgaggatcttttggtaggtgggggactgtggaagggctgcacagagggaggatacctgtacatgggtccacgtgtgaccggggagggactcagaaccccagattgcacaagnnnnnnnnnntccagatgggagcattgtgtcagacgaggatattttggtaggttgaggactgtggaagggcttcacaaacggaggatacctgtacatgggtccacatgtgaccgtggagggactcagaaccccagattgcacaagcagccccgtgcatgctgccctcccccatgtcccaatccgcaggagctgctggagctcccggtgctggtggtatttgacgaggcgtacattgagttctccgacgagccctcaaagatgggctgggtgcagcagtatgagaacctcattgttttgcggaccttcagcaaatgtgccgcgctggctggcatgcggtgagcgggactgagtggggacttgtgtggtttgttgtctcactaggggatggagctggcatgcgagcagatagcactcaccctcatccctcaaatgtaactgctccctcccaggctcggctacggcgccttccccctgagcctcatagaggtgctgtggcgggcgaagcagccctacaacgtcacggtggccacccaggtggccggcctggcggccatgcgcaacgtcccctacatagaggtagctgcgaggggggttatgctggggcagggctgcagcagccgggcttcgggccggtcttgggcactctgtgagtcgtctcccatgtctgcacctggcaggggcagggaagctgctgcccatcctcactccccacccaccaacaccgcacatcctcgtccatgcccccgccccctttcgtcccagcgcgtgcgcgacctnnnnnnnnnnttgcacatcctcatccatgcccccgcccccctttcgtcccagcgcgtgcgcgacctgctggtggtggagagggagcggctgagcgcagccctgctggagcaggtgccctacctgcgccccttccccagccacgccaacttcttgctgtgccgcgtgaccgacgggcgcgacgcggcggcgctgagggagcgcctggcgcgggagtacggcgtcatgatccgccactacagcaccccggacctgcaggactgcgtgcgcatcagcgtggggaaaccggagcacacggacaagctgatcgctgcgttggtggcgctgcaatgacggcccgaggccgcggggttgcttggcacacctgccccttctcaggtagcctgagggggcacaggagtgcgtgcgtcaagaggcctgtgttgggggccctgcatggcccttcccctccaggacccctctgcacgagagacaagccttgtgggcaccaagacctgccgctcggccttgcatccttgtgtcagtggtgccacatgaactgtcacagtactgagaatttacacttgcgccgtggccatacagacagacaagggggagggcgaatctgggttaatgttgtacacggcaaaaggctggacaggaagcttgaatgctcccaggctgcggacactgcatgcggggaggatcatcggtcgaggcctgcaaggggtgcctcaccccaggcgtggcacgcgaacaacgctaccctcattattgtggaagatgcggacgcggtcgcggcggtagtccatggtgaccacccgatcctgccccacggtgaagaccttgaggtttgggaaggcgcgctccagcttggccttggcttcgtccttgtccatgcccacctgtggggggaggttttttaacatcaggtgatggtgaatagtcattgagccaggagctcatgcaaagtatcttcccttggcattccatcaacccaatgaggaagtatatccccagnnnnnnnnnnttttttcaacatcaggtgatggtgaatagtcgttgagccaggagctcatgcaaagtatctccccttggcattacatcaacccaatgaggaagtatatccccagctagcttgtcaaaattctgagggtccgcaccaggtcaggccacgcctccgtctcctcggtgctggccatcctgctgaagagcgacgagaatcctggcaaggggaaggagggggtgctgagcagaactggctggagggcggttggtgggattatatcacccaaacgatacagcgccacgatccctgcactctttcacacaccttggtcgctatcgagggcctggactgttacctgcgagcatcggtcggcaattccaaagagggtactcagcacaagaaaaagacccagtccgcacgcggtaatcagtagaacagccccgtgagagcacactcccttcatctcaccagggagatggcggtcacgcacgctagacacaagagtaagctgcaggctcttcgggatagcaccatccctgggaagactgtcggccgacggcgagttcctcagaaacgtgtcccttcaagactcgagaacgtgaaaggtaaagtgtctcggggcctgctgctgagaatacgcagggcgcgagcttttctgtctcgtcccctccggagttacgatgttctagctttctttccaaggccgtccaagtattgaacaacattgcgacaggcggacggatactgaccgcgactcgaagcacctggcgggccaattcatgacacccggaagccgtgcatggctggaaaagagctaagatgacctcccgcactcccagagtgaagctcgtgctgaagctgcaggaggggagcacgacggtgcaggtgagtttccgccgagctgtccagcgcgggagtcagcgaaaagataacatcaccctcgttctcccaatctcacaacctcatcttttaccactccccaggagnnnnnnnnnngagataacatcatcctcgttctcccaatttaacaacctcatcttttaccactccccaggagccggatcgggaggtcgtgaaaggcatcgtgcacggtgaggcattctcatcccggagaagagcggagttgcaagtactctgccaacccatgcgcatgccagacctcccatccatgcccgtccgcaggctatgaggtggtggaggtggacggattcacctacaagcgccggcgacagcagagcccggttgcggggatcgagaacacgcctcccaatgccacgccggtggccacgccaggccctcccatcccagggcctccgccccccgcacccacccctccaccggcctgcccctccctggccacccagctggcggtgagaaggtacctgaaggagcacaccagccagcttccggaagtcgcagagcctgctgaccgcctcgcggccgtggctgccagcgtgggcgagacggtgctggacacctgcaccgacgaggccgtgaccacggccctgacctccatcctgcagcgcttcctcctccgcatccgcacagaggcggctgcggggcgcctgggctgccaggtctgggaggtgcgggacgatgcggcaccccctgatcacagcgccgagtcgtttgcgccagacctgcaggcccggaaggcggggttgagggcgcgactcacgcgatacgccgatgtgggttggggggtggttggtgtcggatgggactgccgatggggaggagggtatccagggtgggcttcggtgagcccttgttcgggattcatgccctccagctgcttcttatcatggnnnnnnnnnnctgagggcccgactcacgcgatacgccgatgtgggttggtgggtggttggtgtcggatgggactgctgatggggaggagggtatccaggatgggcttaggtgggcccttgctcggggttcatgccctccagctgcttcttatcatggcatcgaaacccgagcatgtgtccgtttcccagagctggggcccggtgctaggcccccaagctccctccagcactcgccagccactcacccactctcacccgctgctgcgcaggaggagaaagaatggcacgcgctgctggagagcgtgcggagcagcagtggcgtcgccggcggcctcatacccgaggagcctgaggcgggccccgccccgccggcgccggagccggagccagaggcggtgggcacactgcgcgcgctgcgcgccgaggtgcacgcgcacatggccctccaggtggagggcctgtgcatgttgactgcggacgtggcgtcgctggtggaaagcgcgggagtccaggcgcgggcggcgcagcacgagttccaccaggagcgcttccgcgccttctcccacgtcgactcgccggcgcgcctgatccaggcgttgacgcagccgcccctgcccctgcaccggctggagggctgatacctgtgtgtcccccttgtttgaccctgacctgcgtgcccaggaggaccacctcgatgcccttgtcgggggcggtcctgcctggtcccgccccttgccccaaatgtgcgacgactgtaactgtattgccccgcatgtactgcttgggggggtcacgctgggcctgttgatcagcctctagagcgctctttgccctctccgaggccccctcctgggccaggccttccccctggccactcgatgcatggtgcagactcgattacatccaatggtgcggtgccctgcccgacacagggcagggcacacgctcgggagaggatgggggtgatcatccccccaacatcccgagtggtaccctcagcgactagctctttcctccctttcttctacatggtcatgccggcgggcatgcccgcggcgctcatgccgccggggggcggggccttcccgcccttgcgcggccgctcggtcatgacggcctgggtggtgagcatgatgcccgcgatggagcaggcgttgatcagccccgaccgcgtgaccttggccgggtccaggatgccggcgtccagcaggtcctccacgcggtcgtgcatggcgttgtagcccacgccaaagtccttgcccagcagccgctggacgatgacctcgccctccacgcccgcgttctgcgcgatgatgcggcagggcgcgcgcagggcctggcccaggatggccgcgccctggcgctcctcggggtgctccagggtggcgacaaagtcgggcaccagctcggagaggtgcagcagcgcggcgccgccgccaggcacgatcccctcctccaccgcggcaaaggtggcgttcttggcgtcctccacgcgcagcttgcggtcctccagctctgcctcagtggcggcgccgaccttgatcaccgccacgccgcccgccagcttggcgatgcgctccgccagcttctgcgagtcgtaggtgctgtccgtctccgccagctcgcgcttgacctgggccacgcgcgccgcaatctcatcgcggttggccgcgtcggcgatcagcgtggtgctcgtcgccgccacggtgagcttgcgcgccgtgcccagctgctccgcggtcacgctctccaccttcatgcccaggtccttggccacaaactccgcaccggtgacgatggcgatgtcctgcagcagggccttgcgccgctcgccgaagccgggcgccttgatggccaccacctggatgacgccgcgcagcttgttcaccaccagcgtggccagggcctcgccggtcacgtcctcggccacgatgaggagggggcgcgacaggcgcgacacctgctccagcagggggatgatgtccttgatggcctccagcttggcgtcggtgaccaggaccagcgcgttgtcaaactggaccagctggcgctcaggcacgttgacgaactggggcgagacgtagccgcggtcgatgcccatgccctcctgcacctccaccgtggtctccatgctggcgctggactcgatggacagcacgccgtcggcgcccaccttgtccagggcctcggcgatcatgtgcccgatgctctcgtcgtttcccgcggagatggccgccacggcgcggatgtcgtccgaccccttgaccggacgcgagcgcctggccagctccgccaccaggtgcgcgcaggccttgtcgatgccgcgcttgatgctcaccgggttggcccccgccgtcacgctctgcaggcccaggtggatcatctcccgcgccaggaccgtggccgtggtggtgccgtccccggcggtgtcgttggtcttccccgccacctccttgatcagctgcgcccccgcgttctccactgggtcctccagctcgatggcgcgcgcgatggacacgccgtcgttgatcacctggggagtgccgtacgactgctccagaaccacattgcgacctgcagaattgtgagtgggggtgttggccaggggggtggtggagctgggctcaggtatgcgaggggtgcatgatgagcgctggagcaaggtgctgtgagaaaggcagtgccatccctcacccctgtcctccacatgcatgagcaaaacctcaagccatacacgactccatgttcccaactctacacgtaccacgagggccgagggtcacggnnnnnnnnnnggtgccatccctcaccccctgtcctcctcatgcatgagcaaaacctcatgccatacacgactccatgttcccaactttacacgtaccacgagggccgagggtcacggccacggcatcggcaatcttgttgatgccgatctgcatcttgcgacgggagtcattgtcgaacaggatgtccttggcctccgcgcgcacgatctgggggcatggaggagggccaatcaggatgcattgcattatgccatctgaaccgacagaatcgtttcgtcctgtggggtctcggcacctccatgcccctcccatgcaccaccccaccctcgcttccagaaagtacctgggcacacctccgacccgccctgggaccccgcacgggcctggtctgggtccgtgttccagtgaatggacgtgccagcatggcactagaggcctgcgatggggtgagtgggtgtggtgggtgggcatgcagtgccgtgggagggggcgggttggtgctgcacatatggcgggtgtcgggcccaccccgcccagccaacctgaatagcggccagcaccatcgagattatatcgcgattctgtatatacacggagtggagaagaggcagggaggcgctgcgctcccggacaagtccccgatcatgcgttcctgtgccgcgcgtgctttcctctcgcacccgtgcatgcgttatcctgaaaatggttctttccccgtggccaatgtagccgagaacatggcccggccagcccatgccccggcggatccacctttggtacccttccgccatgtcttggccttacatcacccttcaagagccaccacgaccctcttgaacatgcacccggcctacgctcccctgcaccccaggcgtcgctgccgctccgccctgcccnnnnnnnnnnaaacatgtacccggcctacgcttccctgcaacccaggcgtcgctgccgctccgccctgcccataaaactacccgcggcccaccagggtggcgctggccacggcgtcgcccggctggactttgagaacgcggtggcccttggtcccggcccggccaagcacccggatgtcgcccagcgccaggcgcaccgacaggccgttctcggtggacaccaggacatcagtgccgtcgccagactccgcctcggccccatccacgctgccgtcgcggtcgatggccaccgccccgccgccctcgccacccaccaccaccgccgccgccagcgcgtcgccggggttcagcttgatggccttcagcccgcgccccacgcggccctgcagccggaagtcggccagcgcgacgcgcttccccaggccccgccgcgtgagcagcaggagccaggggccgggcgtctcctcggcggccgccgcggggccctcctcgtcgtcctcgccctcgtactcctcctcaccgctggaggcctcggcctcctcctcgggcccattggcctcgggttcctcctcggccgccacgccgcagggcagcacgcccatgcccaccaggtgggcgtcgccacgcagcagcattgtctgtgtacaaaaagagaaaagggggggaaatggggtctttgagggtgggtggggttgattgggggggttgttgagggcatggcgtgagtttggaatgcggggggcgggggggggcgctatgcatggtcatcagcggcctgctaagatcgagcgtcagatcggcaggggcccaccttcacgccgcccgccccccggctggagggccggaggagggaggtcctgaagtggatgacgtagccggtgctggcggccaggagaatggagtcggtgtcccccgcggtgcagacaaacctgacgctgtcgccctcgctgaggcccatggccagcttgccgtggcgcgacatgcggccgaagcgcgccagcggcacgcgcttggccaggcccttgctggtcagtaacacgacgtcgtcgttcggcggggggggtccggtgtctgcgtcctcggcactgctactgttgccgcctggaacagccacaggctcgcccggcaaggggagcactgccgccagcgcgccgatgcggggaaacagggacttgatggcggtgccgccggaggggcgggaggcctcgggcacctcataggcgcgcagcgcgtgcatcttccctgcggcggtgaagaggagcaggcggtcgtggtcgttgacggccaccacgtcctccacgctgtcatcatcgcgcaggccggtggtgcgcttgccgcggccgcgcaggcgctggaccgagaaggcgtcggtgcgcatgcgcttgatgtacccgcgccggctgtacacgatgagggagggcgcgttgggggtcacatcctccgtctgcagatcgccgctggagcctggggtccgggagtttagggtgggggggaggtgggatttgggctttgaatcgaagggcgggatggtgtccttttaccatgcctgggcgcacccagggtttctcgacaacaaggccagtggcatatgcatggccacgatcagtttggtcgatgagagaatcatgccgcctatgacggcgggcgccagggcagctgcgcgccccaggtgtcctcggacccagccttttggatcatacagactgcatttccacccaaacccgacccacaaaaccccactcacccgggtcctccgagaccagggccgtgcggcgtgggcggccaaacttctcggcgatctcctccgcctcggccaccaccacgtccagcaccttatcctgactggccagcaaggcctccagctcagcaaccctgagggtggggggttgcttcagacagcatttgaatgtgtacataccccttgttctcagggccctggagcagtcaaaccccctcccaatccccaccccacccccagcacacacacatgcctggccctcaggctggccgcctcctcctccaggttcccgctttccagcgaggtcaggcggcgcagcgccaggcccagcacgccgtctgcctgctcgcggctgagcccatggcgcgccaccagcgccgcggcggcggcggggccgtcggccgcatcgcgcacgctgcgcaccacgccctcgatgtcgcgcagggccagcaggaagccgtccaccaggtgcaggcggcggcgggcacggcccagcgccgcgcgcgcgcgcgccgccaccaccgtcgcccggaagtccagccactcctgcaggaaggcgcgcaggcccagcgtgcggggcatggaccccaccagggccaccatgttgcagctgaaccggccctgcaccgccgtgtgcttgtacagctggttcaccaccagcaccggctcgaagcctgcagtggaggttttggacggtggggtgaggccattttggagggcgtctggtcgtcgcacacgcgcgctccggcagggccagcccaaggcctgcgccaaccaggcctgcatgggatgcaaggcccagaatgcgcagggcacccaggccccacctcccacaaccctacccacctcgcttgacctccacgaccacgcgcatgccgtcgcggtcggactcgtcccgtacgtcagacacgccgatgagcgtgcccgcgtccaccaggcgcgcgatctgctccaccagcgccgccttgttggtctggtacggcagctcctccagcaccaccgcggcgcggccgctgccagcgtgccgagcgccggcgcggcggcctgcagcgggggccttggccgcgtcctcgatccgcagcttggcacgcacggtgaaggtgccgcgccccgtggcatacgtgtcggccatggcgggcgacagcaggatctccccgcctggacgtgggagggagggaggggtttcgagcgtggagagagggctgcacacaagctgggttgaggcaagggtgggcgcgcagggaggaggggtcgaactaatgctgagcgtgactgcactgcacggacannnnnnnnnnaagcgtggagagagggctgcacacaggctgggttgaggcaacggtgggcgcgcagggaggaggggtcgaacgaatgctgagcgtgactgcactgcacggacacggtggtgcagagagagacccacaaaggcgacacggcatttgacagccctcccttcaacacaaatcttccttggcccatcccatccatcccgcccgcctgccttaccccctctcaaccctcagctccccccaaaacaacaagttacccgtggggaagtctggcgcggggatgtggcgcatgagcgcggcggtggagatgcgcgggtttcgggcgagggccctgaggcccgccaccacctcgcgcatgttgtgagaggggatcttggtggcgatgcccaccgcgatgcccgaggagccgttgaccagaaggttgggcagccgcgccggcagcacggtcggctccggcaccgacccgtcgaagtttggcacgaagtccacggtctcggcctccaggtccgcaagcagcgctgcgccggtgtacgcctgcagccggcactcggtgtacctgaagaaaggatggagaggaggggggggggggggggggggtggggggnnnnnnnnnnnnnnnnnnnnnnnnnnnnngttgacaatgagcatggtgggtgggtgggcggactagttattctcaaccaccttgagtcacgcggcggtcactgcgactcggccaagccacttcattgtcccctcaccacatacccacatacgcacacaccctccataaaagcaagcagccacccctttctgatcccccaggtacctcatggccgcgggggggtcgtcgtccagcgacccaaagttgccgtgcccgtctacgagcggggactgcatggcaaagggctgcgacatgcgcaccagcgcatcatacaccgcggtgtcgccgtgcgggtggaacttgcccagcacctcgcccaccacacgcgcgcacttgcggaagggcttgccctgcgtcatgcccagctcgtgcatggcaaacaggatgcggcggtgcaccggcttgaggccgtcgcgcacgtcgggcaaggcgcgccccacgatcacagacatggcgtactgtgtgtgtgggtgggcgcgggatgatggtggtgatgggaggggccagtgggccgaggcgggggagtggatggggaaatcatcaggcccccgccaccagggaatcagcggggggtcgtggctcctcccgggtgggaacctgcactgctcctttcacaacctccaggcacagtggcacagccgcgccgcaccgagaggtaggacttttcggcctcggcgaccagctccgtctcgatgatgcggttggcgatggggggctcaggggcggcggccccattgcgcggcgaggctgaggtggtaaaggaggggcgctggggacaacgctgccgatccagggggtggtggccctggcgattggtgatgggggaggggagaagatgtcgtgggaatgccagtggagaaaagcatcaatgcttgcgcaaagtgttggacaacttctgtccatggtatctccatgctgnnnnnnnnnnatgggaatgccagtggagaaaagtattaatgcttgcacaagatgttgtacaacttctgtccatggtatctccatgctgctgcagaggaacagtgatttcagctgatgcccctgccccatccctttatctttgccagcacgggtacaaagagctcacatgtggctgcagggaggaagtgggcacctgaaggggcaccctcgtgctccacggcagggatccgctgaggaagctgcgtccgctcaacatggagcttcccacccttcgggccgcgtcgaggcgcatgtctcccgtgttcattccttgcccataccccagggcgcccggggtgcgtgtgagtgtgaagggaatgccagtgccgatggacaaaaggcgcaggaatcacgagatattagacataatctaatcttcgtattgtttccacccagtgcgtgggaataggtcgcgctggctgcgcttgggaattcggtctcgcagtctggattgcccagcatgccatgcatgctttagtccctgtggccatggtccccatcgcgtccagctacaaggacacaacccttcccttatcgtacttggtattatgttgttataaaaaataaccatttgacttccttcccctcgttttgnnnnnnnnnntcgtccagttaccaggccacaacccttcccttatcgtacttggtactttgttgttataagactaaccatttgacttccttcccctcgttttgccgtcctgttgcctcgcaagcacctcggaagtgatctgcacggcctgtctccccttcagctttctcatcaacgacacccctgtttcgccgattgggtgtnnnnnnnnnnttcggaagtgatctgcacggcctttctccccttgagcttactcattaacgacacccctgtttcgccgattgggtgtcctggctaacaacgcatgcactggatacagaggcgtgttgcgtcgcgcattgcggcccatcctccgtgccggtagcctgcaggggcctgccgcctgggccgcggccgtgatgaaccctcagacggccctgaggggtgccatgcaacgaggggagcccatcatgttccgcatcaccatagacaggctgagggaggacaggcgccagaccaaccacgccaagagccagctggccctcgccttctgccaggtgcttggttgtgtaagatcgcagctcaggcgctgatgacacccagcaatgcctgaatggctagccactcggggcttctgcctggaatccgcctgttgtgcttcagtgcactgcaaaccctcccccactgcctctctcgcaaggaggaagacagcgagtggccgccagctcacaaacaagaatccatgccccccaccgccccacaggccccccccgcccaggcccacgcctttgcactggccctggtggccgagtgctgcgccgtgggcgactgggatgagtccatgatcatgtgcgcccagtgggccctggagacgctgggcaagcgcgccggcgccgacggggacgcggatggcgagggggtcggcgaggcgcgcgagtcgctgcggggcgaggcgctgcgctccttcctgcgctgctgcgcggacggccagctgaagctggcgctgcgcgtgggcacgctgttccgcctggatctccaggcggagatgaccgcggaggagcgggggggcatggcgcgccggctggccgaggcctgcgccgccaacgccgccgcggccggcgcggtggcgctgctgcgccgctggccctgcctacagctgggcgaggcggtgcctggtgtgttgctgccgcgcctggtgtcccagggcctctcgtccctggccatttcctgggcggaggagctggacggcgacgtgcaggttgttagttttttggggggggtaatgagtgggaaaggaggacatgggcgcggggcaagcgacggcggtcggccatgctccggcccctttactgttggtactccccatgggcccnnnnnnnnnncttttggggggggggaaatgagtggggaaggaggacttgggcgcggggcaggcgacggcggtcggccatgctctggccctttactgttggtactccccatgggcccaggagcacgcccttccttgccccagtgatgccccttcccgacccccctcccacctggccagaccctggtgctgcatgcgtgcattgcgcgcaaccacctgcgctccgcccgggccctggtcagcgcgtgccgcatgggcgcggcggcccaggcgacgctggaggaggcgctggtggcacgcctgctggcctgcggcgcctggggcccggccctgcagcgcacgggcggcgacgccgggctgcagcgccgcgtgctggacgccatggtgctgaccggcgaggccgagctggcgcgggagaccgcggcggggctgggcctggcgctggaggacgacgcggcgctgcgcg

SEQ ID NO: 37901 - DNA, 73 bp, Chlorella protothecoides
gcctcggcggctgccggctggcccagctggtggacgtacagccgcagggcctcgtggtgcctgggagcccaaa

SEQ ID NO: 37902 - DNA, 98 bp, Chlorella protothecoides
caggcaggcctgtgaatgtggtcatgagtggcccctgctagattacacccgagtgcggcagccgattccagcaaggtcttgcgtcctccttgccctgc

SEQ ID NO: 37903 - DNA, 80 bp, Chlorella protothecoides
aggaggaaggtgcgaggaaggtgccatgagcctggtcatggctcgccccagttcctgccggtcagtctccccatggtcca

SEQ ID NO: 37904 - DNA, 72 bp, Chlorella protothecoides
atatgcattgtacggcttgcaagctctccaaccccccctccgccctggtgcaaacgagggtccctctgggca

SEQ ID NO: 37905 - DNA, 75 bp, Chlorella protothecoides
gccagtctcctagtatccaaccactgccgcgtcatcagcaactgaatcctcacaacaatgtccgcgggcgcccca

SEQ ID NO: 37906 - DNA, 187 bp, Chlorella protothecoides
ccctgtggttgggggtctgagatgaccgaggagtggggaaggggggggacgaggagcccccaccgagaccctgcaggttgccagaaatcagcagaggaacacaacaccaggaaggcgtggccatgagcgctgtcatgtaaagctcaaggctggatcatgtctggaagggcggcaccccagaggccat

SEQ ID NO: 37907 - DNA, 85 bp, Chlorella protothecoides
cgccgatccctgatcccatgtccatgaacacgcgctccccatctcgaggctccacagcacgcccttccactccccccttccttcc

SEQ ID NO: 37908 - DNA, 80 bp, Chlorella protothecoides
aggagcccatcacgttgaacgccttgttgacggggttggccgacagcccgcccacagacccgaggtggttcttggctacg

SEQ ID NO: 37909 - DNA, 61 bp, Chlorella protothecoides
ttccgcgatggcggggtatggcatggggggttatgtaggcaacacccatgacaaggcccgc

SEQ ID NO: 37910 - DNA, 126 bp, Chlorella protothecoides
cctacattcccccttgtcaacccccatcccctcttcacacacacccatattcccctacccctcagcctcggaccgcgtggatgccctgcacgtgttggggcacccctccagcgtggcggtggaggc

SEQ ID NO: 37911 - DNA, 63 bp, Chlorella protothecoides
ccctcatcccgttgcagtattcagacgtgtgctcagcctgatcagagagcagcagcgacgccg

SEQ ID NO: 37912 - DNA, 97 bp, Chlorella protothecoides
cggccaccagtgcctggcacgagggggcggcgcaggttcccagagtcgtcaggctcacggcgggggcatgcagccgtgtgaactcgatggtggcggt

SEQ ID NO: 37913 - DNA, 70 bp, Chlorella protothecoides
caagtccctgtccgccctgggtgggttgagaaggtggtgcgggagtggggccgggtggagacggtgcagg

SEQ ID NO: 37914 - DNA, 108 bp, Chlorella protothecoides
gtgtgggttgggggcccgtgacgaaatgtgactgggttctgcatgggctaggtattgagggggcaggcatcggggagttgtgccccctggacacctgggtggggccct

SEQ ID NO: 37915 - DNA, 61 bp, Chlorella protothecoides
tgggtgctaggcttcagcgagagaggcggggcttaagtcccctgatggaaccctctttccc

SEQ ID NO: 37916 - DNA, 12921 bp, Chlorella protothecoides
  modified_base (1050)..(1059): a, c, t, g, unknown or other
  modified_base (1146)..(1155): a, c, t, g, unknown or other
  modified_base (1241)..(1250): a, c, t, g, unknown or other
  modified_base (2042)..(2051): a, c, t, g, unknown or other
  modified_base (3436)..(3445): a, c, t, g, unknown or other
  modified_base (6278)..(6287): a, c, t, g, unknown or other
  modified_base (6507)..(6516): a, c, t, g, unknown or other
  modified_base (7700)..(7709): a, c, t, g, unknown or other
  modified_base (8138)..(8147): a, c, t, g, unknown or other
  modified_base (8274)..(8283): a, c, t, g, unknown or other
  modified_base (8439)..(8448): a, c, t, g, unknown or other
  modified_base (8513)..(8522): a, c, t, g, unknown or other
  modified_base (9528)..(9537): a, c, t, g, unknown or other
  modified_base (9910)..(9919): a, c, t, g, unknown or other
  modified_base (10340)..(10349): a, c, t, g, unknown or other
  modified_base (11270)..(11279): a, c, t, g, unknown or other
  modified_base (11696)..(11705): a, c, t, g, unknown or other
  modified_base (12075)..(12084): a, c, t, g, unknown or other
gcagacccagccccgtgggccgcggggggccggggaagtgacggcgcggaacgtgggccgaccgggcaccccgcccgcccagcgccggccgccgctcgacgaggagatcgcggccatcgagcgggagctggcagagtaccgcctgagccgctcgtggggcggccgcgggtcgggcacgggtggcgacgtccgcggcgggagtctcctgccgggaggaacggcgcatgcgcacggggcgggctggcccagcctggcggagtcccctgcccaaggtgccggccgtggcgaggaggcggcgccgcgcgacgctgccgcgaccagggcgccgagcgacgcggtggccgcctcggcagacttcttcgccggagacctggcggcatggaaggccccgccggcgcctttgaccaccccgcgccgcaagtcgctgcccctcatcgacctctccacgcccggtgagggcctcggaagaggggttgggggggacgacgtcgagcttggggcctggggctcagcgccagggtgcagccccgcgccgtgtggcgagacggctcccggcaagactctcgcgccctcacgccctgcccctcgccccatgctccacgtacccacaccaccgccgcctccccatgcagacgctccgcctgcggccgctgtccagtggcagcaaaaccccctggccgtccccagccccaagatcgacctggcgagcgccagacctgcccccggcccgccctcggcacgggccccatccgggaagccggcgccctccccgcgccagcccctcgcgccgcagcagccaaacgccgccgaccccgcgccggcggcgcggcagagcctggccaccgccgcctggaccgccgcgttgcgcaccgccagcggctccacggactggctcaacgcagccttcgagccggacatcgaccagctgcacggccccgagtcggcacgcggcggccgagggggggcagtgacgctgcccagcccctacggcgcagaggggccgctgccggcgctgcccagcccgcgcggcgcgagccagccgctgccgannnnnnnnnnagcactgacgctgcccagcccctatggcgcagaggggccgctgccggcgctgcccggcccgcgcggcgcgagccagccgctgccgannnnnnnnnncccacgctccgcctgacccatgacgagccgtgaccctgacctttctcattgccccagaccacgctcggggcggcagaatgcaaccnnnnnnnnnnccaacctgctggagctggccgcgctggcgctgcccgatctgtagggaggaggaacgcggcgcctgcggcgacacccccgcacgctccgcctgacccatgacgacccgtgaccctgaccttcctcattgcccaagaccacgctcggggcggcagaatgcaacccctgatctccccgcccaggggcacgctgcctccctgctcgcccttttgacccaccccccaacccgccctgtgactgagcgcttgaactgcggtgtaagcaacgagccctggcatggcacacctgttgcttggactcacgcagcaattgagggtcgcggaaccttgaaagcagcgggccccgacgagggcgggcaggagtcatgccctgcttgcgcggcatcagtcatacaactcgaatggtacaagagctggggaaataggggccgcacgtgtcatccctgttaccgtccactgaacccctttccatccttcaccaccgagggtggggtggggccgggggtccgcccccgctccaagcatggcgcagcccggctcctcgccgacccctgtggccctcgccctcctcgggtctctccccccgcgccggggcctgctgtgcgcgctgggcctggcgcatggcctcgcgctcctcgaacgtcggcaggcggtgcggcgggctgggcggtcggaatcgggcggcgtgcggctcgtgcgccggcgggggcgcgccctccggcgtgccgatggggtatgccatgcctgcgggtgggggcccatgcgcggcccagccgggctctgggcgggaggagnnnnnnnnnntggcgtgccgatggggtacgccatgcccgcgggtgggggcccatgtgcggcccagccgggctctgggcgggaggagtcggggcggttcaggtcggggcggctggactcggggcgggcgggggtgccccaccctggacccaccgctggccaaccgagggcacgagatgtcggcggcggcggggctcggccccagggctcgggctcgcggaccgagggcgggcccagccccagcgggaaggcgggcgccgccgagggctggaaggaccagcgcgagggccggggcggcgcagtcgagcgcggcgacagcggctgcgtggccaaacctgcccccgccgccaccgacatctcgccctcttcgcgctccgcagccgcacgcttggcggcctcctcctccttcagcgcctgacgcggcacgggtgggtcgggggatcgactcagtgcacgtggcttggaatgcgagggcccgggccgtggtaccagcctggagggtgggggtccacactgcactgcccaaccacccagaggggggtgtcccaagggtgcccccgtcattcttccggacaaacccattcggtgaaccagccggtgtggaactcctgcattcacaccactccgcaccttcttcaggtccagcaccagctggtgcttggcggcggtgagggcctccagccgctcggcggcggcggcggcctccgcctccgcggccgcggccccggcctcggcctgggccaggtcggcgctgacctcgtcaatagaggcctgccacgcccgccgcgcctcctccgcctccgcatccctggtccgctgcgcctcctcgtgctgcgccctgcgctccaggtcctgtgcatgcgcgagcgcgaccccggagtcgggcgaggggtcgtctggctcgtctgctgtcggcggggcctgggcctcctccacgcccggcagggccccagcttcggtcatgactgcatattgggaggcttcctgggccgcctcctggtcgacaatcggtcgcacgcctttctggaagtaggccaggctcagaagtccttcctggtcaggtagcagaccctcttcagcggccacccgcacctgcgccaggcgggaggcggccaggaccttgtacaagacggctttggagatttgagaccctgcatcggcttcgaaggtgcgtgcgggaagggggaggtgaccacgggcggcagcgaggtcgtcatagaagaacgagcccatgggggtcccggagtttgggagccgccgagtaccgcgagtctcagcctggattttatggagtcatagctaacgtggatggttgtaggagggatgtgtaatgtcataccagtcctcgaaagagtacttcaagacgaaagctgtcgagcccgggcgcgagcgctctnnnnnnnnnncagttgtaggagggatgtataatgtcgtaccagtcctcgaaagagtacttcaagacaaaagctgtcgagcccgggcgcgagcgctctggaggccaaatccctgtcatcctgttctccccagccggtctcaggcacagcccttcagcgctgagggggatatacgaaggtaatcttacaccagtacgctttcctggtccatatccacaaggcattcctggaacagctcctccgtcgcggggtccaggggcgtcaggaatcggctgcgctggagtaccctggtcggtggaagctggtgcggtcggagcacgtgcctcgaggccatacctgcaccctctgcattgtcactgagcagatcacagtcggggacggcttgacctcctcccagcaggggtggcagcagcagtggggaggctgcgcccacgctcggtcggcgctgccggctgggctgcaggcccagctcgagccaggcggggagcaaggggctgggctggccatccgtcgccctgcggcatggggaggatggtatgaaatggattggatcggtggtgtcagggggaagtgggaatgcatggcgacgcctttcccagggcaagaagggacaggtgatgtgttgtgagccacggcggagggcccaccatccctgaggccacacgagaggatgcagcggtgagtctctaccaggcaagcacacgtgcatcacctctgcaacagaaatgccctgtggacccccgccgactcacccgccctgcgccccccgcggtaccgcccacagatcggcccagagcagcgtgcccgaggcgggcgcggagagcacgaccccggtgcagcgctgcgccgtgcccacgagcgcgtcgccccaccccaccgccacatccacgtccccgccctccagcgcgcgcacgtgcgcgccgtcctttccaaaaacgcgcgtcgccgcgcgcaggcggcgcacgcgcgccctcaggtctccggcgcggacaccgcaccgggcgacgtcagtggcggtggcgccggggtcaaggcccaacgtgcccagcgcggcggcgaggagcacgcgggggctgtcgtccagggctatcctgccccccagcgctgggttcaggaggtcaacccagtcgcgcggtggctggaggccctttctgcaaatgggtgagggcgaggggggagggggggcaggatggaggctgggagatgtaggtatccaggaggaaggctgctcacgatacacaaagctcctgtggtctcttttgggtggctaccacactcttggaaaaaggacgacccataggcgagcggccctccctactgacgcttcccccccggccccatgggaaaccacgcatgcgatgcagcgccccgcgtaaccctaccttcggagccgaggcccgtggctggccatgagcagggtcccccaagagctggggcaggcatacacctcgccgtacggcgactgcagccctgcatcgtcccgagtgaccaatcggcgccagtctgcagacagcaggctctgcaattgtgtgtcgatggtggtgatagagaacagcccgccgcacggtaagactaagaattgatgctccgtgcatggcactgctgccgccttcccccgcccagggttctccaagggactcacccaccaacggtggcggcgtgcggctgggattggttgcagcaagccccgagcgatggcgggctggagccaggtgtcaggcagaccgacgcagtccacattcgtcgacacctttcggcccttggcctgcgtgccggcgagctcgtcccacacctccttgtagcccttcatgggcttcagcgccaccacgcccatcccctccatggctgcgctgaagtcagagacccagtcccccgggacgagggtctgcggggccaaaacccgcagtaccatctgtggggggtccgggggtgggtggcctcaggggctgcagggggtagtaggacgacagaggttgggactggcgggggaggcaggctgaggagtgttgtacacactggggatgccctggctagggcggcactggtttctcctggagacgaggactactccttgaatacatttcgcaagctctcctggcacgcacaccttgtactcccgaagagccagactgctggaagggcccgcaagggctgggggaggcgggatcatggacgctgcacctgcagcgccacccatgcacaggagggctcgtcgggacgtggcagccgtgcatggtcgcgaaattacttccccttgctgattaggtccacgggaaagtcgtgctgagcatgtgcgaggggtcgccctcctgcatggctgttgtgccgctgggctggtgaggcgaggtgtcgttgggcacgaggttcccatgcccattccctaggaatccgatcaggagtgcatcgtgtggctctgaatgtcagtcgggtgggacagcacgagtgtgtctaccgtgcagcctgtcgcgagcgcgattggagatcttgcccaatgtgttggggccgccgttcacgagaatcctgacctcggtccatctccccacattcgaaccgtccacccagcacctttgatcgatgcctcacaaactattactttttcaccactactgtacgttacaatatgagtcagaggtgtgcgtagagcatgtggagagcagtctttgaggtgtcaagcaccagtgaaagcaatgcaatggagggtcagatgcaccagaccagggcacagtctcagcgcccttggctgctccgtagaggtaagggtgcggtcagtcaggagccttgtttatcggggtgggccagcatggtcattgagctaggaggccctgtcaaagattcactccgcggnnnnnnnnnnacccgcgaaagtactggcgacatccaccaggctggcaatcacgctcttgcccggggtcttcgtctccttggcaatatcctgccatgagatggaagtggcacggtggtatggtgaggagtgctggatgatctgtgcggctgatgaacaatgcagggcaaggcggcatgaatcatgccgggggcattcgtctaggcaccatctggagcacagcactagaaannnnnnnnnnccagagcaaggcggcatggatcatgccgggggcattcgtttaggcaccatctggagcacagcactagaaagtccaggcgggaagccccagacttgaaaatcagggccctagcacctctcaccttgggagtcgacttcttaagggaggcaggcttggcttcaggctttgtagcacttgctcctttcttcgtggccgtggttttgggtccggtcttggaagcggttgtcgccttcttcgccgctgcaggtttgcgggctgctgccttcttctttgctgcggctacagggggcttcttgacgggtgcaatcgcctcagatggcggagcgggagcgaccggcttcgctgctggcttctttgcgctggcagcccgcttcgtatgcgtcttggtgacggggatcggcttggcggcagcactggtcttagcgcgcttggcggcaggcttggctgctggcgctgccttggtggcggcagccttcctcttggaaggggtcctggtgatcctcgcagcactcttggcggcgacgggcttcacctccagaggggccgggtcagcaagtgttgggactggcttggtctgcaggggacatgattgggtgttgaaggggctaggtcggcgacgaaggtgaggaaatggtcgttgacctgttcatatcacgtggcgccaatccctgccttggtggggcaccttggagggggcgggcttggtgggagccttgcgcgcggtcttggctgctgtcttgcccgtgactgcagcaggcgccttcttgagggcgactgtgctggttttgtggagctttcccttgcccgcaggcttggctgtggcagatctcttggctgccatccctcccgtatccgagccaaaggtcgacgattcctctcggacttacgttgaatgcagctccctgggtaattacgataacttcgaggtcgattaatggcaccctgggtttctataggttggccgacacgatgtgtaccatgcagctgtcgggtgctggcagcggatccaaaatagtcgcggatccggggtcgacacttgccgtgcccttcacgactgcggagagggagcccagcacgagttgcaggcgataaacgggacgattgcctaattctgagcataccaacatcatgtggcattcagatttgtattagatagcttgttttgcgggggcctcaaagtgccnnnnnnnnnngtaaacgggacgattgcccaattcttagcataccaacatcatgtggcaattcgatttgtgttaggtagcttgttttgcgggggcctcaaagtgcccacggggtggcacggcttgacaaaatggatggtgacgtccatgcgctgctcaagtctcacggtacggtcagtgcaagtacattcgctcaatgcatgcatcatgattgctccaactccagaatgtatcatgctccaatcgtacctagcaggcgaccggttcctggcgatgttcgacgacgccgaggagcggcctgccatcgccgaccaggaggcaggatcgccgagtagtgagcaggacactccctccaccagtgaatcagagtctggagaggacgaagcgccgcagcgatggaccggcgcagcggacaaggttctcccaacaccacgccagccnnnnnnnnnnagattgctccaactcctgaatgtatcatgctccaaccgtacctagcaggcgaccggtttctggcgatgttcgacgacgctgaggagcggcctgccgtcgccgaccaggaggcaggatcgccgagtannnnnnnnnngattttgtcgttcctttgctgcatggcacttccatcgggcagggccgcgctttttgtggggaaaagccggggcagttgggggacacatggcgcgcggggccctccccacgtgccgtggctccccaacccccgcagcatggctttctcgtgcctgtnnnnnnnnnngcaggtcaaggccgccccccagcagcccttcatggaggacagggagcggtacaaggcagagcgcnnnnnnnnnnccaggtcaaggccgccccccagcggcccttcgtagaggacagggagcggtacaaggcagagcgcaaggccttcatgtctgggaggatcgggggtccgcgaaataccccacagccgggcacccagcgcaggaagcctggcgccgaatcagccgtggacccacgcagcagggccgagtttgcccagattcagcgtgacgtcctcgagctgggtgggtggaccatggcgcggtggagggctggtacctgccgcttgggaccagaattttcgtcattcctttgctgcatggcacttctatcgggcagggccgcggtttttgttgggaaaagccggggcagttgggggagacatggcgcgcggggccctccccacgtgccatggctccccgacccccgcagcatggctttctcgtgcctgtggcaagtcctttgcctggcctccccctgcggcccttcctgcacagcgacgaaagtgcgagaccatagtacagccggatcacggagcggagccgccgcctgcatcccatatgggatctggatcggcgagctccccactcccgcccccacgtcttggttgcctccagtgctcgtcacatcctcatcagcttccacccagcttgaactttgacctacaaaatacctgcactgcgggctgcagccctccccacacgatgcacatgcatcccttgcctcacctgtccacctctgccacccccaacatgtctgtcgaacaggtgccactgggctggacaagaaggcacgcaagcagtatgaagctgtttcgctcgtccgcctgggtgccaaggcagaaaagggtccacggataccagccagcatcggcattggtgagggaggacttctgctttgccagggctaggctgggcggggagttgtgccttcaccaggccggggaccagcaggccgcgccctgtcatccaccatgagctccggggggcctcatcaggcaggcccccccccacccaccctgcccaggcatggcaagaaagcnnnnnnnnnngggccggggaccaacaggccgcgccctgtcatctaccatgagctccagggggcctcatcaggcagcccccccacctacccaccctgcccaggcatggcaagaaagcgagcgcagcgggaggctcgggccaccgaggaggccatcgccgccggcatgctgagcgtccggagcctggcaaagaaacggcggcgtgagtccagcgcagcaagaccacgggaccagggcctgcaggaggacggcggcagcttcagggcgggtgtcatgcgcgtgagcaggcccccgcccccgagtgccaagagaggcgggaggcggtgacgccgagacgggcgcatgtcattgtagagggcgtagggagggtgtgattgctttggtnnnnnnnnnngggcggcaggcggtgacgccgagacgggcgcacatcattgtacagggcgtagggagggtgtgattgctttggtatgccagaccctccacatccccgcgaggacgctgcagcaaagctcttgaccccagaccaagcggttccctcggtgagacaacatgtcagtcatgggggaggactgcatgaagctctggcgggctggtgcatgcgcccaagccggaccatgaccgttttgtgtcttctcagtgaacgctccctacccacatgcagattgctgtgtgaggagcagacttgacaattcattgcgtgacaaggaattcggcctctcattactattggcaggcatgaacagtgacctgattccgatgttatatggcttgtagaccccttcatgattttcttcatagctttcgagtgccaccgnnnnnnnnnnggctgtgtgaggacttgacaattctttgcgtgacaaggtattcggcctcttattactattggcaggcatgaagagtgacctgatcccgatgttgtagggcttgtagacccctgcaagattttcttcatagctttcgagtgccaccgtcagcgtcctgccccaccgcgatgacggggattctgcctcgggaccccatgcagtgaaaaaacgccaagggcgcttccatgcgaggctcagcagacccttctcccagtcgaactcagcacgagtagcctgccaccgcctggccccgggttttctgttgatcaggtgaaaccctcgatacacgcttttgacccccgatacctgccgggctccggcccctgtcctccgcgcaccctcgtcatgctccgtaggccccatacatagacagcaggggcgctgcgcatggagatctcgggcccacgcctggtcggcgactgggaggttggtgctcacgtcggctctggctccttcgccatagtgtggcgaggccggcaccggctgacgggccaggatgctgccataaaggagatcaacctctccagactgaacgccaaattgcgttccagcctggagagcgaggtcaccatcctccggcgaataaagcacgcaaacatcgtccggctcttggacgtcatagaggtgggaggggtttaggggctcggggccagaagctgtttgtcgtctcgcatgcctgatttgaggctcctgccggagctgggctctgactgtgccgggagtgaaagccgggcggtcggtggggtttacctcagcatggccaacccaggggcttggaccaacccgggcatgacggctgcctcacggccctttccttaagcctgcatgaggcccaacccctcacccccccggatccccacctccaagcagactcgcagccgnnnnnnnnnngccgacccgggcatgacggctgccccgcgcccctttccttgagctcccatgaggcccagcccctcaccccccccgatccccacctccaagcagactcgcagccggctgtatctggtgatggagttttgcgccggcggtgacctgtcccagttcctgcgccacggcagggtgttgccggaggcgacggcgcgccacttcctccgccagctggcggcggggctgcgggagatgtgggcgcaccacctcgtccatgtgagggcgaggcccgggtgggggtgcttggatggctccaggtgttgccattggcgtgtgggctgtgcatgaagggggccgccccggccagaatccgttcggtgtggatgctgccaccccacagcccgtgatggcaagtggggcagcctcgtgagctggctccannnnnnnnnntgatcggcgtggatgctgccaccccacagcccgtgatgacaagtggggcagcctcgtgagctggctccactccctccccaaccctctcttcgccccgccgctgcagcgtgatctcaagccccagaacctgctgctctcccgctcctccccggaggccgatctccgcatcgccgactttgggtttgcgcgcaacctgcagccccaggtggggatggatggaagaggggacaggatgaaactggagggaaggaatgagtgtgtgatcggggcatgcaagcaatgcgcctgcgcctcgatgttgccatcagtctgcatgcccatgcactggcatccgcgagtatgggggtgttgtgattggcatctccagctnnnnnnnnnngacaggatgaaactggaggggaggaacaagtgtgtgaccggggcatggaagcaatgcgcttgcgcctcgacgttgccatcattatgcatgcccatgcactgtggcatccacgagcatgggggtgttgtgattggcatctccagctgagtcctcctccacctctcatcaacaccctcctacccatccccacagggcctggcggagactctgtgcgggtcccctctctacatggcgcccgagatcctgggttcccacaagtacgacgccaaggcggacctgtggagcgtgggggccatcctgtttgagatggtgggcgggcgcccgcccttcaccggcgccaaccagctgcagctgctgcgcagcatccagcgcgcgcccgcgcggctaccggagggcgccgctgccgcgctgtcggcgccctgccgcgcgctgatcgccgcgctgctgcgccccaaccccgtggagcgcatctccttcgaggagttcttccgccaccccttcctgtcgctcgcgcctctgggggcccccggcgcgcgcgacccagggccccccccctccacctgggccgccaccaccagccgcgcggacttcgcctccacgccgccctacgtgctgcactccgggatcgcggggcgcggggcccagcccatgccccgctctcgctccgccgccggtttcgggcagcaggttgtggggttcgatggccccggcctgacggcgccggggacgaacgcagccgccgtgcacgccgcggtgccgctgggcgcgctgagccacgcgctgcgctcgcgcgcctcgctggacgccgcacgtgagggggctgtcgtcgcggcgcgc

SEQ ID NO: 37917 - DNA, 116 bp, Chlorella protothecoides
ggaaatcttgtgcaggacagcaggcgacgacgacacaggagcctacatcccaaccaaggcccctccacatctcctaagcagctcagaaaatcctcacagcctcgcactctccccga

SEQ ID NO: 37918 - DNA, 72 bp, Chlorella protothecoides
gaagaaccccctcccaccaaaggtaccctgggcctccaaatccctcgcaggaccagcctggcgccggaggcg

SEQ ID NO: 37919 - DNA, 101 bp, Chlorella protothecoides
aggggcgatctgagctccaagccaggctgctcggagagcaccatccagcaacatgccccaagatttggcccccccagagcgccatgtggggaagcagaggc

SEQ ID NO: 37920 - DNA, 387 bp, Chlorella protothecoides
  modified_base (119)..(333): a, c, t, g, unknown or other
accacgatttcccaccaggtagaaaaatggacagtgaccgctttcccgaccgcgttctcgcccacacagccccagaaacaaccagccaccccctctttcccctgcccacctgtgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgaccattcgtcgtgctcagcacggcagcggcctgggcacagcgctcccatg

SEQ ID NO: 37921 - DNA, 76 bp, Chlorella protothecoides
ccccacctctgggagcgggagggcaggtgtatgggggaggagggggggatgttctcctcaggacgtttgaatgagg

SEQ ID NO: 37922 - DNA, 61 bp, Chlorella protothecoides
aggccgccgggatctggacccagatcgagtgatgtacggcctcctcgccgcaaatgtgggg

SEQ ID NO: 37923 - DNA, 106 bp, Chlorella protothecoides
tgacatgcccgagacccagggcaggccgtgtgcgcaggtacttgtgttcataaaccaccccggggcccccgtacgtacctccatgctccacatggaagtcatagag

SEQ ID NO: 37924 - DNA, 67 bp, Chlorella protothecoides
gggcacaatgggcgttggggcgggcacaataggcgcgggggcgggcacaatgggcgttggggcgggc

SEQ ID NO: 37925 - DNA, 83 bp, Chlorella protothecoides
gcttgctgatctccacgaagcgcccgccagtattcaaggtcgccagggacccggccaccatgccggaggaggtgaggctgttg

SEQ ID NO: 37926 - DNA, 79 bp, Chlorella protothecoides
ctatggtggggacgatgggtagtgcggagggatttgagctcgatcaagaggtccagcgcgcgcgattcggatctcacac

SEQ ID NO: 37927 - DNA, 154 bp, Chlorella protothecoides
ttacatgtcaccaaaggtggaagggtgtccgggagagggtagagagcgcgccaactgtcaacagcgaggggcaatggtagggtggcgatcgagccagactcttccacgcgtgcattgcaggccaccccactactcctcggcaatggggttgttg

SEQ ID NO: 37928 - DNA, 61 bp, Chlorella protothecoides
cctccccaccactcacagccatctctgccggccctgggccaccccaacaaaatcaaagacc

SEQ ID NO: 37929 - DNA, 61 bp, Chlorella protothecoides
ggtgcatcatgtagtggaccggctggggggggcgcccccggacgcggagtgttgcagcaga

SEQ ID NO: 37930 - DNA, 61 bp, Chlorella protothecoides
aacagccagtctgtctacgaacaggcatcgtcgaggttaattttgtatgatgcgcagatga

SEQ ID NO: 37931 - DNA, 1296 bp, Chlorella protothecoides
  modified_base (851)..(860): a, c, t, g, unknown or other
  modified_base (1112)..(1153): a, c, t, g, unknown or other
ggcggcgggccgacgtggcgccgccatcccggccatcacgctgctgtcggtggcggcggccaccgccgcgccgcgcgcgctgcgcgcgctggtgcacccgggggaggtcctggccggcctactcatgcagatcttcttcgccgctgtcggcgccagcggcgacgtggcggctgtggcggccgccggcccggccctgctcgcctggtccgcagtcagcgtcgccgcgcatgtggcgggggtcctgctgctggagcgcaccgcggggttcacccgcaaggagacggtgctggctagcaacgccaatgtgggcgggcccaccactgctgccgccatggccgcggccaagggctggccctccgcagtgctgccggcgctgctggtgggcatcttcggctatgccattgccaccttcattggtctgggcatggtggtggtgtacgcccgcatgtgagccccagccggcgattgtttaagaggaagggagggtccatcgggaagggcaggctgacgacgcccatcccccctcctcacccaaccccgccacaagactgtcgtgctaccttgaagtaagacgggcctggagatactaaatacagatcagtgcagcacgcgcagtcaggtatggagagtagagtgcgggaagagcggagcaggagcgagcagttctgaccctgtgggcgacatgttgagttcccatgcgaggcagtgctttcaaggcgggtgcacgtcgggtcaaggccccggggggggcaggcgtaggtttggctgccccctgaacgtccatcccctgacccgggaccacggcgggggccggcggccgccctccacaaagtgcgcagctcgcggggcgnnnnnnnnnngtcaaggcgggtgcacgtcgggtcaaggctccggggtgggcaggcgtacgttcggctgccccctgaacgtccatcccctgaccgggaccacggcgggggccggcggccaccctccacaaagtgcgcagctcgcggggcgcgggccgtgcgtcaggccacggcacggccgtcgccgtgctcggcggcccagtccgacatggccagccgccaggcggcaaaggactcctgccacgcggcgtactggccctgccnnnnnnnnnnnnnnnnnnnnnnnnnnnnnnnnnnnnnnnnnngcgcccgcgcgcgggggctgccctgcgtcgcggccgggtccgagcccgcccctgcggccccgtgcgacggcggactgcccccgctcgccgctccaggcacgggcgtcgagggccccgcgggtgccggggcgtcctcgccgccg

SEQ ID NO: 37932 - DNA, 102 bp, Chlorella protothecoides
tgggcgtgcaaagctggggctttctgggtggggggttccgaggccctgggttggatgtagggtgtctcaggccagctctcccggaggggcccgcgtccctcc

SEQ ID NO: 37933 - DNA, 61 bp, Chlorella protothecoides
cggaccccgggcgggggccagccgcgcatcgatgcgcggcgtgcggggcgggggggtgacc

SEQ ID NO: 37934 - DNA, 61 bp, Chlorella protothecoides
accaacacgctggactggcagtcgggctccacggacgagatggggtgaggggcggaggcca

SEQ ID NO: 37935 - DNA, 66 bp, Chlorella protothecoides
agaggaagggcgacgcgcctgttgtcgacttgcccggcgatggcgcgcctcggcagccgcccactc

SEQ ID NO: 37936 - DNA, 66 bp, Chlorella protothecoides
catcagctccagcatccggctgctcttcctccccgccatcttcttcggtggtgagctgggcgtgca

SEQ ID NO: 37937 - DNA, 61 bp, Chlorella protothecoides
cgtgccctccaggaaacattccaatccatccctcctccatgcactgctctatgatcactcc

SEQ ID NO: 37938 - DNA, 65 bp, Chlorella protothecoides
acacgcgcatgcaatccaaccccgcctcgctttttacacacacacacaccttccaggcgggggtg

SEQ ID NO: 37939 - DNA, 84 bp, Chlorella protothecoides
gcgcccctcggcccacgccctgagtgggcgcgccctgggacaaactggcgtgcctgccgctgccgcggggcgctgtcacccgtg

SEQ ID NO: 37940 - DNA, 450 bp, Chlorella protothecoides
  modified_base (89)..(303): a, c, t, g, unknown or other
gctgccgaggtccatcagcacggtgcgcggggtggcgcccggccgcgcctccatcagcaaattctgcggcttcacgtcccggtgcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgctctgaacgagtaccacatgccaagcacatctgctcagcttgcccaaagcaggggcctcaatacctttatcatgttggcagcggtgttccccgacgcctccccctctcacaaccgacccccccccccccccccccccggccg

SEQ ID NO: 37941 - DNA, 849 bp, Chlorella protothecoides
  modified_base (731)..(740): a, c, t, g, unknown or other
cggcgcgcgcggcctcggcctcagcggcggccgacgcgatgcgctccgcgccgcgcagggcctcgtcctgctggcgccgcaccagggcaatgacagcctcgggccccgtgctggacccgacctcggtcagctccgactcccagcgccgcagcgtgcgcagcgcggccacaccctccaccgccgcctcatcggccgacgcgagcagcgcctccagccgctcacaacgctcctctgctgctgtcagacgctcgcgcgcgaagacggcctccctggaggtgggggacagggttggggagtggggatggagatggaggtggcatggggcattggactgaccgagagtgacagagtgggctgttgatgcatcgctaatattcagaggctgtactgattgttaccaactcgacgcagcttgggattggcgagcccagtccccttttctcccctttcctcaccacccaggcccacctggccgactcccgcagggcgggcacctggacggccagctgctcggcggccgccacgcgctcgcgcagcgtgctgatcagcaccgcatctgccttgcgtgcggcatccgagtcctttggcgccgcttcgcgccgcgccgcctcggcctcggcgcgctcagcccgcagcgccgcctcccgccgcccctccccggcggccgccagctcggcgcgcgcgccctccagctgctcctgcagcaggcgcgaggcccgcgcctcgcccgnnnnnnnnnngatattcagaggctgtactgatcgtgaccaactcgacgcagcttgggattagcgagcccagtccccttttctccccttgcctcaccacccaggcccacctggccgactc

SEQ ID NO: 37942 - DNA, 61 bp, Chlorella protothecoides
catcctttcctggccgtgcggcgaaaggataggagccatcaggtcgaaccttctctgcctc

SEQ ID NO: 37943 - DNA, 78 bp, Chlorella protothecoides
aggcctcccagctgcgccgttctgattcaaacaaactacgttcaatcaggcttatacttgcatgtttgcatcatgatc

SEQ ID NO: 37944 - DNA, 61 bp, Chlorella protothecoides
cggcgtgcggggcgggggggtgaccaaggctgcgccggccgcacgccgccggcgctgacat

SEQ ID NO: 37945 - DNA, 14161 bp, Chlorella protothecoides
  modified_base (243)..(306): a, c, t, g, unknown or other
  modified_base (1014)..(1023): a, c, t, g, unknown or other
  modified_base (1126)..(1135): a, c, t, g, unknown or other
  modified_base (1207)..(1216): a, c, t, g, unknown or other
  modified_base (1395)..(1404): a, c, t, g, unknown or other
  modified_base (1623)..(1632): a, c, t, g, unknown or other
  modified_base (2176)..(2185): a, c, t, g, unknown or other
  modified_base (3689)..(3698): a, c, t, g, unknown or other
  modified_base (4440)..(4449): a, c, t, g, unknown or other
  modified_base (6841)..(6850): a, c, t, g, unknown or other
  modified_base (7398)..(7407): a, c, t, g, unknown or other
  modified_base (7837)..(7846): a, c, t, g, unknown or other
  modified_base (8631)..(8640): a, c, t, g, unknown or other
  modified_base (10033)..(10042): a, c, t, g, unknown or other
  modified_base (10470)..(10479): a, c, t, g, unknown or other
  modified_base (10840)..(10849): a, c, t, g, unknown or other
  modified_base (11204)..(11213): a, c, t, g, unknown or other
  modified_base (11800)..(11809): a, c, t, g, unknown or other
  modified_base (13473)..(13482): a, c, t, g, unknown or other
  modified_base (13903)..(13912): a, c, t, g, unknown or other
cccccccccgacgcaaggccccgtccctatgccaccatctttcccctctcaccccaatccaaccacttcctgcagggccacgacgagatcgtgtgggcgctgcagccggcgcccggcggcaggctgttcagcgcgtctgcggaccgcaccatccgcgcctgggacgtggcctccgcgcgctgcctgggcgtgctgtcaggccacacgcggcccgtgctggcgctggcgctggcgggggggcgnnnnnnnnnnnnnnnnnnnnnnnnnnnnnnnnnnnnnnnnnnnnnnnnnnnnnnnnnnnnnnnncgaccaccgcatcatcgagtggtgccccgagtccttccgcgcgctgcgcacgctggagggccaccacgacgcggtgcgcgcgctggcgaccgcaccgggcgggcgcctggtgtcggggtcgtacgacgccagcgtgcgcgtgtgggacgtggaggccggcgcctgctgcggcgtcctggtcggtcacgcggggcccgtgcgcgcgctcgcggtctgcgcgggcaccgtcttctcgggctcctacgacgccagcatccgggcctgggacgtggaggccaaccgggtgggtggtcgtcttcatctttttgggggggggaaggggggttggggggcgttcatgtgggaatgatttcaggcaggcagcgcttcccgcgttcccccatgctcgcctgcctgcatcgtcagaaccccccctcccttcttcccccctcccccctcaaagtgcctgggctcgctggaggggcacaccggcgcggtgcgcgcgctggccaccgacggcgcccgcgtcttctccggctccgacgatgccagcatccgggtgtgggacgcgcgcagcctggcctgcctggccacgctgtgcggccacgccgacaacgtgcgcgtgctggcggtgggcggcggcctgctctgctccgggtcctgggaccgcaccgtgagggtgtggagcgtggaccgcctcacctgcctgcaggtgcgtgtgaggggtgnnnnnnnnnntgaatgatcccaggcaggcagcgcttcccgcgtccctggcccccccatgctcgccttcctgtatcgtcagacccccccctcccttcttcccccctcccccctnnnnnnnnnngttgtttgggagggaagtttgggagggaagttgagggggggggggggggccaagggggggcaaggggctccnnnnnnnnnncttgtttgggagggaagtttttttggggggggggggaagggtgtgaaggaggagcaaggtgctccaggggagcacagctccggcagcgacttgaacggcgaggccttgagggaggctctttgcaacgtgcacgtgagtcgtgtctgctcgcgggatgatgatccccggaggcgatgggnnnnnnnnnngggctcgtcgcgacgtgcacgtgagtagtgtctgcccgcgggatgatgatccccggaggcgatgggaccctagagctcggcatgaccgtggaccatcgctgccagacaagatgcggccggacttggcccgcccgcgcggcgtgcggcgagctgccaagcgttggtgctgttatctcgttgaatcccttcttccttcctccccacgccccaaacacacannnnnnnnnncggagctcggcatgaccgcggaccatcgctgccggacaagatgcggccggacttggcccgcccgcgcggcgcgcggcgagctgccaagcgtcggtgctgttatcccgctgacccccctgcttccttcctccccacgccccaaacacacaggtgctgaagggccattccgaggccgtgctggcgctggccctgacccccacccagctcgtgtccggctcctacgacgccaccctgcgcttctgggacctgggctccgggcgctgcacgcgtaagtgcgaggggcacggcgacgccgtccgtgtgctggccgccgccgacggccatgtcttctccggctcctacgacggcaccatcggcatctggtagcgaagaggagctggggggattggagctgcgtcggaggcgcccctgcgccaccggtgcggcgacacaggcgcagcccgaccttaccatgcgaaccgcccgctgtttcccaaaggcggcctgtgacacccgtgctgccctagcaggcccgggcagcgcaccactaaagattccctcaatnnnnnnnnnncctgtttcccagaggcggcctgtgacacccgcgctgccctagcgggcctgggcagcgcaccactaaagattccctcaatagtaatacagcagcatgcacgcctcggctcctggccgtcggctgccctcaatccaaacaccaaacctcgtcccctgctgacccctctgcgactgtactctacatccgtgcctgccaatagacaccaccctggcatgccccgctgccagctgaaagacaaacgcaccggcacatgcgcgagagcaggagtgattaaggaggttgcttcaggacaagaacatccgtcacgcgaccgcgataccctggggcgtgggcaccagcgtcggcagcgtggcaaacctgcgtcgcttctgcgggcgcgcggccttcgcgcaggccgccgcgtggccggcctcccggccgtcgggcgccacgtcctcctagtgaaggcgggtttggggtcgcttggcgtgtccatgcatcgattgtgagattcagcaggcaccggtgcatgtacgtccggcatccaagccatgtacctggcggctgcaccgccagggcagtctcctccaccatcccccaggcgggcggacggggggcctcgcggccggacacggcacggccgaccctggtcgcggtggggatgccaatcattccccctttcccccgcctcccttctcaccccggcctggagtcgtcggagagcggcctccacggcgggcgccacctccgccagggccaggcggtccagggccaggtctgcgacgcgcgacccctcggccttgcgcagcatggcccggaagtggcgaacctcctcccggcgcagcagggtgtagaccgcgcccggcgcgccggcgcgcgcggtgcgccccgcccggtgcacgtaggttttggcgtacacgggcgcgtcatagttgaccacggcggccacccccgccacgtccatcccgcgcgtcagcgcgtcggagcagaccaggatccgcgcccggcgtgcgcagaaggcctccagcgccagccggcgccggtcggggcccagcgcgcccgagtactccacgctgcgcccgcgtgtcaccccctcgcccagcgcggccagcaggcgctgcaggcgtgcggtggtctccagggaggaggtgaagacgatggtgggcgcatcggggcccagcgcgcgcagcagggcagccagcgcctcgggcttgcgctccgccgacaccacgtgccggaactccttcaggctgggggggagcgagtagcgctgggcctctgtggcatggagttgtgtgggggtggggcggtggggttgggtcgggcccaaggatggaagtactcgagctgtggcctgtgcacgaggatgcgacggagcatgggtgcatcgcgctgcattgtggagcctcacagctcagattccagtgtaacactgacctccctcccccagcagccctccccccgttggttcccactctacccctcctcgcaccggtggccatggcgaggaagcgcggcgcgtgcnnnnnnnnnncgcagccctccccccctgttggttcccactctactcctcctcgcaccagtggccatggcgaggaagcgcggcgcgtgcaggcccagcttgagcagcttggcggggtccttggtcagcgtggccgaggccacgaccttgaccacacgacgcgcggcccccgtgcccagggtcgcggccagccagccctggtatgactggcgcagcaggcggtcgcactcgtccacgaccaggaagcgcagcgcacccagaccaaagcccggggtcgcgcccacgtgccccgccagccgccctggcgtggccaccagcacgtccggcgcgcaggaggctagcatggcggcctcggccgcgccgccggcccgccccgcggccaggcccaggcccaggcccagggcggcgcagagcggggccagcacgccaaacacctggccggccaggtcgcgggtggggagcaccacgaggccgcgcagggcgcgggcggggcgcgccgccagcgccgacaccaggggcagcgcgtacgccagggtcttgccggagccggtgggcgcggcgatgcagatgtcgtggcggtcgcaggccccgcccgcggtctcgcgccacaccgtggcctgcaccgggaacagctcctcgatgccctggtctgtgggggggttggggcggaggggaagggaatggagagttgcgctgtgaagaggggactgtgggagcggtggaacaggctgaggatgtcagcccaggcctgctnnnnnnnnnntggggggttggggcggagggggagggaatggagagttgcgctgtgaagatgggactgtggagcggtggcacaggctgaggatgtcagcccaggcctgctcagggatgtcagccgcgcgtctgatgatgtaccaggcagtcgagcactcgttgccaaatccaagccgttcccatctcgggcgtgctcaccgcgcagggcagcggtcaggcgggggtccatgcccgacactgcctccagcccgacgcccgacccggcatcaaaggcgacgggaaggcgcatccatggcaggacaggcacgctgcctgcatctttcgagctcactgaagcctttgcattggaggctctcctgtcgtcctcgtcccctccaccgtttgcccccataccgggggcccaaccccccaggtgttgcctgggtggcactccgagtcctcacccactcgtctcgatacagcgagtgatataatccgaccctacaagttacattcaggttccatcatacaaggacgcaatagctcggatgcacaacatcggaagtgctgccaagttggggcgcaggcgcggggtcgccgcatcttttcacagtcgccaatgcctactgtcatgccaatcgccgtgtccacctgacagtccattccatcagagccttcgcagacctgtcacacacccaatcctgagttgctggtcatatgcagcagccacccacagcccctccctctgcggatgccagtcaaaggagggaatcccctgctgtgcgacctgggcatgacttagttgctccatccctcccacctcgtgcctgccaacgtggggaggacctgtctggcgtcagtcgtgtgacaggggtataacgcccaagccctgcggccattgatcaattccatggatcgatcgtgcgcgcacacagtacaccgtgccacggccctgtacctgcacccaccgtgagtctgcatagtggtaggcatgcacggacagggagccgtcccctgcatgaacggcaagcacttcccggttctgaggcaggggggcgacgccccacagcacagagtccagtcgcgcctaagaaatgggatatggcaacggctgggtcgttgagctgcaagacagaattggaggcttgaaagcattgccatccaaaggaaattaactcagtatgacacagggtactctcaggtaaattatggccagcccaggccattcttgctcatacctgctgcacctccatggcgcggccgtggtcgggttggcagggtctgaggttgatcgtggcaagccgccctcccatgccagcggcataggccttgttcatgacgatgccacgtcgatcaaaggccagtccacagacgccctgcccctccatgctgccagaccagaggagggtgccaacccgcagatcccagagactgatcgtgccgtcttgccgacctgaaatgggtggtgggaactccataccacttccagtcaaagcccacagtgatgagcaccaggggtgtatagtgaaacagttcgcaaatccatcactgaccacaagagagcgggcaccgggccttccaatggctcccaggatcgcccacacccacacctgccagcacgctgcgatcctgctcggtccctgcaccaccgagagccaccgcccaggcagcagccgaggtgcccccacacagctgcgcaaccggtctctccggctgacgagcgtcccagaccagcacacgcccatctgcagccccgctcacgacctcaggcggcccgggttcgccgctgcagccgccgcatgtgtccagggcatggatcgcagactggtttgtccctcccaacacactgattggctgaggacgagcctctacgagatcccagacctcgaccccgccttgtgagtcgcccagcaccacgtggtgggagtcgccggagctggccaacattgcggcggatgtgaggggccggctgaccggcagagagtggcttgatttgatctgtgactcccgcatccgccagatctgagcggcccccacgccttgaaccgtgcatcccacgccgatgaaggatgctcgtccggggatccacctgtggcatgggcgatgccagtgcgctcgaggcttcagacgaagggaaccctccgccggacgtgagctcgcatgtgcatgcatactccccggcgagggctggcagacgtttatctcacctgaccgcacggatgttctcagagatcgaagcctgcgagatcacatggatcgacggcttcagcgtcatcatgcgaccctaccctgatcctggtgctgggtacccggattggtggcttataacagcggagctggacacgtcgggtcaggtgggccaaagcaatgggctccaacggaaatatcattaaaatcacaaacgcgtagcaaagtcgatcagnnnnnnnnnntgcgtcgggtcaggtgggccaacgtaatgggctccgacggaaatcccatgaaatcacaaacgcgtagcaaagtcgatcagtcgaccttggcatcgctgcagtttctgcccgtgaccggctctcactagtcaaagccgacgacaccggtccccggccgggtcccggtccggagagctctctggtgacaactggccctggccagaccatttggggtaacaatagacatctcgtccttccgtgccttgcacatcacgtgacagggtgccagtcacccacactccctgttaatcgcgcagtagggcggggccgccctcatagctcgtcatgccacgtcgtctgcgtcaacacctccttgatgatgtcctgctgtgtctgtgtcagcatctttgggaagatgaccctgtacgtcacccagaggtcgccccgcttcacctggacaggcgggaggaagataagcagtggatctcctggatatgaggcagggtctcgcaaaggggaggggaggatgggacaggctctcatgccaggccctggcctcaccccgctgnnnnnnnnnnccctggacatgaggcagggtctcgcagagggaaggggagggtgggacaggccctcatgccaggccctggcctcaccccgctgatgggttcgcataacccctgaagcatccagcaccgctcttcccaccccctttgcctccctgcccgccaccccacctcgtccatgatgggcatgccttcgcccttgaaccagcgctgctcgccggggcgtaccaccgtcttggaccccacggcgaccgtgtgcccatccaggtgcttgagctgagggcgcatgagaagggggcttcagagcggtggccgttcgagcgatgggctcgtgcgttcctgcctctgcatgcagcccagctcacccccggcacggccctcggcaccctttcacctccaatacggcggcacacgcactgcacgaccatccccccccccccccgcnnnnnnnnnnaggcacggccctcggcaccctctcacctccaatacggcggcacatgcactgcacgaccacccacacctctgagcctcccactccacacccggcccccacctcgcgcgtgaagccggtgagggcctccagcagcgtgatgttcatctcggccagcaggcccgactgccgccgctcaaagacggggtgcttcgtcgtgaccagctggatgatcaggtccccatgctcgccatccacgcgcggctcgcctgcgcaccatgtatggatgggcgagatcctcgaggcaaggcaggctgagagcggcaataggagggcgtgggtagggcctagacaggtcgcttgcaaggcagtcccccccatgcaagctcccaaggagggatgaagcaccctgggaatgattgattgctcctccgaccccacctcccacgggcaaaggacatgaccgtccctgcatcccacctacccaccctcttcaaaaaaggtgatgcgatggccgtctggggtgccgggctcgacggacacggtcacctcctcacgctcccgaacgatctttacgttggggcagtcctcgcacacctgacgggtgggagggcggcgttggggatgatgctgtagtataaaccaggactcgagggcttgcacacatggggtcttgaacaaagtgggcccagcagatggtagccactggctcattctgccttcaccacccaccaaaccaacacactcccctttcactacctgggtggtgtactgctggtacatgcctggcccaacctggttggtcaccnnnnnnnnnngcaggacccgaggacttgcacacatggggtcttgcacaaagtgggcccagcagatggtagccactggctcgttctgccttcaccaccccccaaaccaacacactccccttttactacctgggtggtgtactgctgatacatgcctggcccaacctggttggtcaccactcggttcttgcagttgcacttccgggtcccagacgccggcttcagcacgcccttgtctcgcaccacctttaaaagtacgagaggtggaggggattcggggggagttgtgcaaccagaaagcatgcatgaatgagagcgtgcatatctacagaataaaatcatgcccggcctgtcactctgctgcctgtattccaaggtccctcacataccttgaactggcgccccaggtagaggtcctccagggagacctccaggttgatcacgacatcatcgcccttgggcgtctggggctcctcctgctgcccatggcctccaaaaccaaagccgccgaagaacctgcagggcagtcgggactggatagttggtcgagcatcacctggaatccaagcaagggaggcagaacatccccatggcagggcagcaggcgcttgacggcaacaggcactgtctttagacaatgtccttgcaaagaaatgcaccaatcaagccccacaagaatacctgcagagccctcgcatccgtttattccaacactcactgcgcaaagatatcattggggttgtgatggccgccgccgctattgcccatctgcttcaggccctcctccccatactgatcatagatctggcgcttcttctcgtccgtgagcacctcgtaagctacatggtcggttgaaatcaggggtgacatttgttgatcagccacgcctggcagacgctcgaagcagcaccctccaacccacccaccgtggccaatctcggcaaaggtcttggctgccgcctgcttctcctcctcagtcccctgcactttgtctgggtggtacttcagcgcgaccttgcgataggcacgtttgatggcagcggcatccgcgtgccgggagacgtggagcaggtcgtagtaatccttcctgtgtagtggatggcggtgagagggcctaggggtgatgcttccatgcacttggccgctcagccaccatctggcacaatttaattcattccggaacccaataaggtggttaaacatcatccactcacgctgctgtcgataccgccaggagtaggagaagtgcgagtgtcttggctagccgtggtgaggtcatggcgcccgacaagccaccaccgcgcccccaggtgtccgcctggagatggggtcctgacttctggcccagcaaccgcgacagcccaactcggtgtaataaagaacacttctggcccacctcgtgctnnnnnnnnnnggcctggagagggggtcctgacttctggcctagaaaccacgacagcccaacttgtgtgtgataaagaacacttctggcccacctcgtgctgtcgccgacccacgaaacaccacgccgatctgtgatgccggatccctggggggagcttgcacaggaggcgcaggaaactatagggtgagcttcacagtggaggcattctgccctgtgtgaatttagtctgtgctgtggaccaggaaaggatgcgcgcaggcaggccaggtttcgtcttggagcttctcaacgcatgctacgcgtgcttggccatcgtctgatcaacccacacacaggccctgcaccttcaggtatgaaactctgcatcaaagagatacattcctcgtgtgattctgaggaagagtctctttgtgtttcagaagacgacaaacatcgtnnnnnnnnnnaatcagcccacacacaggcccagcaccttcagatttgaaactctgcataaaagagatacattcctcgtgattctgaggaagagtccctttgtgtttcagaagacgacaaacatcgtgactgaccagctacaggggctagaggtgtggactcagcactgccacaagcagagtggccgcctagcacaagatgttgctcccagatgaatgatcgaccggacctcgccggcatgctcgctccttaccatattgccacatctcagtcgcatttatgcgtaggcaggagcaattcaatgtatgcatgccacaatcctgacaaagatggcctcaacgtgcccgttctgcagtcagatacaccaaaagnnnnnnnnnnctatgcgtaagcaggagcaattcaatgtatgcatgccactatcctgacaaagatggcctcaacatgcccgttctgcagtcagatacaccaaaagctgcataagatgagccagagatgaattgattgtcgccgagcctctaactgggacgatcgggaaagcttcaccctcagttcttccgtgagctagtcgacagggagctgttggcatctggcaactaatgaagtcagattctcggcagcagcgcgcgcccgtggccagaattccgacaggttgttgtcctctcgcctagggctggaaaattatgaggttaatccatgcataatacagacggaataaaaaaccgtctcagcgggnnnnnnnnnngctctcgcctagggctggaaaattatgagcttaatccatgcattacacagacggaataaaaaaccgtctcagcgggcccttcactgccttgacctggccaaaactacccctgagcacgcacgtactctcgaatggctacgtcgcaggcagctggctatgaggtctagttcaccccgcaaattgagctggattgcccgatcctcacaccgtttgagtagtaatctctccctcagctccctgctggaaccgggctgtcacccaggattcctgacagatccctcgctgagagccctcgcacctcgccgcccgccccgctcgccaccccttggcacaggaaacatgctacacaagtattatgcccggaacaggtgggaaccggacgagtggtgcaagcaggtgactctgtgttcgaatctcgcagatcatgcccagccccagtgccccttcacagggtgacgaggtccacaagaccctcccatcgcgtcgcgccggtgggtcgttccctcaccctggattcggagccgaagttcggttcggatgcggagcaaccctgccctgtgagtccttccagcatcgctccaggccannnnnnnnnntgcgccggtgggtcgttccctcgtcctggattcggagccgaagttcggttcagatgcggagcaaccctaccatgtgagtccttccagcatcgctccaggccattacccacacgcatctgcctgcgcctcgtcgtgcatgcacaggacaccgctgagtcttggttgcacctccctcccactcctttgcagagcgctggtagaggactggaggtgtccccgcttccatcccccagcgtgggctctaactgggaggaggccgactcccagctgagtacacccctcggttccccacgctcaacaaccggcagctacacctccgcactctccccacaaagggtgaggcggcttgattcggggcaacagtgtgttgcccatgtgcctcagtcaactggcctgcttgaagattccacaggagccagatgtcatcccacccctccacatccctacaggcatatggtggaagcttcagagatggcagtgtctcaccagggaaggccctgccagcctccagcccagaccatgtcagggccaagcaggctccttcccccatgcgtcttgcagccctgcctgaggcgcatgctgtggacacgccagaggccctgcccggaccatcaggccacatcgtcgccttcttggctgtcattctggcgctggcacagatcctctgtgcaaccctgggcctgctcaacgacccctcgattgtggcgcaccgcgccaaggaggtgtggaggaactctggggccgacctggcaacgcaacgcatctgggctggggcaggagcctgtgcaggggtgttgatggcggtgcgcgagctcggagcccagctgctgggcagccgcagcggcggaaaggcacgcatctcatcatgagtatcttcaccccctccacatgtagcagcggcagtgatgccttcatgcctttttgtgcacctagctcctgttgaaccatagctgtatcaccccaccgctggaacccgaaacgcacatgtatatccccgcaccttgtaaccttgcaaggccccacttctctttccgtgaagtgcatgctgtgttccgttcaaaaccggccacactggggcgaagtcccacacgagcgtcgccgatccttcatcacataatgcatggtcgcgaggcgtgatggcatggcgattcgtaggatgattacttgccagcaccagtatgccgaacggtgatccttctcaacacatgatgggtcatccgggggccgctgcggtgctgcaccgaaccgacttcccagcatttccgcacgagccctacagcatacagcgggacctgatgcgctctctgtacgaagcactctcaaagggcggagttgggtttttcgagtcgcctacaggtgggtggagaggggctgggcgctggcacactccctggccatgcctgcttcagcgctgagcggcggtgcaccatgcctgctgtacccctgacgagccctggtcctgctcgcaggcaccgggaagacgctctgcctgataagcgcctgcctgcactggctggaggactcgcgcgctgccagcgccaccgccccgaaggccgaagagggagcggcggtagctggcgggccgcacacgccggagtggatgcggggccatgcggagcgcctggagcgggagcgccaggcccacctactccgggcccagatgnnnnnnnnnntgccggattggatgagaggccatgcggagcgcctggagcgggaccgccaggcccacctactccgggcccagatggaacgcctggaggttttgcgcagcgcccgacgccagcgaggcgcgcgaccggcggcgggtgcgaagacagggcccggtggagcaccaaacgacgatgacgaattcatcctcgaggaggtggaggagggtgcagcgtccgagcctggcgcctccaggaaacgcccggtgctgtcagactccgagtcggaggaggagggcctgggaggccccgctttgcaggctgaaactcccgaggtgcccagcaagacgcaggtcggcacgattggcgagtacctcaccctgctgctctgtctctgtatgcaaggctggcagtcagcgtccctgctttgagctggggtgccgtacannnnnnnnnngcgcaggtcggcacgattggcgactccctcaccctgctgctctgcctctgtatgcgaggctggcagtcatcgtccctgctttgagctggggtgccgtacaggcaccatggtcacaccttagtgtgcccgcctcctgatcacctcgtgcgtgcaagaaactggtcttgcaaacttccttccccggcttcataagccagctccacgattgacgcattcctctggacccgaccccccaccccaccccccacc

SEQ ID NO: 37946 - DNA, 114 bp, Chlorella protothecoides
atgatcggcacccccatctgactggcgtcttgccgtccatgggtggcagatgcccaatgcaccatgcacccttgcccagcatgtactaggttttccacatccagatgtgggtga

SEQ ID NO: 37947 - DNA, 360 bp, Chlorella protothecoides
  modified_base (108)..(293): a, c, t, g, unknown or other
tgattggcggatctccctttgcctgatgcctcgccggcttcgttgctgaggaggccctgttctcgtttggcttgcaacccccacccggccggcctcccctcctcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacatcgatttcctcatgtcggcgtgtgtcgtgggcctgctggcgccccccactcctggccctgcg

SEQ ID NO: 37948 - DNA, 61 bp, Chlorella protothecoides
acaactcgcagctgatgcctgctcccccgcacctcccaccacaccagtgccagcagacgag

SEQ ID NO: 37949 - DNA, 61 bp, Chlorella protothecoides
tcgagggagtggagagtcggatgcaccgccctgcgatggctgctcttgacggagtacgatt

SEQ ID NO: 37950 - DNA, 80 bp, Chlorella protothecoides
atcactgccccattcctttctcaactctcttccattccagctgcgtgctggtgatggagtttatcccagccgtcagcatc

SEQ ID NO: 37951 - DNA, 75 bp, Chlorella protothecoides
atcgtggcgggaaatgccccacgcttccttatagtatggggttaaggccgagactccgccccagctctgcccgtg

SEQ ID NO: 37952 - DNA, 61 bp, Chlorella protothecoides
gtgtataaatataaagaatggagaccaggagctggatgagggttacgaaggccgggaaatt

SEQ ID NO: 37953 - DNA, 61 bp, Chlorella protothecoides
ggtatgtcgtacctgcaaatgcgacggcttttagcgatcaggagatcgctctgccgaaaca

SEQ ID NO: 37954 - DNA, 63 bp, Chlorella protothecoides
agattccagcatgtgtgcgcaccgagcggcgtcagcctcgtcctccacaaggtcggcctcggt

SEQ ID NO: 37955 - DNA, 61 bp, Chlorella protothecoides
agcctcgtcctccacaaggtcggcctcggtgaaggccaccgcctcgtcgccgctgtcgtcc

SEQ ID NO: 37956 - DNA, 61 bp, Chlorella protothecoides
gccgatctggcccacgtactggtactccccgatgtggcacttcatcaggtaggtggctgcc

SEQ ID NO: 37957 - DNA, 66 bp, Chlorella protothecoides
cgtggagaagcgtctcatagctggactgagatgcaatgggccctcgccccagagttctttgccctg

SEQ ID NO: 37958 - DNA, 104 bp, Chlorella protothecoides
ccttgctttctgagcatgggtgcagccgcaacgtaaaggtcccccgcaggactccccacacggaaatgcatgcagtgcaggcagcaacatcaccccctcctctt

SEQ ID NO: 37959 - DNA, 75 bp, Chlorella protothecoides
ggcgttgtccgctgcagagggcagcggcgccagtggggaagctgttccttcccggggcgctgtcactggtctgga

SEQ ID NO: 37960 - DNA, 88 bp, Chlorella protothecoides
tcctgggcctgctcaggtgggtacagcggggaggaagctcttcgcgaggtgatcctcgaagacatgggctctgtgctactcaaaccat

SEQ ID NO: 37961 - DNA, 63 bp, Chlorella protothecoides
tggaacctgaagacgcgtcagcgtctatcgggggcggcgaatgagctcctgtcgatttccaac

SEQ ID NO: 37962 - DNA, 8981 bp, Chlorella protothecoides
  modified_base (2381)..(2390): a, c, t, g, unknown or other
  modified_base (2619)..(2628): a, c, t, g, unknown or other
  modified_base (3212)..(3221): a, c, t, g, unknown or other
  modified_base (4344)..(4353): a, c, t, g, unknown or other
  modified_base (5050)..(5059): a, c, t, g, unknown or other
  modified_base (5749)..(5758): a, c, t, g, unknown or other
cccggctcatgctccgtgctggcgggggggagggctaccagccacgcccccacctgccgggaaagctccgcggccagcgtgggtgcgtggcaggcgaacaacccgtggtcctggcaaaacgtgcgggcaaactccgccaccacggcctgctcctccccgctgttccacaggaacttgtccgcgatgcgacgacccttgtactccaggcgcagggtgacagggaccacatcccggatggagggcttggggggtgggttgggcagctggcacggagcgggactggtcacggtgctcatctccccgcgacgtcacagcgcttcaccaaacaatcatgttcaagtaacgaggtttcggggtgatgttggagggacctgctgcacatccgacgtctacaggacatttcatcacggagatgaaggcgcctgatgatgtacgcctctcggagattctcctcgtcgttcgaaaggacctcacttacgacacggagtgactggcacaatgccaaaccgtgaaaacagccaggattgcagcaatccgggcaattactgggtcacgccacccatcttgttcgatgcagggttgtgcgaggaggatgcgtaccagggcgaggtgccgtggccgcactcggtcgtggtctgtaaacttcccatggagggcattggtgatcacaacagcgcttctggcatttgctgctccctcccgagggtccgagatactcatcaaggtacatggacagcggtgcgaattatggctggtggggtttcggctcccttgcaagggttttctttgggaaagagcaggcctgtaccatcctgtgccccatcccacacgcattggccgaccatccagctgaccaattccctcttctcatcattcaccgccaatgccccaatcagggaggcacggtcgtcaatgcagagtacagcgtcgtcgctgatgtcctcatcagggacgagatcatagtggccgtcgagcccaacatacaggtgcgctgttgggggctgcaccgcctgcgcagtgacgtggggatggtcattacgtctctttcacagacttcacggactgtggtgcattggcatgggccagccctgctcctcgtgaggaggggcttgaaatgcacagtacccagcccaacgcctgggcagtgtctgggctctccatctcactgctcgccaacccagccccacccccctgtccctgggacacagctgacgggaggaatgcaggtgctggatgccactgggaagctggtcatgccggggggcatcgatcctcacacacatctggacatgccattcatgggccaagtctcctgcgacgactttgctaggtcaacgcctcaaagggggaaaagggtgctgttgggtgcagagagcacggtctccgttccttgcccagcacccctccacatgagcgagggggtgttgtctgttgcagtgcggcatccccacaccccagcaccccagcaccccccaccctcctcgccgccgcagtggccagcgagctgcgttggcggggggcaccaccatgcacatcgactttgtgctgcctgtggagcacgacctgctggcgggcctggaggcctggcgtaagaaagcacggcacggggtcatggactacggcttccacatggccgtcacctcctggtccaacaagtgagtgtgcccttggacggggggatggagagatttttaatacatgtcagggatgtgtgaggtggtccgactctgtccaggaggtgttgcagacaggaagcagattgatcgtggagcttgtcacgtaccagccagtgcgtgagcctcctgcctggacgcccccctcccgacaccccactgcacctgtcgtccccctcacccgctcacatccccaccacctccacgcagggtgtcccgcgacatggcgaccgtggccgcccagggcataaactccttcaagttcttcatggcctacaagggctcctttatggtggaggacgacgcgctcctgcgcggcatggagcgctgcgccgcgctgggcgcgctggcccaggtgcacgccgagaacggtgcggcggtggcctggggccaggagcgcgtggcggcgcgcggcgtcaccgcgccgcacggccatgcgctttcccgccccgcagcgctcgaggacgaggccacgggcagagccctccggctggccgggctggcgggggcacgcctgtacatcgtgcacgtcatgtcggggggcgccgccgacgagattgcggccgccaggtgcgcaaatgagcggggggggtggtggcggtgaccagacgtgggggatgaagagtcggaccaggcagccactacgctcggtgcacggttcaaatgtgcggggaactgggggtcatgagctgcgagggcggcccaggnnnnnnnnnntggaggatgaagggtcggagcaggcagccgctacgctcggtgcacggtgcaaatgtgcggggaactggggggtcatgagctgcgagggcggcccaggcatgctttgcatgctgacgccataggacgatactcagtttccaggatcttctgcttcattcccgacccacgctgctcccggcagcaccccccaaccgcacccccccctgcctctttcccaccatacccaaannnnnnnnnngggacaatactcagtttccaggattgtctgcttcatccccgacccacgctgctcccagcagcacccctcccaccacacacacccctgcctctttcccaccatacccaaacctagaatcctctctgcctccgcgccaggcgccacggccagcgggtggtgggcgagacggtggtctccgcgttggcgctgacagaggacagcatgtgggactccaacttcacggtggccgctgcccatgtcatgagcccccccatccgctccacgacgcacagggcgtcggtgcgccaggcgctggcaggcggcgtgctccaggtgagaggtttgcttgagggggaggaggttttgcgggggtcaaagggagaggggtgggatgggcctgacatgggagggccgggcgaggtgagagagggtcaggggggtggaagcaacactaggtctgtagagtccccgcccaaggggtaagctagagtgcgtcctgccaggtcacaccccgggattctcgaaaactttccttgaacttacaatgaatgcgcaagcagtgctgaactcctcacctccccctgcgccccccgccccccgcaagnnnnnnnnnncgaaggggcctgacatgggagggccgggcggggtgagagagagggtcaggggggtggaagcgacactaggttggtagagtccccgcccaaggggtaagctagagtgcgtcctgccaggtcacaccctgggattctcgaaacttttccttgaactttcaatgaatgcgtaagcagtgctgaactcctcgcctccccctgcgccccccgccccccgcaagattgtgggcacggatcacgcggtgttcaactcgacgcaaaaggcggctgggaaggaagacttccgcgccatccccaatggcgtcaatggcattgaggagaggtgaggggcggcccggtactttgtgaagttgtcggttggtgggtggggagggggggaaccccacgttaactgctcccttgcactccggcgcatctccccttgcgacgacccagctcccccacataccttcctgcctccccctcgtcccaatctgcccgccctttccgcctctcacttcccccttgtcccggggtccccccctcatcgccacccccgaccccaccgcgaacacgaagccgtcgccagctcagccactctcccctgaaggttgcatgtggtgtgggagacgatggtgaacagcggtgcctccacccccagcgactttgtgcgggccacctccaccgccgcggcccgggccttcaacatctacccgcgcaaggggagcgtggcgccggggtccgacgccgacgtcatcgtgctcgaccccagcgtgcgccacgtcatcagcgcggccacccatcactccgcggtggatgtcaacgtgtacgagggcatggaagtcaccgggaaggtgcgcaagagaaggggggtgggggattggaccaaatgctatatatggggccgggtgacatgatccagtgccaatgcaagaacggagctggccacactgcggtgccagacgccgtccagccaccgcccaccagcagccacatggcagccactgccaccatgcttttgcggggagcaactgcgagtggcatggctgtgatctaggagatgccccccttccccacccctggggccaagaagggggaaggcgatcaggactgcaacgctcaacgccatgggccccccattctgccnnnnnnnnnncgcttttgcggggagcaactgcgagcggcatggctgtgatctaggagatgtcccccttccccacccctggggccaagaaaggggaaggcgatcaggactgcagcgctcaacgccatgggccccccattctgcctgcctccagatactggcccgcttcatccccaccctggctcctgctccccgtctttgcaggtggtgctcacactgagccgaggccgcctcgtctgggacggcaccaaccttaatgtgaccgccggctctggccgcttcatccctatgcccctcttccagagctcccggcctgacgacttgggcgccgtcgtcccgggaaccgcacccacctgcccctctgggcacagggtcaagcatgctgacacccagagggtggcgactctgacctacgcataggggtgagcgcgatggcacgccagcggaccaatgccgctggccgggattggcatgcaatgtcgcagaaggatcatccatgggaatctgattggccatgctcctcacatgccagcagccctgtgtgcgggcactgccctctgccacagcacccccacgaaatccatgccgagtttggagagggaagatgctccctgtctgaaggacacttacctcccacagcaaccctgctcaacgtgtcagaagcattcctacttgacgttcaagtcagtgtgcaagcacaattaccccnnnnnnnnnnatgcgggcattgccctatgccacagcacccccactaaatccataccgagtctggaaagggaagatgctccctgtctgaaggacgcttgcctcccacagcaaccctgcacaacctgtcagaagcattcctacttgacattcaagtcagtgtgcaagcacaattaccccagatggtgggcgaagtgggttctcacctcggcagccaatctgggataccgaggtctgggacagagacatgccacccagtatcaaggaggagtgcttctggcgcctttattcacatggccgaccagctgtgtgcatcctgtaaaggtcactctctgtgctctcagaccaaatttgcccctcgaagcttttcccgggtcctgctgaaccctctccagctcaaatcccacccggtcccagcagtgagatccattccccgcccagccttttccctttcagataattgtccgttcagaccacaccaaccggacgttccaagaagtaaggatacgctcttgtatgaatggatgtgaagaacacagccggagatgtgcggaaggttgtacctgatgtcacaggcgttagggttgacaaattacccctgtggtgctcgtgtccaaggaatccatcccggggagggaaggaccccatcttagcaatgcactgaacccgaacgttttaagttgaacctttaatatgggattgnnnnnnnnnnaaagaacactgccggagatgtgcggtaggttgtacctgatgccacaggcgttagggttgacgaattacccctgtggtgctcgtgtccaagtaatccatcccggggagggaagacccccatcttagcaatgcgctgaacccggaagttttaagttgaacctttaatatgggattgttcgtggtaagcagcttaaatcttacaaacagtggaaatggtgcgatgaaattcgggcttacctctccaagcgctcgtcaacgaccggaaggccacagccggtgtgccacttgcaaatccatacacaggtgtggctctcctctctggtgaacgtcctgcgtacaaggcattgggtccttgcttcaacctgtaactggtgtatgccttggttatcgtcgggccccttgcatgcgcgctaagtcagcctagggcactccgccgttgcagcgaacaaattgagccacagtaggaatgagggccctataatgttggcaaaaacacatcaggtcaatcatgaaacctgtaagttcgccttctcttgggcttgatgtatttcactcagtggctccggcgaggtcgatgtccgggtgtatccggtatttgtccgcatctccactgcgaagctccgatggtgctacaagctagacttatccttaaaattctcacaaataatggatcacaaagatgtgtggaggctttgagttgatttacgggctccgaaagaatgtaaaatgtccgacccgctcaccgctggttaccaggtgggacgtgcggtcgtgaccggagcgaccgcgcctttgatacccccttgtcgggggagcaactcctctgggttcagcatgaggggcgccattcataacctaagacacccacttgcagtctcaccttcgttttgtctgagaattgggtggtttgacctattgttaagcgttgtgagcacacggaggtcccacgggcagcatgcgcatctgaattctgcacccgacgggaggaccgcaatactccgatgaggggcagcggccgcacccgctggtggctgacgtgcttcctccttgtgcaattgaagtcattctacgtgaaggtctgtggtggcgaaggtggcggttcgagaggctgcgccccccgcgtggatacacttcgggagatgcgcacactctactcccattccttaccccccgcaggcatcctgcaagacagccttctacgcgctaccgagtgcaaagtgagagcccattggctatgaaatgcgcattcggtgcaatcaaggacttacgtgtgccattgaggaacgaacctggtccggccgggcgccctgcagggtcggaactatccgaggtgcctcggcgacaatccccctcaccatgcccttccccttgcgacctgcagatctgggagcaccgtgctccttctcagggaagacagcagtacgctgttctgcaggtatggtcccggatgcattcgctttggctcacattataccctaccaaatcccaactcgccaactcctctcatgatttctcaccactgtttcttgcctgccttaccccaggagtcaagggcatactgaagctggatcagtccgcagtggtcccttggggtcactcgtccttccagtagccgcaatcagcctcaaatccttccaaaaatgttctggtgcttcatgccaggccctcctgggcgtggaatgcctgcggcgaggcgaggccgcatgcagcgccgatgcaatggggaacattgggacagggaacattggctggcacaatttcggttccagtaatgtaggatcacgcaacataggcaagtaaaaatagtgtcagacccgggggaaacaatgctgcatggactgatcagttatctctcctgtggaaaagggtgagcatccactgcctgacaatggcgagtttcctggacccctcctcccctcaccatgagtttgcatgtttgcaaatagactccttgcgccaaccgcatcgcgtagatgtacctctccttggaaagctcaccacttcttgatatcgctcctcctcctcccccaggtaataataatctcgggaacaagaacatcgggagcagtaacaagggcgaccacaacatctgcaacaacagcaagggtttccaggcggtgtgcctgacttccatgttggtaacgtcggcgactgtggatgtgacaccagcacccatcccgaggcccaaaccgtctccgcctcctcccaagaaagcctctccgcctcctcccaagaaggcgtctccgcctcctcccaagaaggcgtctccgcctcctccccagagacggtatccgcccccaccctcaagaggaaagcctcctccgaccggaaagaggtcccccccacctccacccaaaaagaagacacagccgcccccaccgcgggcagttccaaaacccccgagcccccctggaaacaggacaccccctcccacacgcaagaagcctaggcctccaccgcccaccaaacctgtccgtcccccaccgccaccgcaccgcgacagcagtccccccccttccccggtcttgaggtcccctccctcccccatctccaagcggcctccaccacccagtccaaggcgggccagtcctccgccagcaaccaccagtgtggacgtgaagaatctactttgcgcacccaacaccagcgctgcagttgcatgctcgctccaggttactatgacttctctggtgccagttgtgacaatcgtcatcacattcaagtctggggatgaagccactgtggtcctccaccctacatctctgaccacatcagctactgtatctgtcagctccacctctaccgagggcaccgcccaggcactctacacggatccgagcacaaacacgcctgtagtctcgcccttagttccaatcaaacccgttcctattcttccccctgctccccccagcgcccccatttttacacctcctcccgtggcctcaccgtcgccctccccaccgccaaactcacccccaccatctccacaatcaatctccccaccgccacccatgctcctaagcccatccccaccagacacaccgcctcccagcccaacagccctcagcccccttccaccaagcccgttgccaccacccacatctccccctcccagcccaatgactgccagcccacctcccaacccgccacccccatctctgccgccgagcccgcctcccacaagtcctccgcctgagtcgaccccaccgagcccccctcccagc

SEQ ID NO: 37963 - DNA, 90 bp, Chlorella protothecoides
tttccggggtggagttgtctgaaacaggccaggatcgacggcgcgggaaaataaaactcttgctgaaggatctctccctaccctaccctc

SEQ ID NO: 37964 - DNA, 87 bp, Chlorella protothecoides
ggcgccgagtgccagcctgggtgggagggggaaagggcagcacggggtttgttgcagctggcccagtggattagacctggatactcg

SEQ ID NO: 37965 - DNA, 87 bp, Chlorella protothecoides
acatcagcatgttggccgctccgttcacgttgcggttcacgacgttgactttgcagcccttgttgccgcaccgcttcgtgtcccaca

SEQ ID NO: 37966 - DNA, 61 bp, Chlorella protothecoides
ggtaccgccggcccgggattctgcatggaatacaggaaaaggagcgatgacaaggggagtt

SEQ ID NO: 37967 - DNA, 18303 bp, Chlorella protothecoides
  modified_base (5675)..(5715): a, c, t, g, unknown or other
  modified_base (11580)..(11625): a, c, t, g, unknown or other
  modified_base (12510)..(12519): a, c, t, g, unknown or other
  modified_base (13036)..(13045): a, c, t, g, unknown or other
  modified_base (13146)..(13155): a, c, t, g, unknown or other
  modified_base (13299)..(13421): a, c, t, g, unknown or other
  modified_base (13946)..(13955): a, c, t, g, unknown or other
  modified_base (14089)..(14098): a, c, t, g, unknown or other
  modified_base (14821)..(14830): a, c, t, g, unknown or other
  modified_base (15156)..(15165): a, c, t, g, unknown or other
  modified_base (15476)..(15485): a, c, t, g, unknown or other
  modified_base (15908)..(15917): a, c, t, g, unknown or other
  modified_base (16783)..(16792): a, c, t, g, unknown or other
  modified_base (17028)..(17037): a, c, t, g, unknown or other
  modified_base (17298)..(17307): a, c, t, g, unknown or other
  modified_base (18182)..(18240): a, c, t, g, unknown or other
taaacctaaacctaaacctaaccctaacccctaacccccttggcctaagcaaaacagatccctagaggtacacagatgtgatgtcgagacgtccccattttcatctctagtgtatcattatcgctccctacggtggaaaaggacgtgtaatactgcccgagagccttgggacttgcctgccgcgcctgcgtgcgacactgcgtccgcagggacctgtgcaccttcccgaccaggcgcaaggaccttaatttcataacatatcagcattatcatagtgaggctcaatgacgggcattctggtttacgaccaataacatttgtccatctctgcagggtttccaccgaaaggtgcgctcactccacctattcctggtttccgtggtcctgccagcacgggcgacgaaacttgcgggctttcaacccccactggcccaaagataccacattcccctcttgtgttccttaataaacaatgcagcaacacaaggtctccgcggacgagggactcagttaaaattctcggcgggtccaagttaaggaagaaggtccctccggtgctcgcgcgcacggtggtttgcggtataattaattccgagtcgggcgctgtgcacctgtaaatagtccgttgcgttttaattccccccctttttctatttccgagcctaaaaccagtcgagcgctgtccggagtgtcggacccctctcaccggtccctcgccttcacctcgtgtcgggcgggcagcgccccggctccaccagccctgaacgcgtcatgaaggatgggttggagagcataggctattttaagctcgcggccgtggtttgtggtgacaaacatggtacggaagatatcttggacggtggaacatccggctccacgaaccggccgacacgcggagtgcgatcccccctcctgagccgaagcaaagccacgcccagcctcaaccccccaaactcaattgccaggtatcctgctgcactacggcgacgagtcaacccatcgctacagttccagccgtctgttcgtccagtgtgctgcctcatgttgtgccgagaaacccctggcccccaactccaggggtgggagcatcttcacgcccaacggctttgagtcgcattgcggtgcggcggtgtgccgtggtttgggggcacgcggcgggcacccagtcctgggtttttaatgttgagcgtgggcatgcgtcgccaccccccaccccaccccacccccacccgctgccgcttccgctccccaccaccaggcctggcacatcgaaagaagtggcggaccacgctgcgcgtgtttgagcccgggaaggcactccagagcctggggtcctgggccgcctcctgcttcccaggcgagtgactctggagggcgccccgcgcggggagggcatcctgcgtctggtggctgagaatgcgggggtgcggccgccccgaggcggtggggtcaggggccctggcgcggcatcgcccgcccagactgacaggtgcaggtcccctcgcccacgcagacggcgcgtttcctcccgcaaggggcggcagcggcagcacccctcccgcagcgctccgggcgctgcgggagctgaatcacggctgcccggggcagggcccgacggaggtggaagacggggacgccggcctgctggaggccatggagcagccggggcgcgggtccctggactgcagccccctgtgtcatcagcaggcgggggcagaccaccaggccgaggcggacgcgtggacgctggtgagttcttgccacgatgagccccggaagggcgtgggtggcggggcggggcatgggctgatgactgagctccgcctggacgcgtccaatcacacagactcaccgacctccacttgcacacgcggcaggtgccgtggagagccgtgcacaaggatctggagcgggacgtcgcgccgcaccccccggaggcgccgcccccccccgaggcgccgcaccccccaaaggccctccacccccgcctcagcccggagagcaccccgcgcgccgggcacatgggcacgcccagggcgacgggctcggccctccgccgcgcctggccgtcccacctcgacccggtggggcccccctctccgcggcccccagtcctcatccgccgccccagggcgcagatcgctgcgcagggcctgatgcctcgtgacgacggcgggcgccttgtgggccaggaggccggcccccaaggccggatggcggacgcacacgacgacggggcggggggcaccgaggtcttcggcgccgtgcaggggctgctgctgcagctgctggcatccaccggcctggacgtggcgccgccgcccggctctgccatcccacccccggccgcgccgcagcagagcgcgtcttcggcctcggcggcggccgtggcgtcgccgccccgtgcggtgcagccctcggcgggcccctgcccgctccggccacccagcgtgggcggggggaggcaggggcccgtggactcgggggcggggagcgggggcggctgccgccctgcggcccggggctgcgaggcgcagagcggctggtgcctggacggcctggccctgcgcttgagcgtcatggagcgcgggtaccagcagctgcagagggtggtgcaggtgctcctcaaggcggacctggagctgagcgccgaggtccacgccctgcgcagcgcctgcgcggggtgctgccacacgatggtgaggcctggtggggatgccgtgccccggatgtgttgagcaaaacccggcgttctgcaggctctgttgggatggcgtggtgacccatgtcagcctgtgcggtgctgcaagggtgtggcgatggatgggcaagcatttgctaaagcattcccttcccctccctgctcggtgtgctgctccccaacgtgcaggcccaccccggccgccccatgcccaggaggtccctcaagagatatcgtgacgagggcgggttcctgggcgcggtgcatggcgcttagctgcctggcaccaacccccgatgagcgtcatgcccgggcagcctggttctgagacactgctcagaggatggcgccccactcctggtaacaacccttgttccttcatccacacggcactggatggaggcgacacccgtcagcaagccagcatggcctccttatggtccatgcccctcatcagtcgagcatgcagccaattgtccatttcagctgcacacctgcctcactgtcaagccttcactgaacagcatcgactacttgtgaaatgctcagagtacgcaatactgtacccccattttccaccgtccttcacacatgctcatcgaacctttgtgttgcatttgccctgttcccttgtttttcatgctggcgctccgcaccggcctgcattgctggacagcatgcacacccatccccaacagccacgcggttgtttttcaagaactcaggtagactccagacgcgtcccttgttatccaagcccgctgagcttatctttacgtgtggtgatttattttccaagagtgctgatttggtcttcagattgtaagaacattaccaatccatgtctggcctgatcactgcttcacctgttcaggaaagcacagtgcccgcagcgccttcttattcaccttgcccagagcattgcgagggagggctggcaggatgcacatccggctgggaagctggtaggcggggaggtggggagctgccctggcacgcaggtcagccagggtcagctccttgacatcgccgtccagggcaaggactgcggcgatgacctcgccataggtgtcatcgggcagccccagcacggcacactcctggatgccggggagcgccagcagcttgccctcgatgtctagagcggatatctgcacatgggttgagtcaggagtgagagtggggttggggggatgtttgagatgtgccagcaaactgctcgggtgagggacctgtgctgatgtacagcgagcagcctcgtctgagtggggaagcagcaactgcaatcgtgcggcactgcattacagggcatggaggggcagagcctggtggtaggcctcagtgccacatcgtccgcctgcaccaccggatcccaccctgctgctccgtgaagcttccggcgccggactcaccttatacccgccatgcttgatgatgtccacgctgcttcgccccagcatcctgtagtacggcgggtcgccctccacgaccgcctggtcgcctgcgccatgcaggcgtggacccagagctttcgagacgaccctactcaccgacagctctgtggcaagtcagcatatgcacagccttgtccattgggcgcccttccaagctcaccagtttgaaagtagccctcatcatcgtaggcatccctggtggcctcagggttgcgccagtactccttgaacagctgcgcacccctcacgcggatttcgccctccttcccaactgtatggggcgaggcaatggcggtgggtcgctgtggatcgcccagagcacatgctcgcccataaccccagcccaagcgatgcaccgtgcacagggtttccgcgagccaggcagcaagcgcagcgccatccggcagcagcaaaagcgcgctggtgctgccatgccctcggtgagcagcgagcgcgcgcccagcggccctccgcacaaaggcacccccacacctttgttgtcctggtcgaccagtctgacaccaagggcggggaagggaaggcccaccgtcccgactcgccgctcgccgcacagggggttgcccaggatcatccccgtctccgtcatgccgtaccgctccaagggtgtggctcctggtgtggtggtggagtccgaggcgcccatgaatacattggtccgcgcatggagcctgaggcacctggctcgtgtgccttcaactgccaccaccacagcgcgcgcccccacctgatatctctgcccaggccgcgagggtgggcttggggcacgccgcagacccacaggtccacaggcgcagtctccgggctgcttcgcgcattcccccctggctcgtggccggggcgccctcgtaggcattgatgaggaacgcatacatggtgggcacccccatgaagatgctgaccgggtcggcgctggactgcaagcaggcacatgggagtgctgttcaggattcacagagctgcacagcgtggcacgcctctgaggggctgagggagggctgacctgtttcacacgggtcaagctctgaccgcccccctccataactgagtgagccctcacagccccggggatgcgccccagatgactgctcacgcatggcaaactcgcttcgcctcagccaccctcccatcccagcgcagatcgggacaaaagaccgctctcgcagacttctcgccacggagctccttcgatgcatgtgcgtgtggtttccgcccaaaggcctgcacccaccgccacacgcacctggacacgctcccagactcgtgatggcgagaagcgcggcataaactcgactgcggccccggcctgcaggccacacagcatggcgacgacgatgccatgcacgtggtgcagggggagggtgtgcagtatgtggtcctcggcctgccacccccaggcatcgatgagggcgctcgtctgagcgtgcagaccccgatgggtgtgcaccacccctgagggaaagacagacgaagcccaggggggggggggggggggggggggnnnnnnnnnnnnnnnnnnnnnnnnnnnnnnnnnnnnnnnnngcccgcagcatgaccatcaggctgcacgcatgaagaggacactcagaggagggcgtctccacatggtaggcacgcacgagccacccctgcaagcaagagctgaccccatccatgggagaacaagcatgacccgagtctggtgcaacttgctgaggcagtacacaacctcaggccatgcgcaggagccctcagagggtgcgatccgtcacccggtgatctccgccaaccccatcccgcggcaccccacacctttgggcctgccagtggtaccactggtgtaaatcatgagcgcactatcttccggcgcaacattgtccagcaggtgtttgaggccctgtgacccttgctgaggcctgctcccatgagtcagtggtcgacccacggggacgactgtggtccccagggccttccccaggtctgccatgcgctcaaagtggcttggagaggccaggattgcgctggcgcccgagtcgttcaggacgtacttcagctccctgcggagggggcatggagaggggggtggtaagaggtgggaggatcccatgcacaaccatgtagttgggcctgcgtcagcgcagacacggatttgagggctggggggctggcccggagactcagcgccaccttcccgctgggcagcaaagtgtcacatcgacgcactcgtcggggtgggccagacacaggggaacagcgatgcctctttgcagccaggtcgcccacgtggcggccacatagtatcgtcccgggtcacacatgatagccacgcgtggctgatgaggatctgtgcactggtactgggggagccccagcgtctgctgcagggagtttcccatacacatggctgcagccagcacatccttgtagctggaggacagcatgggggtgtcggggggaattattgggtgccgtcactatgccggattccatgaacacaactgcaccctcctgcttccggcatgtcttcgtcctacctgtgagatcccgtcgtatcgacaaccgctgtgcgctggctgtgtcgaagggcagcgcggatagtattcattccggtcgaggagcaaactccggccctttgcaggcaggcatgctaggcctgctggaccttccctggaatcagatatgcgcagattgtataagcattacgaacgacagggcaccagtatgttcagatcgggaggagaagcatggcggagcggagggggacgtagggaggggccagccacgtcatcatttgacttgatgcagccaagagttgtaaacctaggcttctaactaaggtacaaccagcatctgaagagtctctcagatgcatccggattggaagagcgtaatgcaacatcttggcgtaacgcaaggtatctgcatcaccctacaacacattgctcacatcaagtccaggacccgtacgaatgcagtgtttctcggcgagtgttgcaggcaaggcctttccattacaatcgaagacgaaaatgttggaaatccaggcacatgcaggcatagaagaatccgcagcagggcttcaagtggatgtacagtgttctttgccatcagaatgaccacatggcttacatcctacaacaacattgtccccactggccattcaatccagtttgcctgcagcgcagaggtaagacccccccactacaagggcccgtgccaggcattgggccctaaatcttggagggtgccgggtctgatctccacgaaggtgctgtcagcgtcgctcacactgccaggtggcctccagctcagcgcctggctccagaactccacgatggccaggccctcctccctgctcgcccagaacttgtgtccgcggccggaaaaagggcgcgcctggacctcataccgtccaggtcttgattccaggtaggcctttgtggccagcacctccctctccggcacaacatggtcacatggatcgtaggtaagcatcaccctcgacacgccttccccctgctctgatcgctcctgtgcaagggcggggtgggttgacatctgaatgaggatggcccgaggaggtggtgaagtccgagcaacacatggcaaggacaaggaagcccaggcatgccagcatgcttgcaatggataaggaaataccgccccaagctgcagctagacggcctggtcgggcctgccggcagaacatttgacccaccctgggcacttctgtggatttgctgtgggcatgcagccactccggaaggaggccagccgaaaccgcaacacagctccctagaccgagccccggctcaaggagtctcgtcagctccagggccactgtgccaccctgagaaaagccgagcacgtggcattggctggggtgccaagcacctttctcaaacaggtgccgaacaatcagcgctcggagggaggtgcacacagactccaggccagcaatccgctgcttccctgcgctgctggcctgcagaggagggatcagcagggcaggaacttggactctgaagggccaggctgcatgttcaatctcggtgtccaaactgtcgtagaggctcaccatctcccctccctcaattcaccgtcaagatctcgaagtcggcgtcgaatgcatcataccagcaccgtccgttctccgtgaaagggacagcgagtggtcccctgatggccaagaagtctgtctgggaatgcagagtgcagatggggttgcaagcggagatcccggtcccaggtcggtgccgcttccttcaaccaacgcacccctgcacgttgactactcggctaagaagcagttggccaccatgctcctcccagattgactgccttgtcagctttaaggaacctctccccttgagcaatgatccagagctgcacctgggggatcttcaggctctgggccagtgacgcatagggctctggactgtcgcccagcccatgcaacatgagcatgagattctgggaacagccgtcctgtgagggcatgtagcgccagtcccatcctgttgggggggtgacgcaggcagcccttcgaagctcgtcggcaccaggtgcctggcattgcactgacagctgggcttgcagtcgtcgtagcagtgccttggcggggtcgctgccaggctgtctggacaggcattccctcagcgacaccacagccgctcgtgggtcctgcatggcttccagcgcctgggcagcacggaagctggacttggcatggcccctgaggaacagcggatggatgcgggggcagcaaagatggattggggactgctgcacagggcttgcctgtgcaagcaggaaggtctgtgggtctgaagctgacggcgcttcactttcagccttcggactgctgttgagaaaaggggacaacccacccgggtagtaggttcaaggcttgtctggcatcttgcagggcgtccttagctcgtccgagcttcagcagcgtcgcagacctgagagggacaagaatcctgggaggtgggcgagcgttgggcccaggatggcaggagagcatgtgatgcaccccggtgagcagggcaggtacccgctacgaaccgattgcagagaaggacgaccttcgcctccgggctaagtccatgttctcgaagtccggcagtgtaaaagcgctcagcctcggaccaatggccggactggtagaagctgttccccttgtccttcagggtcatgatcacatgtctgtgacactcagagcagtatgacgacgtcacaaactacatgtggacacccgctgaagcaaatctacacgtgtatgagatggcgttcgtcgcgctcagggtatggtccttcggcctgcgaggacgttcgcgacctgtttccagatggagccgatggcggatgcaaccataacattattgcacagcacccgcaatttcattggtattaatccccaggttttctgtgatgtgccacaaagcatgtggtgggcatacttgcttccaatgcggcccctccggtacccttgacgcgcgaagcgaattctgcaaatttagcccacgaccctcgcttatcgatatgatcatccacgtattataaactcctactcactagacgattcttaccctgtggaggagacactcagggctgctttattagctgccctcaccgttcactctctaacaagtggtctgggacggcccttgttcatccgttcaagtagaggcttgagcctgatgtgaatacaaatattcaaggtcagggtgttcttccgctccaacagtgttctccgagcaaggcgtactagacgtacaagtctggatggttgggccatgcacgacgtacgacatgagaccacacagaggaaacaattgacgggcgcgtttcggacgccttgttctgtcctcttttgtcagaagcgcggatgccggttctccggcgtacttcctgtctgtgcgtcgatccttgaacaggcactatcgtgtcattcaagtgatggaggcgcgtgtgaacggtcacccggcacaggcgcactcccggcattactttcggaagccacgactgcccatctaccatctcattctcgagacacaatggtcgaattccatgtgctggagggcccatacagagcacatgctcgctgatggcgattgttgcgcgtgcctaacgtaattcagtatgcaagaaagttcggaaggagcggtgagcccgtatctgagacttcatcactccctgaatgctctgtctgtatgagtgcctggcacaatagaggcttatccgtaacgtaccggcattacaaggtaccgggcaagagaaactgtgcaattgggtgcgctgcggcgtcatctggtccgcttgccgcggcaatttgcgtggacctagcgagccgctgaaagggtcaccaacagtcgtgtatagaagggcaaagccatgaattaggttactccatccattgtaagtcctttggatggatgaaatggggcactccagttttgcccgcgcgtaaggtggactctctcagtatgacaaggggtaatgctggcttccaggcgataccccctcccgggtcagcgttgtgctgtcacaccctccaatgcaggcggtgcgacctcctgtcccatgtcgcgtaagcccgtcatggagggctcgacttcgggaaaccctgccaacattcgcttggaggttgttatccccctatggctgcacgtctcggactcggaaaggtgagctccaggcctcgccggacacagcacgccgtagctatcccgggactgtcaccagatgccacacatcccttgctactgggtccgacaggtacctgctgctggaggatccagagacgggggatgtgctcatgccactcatctacatgaaggccctgctggaggcgaattactcccgcaagctggcttccctgaagcaccgtgtcgttacttgtgagcagggagggtgttgggcaggcttggatcccaggtaccagccctttccctatcactgagatgtgtgccgcccggtcgtccagttcccccagaaagtccactggcggagaaggacggtcagttgtattggcagtgggcctttgagtcccctcacaatgtcaaagttgtggttcgcaaggagcttggtgaagagaacaccccccaggtgcgttgtgacctgtcatcttgccagtaatggggactttggtggtagagtggcagcatgtgagggtttccctgggcatctgtaggaagatggagacctcatgtgcttatcacatgtgtattgagctggtacatgattggatagggaatggatggcacttgctgttgagagccagatgcacatgaccatggttgcgtcacgcttccagctggcgaatcgcgcgtttgccggagccctggcagcgccatgacatcgtcactgcaaggctcgcctgtgtgactcacactggtgttaccccccccccccccccccccnnnnnnnnnnnnnnnnnnnnnnnnnnnnnnnnnnnnnnnnnnnnnncctgcgagtcgtcctgatacccatcgtgtacaatgccctgagtcagaagagcatgctgcggtccttgggtcttttcaaggccttgcacaggtgtggcatggggttggagcgcatacggcggggctcgcgctgcccaatcccgcccccaaccccaacccctcctggacacactgcatgcgcacgtggtgtgtgggcatatggtgccggcgtgcggcgggtcctgctccaggcatgtcctcaaacaacacccccctcccaccgccgctgcagggccatgaagcagtctacttacttccccctgcttcgaccaccccccgatgacttcatggaggagctggatgctgagctagccaaggaatcgtgagtcaccggcgggcagcagggcaggggatcaggtggctgcgcgctctgagcatccgtcctgctagctgtctgggcatgccccccgtctccagtaccacgtcgccccgtctgcagggtccaaccccctcttttccacggaccccgcaccatcgaggcctcggcatcaaagtacatgttcatgttccaggtggggttgcgggagcgggagacgaggtcgaggagggcggcgaggcgcccacctggatgcccagcgcccctgcctggcggcccggggggtggaacggcttgcagtgcgacgccaccatcccaggacagcgacacaccctactcccctgcaggaggacgaggagcaaaaggcgccggacaccaagcggcactgcacccggaccggcacaccgctggtgagggcgcggtgggtggcacagatggcgccctcggtgccggcgtggcccatgtcggatagagctcagacccggaacggtgacctgtgtcccccactcccaaccccagcaggacaggttnnnnnnnnnngggttggcacggatggcgccctcggtgccggcgtggcccatctcgggtagagctcagacccagagggtgacctgtgccccccactcccaaccccagcaggacaggtttgggggcgatgtgtcgagcaagacccccacccccacccctccagtgctggacgcggggctgggcgccttccagcccccccgcgccctctccccgggctcccgcggcggggatggcgtgggcccgtcgtcgggcccgggccccgggctcccgccccgcctgctgcgcacgctctccgggcaggcggccacccgcaccccgcccggcgcggtggcgtacggccaggcgtttgagctgggcggcggccccctcacccacggccagcgccccctgcggcccggccacggcccgcaggacgtcaacatgctggcgctggagctgctggacgtgaaggaggtgcgcgaggcggggggaaaggggagaggtggatggttggaggcggggcgctggatggaggctgctgccatgcgannnnnnnnnnaggttgatcggggttgcaggcgcgttgcagggtccctccctcacgtgtcagtgcagggacgcaagggttgagggatgggcgcacaaccctcacaccccccnnnnnnnnnnaaaaggggagaagggggtggttggaggcagggcgctggatggaggctgctgccatgcgacgtctgtgagcccatgcgggcgcctgaggcggtgtggcacagacccatcgggccatggccgaccctgcccagctgcagggaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcagctctatggcatggtcctgggggatgggtaccagtcacctggccccacggcgtctagctatccggtccccacgcccggacagggcgcggtgatgaagctggagccgggcgcccccaccctgcactccaccgccctggcggctacataccagcgcccagggccgcgtgccagcggcggcagcggcggcagcgggtcgaccctgcccggcgcccagagctggggcgcggcggagcgcttccaggcctgcctggccccaccgacccagtacggggcggtgcagcaggggcagcagcacgcctgggccagggcgccgatcccggcggaggggccggggcagagggcgccatcaccgtatgggcgagtgggtggtcggggggagtacggcgccatgcacgccgacggcggagcactgccctcgtcggtgagtgggatggccaggagttgggcggtgcgagctcgacggggatgccagcgccgcggcgtgcgcagcggcgggcgcggccttgcccctcattggctnnnnnnnnnntcggggacgccggcgccgttgcgtgcgcaacggcgggcgcggccttgcccctcattggctggccgccgtgccccttttgcccctggcgtgcatgccagcctcagcctcaaaccgtgccatccatgcattgcagnnnnnnnnnntccttttgcccctggcgtgcatgccaaccccggcctcaaaccgtgccatccatgcattgcagctgcagacgtccgtgcccaccccgcctccgggctccacggacgccgccctgtctggcctgctggacagcagcaccatctccgcgctgctgtgccacctgtccgacaagcctccagacgatccgggtgcgccgcggtttgagatcctcggttgaagcgcgtgcggagggctgtagcccccaccgccgcctgggccgattcagggacaccgtcgccgcgtatggaggggtggcctgggcccccccctctcccccccaccctggcccagcagctcacagcacacacacacacaccgcccccgccgtgtccgcccccaggctttgcccgagtgctggaggacgcgatgcaggacaccagcagcctgaacagcagcctgactgggggccacccaccctcacacccttctcacccccacctcctcagccagctagtgtcccttacccagcgactgccccccagcatgtgaaaggagccagcgactcgccatctgtttgtcgttcccgctcccacccccctgtttccattgcattgtctgacattgccagtgcaggcacattgctgctggattcccccgttgaacatcaccctctccccagggaccctgccccgcacaatctgtgcccagcacacatccagttgatgtccctgtcgcgctacgtctcnnnnnnnnnnttgtttgtccttcccgctcccgcccccctgtttacattgcgttgtctgacattgccagtgcaggcacattgctgctggattccccgttgaacatcaccttctccccagggaccctgccccgcaccatctgtgccccgcacacaaccagttgatgtccctgtcgcgctacgtctccccaggccatctcaccgctccaaatcacggtcgcacccccactgtgaatctgtgcgtcgcatcctggcaagcaacagaggaggccgtcctacatcacttgtaaacctgctgggtgtgaagggggggggatacaccgaggtggccaacggggnnnnnnnnnncaggccatctccccgctccaaatcactgttgcacccccactgtgaatctgtgcgtcgcatcctggctagcaacagaggaggccgtcatacatcacttgtaaacctgctgggtatgaagggggggatacaccgaggtggccaacggggacgatcaaggggaacgcaaaatgcctagtttacaggggggggggggaggtgagcaacaaattccctgggaagtggggccgggagcggcatccctgcacaaaaatgttcaaaacgagcgctcgaccgggcacgctcggcccgggcgcgctcagcccgcgatccannnnnnnnnnatgttcaaacgagcgcttgaccgggggcggtcggcccgggcgcgctcagcccgcgatccactcgtgccgcagcgcctcggcgggggtcagccgctcctccgggcgccagcgcaggcaggccgcgacgaagcgcacgaagctcgcgtcccggcccacgacgccgcccagcgcgcgcgtcagcgtgacgctgccggggcggtgcagcgtgtccttccccagcagcgtggtgctccgcggctcgccgctctctgcggggcgggggccgaggcaggggagggcgggggtgatcacgcaaggattgattgctcgggagatggggagggggggggattgggggcgcctctggaagccatcgacgtgggaggccacagtcaacacaccagtcccaagccgcccaggtgtacccctgcaccagcccgcccnnnnnnnnnnattgggggcgcctgtggaagccatcgacgtgggaggccacggtcaacacaccagtcccgagctgcccaggtgtacccctgcaccagcccgcccttggatgcaccatcctgtcgaccaccgccctcaccggggtcgaagaatatgggcgcccgtgcagagtacagggcaatgtcgctgggcggtttgcccagcacctccatgatacatgccagctgctccttctcatcctcccctggcatggcgtgaagggtggggggccctgggccgcagatgaccggccagaagggcaccgtgacgcccagctgcgccgttcctcccagccaagacgccagccagggttcccagcccagcaaacgagagggtgcccacccgcaaaccaccaccttcccgcgcctcacctgggaacaagggggcgcccgtcctgagctctgccagcacgcagcccaggctccacatgtcgatggcgtgtccgtagggctcgcccaggatgaccttgggaagaaagggggtactgaaaatgagagggacactggaacaagggtgcaggcggcctcacggcatgccggggcaccctctaggccacctgatgcactccattgccctctgcagagcctgcccaatccccgccctctagatgccaccccctgcctcacctccggcgcgcggtagaagcgcgactggatgtatgtgaaggctcgcttgtctttgaagcagctgctcccaaagtcgatcagctgcagggaagacggggggtggcgtttgggaagggaacattgtcatccaaaaggtcatgcctattcgggcacgcaatggccggccggcgatggatgtccatgcggcatggccgtcccggagcccctaccttnnnnnnnnnnagtggcgttcgggaagggaacattgtcatccaaaagcaaatccctatacgggcacccagtggccggccggcgatggatgtccacgcggcatggccgtcccggagcccctaccttgacgtcgctgcgctttctatccaccagcatgatgttctcgggcttgatatcgcagtgcacgatgccggcccgcaccagggcctccagcgacgtcagcacctggacagccaccctgcgcaccnnnnnnnnnntatgtcgcagtgcacaatgccggcccgcaccagggcctccagcgatgtcagcacctggacagccaccctgcgcaccagcagcgacccgcagccctgtggacaatggagtttgaaaggacacgggtggggaggggtgcgagcgcagagctatgtgtctgcatgaacatgggtagaatcgagcggtggacgaggcacaccaatgacatgcgccacacccaaccctcctcctcccaccaccaggctgcgcctgtcccacccacnnnnnnnnnnatgcgagcgcagagccatgtgtctgcatggacgtgggtggaatcgagcggtggacgaggcacaccgatgacatgcgccacacccagccctcctcccaccaccaccaggctgcgcctgtcccacccaccagcattcggcgctcctgcagtagctcgtacaggttgatggacagcagctcaaaggcgatgcacaggtgtcccctgaaggagaagcagcccagcgccgccacgatcccggggcagccgccctgcgaggacaggtgcgacgcatgggggttgaggggaggggactgtccaggacttgagaaagaaacctgcttcaacgtgtcgccattccaggagcagccaccacaaccactctgcgctacaagtcaaaatgccacgcaggtccctctcagcagcacgcccccggtcctcctctcccacaccctcacacttcacagaaaggagacgcctcccccccaacacacccacacccacacctgcagcccctggagcaggctcaggatgcgcgtctccaccagcgcctgcttctggaaccgcttgcgtccgcgcatgaccttgagcgcgacggggcgcccgcccgcggcgtggtccgcgcagcacagcacctggccaaaggagccctggcccaggacgcgctggacctcgtagcggtaggccacgtggtcccccgccaccgccacgtagtcgccgcgctcgtccacgaacacggggtcggggtccaggcccggcgcgtggttggccgtgaccttggccacgcccggcgcgcccacgaaccagacccgggggtaggccagcacctccgcgcgctcgtaggccgtgagcaggtgcccgtgcagggccagcgcctcggcggccgccatgtgcggccgnnnnnnnnnnnnnnnnnnnnnnnnnnnnnnnnnnnnnnnnnnnnnnnnnnnnnnnnnnncgcggagagcgagggcgcggaggccgacgagcggtgcaccacggtgccggcgggggcgggggc

SEQ ID NO: 37968 - DNA, 61 bp, Chlorella protothecoides
tggcacgtattgcgcgggaggctctggaggacgctgccatggatggcatcgtgtacattga

SEQ ID NO: 37969 - DNA, 104 bp, Chlorella protothecoides
ctggcgcaaacccccaggtggggaaggccagcggcgccacgacggctgggacgccgtccacgacgaccctgagtcccagcggcccacccgcgtccgtccccgcc

SEQ ID NO: 37970 - DNA, 76 bp, Chlorella protothecoides
cgcagcacagcacagcagtactgtccctgctagcagatcaggcgacacacgttctcccctgtccgcaccctgagcg

SEQ ID NO: 37971 - DNA, 65 bp, Chlorella protothecoides
cgtcttcccctccccctcttgcccccttccttcctcccattagtcagccatcagggctgaccaaa

SEQ ID NO: 37972 - DNA, 61 bp, Chlorella protothecoides
cgtcatggggaaaaggacgtggaggggccgactgccatgcggccctgcagcacagttccga

SEQ ID NO: 37973 - DNA, 113 bp, Chlorella protothecoides
gactttgtgcgcatgctggagtcgatgcgggaggaggtggaggcggcggcagccgatgagtagagatgggggcatgcccttgcccggcgtgcccctgcccctggaccttgcag

SEQ ID NO: 37974 - DNA, 76 bp, Chlorella protothecoides
gacaagctctcattgtcagctacacctcccccacctctacccccgtcgccgtctcctcctcccagccctccaccat

SEQ ID NO: 37975 - DNA, 61 bp, Chlorella protothecoides
accccccggttcgccattagaggcaaccaaatgcgccagcgatatcccgtccacgggaaga

SEQ ID NO: 37976 - DNA, 61 bp, Chlorella protothecoides
cactccatatgagacattgcggcagcgtgacgaaagtatcctgagatacaccaatctggtg

SEQ ID NO: 37977 - DNA, 61 bp, Chlorella protothecoides
ccatgagttgggtctgtgcagtgccaatcaacctgccacagataagcctaaccggcaacga

SEQ ID NO: 37978 - DNA, 109 bp, Chlorella protothecoides
ccgcatcatgctctgccaggagaagaagtctgatgagaggcctgcccgatccagcgttgtcgcggcctgcggtgagtttaggggcttccctttgtggtgcagcgcgctc

SEQ ID NO: 37979 - DNA, 77 bp, Chlorella protothecoides
ttcaacagcgctccccgattgaagagatacgtgtcggtctgttcacggggttttgcgagggctgcgattgatgcaca

SEQ ID NO: 37980 - DNA, 97 bp, Chlorella protothecoides
aggtgtgcaagcacatgggtgggtggtggacgttggtttttggcaaagtccagatggcgatccaaagattatccttactttgaaatcgtgcacagct

SEQ ID NO: 37981 - DNA, 71 bp, Chlorella protothecoides
tgcaagctcaagacaggtggcctccattccgtaaggactgtgtcccagcggccgggagacaccaagaccgg

SEQ ID NO: 37982 - DNA, 61 bp, Chlorella protothecoides
gtatctccgtccgcactcgacgcacttgtatcgctctgcccatgtgcagtccgtgatccct

SEQ ID NO: 37983 - DNA, 61 bp, Chlorella protothecoides
gcgagcgccgtggccgggcgctagaggcggggaagggccgggctggaaagtgggcagctgg

SEQ ID NO: 37984 - DNA, 77 bp, Chlorella protothecoides
acagcgcctgcgtgtcgtggacgtgagacacttgaaaggggggatttgcttgggcgatcggcatgggtccggtgtga

SEQ ID NO: 37985 - DNA, 129 bp, Chlorella protothecoides
ctccctccctggaccttgagccggcacggggagatcacatggacatccggggggaggagccggggccagtgtcggccgagaatgttcaagctcatgagaccacgcaggtgcatgggcacccacacctgg

SEQ ID NO: 37986 - DNA, 61 bp, Chlorella protothecoides
ccacggtgcgcatggttagtgtggaggggggggaaagtttggcagggggtgcagtctcttg

SEQ ID NO: 37987 - DNA, 69 bp, Chlorella protothecoides
cccccccccccccccccccccccccccgtgtctgacaatgggtgcattgcagcagacagaatccccccc

SEQ ID NO: 37988 - DNA, 426 bp, Chlorella protothecoides
  modified_base (103)..(357): a, c, t, g, unknown or other
ggtacaaccctgcgttgaatggatgcccgcaacctgtgctggcccgctccttcatcgctgttggcatgtttgtcacatcggccacctgctcctctaccccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccggtctggaggtgacatggccacctccatcccccatggcacctaggttctgaggcatgcatactgg

SEQ ID NO: 37989 - DNA, 80 bp, Chlorella protothecoides
aactttgtgatcacagtgtagtggcattgcctgtcctcgaaccaagccaccggcgtctggaagtcgcggggattggccag

SEQ ID NO: 37990 - DNA, 121 bp, Chlorella protothecoides
ccaggtggcgaccccggggcgggggcctgttaccccgcgcgaccccggtgcgaccggcaccccaccctccccgcacattgtgggcgtggatgtgcaggcgacgccccccggctcgcaggcc

SEQ ID NO: 37991 - DNA, 69 bp, Chlorella protothecoides
ggtgtacgacacgaaagaaggaaggctccctactcgccattcgcgaaggccacgtgaccgcagtatggc

SEQ ID NO: 37992 - DNA, 61 bp, Chlorella protothecoides
atggtggacgaggcgcatgaagagcatgcgaacctcaggatgcagcagctgcggggaaggg

SEQ ID NO: 37993 - DNA, 49939 bp, Chlorella protothecoides
  modified_base (290)..(299): a, c, t, g, unknown or other
  modified_base (427)..(436): a, c, t, g, unknown or other
  modified_base (607)..(616): a, c, t, g, unknown or other
  modified_base (788)..(797): a, c, t, g, unknown or other
  modified_base (1432)..(1441): a, c, t, g, unknown or other
  modified_base (1545)..(1554): a, c, t, g, unknown or other
  modified_base (2654)..(2663): a, c, t, g, unknown or other
  modified_base (2760)..(2769): a, c, t, g, unknown or other
  modified_base (3662)..(3671): a, c, t, g, unknown or other
  modified_base (4347)..(4356): a, c, t, g, unknown or other
  modified_base (6574)..(6583): a, c, t, g, unknown or other
  modified_base (9248)..(9290): a, c, t, g, unknown or other
  modified_base (9366)..(9375): a, c, t, g, unknown or other
  modified_base (9543)..(9553): a, c, t, g, unknown or other
  modified_base (9614)..(9623): a, c, t, g, unknown or other
  modified_base (10343)..(10352): a, c, t, g, unknown or other
  modified_base (11767)..(11776): a, c, t, g, unknown or other
  modified_base (12205)..(12214): a, c, t, g, unknown or other
  modified_base (12826)..(12835): a, c, t, g, unknown or other
  modified_base (14050)..(14140): a, c, t, g, unknown or other
  modified_base (14726)..(14735): a, c, t, g, unknown or other
  modified_base (16886)..(16895): a, c, t, g, unknown or other
  modified_base (17333)..(17342): a, c, t, g, unknown or other
  modified_base (17989)..(17998): a, c, t, g, unknown or other
  modified_base (18444)..(18453): a, c, t, g, unknown or other
  modified_base (19598)..(19607): a, c, t, g, unknown or other
  modified_base (19745)..(19754): a, c, t, g, unknown or other
  modified_base (20015)..(20024): a, c, t, g, unknown or other
  modified_base (21325)..(21334): a, c, t, g, unknown or other
  modified_base (22243)..(22252): a, c, t, g, unknown or other
  modified_base (24716)..(24725): a, c, t, g, unknown or other
  modified_base (26020)..(26029): a, c, t, g, unknown or other
  modified_base (27199)..(27208): a, c, t, g, unknown or other
  modified_base (28188)..(28197): a, c, t, g, unknown or other
  modified_base (29985)..(29994): a, c, t, g, unknown or other
  modified_base (30687)..(30696): a, c, t, g, unknown or other
  modified_base (32117)..(32126): a, c, t, g, unknown or other
  modified_base (32820)..(32829): a, c, t, g, unknown or other
  modified_base (35216)..(35225): a, c, t, g, unknown or other
  modified_base (37290)..(37299): a, c, t, g, unknown or other
  modified_base (40160)..(40169): a, c, t, g, unknown or other
  modified_base (41025)..(41034): a, c, t, g, unknown or other
  modified_base (42175)..(42184): a, c, t, g, unknown or other
  modified_base (44330)..(44339): a, c, t, g, unknown or other
  modified_base (44486)..(44495): a, c, t, g, unknown or other
  modified_base (45274)..(45375): a, c, t, g, unknown or other
  modified_base (46846)..(46855): a, c, t, g, unknown or other
  modified_base (47310)..(47536): a, c, t, g, unknown or other
  modified_base (48191)..(48200): a, c, t, g, unknown or other
gggcgacgtggggccgggcgcggcgccggcgtcgccgggcggggcggggaagaggcgcagggcggccgtgcgggggggctcctccggccacaggtcctccctccccccgcgcagctcccagaccagggaggtggagccctggacgagggcgcggtgcagcagggggaggcgcagcgtgcgtgccagctggtccagcagggtgcacagcaggcccagcgccgcaaattgctgtgatggggaggggaaattggggggataaggggggagcagagggtgtgctggggtggcgnnnnnnnnnngtggggagggggggattgggggggaagggggggagcagagggtgtgctggggtggcgggtcaagtaagagacaatggggggaaggtaaccagccaaagagggtctgtcgccatgggccagggaccctnnnnnnnnnntaagtaagggacaatggggggaaggtaccagccaaggagggtctgtcgccatgggccagggaccctatgtcacataagcatactgcatatgacaaaactcttcatggaacatgtgccgagccagcgttgtgtgctgcccctcatgtaaacacagcaaggatggatggacannnnnnnnnnctcgtggaacatgtgccgagccagcgctgtgtgctgctcttcatgtaaacacagcaaggatggatggacagcctgccccgcccatggtctttcgcttccctcccaccccctctcttccgctgcaatgatcagcctgcagccgttcatccccttccggccaccgcctctcacnnnnnnnnnngtggtccttcgcttccctcccatcccttctcttccgctgcaatgatcagcctgcagctgttcatccccttccggccaccgcctctcaccggactggtggggagcaggacctcggggtcgtcgccggggtccggcaggggcagcgtggcgatgaacaccagtgtggggtgcttgtccacagtgccggcgggggcggtggcgctgggctccaggatctggagggggaacacgtccaacagccgctggatgatcctgtggcccagggttgtgtgggggggagattggagtcgtggatgtgcatgttggcacagggagttgattcctgggtgcatgcgtcaggtcacagccgcagactcgaggccgggctgggacccatccagcagggcaagccaagggatgccccgcaccgtcgctggagctccaggatcaggccgtccatctggaggaggccggactgggcgtggacgcccgtcgagagctgggcatcccgctgcagctgggcctggcttgcagcgagctgtgtgcaatgtgggaggttttggggggagtgatgaatgcctctcacacaaggccagtcccctcgtctgagcaggagcgcccagctcactccccacctcgggccagcagtgttccctnnnnnnnnnnagcacgagcttgcgccagggcatgggctgccctggcctgggcgatcttgatacgagccccctcctccgccacttgttggagccgcaaggcatgtgcctgggccnnnnnnnnnntaccttcttctgagcgtcgtgcagagcacgtgccctcctcctggattccaccagcagcgccttttgcctggcacgagcttgcgccagggcatggactgccctggcgtgggcgatcttgatgcgagccccctcctccgccacctgttggagccgcaaggcatgtgcctgggcctgggcctgggagatggagggatgattgaaagcaatgtggacgaggaaacgggcttcccccaactaaagcacgccctgcacctcgggtttgtaaaggaggagcaaaacatgaccagatgccacaagccacaccgcacagcgctcccgcccaccttgccatggcaagcctccgccaagtgatgtagctgggatctatagtcgttctgcagctgcgaaagctcttctcgcctcccctccagatacttactaaagtcctgggcgcacaagtatgttctccgccgggagtccccgcacaactggcatcccttgtgcggcgggccgggagcatcggagggcattcagggaatcacatgaaactatcttggttattgagcaggccttgcggcttctggatgcaccaatttggtatatagttaatatttgatcacttctttctccgacaccctttcatttctgtccgcgcgcgcgcgtgatgacttttctgggcgccgcgaccgacagaaaatcccgtcaatgtgaagagtacactttgggtactcaagcgcccaacacacattgagttcagctgcattgctggggtcgggaatattgcttggatctcatcagcaacacaacagctctgcaggtgatcaccgtccactgtctcagcgcgaggtaaggattcctcgggacattgttggggtgtcaatggatgtcacgcataccttcaccctgttgttgatgcgtgtggtgcagcggtttcacatagccacctgctgctgcccgcagaagggcttgctgaatcatggaccctgagattttggacctggtgcggtccgccatgggcaccgtgcgcgtcccgggcccaacagacaaggtgtacaaggacgagtgtggattcagcttcgccactccagactcccaaggcgggctgtacattaatctagccnnnnnnnnnngctcttcgagagtcgcctccctcctgcctccagttaactgcctgcatggcaatattcttgagcaagcgcccactcaccttcctcaggttggtcgtgnnnnnnnnnnacctcgaccagcggcggacggggcaagtactctacctgcacgaacgcggcatcaaggtgagggtgttggccactcttcaagagtcgcctccctcctgcctccagttcactgcctgcatggcaatattcttgagcaaccgcccactcaccttcctcaggttggtcgtgagtcagggcccaccgctgatgccccacccacccagctggccattggggtggagggtggcttcgacatcggcgacacccccaagtacgatgtcgtcaaggagcatgcgctcgtcctcctgccagcccagatcagggtacccctgccatgtgccgagctcccagagctggtgctgcaggcagtagcggctgtgcaggtatgtctgttggactcaatggggctgtgcatgtggggctggaggcacggcagcttatatgggctgccttggtgtgcgggtatcgcccactgatgctgtacaactcagaactggcgccccgttttactatcgcaagaccctgcaacccccccctgggaccccccctcctcccaacaggcgcatgacagtgccaggcgtcaggatgaggtggcagcgtggacggaggagcgggtggtgagcaagtatgcagagggactcgagcagctgccggccactcggagtatccccatggacccagcacaggtgccaagagggaggcgagggagtggtgtaggaaggggtgggcttcttgcccttgggtgtgtcatgttggatcataaggacaggaaaacgcgttctcagggtcgctgagctttccccaatagacaagggtgcgttgcactgccctggaaggtgttccgtacaccctaacctatacgattcctgcatccactggacccctcccacagtggaagtgcgacgaatctggcgnnnnnnnnnncggaaggtgtgccgtgcaccccaacctatacaattcatgcatccactggacccatcccacagtggaagtgcgacgaatctggcgccacggagaacctgtggctgaacctgtccaccggcttcatcggctctggccgtccggtgagccactttggggtgtcaaatgcgcgaccaccaagcatcagcatggggttgtggggcctgcatactgggtctttcgcccatgccagacctccacctcaggccctcgccaccacacgcacgagcctcactctcccaccccccctgtacagaactgggacggcacgggcggcaacggcgcagccctgcggcattacgaggccaccgggcgcaagtacccgctggccgtcaagctagggaccatcgcaccccagggcgccgatgtctactcctatgccccggaggaggacgacatggtgctggacccccacctgggccgacacctggcgcactggggcatcaacatgctgcaggtggctggtgggaaaggtgtcgtttaggagaaggaaagggaggtggggggcctgattaagatggtgggtgggtatggctgctgagcatgcccgctcactgtgactctgagaggaggaattatgagccctaccgcattgtggtccccttgtgcaacggtatgttgcgtgccctgtggtggctgnnnnnnnnnnaagaaggaaagggaggtggggaggtggggggcctgattgagatggtgggtgggtaaggctgctgagcatgcccgcacactgtgactctgagaggaggaatcatgagccctaccacattgtggtccccttgtgtaacggtatgttgcgtgccctgtggtggctggctggggccgtacattttcacagtgctgcgccgcacgaggacgccctccacccctttcccctctcccctgctgcagatggagaagacggaggccaccatgacagagctgcagatagcaaagaacatcgacttcgagtttgagcggatgaccgaggccggtgcgacgctggagcccttgtctggtcccgggtgcgcatggccgacctggggatggtttgggggcccgatttgggggtataggggcctgctgatcaggtctgcaagagatcaggacttcctggtgcggatggcatgcagtcctgctggtggtgtggtggggatgaggaagtcctgagggaggtgagcgccacgtgggagggcccacatagctcatgcctgtctcccaatgggctttcaacgcaccatccctctcattgccctgggcaggcatgtaggcctgaagaatctgggcaactcctgctacatgaacagcgtgctccaggtcctgtggtccttcccagagctggatgcgcggtaccttgcgcagtaccgctctgtcttcgagacggcgccgcgggtcgtgccagatgacctcctgacccaggtgaccattctgggagtgttgccactgtgccagacaagggacttgtgccatgggtttgaggggcgtccctgggtgctttaggaaaatcaatggcctgcaaggggtgcccggggcgtgctggcgacacgagcacgaccacacgcctgccttcgcagtgggtcaagctgggaagggcactggtgcacggcctgacgcccaaggaggaaggcgaggggggaggggaggcgacgcccctgacctctgtggcgccctccaccttcaagaccctggtggggcgggggcacgccgagttctccaccaaccatcagcaggtgatttgggagggggatgtgtttatgaagattgtggggtggttgggcagccggggctggactgcagttctagaccataggaaagggacagtcatatctgggcatttgcattggcagtactttctctcctggagaattgttgacaagctttgcatggcatttcagcgtcgccagcactcagctacagcgtcacatttgaatgtggtatgcagtacacattgcgcccacctcaagatcatactcacccccctggaccctcccttcaatgctctgcacaacacaggacgctgaggagtacctgggctacctgttggatgcgctggagaaaacggagcgcgccgcaggaccagaccgccttgtgtgtggaggggagactccagctcccaaggagctcgtcacatttgagctggaagacaggatccagtgcactgtgtctggcaaggtgaggaccaggcatcatcggccgtgtgccactgcaccctgccgtcgtgtacactggggtctcaccctcttgcctgtcctctccttctccttccattgaccaggtgacctacaagcgctccaaggcgacgagccttgggctgaggattcctctggatgcagcaacgaaccgcgctgagcttgaagctcgcgaccagaagcggcagcgactggagaatgaggctcctgagggcagtgttgacaagagggtgggctgcggtggggatggcgcgatggtggtgacagcgctgggggaatgaccctggcattttgcccttgaaatcagtgtctctggctcggctccctgtgttttctggtgtcagacccttttgccctgtctttcgcaggaggccaaggacgctgaccccccagtgctcccgcgggtgcccctcagcgcttgtgtggcggccttcatgtccgaggccaccatcgacgacgtgttttcagccgcactgcaacagaagaccatggtacggacacgtgggagtgggcagcctagattgcttgaaagaatcattctgtgcttgcttgcaaagcattatggcctatggcaatgattcctacctatgagggtcccaagtgtcacctcgtggagcacttgaatgacctcggtcagctggatctgatatgacagtccattcacagcacccaccaagctgcccactgctcctcgcccctgcnnnnnnnnnncatgagggtcccaagtgtcatcttgtggagcacttgaatggcctcggtcagccggatctgatatggcagtccattcacagcaccaaccaagctgcccactgctcctcgcccctgcacaggctgccaagcgaacgcgttttgcaaccttcccggaagtcctgttggtccaattgaggaggtactacgttgcagaggactggacacctcgcaagatggaggtagcagtggacatgccggctcggctgtcgctggaggcctggagatccagcggtgtacaggtgcgtgcattgcgctgagggggcagtaggattgattccctgatgcctggtctcctgagcacggttcaccgtgccttctgtgggtcttccacaccctccctgcactttgctcgtcccaggaggatgaagagttgcagcctgagacgcaggaggaccctggggctagtgccactggggacgctggctcgaacgcgcccgtgccgacactggtggatgagggcctgattgcgcaactggtgggcatgggtttctctgagccgggaagccgcagggcggccgctgcggtgaacagcgccgggcccgaggcggccatggagtggctgctggcgcacatggacgacgccgggataaatgaccccctgcccgacggcggggcgggcagccagtcccagcccagcgccgaggccgtctctgccctgaccgggatggggttcacgccggcggcggcgagtgcggcgctgcaggcctgtgcgggggacgtggagagggccgcagactggctgttcagccgcatggactccctggccgagctggagagcgcggaggtgagggattcggaggccacgcccttggcttcccgagtgagggacgggccgggggagtacgagctgtcggccttcatctcccacatgggggcaaacacggcctgcgggcattatgtctgccacatcaagaaggtgaggaggatgccgttgtccagatgtctatggacggtggtgaagatcttcctgcacggggattacttggtggtgccagggatctcaatgcagcacggcccttcagctgtcaaggcatgagcacactttgtccccttccacatggccattgtgaaaagctcaagaacgtgatttgcatgttgcccaccgtcttcctcactcgcgtactgcccatacattctgcagggcggccgctgggtgcttttcaatgatgaaaaggtggcagcatcctcgactccgcccacagagctggggtacctctacgtctaccggcgcgtcaggctgtgaagcaagaggcctgcaaccttggtacccagcatcaggctcccttgcttccaatagttttacaagtgtggtaaatgaccccagaacccggtctgacagttctcctcaggcaggacacagccttgcgagttcatcacatgggacgagaaaatgtatcaaattccctgtgctcatatacctactcagcagggctctcgtgcgtgttcgttcatgatctcaatagaatgagtcactgagggatgtgatcatggacgggacctacttccgggcacctgaccttggcctgccccaagcctcgctccaaatcgagggagccagctggaagctcatgagtttgcagccaccgcttggccgccgtacacgtgctggtacacccctgagaaatcgatggccggtccagcctccgtcgccagctggcggtacagctcggcggcggctgctgtcatgggcagggcggcgctgcactgcgccgccgcctcctgggccagccccaggtctttgctcatcagcgctgccgcaaagccgccggtgtactcccgcgaagccgggacgccctccatcacgccctgcaagaaaagaggtgggaggactgggcatcatgctgttgcagacactggagcgaggagtctcaatctccaagtgtccctcgacccgtcgcgttgcttgttggcatgcagaggccattgttttcccactatcctgcatggattgatagctcaccaggcacactccacagcactgcctcgcatgcctaccacccccctcactgtaatccccgtccctccaaacccaccggcacgggattgtaggtgtctgccgaccagcacctggccgaggagccgttgaagatcttggtgagattgcgggcgtccaggcccagcctctggcccagggccagaccctcggccaccccggccatgctcacgcccaggaccaggttgttgcacagcttcgcggcctgtcccgccccggcctccccgcaatgcaccgtggctcggcccatggtgcccagcaacccctgggctcgcgccacggcttctgccgggccccccaccatgaaggtgagcgtgccggcagcggcaccgcccaccccgccggacacaggggcatccagcatggccggcgcagtgctgggcgctccagccgccccctcaaccacgtcggggtggagggtggtgcgggccgctgcagccgccaggtcgcgggaggtcagggggtcgatggtgctggagtcgatgagcagggagggccgcagcgtgcggggcggcaggctgaagatcccggtggggcccaggtatgtttcccgaaccgcggcgctggagggcagcatcgtcaccagcgccttcagacctgtgcatttgtggaaggattgcgtgttggggggannnnnnnnnnnnnnnnnnnnnnnnnnnnnnnnnnnnnnnnnnntgatacgtccatgtcgttggagtttgcgcctgaacggacagacttttcagcaacgtcaggcccagtgcactacagnnnnnnnnnncgatacgtccatgtcgttggagttcgcgtctgaacggacagactattcagcaacgtcaggcccagtgcactacagcgtcgtgtgaagaagcatggaggtatgagatgcaccgcacccggggtggaggccagctgggctggagtctcggcctgcagagcccctgcttgnnnnnnnnnnnctaaaggctgggtgccattacattttttatttttcgtgaggtctcaatcgcgatcaagtannnnnnnnnntcacacactatcactctatatcccgctgcaagtagattccgggccatgcacgcctgtgagggaaggggacatgtttaaaggctggatgccattccattttctaattttcgtgaggtctcaatcgcgatcaagtaaagtactcacccccatgttgccgatgccgatgaagccgacgagggacggcatcgaagtcaactgcagcgatgacccgtgattccccccgtagcttgacttgggagttgcagagcgcagatcaatccccaatgctttctccaggaatgtcgaatccttccaaaggcggtattgtgccgagtgcaacttagtattcgccacgcggggtccgcggggtacttctgctgtcggaagtccagtcagcattctcgcgggaccctcggatccgagaaagcttttccgatacccacatatcaccagaaacagccctccttggatacctttcctcgaccaaattatcttttcatttgtaactgcagccctctcgcttacggtcgtaccttgggttcttccgacggagcaaagagtacttccgacacacccgcccgcgagcctgttgcctcctcgagactccgacctcagatctgctatgcaggtcagaccaataggtcactaggacacacattcagcatctcggacatgctggagtgcggtcgccccatcgcccttcgggctcatgtcccgagacaccactcatgtaccataccnnnnnnnnnnagtcaccaggacacacattcagcatctcgtacatgctggtgtgcggtcgccccatcgcccttcgggctcttgtcccgagacaccactcatgtaccatacccccaccccaatgcgcagttctcgcacgacacccctcgatccattagggtacgcctgacccggggacgtccccagaaaacccggcatgagcaggctgccgtgacctcgagcaatgggtgcaccgacatcatgctttcccccaccggtcgcgagtccttgggcccctggtcgggggcattcgaggaggcctcctccatccccaccagccccaccgtcttcagcgacgggagtggcgtgattttctccgacctcaggggctccccagtcccatccttcactgagggtcaattggaggagggagccgcccagaaggagcgagagctgatggatgcgccactccccagggactcgcgtcgcaggcatggcgccgcaccagcccctggcatgaacgacacctgggtggacaaccatgtccacccatccaacagcggaggctcccgtaggcgcatgcggggcctgatgcagcccacccgtggccaggcgtaagagtctcatgtcgtaaccctgtacctgcgaggcagtgcgccactttcaccgccaggacatcccctgatgcatcacgctgttcttgcgatgcaccccctctttccaagcaatgttttcctctgtaccaaagccagttggcggttgagccacgaagcgtcgccttcttgcactcagcacccgctgtgcccctggcccctttgtttcttctaacccgccctggtggcatttgtacctgcacaccaccacgagcatgtttgctccaccaattcccagcccagcaacgcatgcgacagccgggctttttttgccatggtcatttgtggccctcatctgtaatcaccactgtcctgcacgctgccgagcctgatgtctcttattactgtcaagtcttctgtaatactatgatttcacgctggatcgaggcgccaccgccctccactgccagagacctgatcgaaaagcctcccttggcttccaccgcgttcttgaatgcattggagctgccgccgacgccaaagtagtaggatttcgcggccacgagcgcttgcccacccgacctgagagcctgcaggaggtccacggccatgggcagggacatgtgcagtgcagaaacaaggctcacagctgggacgccagggcagactgaacgctgtgtgatttgaaggaccgtccaggtgccatgctctcctgtttcggcacctcatccatgacggtgcagatcacccaggtgcacagattgcatcatgccccatggccctctcaagatatagtatctcaggaatcgcctgaaacccctccgctcgcaccgtgtcaatgcaggccagcaggtnnnnnnnnnnacatgcccgatggccctcccaagatatagtatctcaggaaacgcctgaaacccctcctctcgcaccgtgtcaatgcaggccagcaggtagggcatgctgctcaggctgtagatggtctctgaggtgagcacgaggtcgtagctgccggccagcccctccgccgccaggaaggaatccagcgccgcccatggcccacccaggaagcgagccggcgggttctgtgccgctggcgcagcaggcgaccccctcgtctgccatgcctgccagttggccagcacactcggcgccgtcacttctcgcaggacctctggattatagtcctgcttgcaggcaatgggcagtccaggttgcggtgagcgaacgctgcagaggcggtgcagggtcccacaatttgcattggcggctctcgctgccaagcatcacaggtgnnnnnnnnnngagtccaggtcgcggcgagcgaacgctgcagaggcggtgcagtgtcccacaatttgcatcggcggctctcgctgccaagcatcacaggggggacaaggattgccccagaaaaaacagcccacctgaaagtggacctccgctccctggctgagagcaacaagccctgggatgccatgtccacagcccagctcgatgactttctgccccctgaaagccagtccgggcggggcatcttgcgcagctaccagctgaccctggtgcagacataggtactgggccaaatccatggctccctcccacagcttaaagcctcctgtataaaagtggggatggcaagagggccagagtctgtgagataaaggtccattgtgcatgagtggggagggtgcagatttcaccattctctcattctgaccctcatctcccgcacacgccacaggtcctgactcaccctcgtacttcccaggaacaaggtccgagcccgagcagtctgcatcctgcagaagttcttcagcctcttggctgcccagtgtgctctataaccaaaaaaagaatgaattctgttgctgcactagaataagtacattatctgtagttcaccaactgggcaannnnnnnnnnaaaagaaagagaatgaattctgttgctgcactcgaataaatacattatctgtagttcaccaactgggcaaccaccaccctagacccccaaccttcaggagcgataaatttgcagtgatgggaaacatctgaaagtcatatcgttttgccgcctgcacatgggaaggtgccagggagaacgatacttagagcagggacgataatgtcacagatgcatcatgctttccatgactaccgtaggccaacctgttcgaggccgagttccataactgcctcggctacaagcccagacgcagaggagggtgcatcatttataacctcgctgctctcttcagtctgaaaattgaacttgaacatagcccacagtggccagggccgcaacgtcggtgagggtggcttgaccagacgtcacccacgagctgggtcagtttgcgacacagtcgcgagccatcaaaaccgatctgtcatataactacaagtatttggatctggtgaagtgggtgccgctctaacagcgcagctaaatatggtagagatgacggtgctcgcaacatggcgcccgcgcgctgaagtcgcggtgcatgatctctctcagcagcttgttgatcccatccgcattcacgccactatggatgcgtacgaaaaggagtgaatgttttagagcaggcgtataccgaagccattggagtcctgcagaccgtcgatccagcacggatcacttctcgacgaggaccccaatcattcttgtgcacaccgcacacaagatcatcagacctgaaatctaactggatgtaggaaccgaacaggtggactatagacatggcgggctccttgcggctgtctctggtggacactcagctcaaacacttcaagctgagtcttcaagccttggccaagattggaacggatctcctcatcgaggccctgccgacgcgtgtgagcagattgcccagcttggcagaatgtttgcattcaactgattgtatgcatctgccatctgacctggcattggctcaggcccgcccgcaccatgacattcccgctttgctccctcctgcagctcatcctgcggtgcatcaacccctcccgctccgcctacctgtcgctcacctttcacgcctcgtgctttgatgcctatgacgtgttccgctcggaggtcgtccaagcgggggtgctcatgaaggtgagcgcaggagcggctgtgctggtagtgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagcaagtattggcagtattcaggactcagcgcattaatagacttaacctagaccttgggtccgacggtgactggctggaggtggtcatcttctgtgacagcggtgcgtgtggcggggcgcatcgcatccatcacctgggctcctcggcaagtttgacttgtcccccttgaacatccatgctcatgcgtttcccagcatggccacacttttgtgaagcatgatccggccgtcccgcctggcaatcagctgggcagtcagccagcactctactcctcacgcgcagggctccgcaaaacattccgcatgcggaccacggaggccgagatcctgcaggcgtcggtggatccagcagggttccccatcaccctcacagctgagacacagtccctggccaggtctgctggaggagtgggtgatttgcccaatgcatgggccagctctggccgatggagctcatgttggtttgagtgcaagcctgagaatgacgactcgtccaaacaactcatccctgcccttccgtctaggttgctggccagttttcagtggggcctggaggaactgaccctggttgctgtcccatccnnnnnnnnnnaggtgatttgcccaatgcatgggccggctctggctgatggagcccatgttggtttgagtgcaagcctgaaaatgatgacttgtccacacaactcatccgtgtccttccgtctaggctgctggccagtttccagtggggcctagaggaactgaccctggttgctgtcccatcctcggcatcagaccccaacggagccgtacagctgcacagccacgcagaccccagcagaggtggtatgggctgggggcgctgcatggtgggactggggggtgcagagcgggtcatgcgtgcctcatggcaattgacgtagccatgccacacctctcccttccccggggcatggccatctaatgtgccagatcccctttctacacagcagacaatggtcaaggcgctctcgtgaccaagctggccattgacgctcgccggactttcctcgagtaccagcacacgacgggtagggtgtaaggatgcatgctgatgggactgggcggcactgccgcagtcgtgcagcgcctggacctgattggccaccctggtgggcattaagcaggagacgaattgagcaatgttttactcgcaatgcaccttgactgttttctctgagttacagagcgctgcacccatccccactgcctcccggcatccctcatccgcccccagatggtgtgcggtctgtgaccttcaatgtcaaggacttcaaggccatgctctcactgtgcgagcacctcggccgccccttggtgctgaggatggagggccccggcctgcccttgatggcagagccagggggggaggggggcggggagctggaggcgcagctggtgctggccacgctgatggagggcaacgacggcctgacccaggcaactggaggggcacccgccccaacgcagccagaagtccacacggatggtgagtacgggacggaatggtgtcgcagacgtgcagaagggcatgtgctgagccgcatactatgcaatactgtgctacatgctcgcctacaatgtaccgaacttcagcaccagcccatggtaatgtaatcgaagcttgcctccgactataatctccaaattttctgtgcaggcccttcccaggagaccgacaatcgcatctccacggcacgttgggatgccccagacgcagacctcaggtgcagactgtaggagtgatggtggtgcgccgtagcggagttcgtgcatattactgcaaacgggcctcgggatggagatgtgcaaggaatcacatagattacccttttaactgaggggatgaacaccaatcaatgcagtggagcacatggcgaggagcaggaggtcggcgggagtccgctcagagaggagtatgtcgggggcttgccaggagtcatgaccgaccatgaatgggcctgatacccactaacagaacagatgcaccccttgaacggcgccgatgacttgttcaacttttacagatgtatattcatgttcctatgcatagattcgtgaaatatgcttgatcatacgatcgcgatttgtcgaccgaccgatgacatgccacgaaggaaactgtgaatgcaaagttcgacggcaaccctgtacccctccatgctaggcaattggagcgaacttcacgcccaaccaccattcgaggccacttttcatgcattacccatattgctgagccacgcggattaccccagaatgtggccgttccgatgctgccaggtctgctctcgggcacccccggtcaccgacgagccggcacctgctgagaagaagcaggtaccgacgacaccaccgcagtcactagaactaattcgagcgcatagtagatctggctcgcgcattctgcagaacgcagactctggcgccagtcggcagcgtgccggcccgagtcagtcgctgctggaggcgtcggcacggagattggcatcagtgacggaaaccgacggcaacgaggcagtggtatgggacctagacgaccaagggatcccgcaaatgttcctggatgcctatttcgacgccatcaagcaagaaaattccaagtgagttgattgggggagggctggtatatggttgggtgtcttgcaacatgattgtaaaaggagattaaggggctggagtggcttgcacggcattagacccaaaccctaactacccggcatacacnnnnnnnnnncaaaggagactaaagggctggagctgcttgcacggcataagacccaaaccctaactacccggcatacacaacactgaatgccaagaagcctctaaccttcgatcacgctcattatctggtcaggtgggcgattgataaccctgcagtggcagacctgtttgccgaggatgccaaaatgctgacacaagacaagcagaatctgaccggacgacctgccatcctgaaacagcttgagaaaggtgcggcgttagaaaggttgatgcagaccgtccttccttttggattaccagtgctttgcctggtgtgacatctgtgtggcgggagtgcctgatcatgccggctgtagatttctaggccctatcaatccgattacttggattacaggtttgctcccctcttgccttaagtatttcttcatccaactgtgctctgatctcnnnnnnnnnncagtgcctgatcatgccggctgtagatttctgggccctatcaatccagttacttggattacaggtgtgctcccctcttgccttaaatatttcttcatccaactgtgctctgatctcttgtatttgcaggtgtcgggctccttatcaagatgggaggaaagtctggcgatgtcccagaagtgacagtggaggggccatcacgcacgccagaggggtaccatgtgatgaagtgcagcatgaagcgaggcctacgaaccctgtctttcaccctagagtttcacatcaagggcgggaagatccaatatatgcagaacacccggtcatagacagtgtaggacggtcgaatgatcctgaggtttgcattttattccagacaggttcccaatgagatgaccccgtgcctgtgtactccattcctgctgcaagatgtaagcatcgtgacatcattacaggagattcatggacgagtgaactgacaaccacaaggccattcctagcaaggccgatgcaagagaacctgtcgcatatatctagacagactgaggcagcccagggtttcagggcgttgagggccagaaggacatctgttttgggtcagtgaacggggtcatagaatgttgacaggttgcatgttacatgagaggtcannnnnnnnnngtgcctgtgtacactcctccattcctgctgcaagatgtaaagcatcgtgacatcattacaggagattcatggacgagtgaaatgacaaccacaagaccatttcctagcaaggccgatgcaagagaacctggtgtgtatctagacaaactgaggcagcccaggtttccagggcgttaagggccagaaggacatcttctgggggtcagtaaacggggtcatagaattttgacaggttgcatgttacatgagaggtcagggctttgagaagcttaaatgctgatcttgcagggtttcttggatagatgttgaggacgcggtggtgctgcgtgatgagcaagctcgaagtctcttccgcgcgcgcgcgcttcgttattcggtatgcatgtagcgcacccacgagtcactgccctttccttgcatctggactcaccatgcatatgaaatannnnnnnnnntgcgtgatgagcaacctcaaagtctcttccgcgcgcgcgcgcttcgttgttcggtatgcatgtagcgcacccacgagcaactgccctttccatgcatctggactcaccatgcatatgaaataagatgaagcctgcttattcaccgcgatgagcgctcgtacggggttggggcgcctgggtgggtctctgtcggaggaccgcgccctggccgagcgattggaagccctgctgtcctctctggagggcagcttagacctcgacgatctttcctccagcttgagagataggtaccccgagtataggaggaagaagacaggaccattcaagcagctggtggtgaggggcctcgagactgtgcgcagaaagcacccggaacttttcgccgacgaggtgcgagaaggtggtgcaagaaaggagcttgaagattgggagccagtcgaccttctctaatgtcccagctattgctgttctgccacgacaggaggatgcagaggaggacgaaccagcgcttgcctcaggatctggtgcttcggccccagctggtctgaacaggagtctgaacaacctctacaggcagcccgaggagcagccaactacagcagctggggaagcttccggggacatggcaggcctgaatattggtgagacgactctagaagccacacccacaggtcaagccaccacttcagcgcaagcggtccagcagcagcaggggaagcgtgctggcaccccctcaaggtatacatcagatgcagtggcgtatgggtgcaatgggggcagaaaatcaaatgtcatgtattgaaggccggtctcgcttaggaaaaggattagaaggctctgtgtgagtatcacagctggttcccatctgggctcagtctagtccatcaggccatccctgtgtcaccagcgcctccctgcacaccacaggccagggtcaagcaagagggctcgggttgctgggggcgtgcgccttgcctcagccctggccgacccacggcccgtgttctacgctgatctgggcggcattgagagcgtgctggaatccatcaaggagctggtggagcgaccattgcgccacccagaggttggctgatgctggtccacaatgcctgttcactggggtcgctcgtgcatcctggcgtgcnnnnnnnnnnactgatgctgatccacaatgtctgtgcactggggtcgctcgtgcatcctggcgtgcatcctgccagtctggtcaggcctgctacacgtgcttgcctgaagacggggatgcccatctatccccccctcctcctacttcnnnnnnnnnnccctgccagtctggtcgggcctgctacaggtgcttgcctgaagacgggggtgcccatctatccccccctcctcctacttccaggtgtacgactggctgggggtagaacccccccgcggtgtccttctgcacggccccccgggctgcggcaagacggccctggccaacgccattgccaacgagtgcggcgtccccttcttccgcttgtcggccccagaggtggtcagcggaatgtctggcgagtcggaggccaagctgcggnnnnnnnnnnagctccggaggtggtcagcggcatgtctggcgagtcggaggccaagctgcggggtgtgtttgccgaggcggccgcagccgcccccgccatcctcttcatcgacgagatcgacgccatagcccccaagcgcgagtcggcgcagcgcgagatggagcgccgcatcgtcgcccagatgttgacgtgcatggacgacctggcggcggccggctccgggggtgcaccccggggttccgccgcagcagaggccgggccgggcatggaggtcgacgaggaggtccggcgggagcctgggaagcatgtggtagtcattggcgcgacgaaccgacccgatgccatcgacgccgcgctgcgccgcgccgggcggtttgatcgggagatcccactcggcatcccctctgaggagggaagggcacgcattcttgaggtgatgaaagaaggtgttggggaatggaaggctcgagggatgggagccctgggctgagcaaggtagcgtcgcgaaggtctttgaggtgctcgtcagggcgcactgggtggccccatcaccccacctcgccctgtggccctgcccaggtcctggcgcggccgctacgactcgagggcagcttcgacttcaaggccatcgccaagaagaccccgggcttcgtgggtgccgatctctcggccctgatgaaggaggcggcagccctggccgtgaagcgcatctttgcgtgagtctttgacctgtaggaggtgccgagtcatgactgctgggggtcgattgttgcgatgtgccaggcagtgagaggtcaggtggagcctgcatagcgtgggggatacctgacccccgtgtggggaaggcatgtatcagggtcctcgtcaacaccactcaccaccacatccctctgctgttttgaagggatttggaacaggttcggctggaggagggggccatggcagagatggtggatgcgccagcgaccccgcaaccccacgtcagtgggcccacggcagccggcgccggtgcagatctgcaggagcctcctgcggcctcgggcaggcaggcaggggagcaggataccttgacccgcgctgagctggagggcctggcaatcacgatggcggatgtggagtcagcggtgggcaaggtgcagccgtctgtgagacgtgaagggttcgcaaccacaccagacacgacgtgggaggatgtggggtccctgcaggaggtgagtgggcgagtggcttactatgtcgggatgtgtgtcagatcgtgtgcgctcgatgagcagcatggccagtagtcccaggttgtctgaagcacaggnnnnnnnnnntcaggaggtgagtgggcgagtggcttactttgccgggatgtgtgtcagatcatgtgcgctcgatgagcagcacgtccagtagtcccaggttgtctgaagcacaggggccacaggtcctgtactgcgcaggctgcctgtagtctccatcactgccatatctgtgcatgcaagtcattcaaggcagccggatataacataccgtccctccatcccgatgactcccaagattcggaacgagctggactttgccatcacccagcccatcgccaacccaggcatctttgctgccatgggcctgcagcaaggagctggcgtcctgctgtatggtccaccaggtgggctctaccgatgcattcagagggatgaatggcccgggcgctgccatgtgagctcctgtgtcagtgctgccctgcccacccgcatggctgtgcctcgatgcccgagttctcacactgacaccccccacgctttctcccccaggttgtggaaagacgctggtggccaaggcggcggcggcggcgtccggggccaacttcatctccatcaagggccccgagctgctcaacaagtacgtgggcgagagcgagcgagccgtccgccagctctttgcgcgcgcgggcgccgcggccccctgcgtcctcttcttcgacgagatggacgcgctggccccgcgccgcggcggcgagaccagccagagcagcgagaggcttgtcaaccaggtgagggtgtggcggcgggcggtgggtcgggggactgatggtctgacacatggccctggattgacctgtgtgagggctcgaggggggtttgggggggtccccttgctttgccctttgagattcttgcactctaccacattgagactccacttgacccccctctggaactccgctccacactctccattgnnnnnnnnnnatggcggcgggcggtgggtcgcaagactgatggtctgacgtgtggccctggattgacttgtgcgagggctcggggggggggggggggggttccccttgctttgccccttgagattcttgcactctataccacatcgagagactccacttgaaacctctctggaactccgctccacactctccattgcttttgcccctcagacccacacccactctccccaaccactgcaccagttgctgacggagatggatggcgtggacggccggacaggggtatacctcatcgccgccaccaaccgccccgacatcatcgacccggccctcctccgccccggccgcctggacaagatgctgtacgtgcccctgcccgacgccgcggggcgcgcctccatcctgcgcgccctgacccgccggaccccggtggggggcgccctggacctcgacgcgctggccgcctcccagcggctggagggcttctccggcgccgatctggcggccgtggtgcgggaggcctgcgtcgcggcgctgaaggagggcctcgcagctgctggcctggggggtctgggtccaaaccaggcagggccgctggtgacccaaaggcatctggaggccgcggccaacagggtgcagccctcggtgtcgcgccgtgaccgggccatgtacgagcggctgagggacagactgtgcagtgcgaggggccacatactgggcgaggtaggtgggtgggtgggggagcgggcgtgggctgagttgaggatggggagggggtatgtgcgggggagggatgcctggtgccgagaggggagctggtggtgcgggggagagattgggtattgttggaccccatggtgtgccaagcaacccaagcgacaacgaggtctgagtgccccttccagaatcctttgaatcttgtatcatctcccatccacgcatggacaggacggcaagcctgtgggagagtccagaccggagcccgtggatgcaagtttccgagcatgaagaggctgatagggtgtccttgaggccattgaacctaatgcacatccacccaccctgattttgccccctttggaaccacttctcggagattaaacactgcaaccagagaagaaagcgatgtcgaccatcaggcaaggctggagctgttgcacgagggctgccaacttctgcgttcaaaccagcagttgacttggaaagggcgcgcgtcaaaaccctcgcggtttctgtcagatttccatcgagaacggtcttcaaccacctccagatccactagatagttcgcaaagcttcctaattgtcgaatttaatgtgtgtccatctccagaaattaagcatcttgtaatcatcccttcccatctgtcgacgaggccggtaacaacccaggtcagccctcaccggctcgataccacgatgccttccgttcgcgagttctcgtctctcaagcccatgattacaaaggtgcatggaatggaaagagagtttcctatcggagttggttggtacgatgtgtaccagatagcttgcgctctcccccgctgcaccgtcgaaaatgccctcaacaaccaccgattgcagtactttggagtgtacagcgccagcaaagtggtggagaaggctagcagtgctagccccaaagtcgttgcaatctcggcgccagtgcttgctgtccccagcagagctcggcctcagatgttcctgtcacttccccgaggggaggtaaaactccaactgcagcacgccgcttgagcccgtaagtgggagtgtataagggactgcagaccttgccactcacctgccgtcaagcgtctgtttggtcataacaatgccagctcttgtcacctcctttatcgttcactcccgtgcacaatgattgtcatgcaggaaggccccaacatacctgtgaaactagaacagaaaccttcaacatgtggatggtccatcctgataggttctagcgttgtatgatagcagactcttcacattgtgatgtcctgatgcatgaatacttttgacaggtcgccctcttgtcctctcaccaacaacatctgacttccttggacactgtacaatacgaatgtacccttacgtttgtacgacatcatcgttgtgacccaatctcctcctctgcaccctgtgtgattgtaaaatccaggcttcagtatgcttgttgacaaggggttggtgcactgcggctgtggtcctgccctgagataccgcgggaggaaatcctcacgacacatgcgacaccattcgattcgaccttgcctggccccatggcagggcggggaaggcatcgagatcgcataacttgtacatcttcgatattctctaccggacggatgacaggcatcttcttgttctccctcccacgaacaggcggatgctctcgccatgcacagccccaacaccatgctaagattttgaaactcagcattagcagacaccatcttgctgctcgtaggagnnnnnnnnnnaaccatgctaggattttgaaactcaacagtagcagacaccatcttgctgctcgtaggagaactcattatgcatccagcgggacgagggcgtgtcgtgagtgcatttcctccgatgatcatgatcaaaagctgacggcaccttccaagaaggatctgggcacaaggtgaatgaggaaccccgtgatgaactcggtttggccactcgagtggcacgaaggatccatccctctgcaatgatgatgaactcgcaagcatgctttgatacattcgatggacgaccttcgggtgaaagcccctcaaccacaggtttccctttgacatattcccaggtctgccatctccctgctcaaggggtacagagccttcatctcccccctcctccagccagtgtgtcgcttcatcccttcctgctctgtgtactccatagaagcctacgagacctacggcgccacgaaggggaccgtcctcatggtctggcgcatcctgcgctgcactccgtggggaggttctggccttgacccggtccaatggcctcccccgggtctggaaagattttttcgctgagcagaggtccccagcctcatacaaatcctgtctggagctttgttatagatatgggggcatgctctaatgtacactcagaggctgcggggcttttcatgatcctgcattggatccctgccgggcgtccttgctttgtggctgggcctgggagtcgtcgtggccactcacaggctgacggctgtcttcctcctcagacacttcatcatcatcgtcgctgagacccaagagctccagcaacccaaacagcgtttcctctgcagcagcccgccgctgctccggtgccatttctgctagacggcctcgcagccctgtgtcaagagcggggcgagggcagccgaggtatttggtgtgtcagtcagagacaggtgccctggtctccagagtcaacaagtaggggataaggcaggcctccatatcatgcatttgacctgaccccacatgcaatgcaagtatgggggaccacgaggaaggcccaatctggccagaaccagatcctcctcccaagcattacttccatccccaggtctccctgcacaccagctgcagcctcaagggccttgcctagctgcaccgacgaatcaggttcatcctcgtcccagttgcccggcgcatcccccctcagctcatccaggaaggggtttggacagctgcccccaagcaaagatggccccaacggctccgccacatcattctctccggtcgcatacatcgccgctctcccatgttgaggnnnnnnnnnntcccctcagctcgtccaggaaggggtttggacagctgccccctagcgaagatggccccaatggctccgccacatcattctctccagccgcatacatcgccgctctcccatgttgaggggagggcttcagacgcagtccaggccacacgtgggcctgcagcgcctcgtggatgcgggtcacgccctcgctggtgagtgacagcgcctcaccatcgccggggaggggcaccgcgaccagttccaccagctggtctgcgcaccaagcccgtgcagcttccaggcgggggtcctcctcgtcggcgccataggctgccagcactcgcaccgagctaccatcgatcgctctcgtctcccaccagcgctgcaccctggagaggctctcgccaacggccgcatccaccaccagtatgcatgcatctggctgggaaggggtgggatcgctcacatccaggaggcgcacgctgatgttggcatcgtaatactttgtacttatggaccatggatgagtgcatccaggatgcagcccttcctgctccagaaccgcgaaggtcagcgcggaagtgatcgtggggtcggtgcctaccaagatcagaagcgcctcgctacgtgtcatcctcgcacacaagttacttgtgtggtatgcactcactgccctggaaggcaggagagggcactatatgcattgagttccatgccatatttatgatcccggagaacgtcagaacacccagggcgccaagtctgattgccaccgaacgcccgatgttgtttgctgcttaacaccaagatcgatgctgttgctgcgttgaacttgcattgccaagtttatcctccctgatctcttctgggaagctatggcggtggagacagaggcaccatcggcacagccaggcctggagcacgtccccttcacaaagctctacaaggatattcccgtgcatttccaagtgttgagcctccccaagcagacgctcatctgggtggcgtgtggaccggcgcggttgagatccctgtcagcagccacagtggtaccacaggtcgctcctgggacaggttgggttttacggctttgatattggtgtggagtaaatttctatcaggggacttatttacaatccaattttggaaagttcatatggtaaaggaaagcagaggacacccattcaaagcnnnnnnnnnntcaggtcactcctgggtcaggttgggttttacggcttgatattggtgtggagtaaattcctaacaggggacttattcacagtctaattttggaaagttcatatggaaaaggaaagcagaggacacccattcaaagcttctctctcctctccgccccctcatcagacgggactcccagctgtcacatcgctcatcgggtgggcggccaactcttcagaacagggccttgccagtcgtctaggtgaggggcgatgacaggaagaattgatccttcagatgagaaaatgattacgtcatagaatgctacttcccttctgtttccttcatcgtatctttggtacccttggagattctgaaagtgactctcccacccctccctccctgtccagcacaagcttctggaaaagccgtgatggtgtctctgaatctgcccagcaattcagctggaatggaggcttttgtcgagcaggagctcaaggcccacctgctcaggcaatagtgcagctctggacacgcacgaggtggcgcatgtgtgcctccagaagggctcctcttgcatgtgcggaagcttggggccctcggcttgtgtccaaggctgatgaccgttcgtcctcgccttttcatcggacaacacaattttccggcatccccactgcatggctgcaccaatgcctggtgcaggaggatatcaaacttactccccacccatccttgtccgttctactctcacgaaaattacaagccggctgtgggcccggcgtcaaaacccccgacagtccctagatagtcatcgtcaaagtctgcgggatgtgggagcgggcgagatgctgcctaagtgatgcttttgagggcgaggggtctatggagtgcaaggacatgcacaccggcataacgatcgattcttgctgctgtttgcggcccccccctcacccttcggtcccaagacccaccgccccacccacccgagaagtgcgaggccannnnnnnnnncatcgattcttgctgctgtctgcgcccccctccctcacccttcggtcccaaaacccagcgccccacccacccgagaagtgcgaggccaggagcgcgctctccgcggcgtcttcgggcgagggcgcggggtcctcgtcctcctctagcagcttgccctgctcctccagccactcgagggcgtcggggacgtagtgtgcgcccactgcgcgcatgtcggcaatgcccagcggatcctccacgtccacctccacatcgcgagggtcggcggcgcggccgtccagcgtgatcaggtcccacacctggcggtgcgtccaggtcttgtactctgggtccttgatgtcgcctgtgtacccgcagcggacgtcgtggcgccagcgcgagcccatgcccgcgtgctggcccacccgggcccgggccgcgttccaggctgttggatgatggggacagggggcggggatgaccggaccatgagtgcatggcccatggtgagccgggcaatggcacaccctgggcgcgcagcacagagcaccacgagcgcgctcttcgccccttgcacctgcattctgcgacctggcaaccccgctgcgaccccgcacactcccctgcggcaccttggttcctctcgtgccgctgccgctggcattccgccatggcacgcaggtcccactcgtccaggtcgtcctgggggggggcggggggaccctcctcagcctggttggtccgcatccgctcgtgcgaggccagccgcgcctcctctcgctgcctgaactcgtgggttgagcaccggctccaggcctcgctctccagggcggccctgggtcccagcgcggcggcctgcaggtcctcgaaggtgtgcagtgtggggcgctggcggttcaccagcacgcctgcatcgtcgacggtggccatccaaggtcgccagctggtgtacctgtggtgggcagcagcgtgcatgagcaggcgcggggactgggtgcggctcagcccacaggtagctgccaccaggccaagcactgtcgtgcaactgaggcttcgaaagtgccacgtatcaccaactccttatcctgtatgatgcccaaatacttgcctggcggtctcaggatcttccaggatggtctccaaggccaggtccaccgcctcactttcctgtgggtcagctgcagcggcacacagctgagtagggcggccacgcctccctggagcgggctcatacatacaatgccttggaaagtttctggtgaaaggtcgccctgcgcgaagaccaaagccccaggtgggctgcggggcagaagcgaaggagaccgccatcgcccagacgaaggggacagcttctcatgcggtcatactcatagagattagaatttttcttggatcgtgatgtatgccagatgtatgcaggtgcaattccaacgaggtaaagcgtgagcgggctagccttgttgagggaaattttcagataactcatgctgcgcttgggctcgacacgcactgatcatcgagtaagcaagaagacgccatgttccggattctgttctctcggtgtacgcaggaatcagaagtagagtgcatcagaatggctacatttccaatgctgctgagctgcacgccagcggctcgactcgcccgctctccaaagggcccagcggtgcatggatccatgcagcgatcgacatgggcgactgccgcatacagacgccaaggtgcagtttctgcttcaggcactgtcggatatggagagaaatgacatgcttcgtattagtaatgtctggcccccgtcccactctgcgnnnnnnnnnngcttcaggcactctcggatatggagagaaatgatatgcttcgtatcagtaatgtctggcccccgtcccactctgcgccacagaccgtttcccaagcataagggcaagcagtgttgatgccgacaacgagtctcgactggaggccttggaatccatggcacgagggggaaaggagcagaagggcgcagtggagaagagaccatcggttcggcccaatctcacacaggtgaggtcctggaagtgttaaggcgacggcaatgcttgttatggctcattggagaggcaacgaatcaatcgcagggcccgcagagcttgtaggcatcatgagaggattgctcagtgcgctgttcactgtacaaatctgtaggctgcaaaggcggacatgggaccctccaccgagtggggcgagcgtgatctcttccccaagggctgggacgacatgccgcttcccatgaaggtgtcccagctttggatggggaagcgaggtctcctcttctggagcaacaaactggcatgggctgccgtgataggcgtcggggtgttgtgggttgtgtttcggttcgttggtccggcgctgggcttgtaccagctacaaagcgacctgtctactccaaacctgctctgaacagtttatgtgatgccttgaacagatttatttggtgtatggtcttgtgactgatgacacatgttgttnnnnnnnnnnactactccaaacctgctctgaacaatttatgtgatgccttgaacagatttatttgatgcatggtcttgtgactgatgacacatgttgttgagtttgtgctcattatgagcgcgcggactctcgtgacgactgcacagatccgaggaatttgcatctcctcgatgtcgtcctcggcgctatctgccactccatccgccaagctaatcctccctctccgccctttctgagctgtgctctcaagacgatgggtgcggcaggcgtgcccagttcaaagggtccgggaaggactcggccccgacagcaccagaaaccggctgctgacttgcgcctgccagccatctctcacgagtgcgcaccgtgccatgtgtcaattgcatgttcgagcacggcgagatcttgccagcgcatctggcccgcagcccactctcatcccttggtcaacctgcagggatgccgaacatggtgaggtcgccggcgatccgacatcacgagtctccccctccatcgagcagacctggtgcacctatatagatcccaagtccctgcaagcctggtacgcagccttcaggctggtcgctgagcagcaagcggcgctgctcaaggggtcacccctcctctcgggagctctcccagatctcgatgacctggtgcgtgatcctcgtggggctgggttcgcattctgatgatgagggaatttgaaatctcttgtactcctgcttgaagacgtgcttgttcaggcattgcgcacacatccctacacctcaccttctcaggcctcctgggtgacgagcgaaacgtcattcagtgtatactccctggggacctcccctgggcgccttctggtgtgtgatgctgagaagaacatatatggcagccattaccacatcagggagcctgagtcgagcaccatcaagctgacagcggcagagttcgtgcagtgtgcgcggaaatggaagagcaagctcttggtcctggaggtgagcctcgtccactgggatgatagtggcgcctggctgaccaaggcgctgctgctgctggcatgatggaaacagcagcatgcgcagtggcttagatgctgcttgagagacctatgaacgacctcaatatcctggcgggagggatgccggtgagccaaccctatggccctcatcctgccatgcaggcgctatacccactggcaagcatcaagccttccacagagagaaccagtctccgaagaaacctcccaagtggtctacaaaccttggtagactgggactggctagaggcgtggcttgcagcgcaagagtttgggccgctgtcttcgttgcgcctcatggctggtgtgcggggcaccctcctgccggcaagctatgctgtacgtgacaggatactcacccaggcgagtaacagacaggaatggcgatatcgtgaggatcgtnnnnnnnnnnctgcgcctcatggctggtgtgcggggcgccctcctgccggcaagctatgctgtacgagacaggatactcacccaggcgagtaggagacaggaatggcgatatcgtgaggatcgtttcagtacgggaatcggtgtgccatctgcgagtccatttctctagagtcccgccgtctgtgcacagaactgcaagaacacttggcctgctgtcttcttgtgagggattctggtccactctcacttttccatatgccagcattcaactatctcaccgccttcttcccttggccctgtcccctgcagctgactgggagatccagggtgttccttttccctccatccatggcatttcagggcttgtatccctaccccgtccaccatggctatgacaagtactccatggtgaatctggaggaacccgacgtggccgaatggcccctggccacgcggctgaaggcagtgaaggctgtattgcacccaggcaatgcactgttcatcccaaattactggtaaggcggggcgatgtgtggctgtgcaggactggggacctgggggctttgctggacgcgactggacgcaaggtgcgaggcatgccataacttgcaatgggggaacgctacgactggagttccaccgtgttcccaggagggtcggtcgatgcaatccttccaggtttgcacatgtcgagatgctagctnnnnnnnnnnagaacgctgcgactggagttccgccgtgttcccagtagggtcggtcgatgcaaaccctccaggtttgcacatgtcgagatgctagctccagaggacctgatgctgacacttgagctaggacagggcgctcgtgggctcactcctggtgcagcggcggttcacctgtcacgtgcactggaggagagaatctgtgaggccgagtccccaaaggtgagtggcgggcagggagtgggtgggcaggacctggagcggttttcccggagagtgtcaaccgtcttcttcacggtttttcaatcgactagatctatcaacctctctgaccatgtatcaaccctgctgtgcatcccaggccgtgagggagtggctcctgcgcatcgccgcggggatggagattgaaggtgtggacctggctacggtgaaaggatacaagcggatcgtgctgtgccagggggtgcgcgatgatgtcgaggctgtcctcggccagggtgcctggtcgacgttcctgccctccatgtgcgagggccgcctgcaacctacgccttggctgaacaaggtaagagatttaaatcagatatggtgcctggcgaccgcccactgccactgtcctgcgtgtagagggagagttgattccctatttggccgtacagcatcgacctgatgccgggccagaagatgtgcccttccttcaaatactcctacttctcgctgtcctcccctgactcctccagaactttcgggagccgctctatcttacggatgtcccagtcaggctcgaggatgaccgcaccgaggaagagaaaaagtatcctgagctcttcaggcaccgcctcagaggtgaccatgggccaactatattctgtgtataccagtgtagactgcgttgattgttcattgatcgtaagtttgatttaagaagttccctctactcttcatttgtagctggaggctggacggttcccgagaacaagtgcaccatcccaattcctggatataacgttccagcatcataccagcctcagagtcagcaagcttaacaggagtggtgtcaacaaatgccctccccaccgccccaactgtaagcagacttggcacccctcctcttgtcgaaatgtttaatgagttcaagatccaggctgtagcaccatgagaaggggtggagatcttctccgaggcacatggaatggggtcacatctctcaaacataaaagtcttgtcgggagctcccgcctcccacctccttcagcttctttgagatgctcgtaaagtaatcctgtacggacaaattgtgtcatgagagtgctgagtcaccactatccctccccagcctctagaatgtcacttctgagatctgatccactcctcatatgccttcagacagccagacatcgcacctctccatgtgcaccacgacccaattcaccctttcaaccacacaccgctctccaaaattccttcctaccttaaggtaggcctccacggtggtcactgacccgggctccaccccgagcaggcgataggtatcgtgcatgggggccgaaaagttctcattcccggccaggacctctgcaaaggccaggcgatctgccgcgtcccctgcccactgcagcgagcgcaggatggaccgcgtgcccttcagcagccagacagggatgttgcgcgtcttggcgtccgtgtcggccagtcgctcgcagatcccgatgatctcctgggtggtgtaggcctgcgggcccgcgatgtccagtgtcttgttcaccgcctctggcgtcctgcatgcgatggttttggaggagacgatgatttggggcgggatgaagaaggcggcaagaatgacgattcacagaaggggacattcttctggagagtgatactgggaggatgagacattgccagctgccaatagtggaacatcaaagggaagtgcccctgtcgacgatgcccttgccaaacagcagggaatccttcagatcaatacccagcccgacaccattccagacctcaaagatgccaggaccaggcgggcaatgtcctgggtgtccatgtaggctgtgcgtgtgtcgtccttggtcccccacaccgcgcgatcctccagcaccgggatggcgtagctggcgaccagcgcctgcatgaagccacacaggcgcaggatggtgtagtccaccccactctgctgcagaaacttctccgtggcgttcttgatgttcatgagggggacttccgggtggcggtcgcagtggacgatggagcagaagacatacctgtgcggcgatgagcccggcatggatgagggtggcgcaaggagtgcaaagatcctaaggacaccatgttgctagtcataaagctggcgcagtgctgacatgaagaacacaggccgcttgctgtgtcttcgnnnnnnnnnncaaggataccatgttgctagtgataaagctggcgcagtgctgacaagaagaacacaggccgcttgctgtgtcttcgaggctcaagctgtccatgcaatcattctctgaagtgcaaagagcacaacaacccctctgcacactcccacctttggatggacatggcttgtgcgcactggatgagggcaaccttgctttcccagtcgatcgccatggtcgactcctccgggcgggcagttgcgcagtcaatcacagaatggatcccaaccagagcagctgggagagaggtagggtccgtaagatccgcctgcatgcgcggcatgggcattgaagcattaccgtagggagcaacaccatgggcaacggtgcatgcagggcgtgtacccacgccacactccacccccatcatctaagaaattgtgccaggactgcccatccattcagtctacctggacggtggtcgcgccccagtctcgcaggaagtcggcgggcgtctggcgtggcctgacagtgcaccgcacctcatacccctcgtccagtgcctgacggaccacctgcctgcctagtgtgccggtgccacccaccaccagcagggtgttttttccgactgtcgagccactggacgcagcgcacaagactgggcgagggtatgaccgggaaagcgggcctggggcaagggcgtggagggctgagctcggtgagaggtcccgccgaaaacgatgaatcgatcacgtccctcctcatgcgaccgggtactgcccttcacgatactggtaatggcattcagggcatatgaagaagtcacacacctgtcctcgttacgcgcgggcagccgtgcaaagtgctggcatggggcatcgtgccaatccctgcatgaccagagaattgagtctgcatggagaccagcgctggcggttgcgacccccgagggctttctatagcaaaaatgtttgcttcactcaggaacacggcttacaatcgctgtctcaatgtccctcggtgctgggatgaggccgacttgcaacttgtgtggtgggtgcaaattcggcgagtcgcgcgcgcatgaatttcatctcctcaacacccacgtgcccgtggccccatactctgcaagaacagagacggcccgatgtcggtgatggctggttgaatcgataaaccaaagggcggtgtaaatattggatagccttcatgcatctcgttaggctgtcgcggcagctgtgtgtcctcgcaagcctctccctccttgtggtctgttactgttctattgactacgatctgcatgacgacgccaggtttattgtttctgtcgcagctgacgtccccggtgagattaggataatgcgaggtgatggtagcgagggggtgggccgggtatcttgcgtctctgctcgtggatacgttatttttcaacccatcattatgcgttccctgtcccagatgaaagcacacaagcttgtgaagcagatgaacgaagtcaacagatgaaagacaacctgggaaattcatatctatgttgttaccctccagttctgccagtcaatacgtcggtgagatgctgccattgcacaaagtctccagaggatacatgctgcactccgaaatgctcactccctgcaatggtatggcaatcctatccttgacatctcgcaggaagctgatgccaaaacgccactgcaagtcgaagcctccgcggctgaacttcttgcaccccttggtaagctgcagagatggcaatggtatcgcctcatgaccgactcggatgttcagggtggtgcttgtgccctaagcactgacctgcttatgggctccattcgatgctgcagtgggttggtgtacggtactgacggaggactggtggacctacgaggtgtgctatgagaaggaggtgcagcagtaccatgctgaggacggcaaggtcttgacggcgtatcacctgggctactatcaaccggacgatgaggcatcagtggtaggtcttggactaaggaatgggaggtggcgttgagcatgtcatgagctgaccttgctcatccctgctgaaagctcccacattgttgcaagccannnnnnnnnntagtaatgggaggtggcgttgagcatgtcaagagctgaccttgctcatccttgctgaaagctcccacattgttgcaagccactcctgcaggagacgctgacattgcatggtaagggcaccaagttcctcgcacagcagtacgtcaatggctcggactgcgagcttgcccgaaagcagcgcagtacagaggtgggacttttgagcgattgtgttgatgctcggagcagagacccatgcctcacagcttgaggcatggtctcaggcgccctgcctggttctcggcacgcacacacacgctcggacccctcagtcaacaccaccaacccacacaggttcgatatacttgcggccaagatgacaagagcatcatccagtctgtacgggaagtagaaagctgttcgtacgtcgtcaccattttgacaccgctcctgtgcgctcatgacgactttgtcagcgtcgagcctcctcctcaggagatccactgccggcaattgcctgactctgctccatccccagacgcgcatgtcgacctatgatgtggttctgagggatctttagtgccagccggctggataggggggccccttggtagggcgccgagacggggcaagacagggcgcagcacgcgcagcatttccccacacctccggcaactatgtcgccgaggtgcacaaagagtcacgaagatgaaattttgagctggagtcttggcataccaagagataacagcgcatgcaaatataagtcatccgccggcacccttccttgggcacacacgacgaaatgtcgggcgcaagcgtgcccggactcaaccgagagcaggttgagaaggccgccaaggctcttttaacgtacgcgcagaagaagggacaggagagcagtaacctgctcctggacgacgagctcatctacctggtgaggatggattggcagcggaccaatgcgtacaatttgcaagccgcacctggagacggagggctggaggtggcgcacagggtcaaagtgctctctattccacttcgcagaatattgcactgaaaaaggtcccccagacgccacggaaggacaagcctgtacggctaaacattccgcaccccatctacagcctggagggggcagaggtgtgcctctttgtcaaggacagcaaaggcaagagagggactttggggggcgctcctccttacataggagcttaaagtagccaggtttcaatattagcatccgaatgaatgctggagatggtctctgatggcttgcacctgcgaatctcctccaggtgaagggcacaaggccagcaagaagaaggtgaaggaggagcagattgccggagttacaaaggtggtgggcctatccaaacttaggtacgggaattcaggcatacgtgaaggattggacggtgggaggttgctctggaaacaacaaccaacgggcacctaccatcctgacctctccaggacaaagtacgagagccatgaggcgaaacggaaactctgcaactcttacgacctgtttctggctgatgagcgagtgctaggatctctaccaaagctcataggtgagtggctggatgccctgcgtgctcgacgccaggcattggcatttgctctgccaggcatgagctgaccttcctcgtactgttgctgcaggcaaatcctttttcaagaagaagaagcagcccgtgccagtcaagttggtgggaaaggactggtctggacacattagcaaagctgtgaaggccacatactttttctggacgggtgcggtgggatatgtgtaggatactgtgcttgggcttgcgtgagggcaatggagggataatgggcgactgtatgtttcaaaccatctggagccttgtggatgtggaattcaggcttcatctgtgcattggaacatatgcaggtggccccagcctctcaatccgggtttctcggtcctcccacacccaagatgaggtacagagtaggactggcaaggtttgcggtctgcttgatctgcggatactatcttttgttcgttcctcccacaccctgtgcttttacgtctcgggcaaccaccaattccgaccaccctcactccttgcaggtcgtagagaacgtcattgctgccctcaaagatgccttgccccacattcccaagcagtggaatggcgtcaaggtgggtgggagcgctggcaggggggagttgctctctacctggggggggggtgggtctgagaggttgtttgctcttgcgcttccgttttgttgtaggaagaacgccaggtcccctggagcgttcccattcagcatgcgctctgcacaatcctcaatcctcgacacaggcgctgtacatgaagacagcagactcagtggctctgcccatctatcaagcctccccggttcccgatgtagtgcgcatcaaggcctgaggctctcttttgctccggcttccatgctacctcttgtcgtactgctgacatatgtcctgggaatgactgcgtcatggccaaattgccatctgcaaccgtgccctccatccctttgtggaagctgtcatgatggtacagagcagctgagggggcacagacacactagaatcgtcggatgtccttgggaggcttaaagtttacgggatgcgactctggagtggccgtgaaatcctccttccacatcttcacggtcttgtcagcctcgcatgtcaccaggcgagaaccagtcttgtcaaatgccatggcataaatgcctgcaagggggaaatgtgcgggacagacgcaatcgttggagcttacgttagggtagcaggcaacacctcatctaggaacgaactgtccgataacatgcacacccgcaatcagatctaagagaatgtccattagctcccannnnnnnnnnttcatctaggaacgaagtgtccggtaacatgcacacccgcaaccagatctaagagaatgtccattagctcccaaccccaacactgcccacccaccttgttcactctccaaggatcccggttgggccactgtctcctgctgctgaaaggcgttgccagacttccagtcccagaaccaaattgagccgttgtctgcaccagacacaagcaccccgtcctcgttcaccgccaggcaattgatgattgcctgcacgtttgcagggcgtcgggtggtggggttgtcatacagaggtgacggaagacatggcaatgctgggtgggaccttgtgtctcacaaccaccaaacttctcccactgcaggtgcaacacctcacccgctgctgttggagggtgttgtgcaggaactctccccgtggcagcttgaacttcttgatgttgtcggccccacccgatgcaaatgtgtgctcggttgggtgggcagtcagaccacgcacggcctgtaaaatttggcaagtgcgcatatcacgaagaaggtcgatgccataggttgtgcctaaccatgcatcactgcaaggaagaagcacaaaactgatccctcctcagaatgtaaagcccagcttagtgttgcaaacctttttatggtaggtcagggtcgatagtgtcttgccggttcgcagatcccacaaccggatggtcttatcgtgggaagcggtgatgacctgagataggagtgaagatgcagcccatgagggggcatgcagggtttcctgggtatgacaatctcccacgtgagaatatgtctggcaggccaaggacccccttcccactcacctgggggtccgtgggctggccgaggannnnnnnnnncgaagcggtgatgacctgagataggagtaaagatgcagcccatgagggggcatgaagggtgtcctgggtaggacaatctcccacgtgagagtatgtctggcaggcaaaggacccccttcccattcacctgggggtccgtgggctggccgaggatggcagaaacagtgtcttcatggcccgacaggcagtggatctggaccttgctccgaatgtcccacacccggcaaactgtgggcaaggagcaaaacggccaagaacttggacgcacgtcaatgccgtcgagatccatggtgcaatcgaaggaacagcaaggtccttaatccccaatcctgccctcaacgatacctgcatcgcggccgccagtcatcagtatatctaacgtgggatgttgggccaagctatagacgcctgaaagatgcccatggtaattccgaatgacctaaataccaggacatgaggcaatggaagatgagatcttaaattcgaggataaggcgccctgtgaggaatggttgtgcaaggccactccccacccctgcggccccactctacaccctctgggtgcatccaacctcagtgtcattcattcaacggccttactgtcacccagccctgcgagcccccataccttgttctgctccaggtcccagcatttgacttgcttgtcaagagcacaggagaacatgtaggggtggcgctcagatacagccaagccagtcacctgtcattgggcaatgacaaaagagggccatcaacatgtcttgcccgtgccatatgggcgcaccggacactgatgagaagcacaacaaactcccccaggcataatcatcctggctgatgggactttcatctccaccaccgcgcaggcagaggaggacctacctgctctatatggccagtaagagtgagccgcaagtgtccagaggctgtgtcccagattttgatggttcggtcgccagagcccgtgcagaaccattcatttcctggctcaaacgcgacagagcgcacccagctgcacgttcagcagttaggcagttactcttgagccgggtctcatgagcatatcttactcagagccagacatccagatccatacaaaccacagccttgcttgcccaccgagctcacccaaggtgccccgnnnnnnnnnnaaggcaattactctcgagccgggtctcatcagcctatcttactcagagccagacatcgagatccatacaaaccacagccttgattgcccaccgagctcacccaaggtgccccgagatgacacggtacattttccagggagcatgccattctggccgtggccacttgttggggattcgccgggcaatgacagagctgggaacatactccttctgtggatgagtgggcgtctctttgcattgctgagacattatcggtgacagatgcttcaaacaaatctgactgatacgatctagcacagcaatgcgacatgacactcagattgcagtttcttgtgcaggaagcattcgccatgctgcaccacctctgggtgcttgcccttacctggcctcctgtcgcagtgggtaccatgatagtggtgctgagtgccgccttggcagcaggagtgatgcttgccgtggaaccgtggaccaccagctgcttgtctcgactgcctgatgcagcccctttcctgcagcgcgggagaaacatgaggagaacgtgtgtgtaggcctccacctacttgaccatcgcaaactctggtagaatttggagcactgacatcagctgggaaaacccgtggcaactcactcttgagcctgcaccgaatcgattagcgtggagttgatggtcttgggtgccgagcctgtcgccttgggttcccctgggacagcttgggctttgtacttgctcaagctcgcatactcatcggatatctgcaggaggaatatacaatcgcacgggactggcatttgttctgcatgtaaaggtacagaggtgacaggaactctgccatccctcacagagtggcctgccacgagcaatgctgggccaccaatgcatgcatccatcccctctttcacactgaccttgcaggaaatttttactttctgcgaagcttcatcgagggggatgctttcccagtgtgaactatggaatagatcatacgtccgcttcagggatagcagggcgagcgctttgagcgacctcttctcaatagggaattcctccacgaccagtgctgaccctgcgccagcaccatcggctgccatgggcagcttgatgctctcaacaatgtcagatgcgagatgatcagcaaacttcccggcagatgttccacggtgagcaggtgctgtggatgccggacacagaacaaacaaggcgcagagtcagagctcccttggtgcgaaatatgctcgatttctgtcctttaaacctgttcaagtctccatgagagtcaaaacggctgtcggacgctggtgctttagccgagagtggtgcgcgggaaggctcgaacttgggcgcgaggtggcagcgtcacggaccgatgggaaggccagtaagtatagcttggttggaggagatcagttggaattcagacatcgaaccattgccaataattgttgtctgacgcccctagctgtggtgacaaagagccaccctccagtttggagcacttcctccgcgcagacggtccagccccaccactcttgctgcaacacagccacctcctccaaataaatataagaggagcaacagcgatggcaactgtcgatccgcgcctcgatctcatcagcaaatcaattagggtcgtacccgacttccctaaggctggcattcaattccaggatgtgactaccatcctcttgaatcccgaagccttccaagcgaccacagacctgcttgtggaacattacagagatcagcatatcgatgttgtcgcaggtaggcaccggcattcagggcagcttcgcatgccacccttgcatgctgcatcggcatgtggcccttttgctgctgtgtactgcatggtcccccacaactcattaaaagtgtgcctcaacatagtgcattgcaaaacaatactgcacaaagaatctgagagtacatcactgcaggatttgaggcccgaggtctgatctttggagccccgctggccttggctctgaaggtcccctttgtccctctgcggaaacccggcaagctcccaggcacgcataatcacgccctgcatgcatgcactgcaattgcgcagctctcatgtgttgtgatgctatcaatcgcaaaccaatcccttcttctccaggtgccaccgtgtctgtggagtannnnnnnnnngtcagggcagcgtcgcatgccacccttgcatgctgcatcgccatgtggcccttctgctgctgtgtactgcatggtgccccacagctcattaaaagtgtgcctcaacatagtgtatcgcaaaacaatactgcacaaagaatctgagannnnnnnnnntttacgtgttgtgatgctattaatcgcaaaccaatcccttgttctccaggtgccaccgtgtctgtggagtacaaaaccgagtactctgtcgacaagatcgagatgcacattggtgctgtcaaggagggccagcgtgtactcctggtggatgacctcatcgccaccggtggaacccttggtgagcttgtcttgcgtgggaagagtgtgggagttgcaagcgtggcttgtgatggtgcagtaaaaacgttaatagtagttgacaaatgtcaaaggctcagctgtccccatggcccttgtccagttgctggggccgagctggtgaggaaggtgggtgcaattccagtcgaagctgcatgcgtcattgagctgccggagctggagggccggagtaagttggatggactgcccttgtttgttcttgttgagaaggctggcatctgaggtagtttacatgaagtagatggagcttgatgtaagtgtgtcaggcatcctattttagaaaagggaaattgaatggttgagtggctgatcttggtgtgtagggccgttgggctggacgatccagtgcgacctccaaagggatccctctcacaccagggcaaagcatgaatccgaggaagatcacaacactgcgcacggctggccttccccattgtgtcacttattgcggagactaaggatctcgggtggaggccgggtatcaaacgctcgtgcgaccgtccggcaatctgttgcaaacgggcactttacaaaaggcatctgccggcactgctgatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcgcagcagcaggtctacccgtgtattggtgacagtcgctgctgcagagcctcatcgcttacgcgtgaatggtgtcttcagtaggagaacgagcatccacttccagtgaggctacagagacagacgatgagaatacatcgcaaggtctcaagcagcgtaagcggcatggaggcgtgcctgccgccgagcagcaggagccaactcatgccacactgcaccataggccaaccacgagggcccgagctcgtcgaggagcgatcacgctcaagtatctgatagacaagggggtgctggaacccggcaaggacgtcctctcacttgtgcgggagagtgtgttgggtgcagctaggcaacatgtccatggtgttgcatgtctcttgtgtgggacactatctgaggacaccctggtcttgctattctcaggattacaaggacctgcggcaactcgccagtctagaaagcgatgggcgaatccatgctacagttgggggcagtaccttcgtctttgaggtgagggatgccgccttcacaccttcacaccaggccgacggtggtggtgatactttaaatgacacacaaaagcccaccagcctccgtcccttcgttcccaacagtccccatcgggcttttcgatcttcatcaagaggctcgtcgtgcccaccaggaaggccgatgatggctggaaatctgttcggtatggagcacagtgagttggggttaggggagggcgctgagaggatagatggttcctgagcccagggcattacgagacttcctaatttgaggcattcgctccaataccagttacctggagcattacaaaatccagttgctcggatttacaggcgcagcactcgaacagtcatcaagtgcaggtcctgcaggtaaggtggactatcgatatatcgacctagtcgcgcatacctcactcttcagccttcactgtagggcattggattgtctcaatagcaccgtcaactcactgtctgatacagatcacgaatctctgagcaaagaaacgatttcagaagcatccctgccgccccctgatgcccatgtggagaatacggagcatgacacctgaggcaacggtggtgacggcttgcatcgattcatatacagcactcatgctctacatgcttggaccatcaccatacatactgtgaggtcccgggtgccgaggctggatctcacacccatccttcagcaataccacctgaaggagataatcccgcacagaagtcagcatcatcgttgccgctctaacttctccatacccactgcttgtgcgtattacactaccgacctttgccaacgtatggacgaacagcgaccatccatggggagatcagtgacttcagttctctctcatccttacgatgcggccactcgtaccaacaagaaaagttctggggttggtactttggcagatgaaccttctcatggtatgtcagccagagtgctcaannnnnnnnnnaagatcagtgacttcatttctatctcatccttacgatgcggccactagtaccaacaagaaaacttctgaggttggtactttggcagataaacattctcatggtatgtcagccagagtgctcaacgttaagctccagtagtcgtagagcatttttgtcacagacggtaatcaggaaattaccgctccccgagtacattaccgagatatttggcctcattcaaggtctggttagcgagcgatggaggaccataaccaatttcacaaaatgaaggtgtcctcgcaatctatgaccattgcgagatctttccaactctgctgtcagggcaatcatactctgcgcggaatcaaccaaacaggacgtctgcgaatgttgcgaggcttgctcagatcaggctcgctgcacataagtctgcacaacaacagacccaagggttcttcgaggtcatgcatgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctctgtacaccttgaatcgtctcgacgacgatgagggcgaatgtggtcccagtctaggtattctgatcggaaatctaatggcactcatgccgaggggtatgacatttacgtgcgatcctgtggaccttgctagtgtcaatatatagatctggtgtgtgcccttgactcattgtaccgcataacctgagaactgaagcagtctaataggaaattaggaaggataccttgaatctgactcgaatacgcgcctgcaaaggggagctactacaaaacttgcaatctgtagcacagcaggtatggagcacctgagggagccgagggtatgcttccaaaagcgataataaaggctgatcagaggaaagaaagcacaggacccacctcgcatatggattggcgtaggcaattggtcttgctccctaagacgccactcgccccttgagccggtatcaaagctgccataacttgccttgcctgcttcaccggcccctggaagttctggggccgactgatggacctcagcttacattcataagcagccgcgagcgtgcgaaattaggagcgcaatatcccctgcgcaaggtagcatgctggcatgctccgagtagtcccctcattaaactcgtgtaaatatactttcattctgtacagctcnnnnnnnnnnggaagttgagaaaaatgaccggagggagtgcctgacagcgaatgaggacatcagaaaatcattgactagatactctgcaacattgaaaattatgtatacactgcaagtctttctcaacttactcctgcttgtgctgatagcgtatcgctattttgatatgcgctgagaaaagagggaatccttttgcgactgaaagagacagggagaaaagactgaataaatggagcacggcgtccacgcgttagagcagcccacttgcacgttgccctaaatccaccgctgcaaactaaaaaaatcctaatacaaaattcccaatgccgatattgcaatccacgacgtagatcatatagcaatgttctctgtcctgtgttttctccctgtatctgcgaatattaagggtagtgaaccatttcaatgccctgtgatgtggtaaggggggggcatttttaaccttgagatgcaatttatcaatgccctcacccaatgttacggtatgctcgcaccggctccataaaagcaccaaaaggagtgcaagattgagttctctgaggaatgacgatcaaactctgggcggcccatctgtgaacgatgattatccgaaggtgcacaccatccatgtatccattagcagtactcgagcaagagtttacaatttctggttacatatagctactgaaagagacactgcctttatgggtacgtccttagatcgtgcagtcatgggaatggttgagcagtattcaaattttagaagcacatggatatggggcggcggtaacgacgtagagcaacgaaaaagtgcataggaagcgcaccagtttatatcaagcggctaaacatcttacgatgttgagagccgctgacagtcagttggatattgcagggtccactaccactcggcgtaatcgccactcgcattgcattttgtcgcaaaaaggtagtcttctccttgtaaacgcaggtaggattggaatcacagaagttgtggagtgcctgagaggcatgtgtacctgccttgtaagaggctttaagcgctggcctctgctcgcatgacaaatctgttgccctttgtcacctcagtcccaaccagtagtgcacaattgccaggccgccgattctagcggtattaatcacctattgcttctgtagtaatgttgagaagtccggaatagccggaagcatgcacgcacgcaaactttcatttcaggcagttgtatcgcacagagcatcaaaacatttgctatcatttttacatcgttgggcattcttggcgtcgatggaacaagatcctatcaatgattctagaaggtcgtgatcttcccgcgacatagactcctctaattaacataggctcttgctgataatgatgttgcactgtacggacgtttaccgatgaaaagaatcattccaaagatcgtggcgacgcttttttcatatctatcacttctaatgttctttagcatcccaagggcattgcattagcttatctcattctcccgtgggattagctatccctgcagtgtggtatgtaagaggacgtgatatcagtcaaccgtaacaatttcccatctctatcaagaattagaaggacgtcgtttgtgcaggagctcagatactggcaggtgacaagggggaactctacacgaatattactggagttttgctgctgtaacaggtgcaaatctaggtgtatatgtgccgaggggcaagctatgctttgccatcgctaatgaactttc

SEQ ID NO: 37994 - DNA, 68389 bp, Chlorella protothecoides
  modified_base (818)..(827): a, c, t, g, unknown or other
  modified_base (1050)..(1059): a, c, t, g, unknown or other
  modified_base (1150)..(1159): a, c, t, g, unknown or other
  modified_base (1410)..(1419): a, c, t, g, unknown or other
  modified_base (1473)..(1482): a, c, t, g, unknown or other
  modified_base (3415)..(3424): a, c, t, g, unknown or other
  modified_base (4109)..(4175): a, c, t, g, unknown or other
  modified_base (5229)..(5238): a, c, t, g, unknown or other
  modified_base (6050)..(6059): a, c, t, g, unknown or other
  modified_base (7517)..(7526): a, c, t, g, unknown or other
  modified_base (7764)..(7773): a, c, t, g, unknown or other
  modified_base (8557)..(8566): a, c, t, g, unknown or other
  modified_base (9733)..(9742): a, c, t, g, unknown or other
  modified_base (10450)..(10459): a, c, t, g, unknown or other
  modified_base (11901)..(11910): a, c, t, g, unknown or other
  modified_base (12530)..(12539): a, c, t, g, unknown or other
  modified_base (13142)..(13151): a, c, t, g, unknown or other
  modified_base (14105)..(14114): a, c, t, g, unknown or other
  modified_base (14414)..(14475): a, c, t, g, unknown or other
  modified_base (15371)..(15380): a, c, t, g, unknown or other
  modified_base (15442)..(15634): a, c, t, g, unknown or other
  modified_base (15693)..(15702): a, c, t, g, unknown or other
  modified_base (15982)..(15991): a, c, t, g, unknown or other
  modified_base (16441)..(16450): a, c, t, g, unknown or other
  modified_base (17141)..(17150): a, c, t, g, unknown or other
  modified_base (17467)..(17476): a, c, t, g, unknown or other
  modified_base (18103)..(18112): a, c, t, g, unknown or other
  modified_base (18763)..(18772): a, c, t, g, unknown or other
  modified_base (18961)..(18970): a, c, t, g, unknown or other
  modified_base (19361)..(19370): a, c, t, g, unknown or other
  modified_base (19750)..(19759): a, c, t, g, unknown or other
  modified_base (19838)..(19847): a, c, t, g, unknown or other
  modified_base (20129)..(20138): a, c, t, g, unknown or other
  modified_base (21328)..(21337): a, c, t, g, unknown or other
  modified_base (21768)..(21810): a, c, t, g, unknown or other
  modified_base (22759)..(22768): a, c, t, g, unknown or other
  modified_base (23156)..(23165): a, c, t, g, unknown or other
  modified_base (23235)..(23244): a, c, t, g, unknown or other
  modified_base (23978)..(23987): a, c, t, g, unknown or other
  modified_base (25407)..(25416): a, c, t, g, unknown or other
  modified_base (25712)..(25721): a, c, t, g, unknown or other
  modified_base (26355)..(26407): a, c, t, g, unknown or other
  modified_base (27003)..(27012): a, c, t, g, unknown or other
  modified_base (28506)..(28515): a, c, t, g, unknown or other
  modified_base (29191)..(29200): a, c, t, g, unknown or other
  modified_base (30635)..(30644): a, c, t, g, unknown or other
  modified_base (31156)..(31165): a, c, t, g, unknown or other
  modified_base (31261)..(31270): a, c, t, g, unknown or other
  modified_base (31963)..(31972): a, c, t, g, unknown or other
  modified_base (33830)..(33874): a, c, t, g, unknown or other
  modified_base (34094)..(34103): a, c, t, g, unknown or other
  modified_base (34213)..(34222): a, c, t, g, unknown or other
  modified_base (34737)..(34746): a, c, t, g, unknown or other
  modified_base (35680)..(35689): a, c, t, g, unknown or other
  modified_base (35965)..(35974): a, c, t, g, unknown or other
  modified_base (36211)..(36220): a, c, t, g, unknown or other
  modified_base (36437)..(36446): a, c, t, g, unknown or other
  modified_base (36518)..(36645): a, c, t, g, unknown or other
  modified_base (36736)..(36745): a, c, t, g, unknown or other
  modified_base (37200)..(37209): a, c, t, g, unknown or other
  modified_base (37473)..(37482): a, c, t, g, unknown or other
  modified_base (37806)..(37815): a, c, t, g, unknown or other
  modified_base (38469)..(38478): a, c, t, g, unknown or other
  modified_base (38883)..(38892): a, c, t, g, unknown or other
  modified_base (39137)..(39146): a, c, t, g, unknown or other
  modified_base (39692)..(39701): a, c, t, g, unknown or other
  modified_base (40001)..(40010): a, c, t, g, unknown or other
  modified_base (40583)..(40592): a, c, t, g, unknown or other
  modified_base (41281)..(41290): a, c, t, g, unknown or other
  modified_base (41570)..(41579): a, c, t, g, unknown or other
  modified_base (41737)..(41746): a, c, t, g, unknown or other
  modified_base (42069)..(42162): a, c, t, g, unknown or other
  modified_base (43395)..(43404): a, c, t, g, unknown or other
  modified_base (43862)..(43871): a, c, t, g, unknown or other
  modified_base (44344)..(44353): a, c, t, g, unknown or other
  modified_base (44790)..(44799): a, c, t, g, unknown or other
  modified_base (45071)..(45080): a, c, t, g, unknown or other
  modified_base (45441)..(45450): a, c, t, g, unknown or other
  modified_base (46367)..(46376): a, c, t, g, unknown or other
  modified_base (46652)..(46661): a, c, t, g, unknown or other
  modified_base (46886)..(46895): a, c, t, g, unknown or other
  modified_base (47187)..(47196): a, c, t, g, unknown or other
  modified_base (47462)..(47471): a, c, t, g, unknown or other
  modified_base (48024)..(48033): a, c, t, g, unknown or other
  modified_base (48294)..(48527): a, c, t, g, unknown or other
  modified_base (48591)..(48600): a, c, t, g, unknown or other
  modified_base (49015)..(49024): a, c, t, g, unknown or other
  modified_base (49153)..(49162): a, c, t, g, unknown or other
  modified_base (49306)..(49315): a, c, t, g, unknown or other
  modified_base (51542)..(51551): a, c, t, g, unknown or other
  modified_base (51908)..(51917): a, c, t, g, unknown or other
  modified_base (53382)..(53391): a, c, t, g, unknown or other
  modified_base (54034)..(54043): a, c, t, g, unknown or other
  modified_base (55491)..(55500): a, c, t, g, unknown or other
  modified_base (57371)..(57380): a, c, t, g, unknown or other
  modified_base (57462)..(57530): a, c, t, g, unknown or other
  modified_base (57734)..(57743): a, c, t, g, unknown or other
  modified_base (58962)..(58971): a, c, t, g, unknown or other
  modified_base (59614)..(59623): a, c, t, g, unknown or other
  modified_base (60198)..(60207): a, c, t, g, unknown or other
  modified_base (60546)..(60625): a, c, t, g, unknown or other
  modified_base (61009)..(61018): a, c, t, g, unknown or other
  modified_base (61961)..(61970): a, c, t, g, unknown or other
  modified_base (62689)..(62698): a, c, t, g, unknown or other
  modified_base (63594)..(63650): a, c, t, g, unknown or other
  modified_base (64401)..(64410): a, c, t, g, unknown or other
  modified_base (65491)..(65500): a, c, t, g, unknown or other
  modified_base (65825)..(65834): a, c, t, g, unknown or other
  modified_base (66313)..(66322): a, c, t, g, unknown or other
  modified_base (66674)..(66683): a, c, t, g, unknown or other
  modified_base (66969)..(66978): a, c, t, g, unknown or other
  modified_base (67222)..(67231): a, c, t, g, unknown or other
  modified_base (67713)..(67722): a, c, t, g, unknown or other
  modified_base (68026)..(68035): a, c, t, g, unknown or other
  modified_base (68216)..(68242): a, c, t, g, unknown or other
ccccccccccccccccccccccctcccctcaaccaccaaccgcatcacatctctgccttccatatggtcgcagagctgactggcgaggaccctgcccccgtccctgccaccgacccggaacgactcaagggcctgtccagccctcctgaggaggacgaggatgagggctcggatcctggcctgtccggggtctggcgcgccatccccttcctcccaagccttgtcgaggccatagtgggcacgccctacgaggaggaggaggaggaggaggcggcccacgaggatagcaggagccggcgccgcgccgacgagcagcgggcggccgaggccgcggctgcgcacgcctccgctgcggcccttggtgccgagcagaacgagccggtgccgctgcgagtggacccgcgcgcccgtgaccccctggccgagcccagctcgctgctgcggccgggggaggccgcggccctcgccaccctctgccccacacggcaccgcctggcgcgctggcagctggcctacagcacgctgcgggacggcatctccatgcagaccatgctgaggatggggcatggcagggctcccaccgtgctcgtcgtccgagacatggacaggtgccgacgggttgagtgctaagtccatctgggcgctgggagtggtggtgccggtgcctgcgtgtctggctgcgggagcggtggcctctcgaggcgcaggcaaggatgccacgcataggtgctgggactgtgcctcgatcgagccggggcacgagaggaggatcgtcgcctccctgccgacaggtgcttgggtgttgctgctctgatgcnnnnnnnnnnaggcctctcgagggggaggcaaggatgccacgaataggtgctgggactgtgcctcgtttaagccgtggcacgagaggaggatggtcgcctccctgccaacaggtgcttgggtgttgctgctctgatgccatcaagtaccccatcctgcaggaatgtgatgggggccttctgctccgagccctggcgcacatccacccgcttctatggaacaggcgagaccttnnnnnnnnnntttcggcaatgccgggccgaagtttgcaggcttgcgccttatcgtgcggtgcataacagcttggcgcgctgccgtgctccggagctttccnnnnnnnnnntcttccagctcgggactcagcaggtgcggggatggtgcgggcgcgaagagtgcctgctttctgtttggcaatgccgggccgaagtttgcagccttgcgccgtatcgtgcggtgcaaaacagtttggcgcgctgccgtgctccggagctttcctctccccaaaccttcttcctgaatcccctccgttccttttgtgtcgagtaccagcgtgcatggcggtggtggacacagcagaacgcccgagcctccaannnnnnnnnnaggcccagggtcatgcactgcaatacatggcctcgtgccctgtgctgggagctnnnnnnnnnnactacttcatgtggggcgatgcggagggcatcgccgtcggcggctctggcgggtgagttgctccctgatgacagtcttggacccagacccaggctcatgcactgcactacatggcctcgtgccctgtgctgggagctgccctggctgacagctgcaatggttctcctcttcaccaacgatgccaccacaccctcgcatggcaggtatgccatctggctggatgccgactttgccaagggcctgtcccgctcatgcctgacgtttggcagtcctcccctagtcccaattgaggagtttgatgtgggagctgtggagttgtggtggctccgatgacactgggtggctccctaggaccatcaaagcattgcacccagagctctgagctggtgatcctgccctctgcctccaaagtatcgagctatttgtatcatatcaagcaccctgagagaatgtcttattgtctgtaccgcactgttcatgagcttgggaggcgggtcaacagctcgtcggctgtggcgccctcttccaaatccaccaggacatgctgagggacgacgggggcgcgagaatgggcgcaaaggtgatttgcaaacaatccacgtactgcgagcagctctatcattcaaggtgtccgattctatatacaggctccaccagaccacatctgcgtgtcgtttaccgtagcactctggccgtgcatgtcggcccaataaggcagggccgtcgtactgcgtacacagacgactgtgacgctcgacaggactagatatgacggatgcggtagatgctgcggcccccgcgcgggccaataagtcgagaaagaggagtgacggccctaagaccggggtggccaagtaccggcgaggggaggaggtctccaccaagacggtgcgcgagtgtgcttcctgtgacgagagtatctattgccctttcacgactttggagtggcgatgtcattccagttccattcatgcatgcgcgcaggtcaaggataagaagctgaagggccagctcttgtacacagagcggtgtgtgccacgggctctgggatgtgttgccagctgtggagcggttgtgaatgcgcagcagactgtgcttgcggacacccggcagcatgcactgaatctcttacctccgtgttcctctcacccttcccccttcactttcagggtgttcaaggatgcccagaaggcagctgcgcgcgtggatgactggctgctgccggctgcggctggcggcttggaggcggagggcatggagcagacgtggcgcttccaccaggaagacatcgtccaggcaaggctttgtgattttggagggtggaggcagggaacgatgcccctcacatggccagtcccgagaatgagaagcctgtgtgcaggtcccagtcaccagctcactcatgctgccctcctctgcctgccggcttcgctcatgcaccttgggcccatccactccaacccatccagccccacccaatcccacccacccctaccccattcccctcgctgtaggcggtagaagtaggtgccgggcccaaggcctttgacctctccctcccttccctaggcccctatgcgctggccaccacccgcgcagggcggtaccttgcgctgggcgggcaccgcgggcacctagcgctcatggaccgcttgcagtcgcgcgtgttgtgcgaggtgcaggtcaaggaaagcgtgcacgacgtgtcggtactgcacagcgaggcgttcttcgccgccgcgcagcgcaagtacgtctacatctacgacaagcggggcatcgaggtccactgcctcaaggtgagcgcggggtgaggggggccttttgttgcaggagggtgtaccgtgctgcctggggtgttttcatggggggaagaagtcgcctcgtctcttggcacctgcatgcatggtctccccttggtcgcctgcgcctnnnnnnnnnnaggggccttttgttgcaggagggtgttttcaagagggggaggagtcgcctcgtctctcggcacctgcgtgcatggtctccccttggtcgcctgcgcctcccggtgtgccctcgaaacccaaagcccatgaaacaatgtctcgtgcccttcccttctctcactcccatcacctttagatgacttccacccccgcaaaaaaaaccacaacacccctcgacaggcgcacaccaacgtctggcgcctggacttcctgccgcaccacttcctgctgacctccgtgggcgcctcgggcgtgctgacctggcaggacaccagcacggggcagatcgtggcgtcggccaagaccagggccggcccctgccgcgtgctcacgcatgatccctccactggcgtgagcacgctcggccacggccgcggcacagtatccctctggacgcccacctcccccgtccccgccgcgcgcctgctgtgccaccacggccccgtgctggcggcggcgcacgcgccgcgcggcgccggcgccggcccgctcctggtcaccaccggcgccgaccgcgcggtcaaagtgtgggacatgcgcatgatgcgggcgctgcacgcctacaacgcgcccgccccagccgccgcgctggacatcagccagcgaggggctctggccgtggggtgggggcggcgggggcagggnnnnnnnnnnnnnnnnnnnnnnnnnnnnnnnnnnnnnnnnnnnnnnnnnnnnnnnnnnnnnnnnnnncgccgcgccctacttgaaccacacgctgccgcacgccgggctgcgcgacctggtgttctgcccctacgacgtgagccggggggtgggggattggtcatctgtgtgtgtgtttggatggctgggagagcggaggggcgctgtcttgtgaggggcaggaaatgtgggcctgagggaggtgggtgatgcgatcctcgccgctgccgcacaagcctttgggcgagggaacgacgcggaggcctgcgatgtctaccgatgccccgtgctgaccttgcactcgatggtggacgcgccgcagcctcgagcgagggactgcagatttcagggtttccgccgctccctgtgccgccttctgtactacacgttctcccataccttcctccttgcacacacatcctccctcctcaccctcaacaggatgtgctggcggcagggcacggcgggggggtcagcgcgctgctcgttcccggcgcgggcgagcccaactacgacagcctggtggcggatcccttccagcggcgcaaggcggcgcgcgaggcggaggtggccttcctgctggacaagctgcagccgggcatgatcgtgctggaccccgactccatcggcggcctggcgcgggagcccaaggaggtgcagaaggagcgcgcggaggcggcggccgcggccaacgcggcggccctggcggcgcagcgcgccaaggccgacgccaagacgccgatgaagggcaagaacaagcccactcggaaacggcggaagaagcagcagaatgtcatcgacgacaaggcgccagcgatgcgggcgcgcatggccgagcagggcgtgctgggcggtggccacgctcggaaggagagcgagcccatcccggagtcggtgccacgcgccctgcaccgcttcgtcgtccggaagtgacggctgcgggccgtggcaggcagtgtgaggtgctgggagggccggggacttactgcaaggagctggagtcatcggcctggggcgggcagcccagcacagtggctgtggacggaagaccgtgccaatgcactctggccaatgcacatgnnnnnnnnnngggcagtgttgaggtgctgggagggccagggcattactgcaaggagccggagtcatcggcctgaggcgggcagtccagcacagtggctgtggacggaagatcgtgccaatgcactctggccaatgcacatggccaatgcacatgtgcacttggttccctcaaaattcttgatcgattcccttcagagtctctgcttgccagccgtgagcacacccactccaagctccctggtagacactggatcaacccccaccaccccgctgcttgccagccgatgtaccacgcacctctgacccctgtgcatgtgtacgaccgcagcatgttgccagactgcactcgaacaaggagcatggctgctccccagcagtgcaagcatggcacagacagagagtgccctcacatctcggcgccaaacccgccgctcccgaagtggtccttgctgttccgccccgcgtcccttgtgtcgctgcgcagcttggggcagtcggcgatgcggtggcccagcccaccgcagtacacgcaacccctcgtgcccgaggccgcctccagttcctgcgtgagcgaatggtggcgtgaggggagggatcagggcgtgagggagtggggagttggatgaagcaccgacaggaaggggcttcatgtgggcgcagcatccccgtggtttctccatccctgcctgcctcgaagcagcaggcattcagaattcctgcttctgggtcctggcagatttcatcgctcaggactgtcatccatcagcaggcctcggcaccccctccccctcccccctttcctcaaccaaccccctcactctnnnnnnnnnngagcaccgacaggaaggggcttcgtgtgggcgcagcatccctgtggtttctccatccctgcctgccttgaagcagcaggcattcagaattcctgcttctgggtcctggcagacttcatcgctcaggactgtaatccatcagcaggcctcggcaccccaccccccttccccctttcctcaaccaaccccctcactctccctcacccgcagctcgtccatggggtcgtgcagggcctgcaggaccggggggatgcgctgcttggcctcgcgcaagaggtgcttcaggtccagcagaatgctctcgctctgcgccttgttgatgaaggtggtggccaggcccgtcttgccgcgccgccccgtgcgcccgatccggtgcacgtagttttcgatctcctcgggcatgtcgtagttgatcacgtgctgcacgttttggaagtccagccccttggacgccacgtccgtggcgatcagcacatcctggaacgtgggtgtggggagggcgggtgggtcagtcatgtgcgtcgagggaggatagtctagtgagagaggtgggagggtgcacagcgggtgcagggtctgcaggacaatttcttgtggcatgtgccggggcagatggcacactccagaccagcaccccgtggccagaagatcagcaccggactctccccacccctcaaactccacgtcttcctaccttctgccccgtcttgaagctctggatggcccactccctgtcctcctggtccttggaaccgtggctggccaccgcctccacgcccttgaggagcaggaactggtggatggtgtccacgtcctttttgccctccgcaaacacaagcaccggcggcggtgtcttctgcaggcactccaggaggtaggccagtttggcctcctccttgacgtactccacctcctgaatgatgtccaggttggtcgcccctgcccggcccacgttgacggtcacggggtccaccagcgccgactcggcaaaggccttgatcttcataggcatggtggcggagaacatgagcatctgccgctggccggtgaagaaggacaggatctcgcggatgtcctcctcgaaccccagatccaccatgcggtccgcctcgtccaggcacacgtagcggcaggcgtccagggtcatgcgtcgcttggccagcaagtccttgaggcggccgggggtggccaccaccatgtgcacgccggcgcggatggcgtcgccctgggacttcatgtccacgccaccaatggtcagcagtgtgcgcagctcgggggcgccgtctgcggcagagtttgtggggtgcagagtttctggaaaggtcaatcggtggggacaggggtccacaggcaggagttcagggtcagacagagagccgcggagggagcctgtaccagcacgatcctggtaaagcagtggacgtcgctggcagtttacaaagccatgcatctggcatgnnnnnnnnnnttggaaaggtcaatcggtggggacggggttccacaggcaggggttcaggttcagacagagagccgcggagggagcctataccagcacgatcctggtaaagcagtgggacgtcgtcggcagtttacaaagccatgcatctggcatgttcaggccagccaaccgccaagtcaagcaggccacatggacaatatccatacctccaatccacgcccgcacctgccctgagggcttctgagtnnnnnnnnnnttatatccaaacctccaatccgcgcccgcacctgccctgagggcttctgagtaggcaacaacaatgtcgtaggtctggcgggccagctcgcgggaggggcagatgaccatgccgatggggccctccccgccctccagccgcatcctgacctcctcctgggcgaggagtggagacgagacggggcacgtcatgttgaccagcaagcccagagcacagcagcccgtaagcatgcccctttgtacgccacagggtcgattgacacaatgcacagactcccactcccacaaagagatgccctcctcacctggtaggcagcgaggaccatgggcagggcaaaggccagggtcttgcccgagccggtgaaggcgatgccaatcatgtcccgccctgacagaatggccggcaggccctgcatctggatgggcgtgggcttcttaatcccggcatcggccaggtagcgcaggatggagggcggcagccgcatgtcctcgaaggcggggatggggggggggaggtggtgcccctcgcagatgatgtagaagtggtccctcactcgctgcatgggtgttgaaggagaggggaagtggtatcagcccgtggagaaggggaatcattgggcttgtgggtgagatatcatagagttggatgctctggaattgcaggtgccagcaggagagcacactggactgccagagcatgtccttttgcaagactcctttcccctccacagccaaaaagaaatgacaaacaaaaacgaacctggtgctcgtcctcggaggtcagnnnnnnnnnngcagggctcccagagcatgtccttttgcaggactccttccccctccactgccaaaaagaaaagacaaacaaacacgaacctggtgctcgtcctcggaggtcaggcggtacttgaggggcggcttccaccccgtcttcatcacttgcgtgtatttgatgtccttcgccagttccgcataagtcttcagcgccgccttctgggtgatgctgcgcatcagctctgcttcctccttcagcacgcgctcctgctcggtctcgcccaagccctggcaaggcaagagtggcgggaggaagggatgggatgggaggtcacaggccatcgggctggggcgaggcacgctccctgcgcatgcagtggtcccatggtccacccacctcctgcagggccttggccttgaggatgagcagggactccttgccacgctgctgcacggccggctgttgatccctgggtgctgcccccgcgccatcggacgacccgccgtccttgttccggagaggctctccattcaagggagcgaccagcgacggccggccgagcctggacaagcgggactggacctccaactgccgccgtttcttcaccgggatgtactcctcatacctgagaacacgtatgcgaagcgtcagtcatgcttcaagtagtttgcatggcgttgcgcggccatatttaatgcacactcgagctatgcctactcactcctcgtcctccacgggcagggcctccgcctcctcatccctggccatgcccagaatgcgatgaagctcgcagtcagagcctttgtgaaattcactctggttggcggatgcgaggaggatccccgaacgtggtcgtgcaggactggagatgtgtcggagaggccctcggggtctcagaacagagggcaaataccttgaatcggagtgaaatttgagctgatggtgataatgaaaaccttggcagcgctggcaatgcccacagaggctgcatattgtagacgcacggctcggtcactgaaccatcgctcgatctgaagcgcgcgctcgaacttggggagggacggccttttccggcaggggcatgcaccggctgtggaacccaatttgaaagcgttgtattacatgaccaccagtgtcattcactggcaaacatgttgatgctgcgcactcagcagcctccccgcagcgnnnnnnnnnnaatctgaagcgcgcgctcaaacttggggagagacggcctcttctggcaaggcatgcaccggctgtgggacccaattttgaaagcgttgtattacataaccaccagtgccattcactggcaaacatgttggtgctgcgcactcagcagcctccccgcagcgcaagcaccaggtggaggaccgagcctccctcgatgttgtactccttggcgagcttgtcgtcattcatctgcttgccggcaaagatcagcctggcaggggcagggccaggagggggagtgttcagatattctcttactcagggactgctggatgggtcaggctcaacgcgcctgagcttgctgcagacagcactcgcacgacctcctctccaggatgctttgggtaggtcccatgcatgtgccagccttgccagcgcttgcagccgcaacatgagaaatctgatcacccatacctctgctgcacgggtgggatgccctccctctcctccacacgctccttgattcgggcgattgagtcattgggctcgatgtcgatctcgatctccttgccagtcagcgttttgacctggtgtagggggatggagggaggattgcgtcagtcgctctggaccagtcatgcaataggtgtgaccaaacctagacactctcgcaccttgatcatcatgccaccgcggaggcgggggaccgcagtgcacgcttgggggcacnnnnnnnnnngcactctggcaccttgatcatcatgccaccgcggagtcgggggaccgcagtgcactcttgggggcactgggcgtccgccgagtggtgcagccactccctgcagcctgcatacaggcgaaagtcctggatcctccaccccgtcaaggtggctacgcgcgccttgaccgcatctggagagatgaactgggtgagtcacgtccggtgaatttcgaatggcggcagagcaaggacgcgcaaggtctcccccacccgcttgcctgggctcaggacttctccgacgtcgaggacgaggggaccaccctccttcagatttgcaagcactcgcatattacaagctggtaggctcctcaggatctcagtcgtgcccggcctccctgcctgtgaggtacagccctatctgccctgaagtgatcacttcagaccttgctgtgtcaaaggctcgtttgctgctggaccaatgaagtgcgtcgtgcctcctcgacccttgcatgtgagtgatgcgtggggtcctgtgatgcgtgagattgagggggcaaacgggtagatggaggtgagtcttgctggcgtggcatcggctgactggcgggaagtccacccctgggcagtgactggttgtcaggccaacatgacgagcacgagcggggcgcgcccgttatgaatcctttccggagcatgttggtgtttgagggagttgaagagcgagtccatgaattctgggatcaactacaggtgaggcgagggcgttatgatctgggcgaagccgacccggcgcgaacccaaagagccaggaagacggggattggttattgattgggaacatattcattgatcattgggtatgtttcataagctgcaaacaatcttgtggcgcctttctttcgcgcagacctctcgtacagtccatcatgccgttcggcaccaacgagtccctgcaaaacctcacatgctctgaactctccaccaccgcagcgagcgctactacgacgacgtgtacgagtataggcatgtagtgctcccccccgagatcgcgactcggctgccaaaagaccgcttgctgcatgagcacgagtggcgctcactgggtgtgcagcagtcccggggctggatccactacaccatccaccgccccgagccccacatcatgctcttccgacgagcaaaggggtacggcacagccgcagccgtagtgcccatgcagcagtaaacacgcgctgtggcatggctctcccaaaccctaggttctgactggacctgctggagtagacaaacatgccggcccctgagcctagcacccccttttcccaagtcaaagcctgtgatgggattcccccccctcatcaaagctcagccctccctatttgagaaccccttgctgcaccccacccgattccgccagccctccagcgcgggtgaccttgcctcaaagccttcccgattcatgnnnnnnnnnncagccctccctgtttgagaaccccttgctgcaccccacccaattccaccagccctccagcgcgggcgaccttgcctcaaagccttcccgattcatgattcactggatccaaatcgcccctgtgaccttctctcgccatgcgaggctgccaagctgatcctctgctgtaatgcagggtgctgaggaacggtgagttattgggtctggcaatgaattggaaggggatggtgaaaaccacgtcgcggaaaacagtgatcgcaaattctgcgcggggggccctcggccactccaggtcaagccgagtggccagcaggggtggacagccgcaccgtcagtcggagcccaccacgcgcatgagctgaatggcaccggccgagttcgctgcgagcaggtgctccgcccccggccgccaggccactgcggagacaaagggctgggggggagctggccgcatgccgcctggggctggggcgggggccggcaccggcgtctggatggcctggcaggccaggggccgcggcaagcgggttccatacacgtacacctcgttggtctcgctgccgctcgcaatgaggccgtcctccactgcagacgggagggggaggaaaggggggaaagggnnnnnnnnnntcggcgtctggatggcctggcaggccagaggccgcggcaggcgggttccatacacatacacctcgttggtctcgctgccgctcgcgatgaggccgtcctccactgcggacgggagggggaggaaaggggggaaaggggggggggtgcggatgtgtggggaagaatgggttggacatgccccgactgaccatggcatgccgagctgctggacatgatatgcacaggtccgcatgccccctccatcacctccgtgccctgcgacaagctcccagcgcactctccacaccctcatacccctgccactccctgactcaccgcacagacccacaaagttcttctcgttggtgtgccccgtgtagctggagggccctggcccggggtcggcgcccagcatgccccatcgtcgcagcgtggagtcagtggaggcggtgatcaggctgccagagtccagccagcgcacgtacgacactggcttgctgccaaatgcgggggtggggtgggggaaagccaggtggtgtggggaatcttggggacaggatggacatgaacacgcaccccgaaacatgatgataggaacaggcagagccgtgagggcacagatcnnnnnnnnnntgcaccccgaaccacgatgatgggaacaggcagagccgtgagtgcacagatcccagaccagccggcctgcccaggtgccccctcatccacgacaacaacaagcacccggcgccttgaccacagcccgcgccgcacctgtggcctgacagcgtctccagcggccgcgccacatggcgcgtgtcgtacaggtacgcgtggtggtccgagcagcccagggccacatggtggctggaccccgggcgccaccgcacgcagcacacgttgacgcccacgtcgatctgcaggggaggggatgatgggtggggaggggggttggcccttctaccgccttgcaccctgttccttccctccttccaccgttgccaaccccccaacccccccctccacacacacacacacacacacacacacacctgtccgaccatggtggcgaggctggtggaccacagcttgaccaggccgtcgtcggaaccggtggccagcaggccctgggccgctgcgcagtagtgcactgcccagacgcggcgcacgtgcgcctcgaattcgtgcaccaacgccagaccctccacgtcccacaggctcatggcgccgtcgtagtcagaggcggccacacggtgctcgctgcccgggtcccagctcagggaggagatcttggagcgggccatgagctccgccgccggcggctgctgcgccggcgagcccggggccagcaccgcggcgtgctcgtacacgctgtggtggggcagggggtccggcatggatgcggaatgactgggtgttttccttgggaaaggggggggggggggtcccaccaagagaaaggggaaaagcactcccagggaaggagcagagatgggttttagtatggagcagcagtgttgaagccttgtccaggaggtgtgcactgtggaccggccacccgcccaggcacccgcccacccccccaggcacccnnnnnnnnnnttcccagggaaggagcagagatgggtttcagtatggagcagtagtgtcgaaaccttgtccaggaggtgtgcaccgtggatcgggcatccgcccaggcacccgcccacccccggctccccacctgatgcggcgcgacactcccgcgcaggcaaacaggttgccgcggctgttgtactccagccccgacacgatgctgttgggccgggcgccaggcgggcgcgggatgacggccacggtctccagcgccgcggcgcggtggaccaggtccagcgcccccgccagcgcgcccaggcccccgcnnnnnnnnnnnnnnnnnnnnnnnnnnnnnnnnnnnnnnnnnnnnnnnnnnnnnnnnnnnnnngcccccgcgcccgcgccgcgccgcgcctcgtaggccgccagcaggccgtccaggtgttgcgacaggcgggcgcgcttgccgccaggaacgaagagcggggcgcctgccaggtcctgcgtcgggtcggggccgggggcggggtctcggggcgacacgccgctgcccgaggcgttgctggagtcctcaccctcctcgcggctggacccagtgtcctccagctcggtgccaggcaggcagccagggtcgacccgccgcgccacagcgcggatgtcggtctccaggcagtccagccggtcctgcaccctgtccagctccgcctccttggactgcctgtggggtgaggggaggggccgccatgactggggtggggaggaaggaacgatgggcagcgacacgagtggtaagggaggtgttggggttgcaggggatgtgacttgatcgggcgaggagcgaaagagcctggcttcaggccaggctggcaaggcttggccagggaaggcatgatggggtcgccgcgccagccaataatcatcatgatagggtagcccctccaacaccacaggacgcaaagacctcccccccccctctccccaaatcatccaccccctcgcctcgtcttctggaggaagtggaggagcaggtggggtgcagggtcgcgctgccgctgcgtccagagcaggtgcagcgcggcgtccagctcctctggcagcatggcggggccaacctcctccagcaggcgcttgaggcgggcgattggggacaggcgcatgcgcgcgcctcgcacctccagcgccttgcacaccccggccagcaggtggttgggccagacccgggcctccgtgaggtaggaccggcagcaggggcaggtgctgtcccgctggacgtggcgcaggatnnnnnnnnnnaaagtggaggagcaggtggggggccgggtcacgctgccgctgcgtccagagcaggtgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggcgtggcagaaggtgtgcccgcacggggtcacgcacgggctgcgcatcacctcgnnnnnnnnnngcaggcgtggcagaaggtatggccgcagggggtcacgcacgggctgcgcatcacctcgcggcacacggggcaggagaagtccgcatgcgaggccacatcctcccctgggcccgcggaggacgcatgaaccgctggcatgtccattacatggtgctgtaggccggtgcgctgcctgcttgagggggccgggcggtcagcaggctggtttgatctgccgagtgggacgggcgcgagtgccatgcgggcaggccttcgcccatggtgctgtggtgttcttggnnnnnnnnnngttgggacgggcgcgagtgccatgcagacagcccttcgcccatggtgctgtggtgttcttggagccgggtggagggaccagatccagcgagataactgagaattgggggcatcgaggtgcaggtcgcgcccatgcatgctcgtatctgggactggtggtcagtaggggtcctctgaggtggccagggactgattgagggcgccggggactcctgtccccagatgtgcggcttgcacagaaatgggatgatccctctgcaagaaccaccccattcatgtctcagccttcattattgagcacacttgtgtgtcacacaacccgcttcttcgctgtgttgccaaggcgtctgttgaggggggcttggccaaggcgtccctcacggcgaaacaaccgcggggggagagtttcacatggcaggcacatctgagggcatataagaccacaaagcannnnnnnnnnaagggggcttggctatggcgtccctcacggcgaaacaactgcgggaggggaagtttcacatggcggggacatctgagggcatataagaccacaaagcataatcttcttccgcaggcctgcatgagcatgcagccttcactctctgatccgcgttactggtgcccacatcggacctcccggagagatccaggaagttggtcggactggtttgtaccacgacccaatctccccaggcagatctcgacacccacacatcactcagaaaggctctcgaacctatctctgcatacattagattgtctcaacaccaccttgaagtaaccttggtgccatggagagacaggatgccctcaccctggccgccctcccgctcctcgggatatggttgctagtggctcgcatcctgtccatgctcacccccctcctagccccctggctctcgtacctgctagcacaaagactgtactatgccacccccttcgcggtgtacgccctgaggagcggggggggtgccaaggccatcctcacccggctaggtttcgaggcctcatattgcatgaatggtgagcgccggatggtgtcggaacccaggccccctctgtcgggtggcgtggaatgctcctaccggcagagaacgacaagttccgtatattgtcgacaccccctcccccccccttcccctcccgtagtnnnnnnnnnngcgacaaattccgtatattgttgaccccccctcccccccccttcccctcccgtagtggtgcgacggtacctgaccctgcccctgcgtccccacctaccccacttctacatcgtggggttccccaagtgcggcaccacttccatgtgcacctacctgaagcagcacccgtgcatagacggtctggacgggcttccctaccacgagatcttggagaagtgggtcgggcgcgtgtcgggatcgggggcggtcgggaccctgggcggggggtgggcatgccaggaaacccagtctctgcccaggctctgggcacgccttcnnnnnnnnnnacgggcgggaccctgggcggggggttgggcatgccaggaaaccaagtctctgcccaggctctgggcacgccttccccatagccatgcactcacccacccaccctcccttactcaccaccaaatttccaacccccaaactcccccccatctcccccccagggagtcccacttctatgttggggccctgggccgctcctccaccaccagcacctcggcctaccgctccttcttccccaccatcgtggcatccaccctggcgcgcgtccgccacggcaactggctctgctttgacgcctgccccgtgcacgcctgcctgcctcatgtccccgcccgcatgaaggccatgacgcccaacgccaagctggtcttcatgatgagggacccgctggcggccgtcatctcgggcgagctcatggtgagcgtgtgtgggacggggtgtgaggaacctggggcgcccgcggacattgttgtgaggattcagttgctgatgacgcggcagtggttggatactaggagactggctgagctgctcttcctccggcgtggagaacgtctgatccgctccaaacccagcaagaggcggcgctggtgacccaccccacggcctccatccctgctggctgaccnnnnnnnnnntggcgtggagaacgtctgatctgctccaaacccatcaagaggcggcgctggtgacccgccccacggcctccatccctgctggctgaccatcacaccctctcttgcacactttcctctgcacaatcacagctccgggacctgggcatgcccctgcagtggtccacgctgggcgagcacgacctggcgggggacagcctggccgagacggaggaggacagcgcgtactgggcggctgtcgagaagctgccccttgatgaacctctccccgccgacctcatgcagcgcttctacagcaccaccgacccgcggcccgcgctgcgcgccgccaagtatgccgactgcctggaccgcttcttccgagccttccccaaggagaacatgatgttcgtagactttgccgactttgtggcgcagccagaggtcaccgtgcgctccgtgctcaagttcgtgggcgccgacgcggcgctgccggcctacgccttcaagcccatgccgccggggatgcaggtgcggcggtgggagctgtggagcagcaggaggaggggggcggtggcgtgtctgtgtctggaggttggatgcccactgggcaggatcaccctgcctccccccaggtctgggctggcccaagcaggcccttgcatggtgcgtcannnnnnnnnngtcaccctgcctcctcccaggtctcggcaggcccaagcaggcccttgcatggtgcgtcaggccccaacactcctgcatccctgcgcgcccccggcccctgaatcagtccgtagacctctgctcatgccatgaatccaatcccttcttcgactccaaactcgctccgcagggcaagccccgcggcaggannnnnnnnnnttaatcccttcttcaactccaaattcgctccgcagggcaagccccgcggcaggacgatgcacccggcggtcaagcagcggctgcgccagtactatcgctccagcaacctggccctgcaacagatgctgggcaggtccctctcttggtttggcgaggacgtgtgaggcatgagtcgtcgacggcgcacgcactggccacgctcaaacggcccagatcgcttcacagctgctcctatgactcgcggcggccgccgtcggagccacccttcagggccttatcaggcacacaacccccttggtccttttcgttgatccatgcaatgaacctctctttccctggtatatacacttctggtgccgcgtgaaggtgtcagggctggcttgccacctcnnnnnnnnnntcagatcgctccatggccgctcctatgactcgcgggagccgccgttggagccagccttcaggcccttagcaggcacacaacccccttggtcctttccgttgatctatgcaatgaacctcttttcccctggcatatacacttctggtgctgagtgaaggtgtcagggctggcttgccacctcagctcgttcctgggcggcctcacagtcaggcagcagcatgccttgcggcacctggcctcccgtgggagttctcgacgcggcttcacgttcccaatgttggcatcttggcatccttgtgtgtaagagacttaccactcctggtgtgtgtgcttgtaggacccatgcgacgatgactctccctgccagagttgctcaaacnnnnnnnnnncggcagcagcatgccttgcggcaccttgcctcccgtgcgagttctcgccgcggcttcacgttcccaatgttggcatctnnnnnnnnnnagtacccagattgaccaatctggacgccagtcaggattgcctgctcttacagagggcgtgagggtgatgagggaggtattcccccaagcaatgagccatatgaaaaatgaatgtcgtgaaatgggagatgcccacatcctcgagaggacgaggggaggaggagggcaaccaaccccctccgagagcccgggggttcccagtgcaagtgcaatgcctgaatgagtcctctcgggccctgtgcggctcaccgtctccccagcagccgacccaagggggccactnnnnnnnnnnggtacccagattgaccagtctgaacgtcagtcaggattgcctgctctcacagagggcgtgagggtgatgagggaggtaatcccccaagcaatgcgccatatgaaaaatcaatgtcgtgaaatgggagatgcacacatcctcgagaggacgatgggaggaggagggcaaccaaccccctgcgagagcccggggtttcccagtgcaagtgcaatgcctgatggagtcctcttgggccctgtgcggctcactgcctccccagcagccgacccaagggggccactggggtcgcgccgctgcggcgccgccagcccagcgccgtcagcgcagcgcagagccggcatgcatcagcgcctgtatggcccgctcgtgctgacgcagcaggatggagggcccgctgatcctgcggaacagcccgatcttctgcagcaggtgcttgagccgctccacatccttgagctcgcaccagccctgtggggtggagtggatgggtgggggcccggcgtcacagcagcgcgccagtgacgtgggcggcggacagggatggggtggggagtcggcacttgatcgacatgagcatgagggccggcgcaggccaggagcagccatgcccactgccctcttctcccccacgttctattggcacgccgcgccctctgcggcgcctcccctactcttcctcccacccatggattctagcccccccaaactgcccctaaaagtggccttcaataactcccccccccccttcccaagatatggaagccggctcactttcaacttggtctccgggtcggtgcagcggacgctgactccctcgctcaggacaaagcgcgagtagaagaagtcggtgacggctgtgggccccgccgccgccgccatgtaggcgtcctggtcggcctcgatgacgaagcactcgcggaccttggcgcggtcccccgcccgcgcagctgccaggtagctgtccgggcaggagcgatgtgccttgtccacgacgtcggagacatatgagtaggggtagtgcaggatgacgctgtcgtcggaaacgaggttggtgaactcccccccggggttgtcagccgactgccagcgcggcgagggatcccccgtccagaagtggggccccaggtggcgcaccccgggcgcgtccacgcgcaccgcagccttgccgttggcgtagaggaggaggaagnnnnnnnnnngtcccccgtccagaagtggggcccaaggtggcgcaccccgggcgcatccacgcgcaccgcggccttgccgttggcgtagaggaggaggaaggaggtggaggcgcccagcttgaagcgggagcggtaccagtgcgcctcgggggtgatgaagtgcttgtgcacccgaaacagcgtcacctgctcataccggttgaccacatccccggcctctgactggccttcgaagttcatgaagcgcaaggaggcgacgtggggcgggacccgccccagcacctccgccaggctgcccgaggcatcaccgggctggacgagctcatcggggtccagatgcagcagccactgcatgccgtcctccttggcgcggcgcaggccctcgtgctcgccaaagcctgtttcaaatggggggcgggggggggggggggggggggggnnnnnnnnnnnnnnnnnnnnnnnnnnnnnnnnnnnnnnnnnnngccgtggtgtcgtgcattttgtgggcggcaagggaatgtgtgtgtaaaggaaggaaaggactcgagaaagtatccgctcctgctgtcaggccaccgggaaggctgcggaaccgcgcggcggcggcgcacacccaaccctcgcggtcccacatgcgtggtccgtcccgccctcccatgtccctgttcctccccattcccaggcaccccaccctccccacccacacgaagcctcaccctgggtgaccatgagtgcatagttccccggtcgccccttccactgcctggacaggccggagtagagctctaccagggcgctgtccacgccctttgcccagggctcgtgcacgtggatgaggcgcacatggcggatggtctccagcgcctgcaccgccgccgcgtcgtgcccgttgtagacgatgtagaacctggacacgcccatctcggtgtggtactgcagccagggcagtacctcacgccgtacgccacgcagatccacgccgctggtggtgaccaccgccacgcgcgtggtcgcgtacggcgccgcctcctccgccagcgcgttcaggaaggcgatgcgcgcggggacgctgctggtatcgttgagcgcatcgcgcgccgccacgcccatctctgcggtcgtggtgcggtgctggcggcgcaccgcggtgccctccacgggggtcatccccgccaggctggcagccatgagcgccgccagctcagcgtgcacgtcctgcacccccggcaccgactcgcttgattgcacgccgtaccgcgcatccacggggagggggacctcccgccccacgatggccctcacctcgcccctggtcagctgcaggttcagggggggatggaggtgcggggggcttgagggtctgagcgtgtttggaacgaaggctcccaggggacctggccctgatgcctgcgggtcagggcaaggattcannnnnnnnnngggctcccagtggacccggctctgatgcctgcgggtcagggcaaggattcagcagggaggcaagggcaattgtgcatgcagatgcagcatgctttgcgaggggttggcatgctcaggcccctggcacaacagtgcttccatgattgaaatcccctctcccgagtccccctacctggccttcctcggcactctccatcatggtgcccatccaggggttggtgtccgcaagggagcgcaccatggcctccacccgacccttgatgaaagcggcgtcggcatgggccaggtccactgtgcagttggggcccaaggagaagggggcggcctcccgggactgagcaaggacctgggagctggaaggcgagtcggcgaacaggctgcggctggnnnnnnnnnnccctccctcccgagtccacctacctggccttcctcggcgctctccatcatggtgcccatccaggggttgnnnnnnnnnnggcaaagaagagagcaatggtccgccggcggtcccccgagggcagcaaccggggactgccgcgcttcatggtaggggcaccacctcactcccgacgacggatgcagacgcggttcagcgcggcattcgatcacattagcctgatcaataagtcattacaagttgttaccatacatagaatccgacgagagtcccaacacaggcactttgtgaatacgccggggatcctgtaatttcgaacttgccccgaggtggtcgccatttccatagtccctgttccccatgtgccaggtagctttgggggggggggatcgaaatattctttgtccgaacgctttcagaaaggctcctggattgagatgaatgggtcggagcacattggaagggggggtacatggttaatcttgcacagtgtaagcagccctcagagcagcacaccaacacctctggccacttcaagtatgcaccaacaattttatggccatcttccccaaatgcacttgccacgcaggtcttcacaggattcgttgggcaggaggaggctcagcgcgattgccgctaaggctgtagaggattggcaaggaaggagtgactctagtgtcagccgtctcaaactcttcaacccaacacgctgtatgctgtgacacgaggattgcacattcgcaaattacccttctgcaaggatgcaagtgctctcaaaacttaagatgacccagaatcttgctgacgtggacnnnnnnnnnntgttgggcaggaggaggctcagcgcggttgccgctaagcctgtagaggactggcaagggaggagtgactctagtgtcagccgtctcaaactcttcaacccatcacgctgtatgctgtgacacgaggattgctcattcgcaaatgacccttctgcaagaatgcaagtgctctcaaaaaccaagatgacccagaatcttgctgacgtggacctgcgcaagagagagctcgccccctctccacatcgagagacacaggacttgccgctcgccaacctcatcggggaaggtatgcgcaaatctcgcaacaaacaagatggggcagacaatgagcttcggtctgtctcagttggacgtggaggagatggtccaacacagcaacggggcgtgtgcgcagggcggagagtcgtggagggggctgtcaacgctggcatttacttgactattgacccctaaatcaacgaacgaacccaaatgcagtcgatcagcaagagattgaggctctgtacaagcggttcaggaggttggacaaagaccgcaaggtgagaggggcgaatgccgtcgggtcgccactcgccactcgagaagtgcacctccttcctattcctcagcgcgtcttacgctgcaccaggtcggggtcctcactactgatcctcgatgccgtgctccaaacagctcctattctgtggtgtctttggcgcagggcttcatctcatctgaggagttcctgagcattccggagctctccatcaaccccttggcacaacgcttgtccttttttgtagagagcatcaacttcaaggagtttgtcaccttcctctccgggttcagtgccaaggcggggcgggaggagaagctgaaggtcatgtttgatgtgtatgacgtcgacggtaagagaccgagggttggatgggaagggagtatggaagagggggggggttcagactcctgggctgtataatggcgcgcaaaacgtgttcatggattgctcaaggtattgtggccgccaatgccaggtggacgtgtaatctctggagtatgggcggttgctgccaagctgtgctgggccggggacatttcgcgactgagggccacttgtgccaacctatcttcatcccatctgttcactcacgcaggcgacggcttcatctccgaggacgacatggcgcagaccctgcggtacctcattggcagtaccctggccgaggccgagctgcgcagcgtgatcgagcggaccatggtcgccgcaggggctgatgccaaggggctgacctttgcgcagtacaaggaggcgctgggcgacacccaactggccctcaaccttgaagtgcccaccggggactagcctggaaccctgggtgcaacacaacactgctacgcggccagacagcatgaggagctcatggtcatttggagtaacgcannnnnnnnnntacacaacactgctatgcggccagacagcacgaggagctcatggtcatttggagtaacgcagggcccggaccggtggccactttccttcgtgcttttcattcaacacatcattaaacacgggcctgggcgttgtttgtctttacattccagttttggtcccaagtgtcctgcctcggacgctctgggcattgcaaggaggtccccatgtcttggctgagactcatcgcggcgcttgtcttcgccaagtcccgaaggaatgtcacaaagtcctcatgtcacatcacaatgctgcttnnnnnnnnnntgtgcttttcattcaacacatcattgaacatgggcctgggcgttctttgtctttacattccagttttggtcccaagtgtcctgcctcggacgctctgggcattgcaaggaggtccccatgtcttggctgagactcatcacggcgcttgtcttcgccaagtcccgaagtaatgtcaccaagtcctcatgtcacatcacaatgctgcttccctcgaatgcgggagcatacatggagtgggatgctgggagaggaaagcgatgccatacactacagtgatggtctgggcaggttcacaggggtccagaccctctgcactgtcgagcaggcatctgaagccagcctgtcaacctgtcccccacctgctggggacgtgcatcacacggcatgccccagagcgatgccatggtccagtcaggcctgggcagggccctgcggcgcgcagtcgatcagacggccctttgacccggggacggggcgcacgatgcacccgccccccgtccagctgcccaccagcttcccctcccggcccagcctggcagccagcgcgtccaccgccgcagagggaggcgggaagcggccgtgtgatgcccgctgcaggagcatggacagcgcggccggcaggcagggccccgcnnnnnnnnnnnnnnnnnnnnnnnnnnnnnnnnnnnnnnnnnnnnnnnnnnnnngtgggcgcatgcagccggcgcgcggcggggtccgagggagtgcccggcctcctctcccccgccacagacgccgcgtcgagcgcggcgtccccgcgctcccgcgcctcccgcgccacccgcgagcaggcccgctgcagcgcctggagtgcgccatgcacctccggccccgccccgcccagcagcgcgcgcagccggttgcgctggtacgccggcgtggcgttggtggggtcggtgacgtgggggatgcccatggcggcgccaaagtccagcagctccgccttgtgcacgctcagcagcgggcggaggaggagcggcgggggggcgtgtgtggcgggggccctatgccgcgtgtcggaggccaggggccagggtgagaggggcgccatgcaggccaggccccgcaggccgctgccatgcaggaggcgcaggaggaaggtctcctcttggtcgtcggcgtggtgggcggtgagcagcccggagcaggcgctcgaccggcaggccgccaggaggagcgagtagcgcgcggtgcgggcggctgtctgtgtggccccgccactgggcgcctcgccgcgccagtcgacggccagcacccgggnnnnnnnnnncgcgggcggccgtctgtgtggccccgccacggggcgccacgccgcgccagtcgacggccagcacccggggtgccaggcccagcgcagctgcggtggcggccacggcagccgcctcccgcccgctctcgggcctcaggccatggtccacgatgagggctgggggtgggggaaggtcgggggagacctggggagggacggcggagggtgcagtcgagcggagaagtcaggggtgctggcgtgagagggaggacggggaccacagcgaggccggcactccccgttcacgggcgcgcacctccgcatgccaggcagacagcagggcggcgagggccatgctatccggacctcccgacagggcgatcgcgagccgcgtggtgggtgggaggccgtacgagaacatggcctggctgaaggccgacaccaccctcccagccatcctcttggagcaacggtgggcccctacatgtcgtggtcaatacgatgtgcccaggaatctcatgcagtcgagactttattgtctgtattggtggtggttcgcgggcgatgtagtcggagagttttcacgtggaagttccctcgagatccgcgcgcgtggactgatggggttgctgacggagttggcactccgaccaacaagaacgatagctcaacgaggaagtcctcatcatacatctcaatacgagcctgagattgaagcaaggtacatgttgcgcagattgacacccaggtccgttccatgtcaagtatacaggacagggcgtcagtggtccatgaagtgatctatcgctgcagagaaggccgcaaaggtgccgcaccccagggccatggccttgggtccgccgctatgtgccagcactgcgcccgcggtacaccctgcgtagaccgagttgtacctgtcgtgcttggcgcgcatcttttcgatcacgcactcgctcccggcaaacagagcgcccatggcactgaagcccttggcataggacctgcagacaggcatggcggcacgtgtgtcaagacagtgcagacattgtgatgggtgaaactccggtcatcgactctctgggcagctgcttcgtgacaggcaccagcatcaaggacaaaggcccataaataccgccccagctgctatcggtgatgccctgggaacatcattcatcatatccctttgcaactatccatgcgttgcactgcagatcatccctgttcaccctccgatgctgccctgcacctaccagctcttggagctagtgttgcgaaccatgtccttcatgatctggcgcacattctgcttctgattttccgtcgccagcctcccatctatgcctagaccctgtacattgatggagttggagcggagtggatgattctgacagcacaaggcttggcccacgtcaaggggtgtcctcgcttccaccaggaccagtcagccactctgagcgccctggagatacgacacccaaagctcccactcaccgcgccatccatggtgcccatgannnnnnnnnnaagtccaccaggaccagtcagccactctgtgcaccctggagatgcgacacccaaagctctcactcaccgcgccatccatggtgcccatgaacagcccaaacatggcaccgagccccgcgcccatcacagcggacagcacggtgcgcacggcgcagttattcattgcctcttggccggccatctgctccggggtgggcagctccagacgggtgtacttctttccgcccagcgcatgcctctgctccggcccagaagtgctaggttctccattgtccagagccccggaagcctccggcacgtcggacgccgtggacatcggcccagcaacagggtcacgagcgtcttcaccgccgggcctcgtgcatgcaagcccaatgtatatgcaaaactcgatatgactttgaaagataatattgggcttcggccacaggcctcatggtctgtcaatggtgcgaatgtgtccatgtccctgtggggagcgcgcgcgactccacccctcccgttgtgtcattcgtacctacccacctatggggcggctgccctgcccctgtcacacgatcaactccttacacatgtgcctttgtctcgggcgcttctgacccaccagcagcgggttcatccttgcccgcttccacctcctgctccaccttctcctcgctgacctccgctgccgacnnnnnnnnnngagcaggttcatccttgcccacttccacctcctgctcaaccttctcctcgctgacctccgctgccgactcaacgggagcaggctgctcctcgtcagctccctccgcatcctcggccttggccttaccctctccctccttggcttcctcctcctctggtggtgtggccaggagccgtatgttgtacttgagcagctgcttgaagtcttccaccaccgcgaagccacaagtggtcttcagcacattgatcaggattgtcttctggggcgccgacaagttgaccttatgtggtggctgcagaccaaggaggaagaaggatcctcaaatgacttggctgcaccatatggtcctgcaagtccccatgtgaggcctcacagcattgacagactctcccagagcccgagtccacatcgggagacctcacaccaggccgcagccggccacccaccgtcttgatgttgttgaccacggcgttgatcacatccatcctgtctagccccggtgccgcccgatgctcatattgcactgcaaactgtttcagaggatgggagggaggtagatgggcgtcagagcacttactccaggatagtggctgcacatttcctattctttcgcagccgattggaccatgtcgcagcaattccgtataccgttctcatctgcctgtccaccctacacctccttaacccgccctggtgcgcttcccctgcatcaaggcatgacgtgagataccctgttcctcccgagtcccccaactattccccctcacccaacctcaagcccacaacaactccccacctggatgccctccttggcctcagcaccggtcgtgggaaagcgctctcgcgccagcgtggcccccgcctccctgatcttctccaggctggcgtagcaggtgctctccacggggtagaaacggttgcacagcttggtccccgcgcgccgagactggcgcgccgcctcgcaagcacggctgaccagctcacaggggccgggggagccggggtacttaatctccacaaacacggtggagtgaatgccggtggggtggtagtagaacagggacttgcggtggtccttcaggtctgccacctcagcggccagcagggctgccacgtcaccgcccgaggtgctgggcgccgccgcgctttccggatggtccgcttcgtacaactgggcggtgatgaagaggagaggggaggttgaaaggggggggagagggagatcctgcaatcaaagacgcgctgcggattggatgtgggaaagaagctggtgcgaatagcacacattggggtggaaggtggaacaacgcaagcaccaaatatgcaagagcgcgacagtttcaagggaatcatggcgaacctgttggcaccccatcaaaagcaccatcatgtcaacatgctgttacctgtgtgaagacgtcgatggcctccctgnnnnnnnnnnccaaaaacaccatcatgtcgacatgctgtaacctgtgtgaagacgtcgatggcctccctggccgcaatattctcctttccaccagcacaggacaccaggatgcctcggcttcccagggggatgccgtccttcttggagctctgatgggtggggaggccagggatatgtaaagtccggcaaggtagcgcagcggtgtattattccgtgccaatacttgcccacacataccgcatattcacctcgacctacattgctgggaaagtactttcgtttattggccctcgactggccctctgctccacgcttacgattgggagcctcactcatgttggcctgggtggtaggccccgtgagccacgactgctcaccagtctgtgaagaaagtaatacagagtaatggtgtgagcatcgtagaaatggcaggtgtctgcatgtctgcgttgtcagacctcctcgacaaatttggtcactccgcgcgctcgggcgcccgcgggcgccgtcgaccgtcttgnnnnnnnnnnacccagagaggatcgtcgggaaggcgggattggcaggtttccagttccagtacagatattctgccgagcatgtgtggtttcaggggagcccagcannnnnnnnnngacaaatttcgtcactccgcgcgcttgggcgcccgcgggcgccgtcgaccgtcttgaggtgaagagcttctccagggacggtgcaagactggtcaggtgtcacaactcgatccctctttccatcacacacatcctgcccactgatctttatcgaatttacaaggaagcaagggcggtgctagaattcggtgctcggtgcggcgacgttggcagtaccaggcaccggccatgcagcatccccctctttgaggggcaatccgagcgcagagaggatagtcgggatggcgggatcggcaggtttctagttccagtacatatattctgcagagcatgtgtggtttcaggggagcccagcagcagatgtagagtgtgtctgaagtacagtcgttgtgaatcccgcccgtgaggttatcataccaaagcataccgcctgttcacacggacgtgacaggccccggggcctcttccagctccccatcgtcgctggactttgtgaagggctccgacgcatcatccagctcccccctctgtgaatgggtggggacggtgagacttgagcgctctgcagacatggcttcagggcaggaggaaattctctgcctgctggtgcctcacaggcttcacaccagccgcacaatgagctccacgcccccacccctacaaccagcctctcctgcacctgataggcctctnnnnnnnnnngcaatgagctccaagccccccatccatacgaccagcctctcctgcacctgataggcctctgccaggcaggccgtcttgacggccacatccacattgcgcactggccccttgaaccacttgcgggcgctgagcagccaccagccgagggagaagatgagcgtgaccccgacggccacgggcgcatagttgagggtctgggagttcaccgggtactggttgggcagcgcaaacacgacggtgatgaaggcgcaccagaacacgccgatccagccgatgaccagcgagaacttgcccaggtggaaggggccctgtggtgtttgtggggggtgttgtttgggtgaaagggggcgcctgtttgtggaaggctctgtgccgtgctgtcggagtgatccacaggcagcatggtgccatgtgcaggcaaggcggcctcaccggcacgggggcggatgcttgacacaaatgtgttgcctgccaggtcacagaggcctgtgccaccccatccatcctccatcctctcaaccccctgccccctcccccccaccttcttgaaccacttgcgggcgacggtgaggcgcaggaactgggggatggcgtaggagatgtacatgccgatgacgccgatggaggacatggcggagaaggccacggtggagcccagcagcgagaggcccagcaggatggcggcggcgcccatggcgatgatggagttgatgggggttcccgtggtggggttcacccgcttccaccagcgcgagccggggatgccgtcgtcgcgggaaaaggcgtacagcatgcgcgagttggcggtgatgcagaaggtgccacaccagttggaggcgacgaacaggatgagcatgaaggccagggcgggcttggtgttgccgttgaaccgcgcggcaaaggcgtccatgaagatctgggatgtggcgtagcctggatgtggtggatggggggagaggttggtgataggggtgtcttgcatcgtgagggtttgggttgtacttgaagcacaagagggtgccctgagttcaggaaagacgattgcagcaggtggtagcatctgggtcgtcaacacgtgcacggacagcgcggctgggcaaggcctgcccacgccatgcagaccccactgccacgccagctcgctcagtcacagtgccatcaacctacccctccctgcagcagtgcccaggcaccctccccccctgtgtggtcttccaacaccttccccctttccacctcccaaacagcacctccatgactcaccccccgaaatggtgtctgggttggtgatgttggcggggtcctggatggagaaggtgagggagagcaggaacatccagccgcagatgaaggagcccacaatggccatgatgaggcccaccggccctgcaatggcggcgttcttggtttcctccgcgatgtgtgcggaggtgtcgtaccccgtcatggcccactggctcatgagcagccccaggaggaagaggtagaaggggttgctcacccccgtgtcggggttggggatgaaggtgccgaatacccagtccgcgctttggtgcacgggcgcgatgaccagcaggccgatgaccacacccagcgtgcccagcacgtgccagtacaccgacaccacgctgagccagcctaggagcttgacggagatggcgttggccacgccgtgcaggattataaagccacagtacaacccgtactgctgcgcgcgggtgaattcgtagtaccgcccctcgctgatgctgatcacctgctgcaggtacatgaccaccgtgtactccacccccgcggtgatgcccacctggcccagcagattgaaccagccggtgatctggaaaaggtgatttgttannnnnnnnnnnnnnnnnnnnnnnnnnnnnnnnnnnnnnnnnnnnngtggaagcagcaactccccatccaggcttgcactccccagcgggccagatccgtagtccaaggtggacagctttgccgatgggatcaggggctcgcgctttacacccctcctccccatccaagcaacgagtcccagagtctccccctcccttccctcaccgcacccaggagtaaagaggcccgtgccggccgccaagggtgcccgcccagaagtagacgnnnnnnnnnngggggggggggttcaatcttaacttatcattgggttagggggggctttgacaaaatcccagggacaatcggctggagcatgaccgaaccagtgagaggtggagggagggnnnnnnnnnntctccccatccaagcaatgagccccagagtcccccacctccctcatcgcacccaggagtagagaggcccgtgccgaccgccaagggtgcccgcccagaagtagacgccgccggacgttgggagggcgctgcacacctcggccatgggcagggccacggtgagggtcatggtcaccgccaggggccagccccaaattacagacacggggccgccatgggtgaagccgtaggtgtagaacccacccaggcctgtaagcatggacagcaggccaaaggacaccgcgaactgtggtggtggggtgcagaggggaggggacgttcatggctcgtgggatgcgaggagggaagtgatggggtgtgcccaccgccccggtcgaccaaggaggccttggccagtgcacaggctgggaggcaagtcctccacgagggttccagccacccccgccgctcatccccgtgtcagcccattcattcaacctacaaatctcctgaaagctcacgttcttgagcaggctnnnnnnnnnnaaagtgatggggtgtgcacaccgccgcggtcgaccaaggaggcctcggccggtgtacaggctgcgaggtaagtcctccacgaaggttccagccacccacgcccctcatccccgtgtcagcccattcagtcaacctacaaacctcctgaaagctcacgttcttgagcaggctgagctcgcgggtgagttcctgcttgtatcccagctggcggaggcgggcctcgtcgtccaagggttcggcgctcagccgggcaaccgcgctggggcgcttcttagcagtggtcaggttcagctcaaccatggtgttaggcagagctagactggtgatgggggcctcaggcgttgtgggcaggccaccgggtggtgccgtccaaagcctcgatgggaggctgtcggcggcagggcggtcggcaggtccacacagtcttggccaagaagatcggggtgtgggtcctcacaaacggtcaacagatgaggaacgatgctggtacgcagctcgacagacgtataggctccgcctaccaggagcagaagggcccagcgttctgtgcctccgtcttttaactgactggtctgtacgctgcgctgcctgtgtagtgacgtgcaaaccttctctatagcctgcttgctcttcaaaagggtacccagtatctttcggaatgggattagggtcgcggactatggacgccccggaggtccgagttggcgccatgggctaagcatctaaacagtagtcgggcgagagtgaggttgcacgagtaagagattgcatttgtctgcctggaagtttcgaagatttcaatggtactcccaactgacgacctatgcccttgcagtacaaaggacgaccactccatcctggttgcgttctgctggcatgtcactgccttattgtgctgggggggtcccagaatgttagattgattcagattcannnnnnnnnnagtactcccaattgacgacctatgcccttgcagtacagaggacgaccactccatcctggttgagttctgctggcatgtcactgccttactgtgctggggggagtcccagaatgttagattgattcagattcacaagactggcagattgtgtgtagtaatcaagtagatgcagaacagcgttggtggagctgcggacccacccactctaggtgatagctgccaaagatgtcttggtgattgagtgtaagagtgtggtgatcaaaatgatctcccacnnnnnnnnnnaatgatagctgccaaagatgtcttggtgatcgagtgaaagagtgtggtgatcaaaatgatctcccacgcggtttgagattcgccttggcagtcgcttctacgcaaatattacaagccctccagcactcgcgcaaaacaaaagctccaggttattttcgatcaatgttacgatttcccgtcaatcggacattccatctgggtttcagacgttcgagcagcagagcattcggtttcggnnnnnnnnnnagctccagcttattctcgatcaatgttacgatttcccttcaatcggacattccatctgggtttcaaacgttcgagcagcagagcattcggtttcggaagcactcgtgccatgccaggacggcccaacctcgggaggctcacagccgaagacctgacggccctccgtgccgagccgcgagctactgcggttctgaatttctggtgagactgggtttannnnnnnnnnaggtttgagatccgccttggaggtcgcctctacgcaaatactacaagccctccagcactcgcgcaaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactaggggattgccggttctattcctcgatggcggcccagtgtgtcctcatggagcctatgacgccgatcacttcgggacgagcctgannnnnnnnnncgactaggggattgccggttttattcctcgatgcctgcccagtgtgtcctcatggagcccatgacgccgatcacttcgggacgagcctgatcatttccacgcacgtgtaccaggtttggcgagaagtgggagacggagggtcttcccaacccgaccgagaggctgggggtctggtatgggaagagcgatgccctggactccagcatccgggagtcctttggaggggaccttgaccgtctcctggagggccggctggatggctggcgctcctccctgctgccagcagtggcgggcatcatccttggggaccagttcactcggaatgcgcgtcggggcacggccagcatgtacgatgctgatgccaagacgctggagtggacgcacgccctgatagcggatggcagcattgctcggctgccgtacgcgcttcgccacttcgccgcgatgcccctcannnnnnnnnnacatgtacgatgccgatgccaagacgctggagtggacgcacggtctgatagcggatgagagcatcgctcggctgccgtacacgcttcgccacttcgccgcgatgcccctcatgcacagcgagagcctggcagaccaggaggtgagtgggtcgctggcgaggcgggccccctaaacttgcaagggagctggggcttgtattgcctgtgcggacagccccccccccaccgtccaggctactggctcggaaagcgagatcgatgacnnnnnnnnnntcccctaaacttgcacgggagctggggcttgtgttgcctctctggacagcccccccaccataccatccatgctactggctcggaaagcgagatcgatgacattacataccagagcatgagcgccattgtccgcgactggggccactcgcaaaccactatgcccccccctcccaatccgtcagctcatcttggagctcctcaagagatggcatggggagctgtccagccaggggggtgacgacgaagttgttgagtttgtgcagacagcaatcccttatgcagagggccatgtggatgtggtgaggaggtggggacgattcccannnnnnnnnntgacgaagttgttgagttcgtgcagacggcaatcccttatgcagagggccatgtagatgtggtgaggaggtggggacgattcccacaccgcaatgcgatcctgggccggccttccacacaggaggaggaggcaggcctcagagacggcagcattgcggcctggtgatcatgctcgcgacctggcatcctgaggtggagttggttctctctgtcccaccatcactgtcttgcttgcttctgccatcaaatcttgctgcgatgacaaacctgaaggatttgtaatcgatcagagagtccaccggctccaccttttctgctgggctgccggtcacctcaacagactgttagaacggtgccccaggaattccccacagataccaagccggtgcatgggcagcattgatgccatcaagcagctcccataagatcaggtgtggcggtgtgctcccccaagcacccagccccacccctcccccacatttcagctccctatgcacacccttatcactctggttgaatttgcaatccataatcattcttggtcgatgtttgaagtcaggcttgcaataaggaggctgtcgtgtaaagccttgggtccaaggccagggtgaaaacagcccagtagcggcgtggctgccgtctgctggtttacannnnnnnnnnccagggtgaaaacagcccagcagcggcgtggctgccgtctgctggtctacatcttgaggccgccacaagttgtgccatgactgcccttcttgcctgagtcagccacccagacgcccctcgaactcgatgagaatggtcacacatcaccactcagcaggcggcgcccacagccatgacggatggctgctttggtggggaacttgtgttcaggtctttggccgtccctaaatgaggtgacccgatgcacttcgcaaggaacttctctgtaagtgggtttttgacactttgttgcatgtggggcaacttcactgccgtcttgcaatagatccttgcaaggacagattataaaacccattactataaaagcacacaatcaatctaccagttcagagtcaggacatttgnnnnnnnnnntcaataggtccttgaaaggacagagtatacaacccattactgtaaaagcacacaaccaatctaccagttcagagtcaggacatttgtgcttccacctgcagttttgtaagccactagttgggcataggacacaaattgtgcagtggcatagtccaacattgtacatactttggccggggggccagaataaatatccggcgaagctctgaactatcgcaccatcttctttaaagaaagcgtagtannnnnnnnnngttgtagatactttggccggggggccagaataatatccggcgaagctctgtactagcgcaccatcttctttaaagaaagcgtagtagaagccatccggaactaagcttccaagtgtcaacgagaacgtaaaggtattgtcggagcgagtggcggttccactgatagacccaaattctggtggtggaggggcggctcccggaggaggtggtgaggtgttgagcagcttcagcggcaccacctcgtgaagggtggtcttatctgtatttacaaatgcagagccaagagaataatctgtcatatacgttgcatccaacgccatcatgatgtaagtgatgctggatctggggctaccttcctccatggtcgtaagcgtttgaaacatagacgtaaacagctggcaattgacggagtaaggtttgtaacccgtagtagtgacaagacacgcggcggtgaccttcccatttgcaggaagaccgaactgaagtgtggcggttgctggtactgatggtggtggaggtggcgagggaggggggctgggcggaggnnnnnnnnnnccatgatgtaagtgacgctggatttggggctaccttcctccatggtcgtaagcctttgaaacatagacataaacagccggcatttgacggagtaaggtttgtaaccccaagtagtgacaacacacgtggtgctgaccttcccatctgcaggagcaccgaactgaagtgtggcagttgctggtcctgagggtggtggtggcgagggaggggggctcggtgagggagggggcctgggtggaggagaggggctgggtgtaggtggtggagagggcgagggaggggggctgggcggaggagagnnnnnnnnnnggcattgggaggaggagggcttgggcttgagggtgggggtgacatccttacgggtggtggtggagacttcttggcgggaggcggcggaagcttctcggcaggaggcggtggagacaacttggcgggcggtgggggtggcttcatggtgggtggcgatggaggagacttccgggtgggtggtggcggtggcttcttggcgggtggtggcggaggcttcttgacgggtgggggtggggacttcttggcgggtggaggtggagactttttggcgggtggaggtggagacttcttggcgggaggcggcggcaaggcaaggacccatgcatacttccggaactcgagcaggctgcaaccctgtaagttcttgcggttcccagacatgttgaagcaatggtggctggtgccctcattgttatatccccaattggcagtgcccacattggagctacctgcaaaacacagcaccgtggtacttgtgagtcagctccacctagggttgcagcggctgtgcacatcttgcatgtcatctacatcctaccccttgctcaccaatattgtcatccccaacgttcnnnnnnnnnngtttccagtcttgttgaagcagcgattgctcgtgcccttattgttgtttccccagttggcggtgcccacattggcattacctgcaacaggcagtaccttgtctacagtgaggcagttccacacaggattgcagcggctgggcgtatctcacacgccaatcacatcccagctcttgctcaccgatgttatcattcccgacattctcagtgccaaagttgttcttgcccttgttgccggagccaatgttgccattgctgtctgctgggcacgccttctggcctggcttcaggcactccacagccaccaggatcttggtcgagcgtggtgtcacgattcctaggggggtcagacggacggcactcaatgagagacccataatgtcgagagtggatgtgcggaccgatcccgccttgctgaagcccatgtgcctgcaaaatgggagaggtgaaccagcatggatcagggtgtgcttgccataggatatgtcagatgctgtgtctgctcaatgatcatatccaccaagcccggccggtggtgtgcaaacaattgttctgatacaaacatccaaccatgcgttactcacttgcaaacggcatctgcactgtcgcccgttgtcaggtacagatgggctcccagactgtaaggaatcgaataaaaccgacatgttggaggagcatcgggagcagacnnnnnnnnnntttgctgaagcccttgtgccttttatttgtgaggggcagacgtgtatagatggatgtgtgcatagcagggcatatgtgagatggtgtttctgctagatgccgattttcacctcaggcagtccagtgatgcacaagcacacgctctgcgccgcaatacactcctgtgctacttacttgcaagtggcatctgcactgtcgaccgtcgtcaggtacagatgggctcccagactgtacggaatcgaataaaagcgacatgttggaggagcatcgggagcagacnnnnnnnnnnccaacaggccgactcgagcacagtgggttatatgcgtgcctgaccgaagaagcaatttccccgacccccaaaaatgctgagtagggacacggatgttgggggcccggccggaggcatgtgcgcgagggcttcgtgagaataggaaggtcaccgatgcnnnnnnnnnntcaacagaccgactcgagcacaatgggttatatgcgtgcctgacggaagaagcagtttccccggaccccagaaatgctgagtaggaacacggatgtggggggcccggccggaggcatgtgcgcgacagcttcgtgagaataggaaggtcaccgatgccgctggtgaaccccgagccccttccctcatgaaaatagcacacggctcacattgcactgggaagcgcgacgaaagtggagctgcatgtggcctgcggtgggcgggaatgctgaggaagtggttgtagaaggggcgaccgcagtccggctgacgcgggtgcgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattgagttcctggcggtcggtgacatcctgcaccttgcggcgctgtcactgttccgcctcctggattcacttgtcgggagtttggtttgttgcctttgagttaggacccctttcctttgcaacacctaggtcgataaatagagttcgaaagttgttttctacctgttttgtcctttactttcatcatttatgtttgtaagggtatcagggaagacggcggagatgcttgtcgcggcattccggagggatccatccggaacctgtgatcaaaaacgatgcagggtgcgcggtaaggaaacagcttgcaagggaaatcaacccaactttgaactcctctctgggctgatttgggcatcgtcacttatttcaagccggacaagtcacccgatgacgattgcagcttctaacccccctcaacgtcgcctcaagaacagcatctccgcatccggaagaacctccgcaatgcgtcaggtcgtgcggaactgatcgcacatgaagaatcccaatgcacgtgtcgaatctatcactatcgcccaagaattttgcaaacaccggttggagtggccaccatgttatcactccataggtttcacgtcgttgtccttgctgttgaggaaatggtgaaacatccaccgctgaggactcttcggctgatgaggccaagtacagtttcacaagcagaggcgaactaagcggcagagagatgggtgctagcaatgactctgaatcttgagactgtcccaagatatgcaaatgaaagtattcatggtggagtcaatcactgagaataccaaagtgtagggagacagtgaccccacgaacactgcgaggcaggagcaccctgttctgcagccgtttgctgcctgggatgtcggcattgaggattcgaggcagatggttttgaaacactttgttgcgggtgggcaacttgatcgccatctatgcttgtggtctttgcaaggacattcataaactagttacgcacaaagatgaatgccgagaagtagcagcaaactaccagattcacaatttcagggtcagggcgtttgagctcccgcctgagaacttgagggccactacttgtgcgtatgacacaaagggtaccacggaagcgtccaaattcagcaccattgtggacgggttgccagtgtcttggctcattatgttctgaactacagtcccatctgtcgtgaagaaagcatagaagagagcgtctgggacgacgcttccannnnnnnnnntatcccatctgtcgtgaagaaagcgtagaagagagcgtctgggacgacgcttccaagcgtcaccgagaatgtaaatgtttgatctgctctggtgacgctcccactgatgaacccaaatgctggtggtgggggcgagggtcccgggggaggtggtggtgaagggtttagcagagtcagcgccatcacctcgctcagagcaagactgtctttgtataccaatgcagagccagtgacgaaattcctcatgaccgtttgcgggagtgactcccccacaatggtagtgactgtggatgtggggctgtattcctccatgaacccaattcgggccaagagggatgagtacagattgcatgcagtcatgtaggaaatgtcccccaccgtggtaaaaacacacgtggcgttgaacttcccatctgtaggagcgctcaactgtagtgtggcggatgcacgtggtggtnnnnnnnnnnggaacccaattcggcccaagagggatgagtacagattgcatgcaaccatgtagggaatgtaccccaccgtggtaacaacacacgtggcgttgaccttcccatctgtaagagcgctgaactgtagtgtggcggatgcacgtggtggtggagatggaggcgatgggcttggtggaggggtgggaggtggcgaaagaggtgggctggctgaaggtgagggtcttggcggaggaggggccctggaccctgagggtgggggagaaggtggtctcaagggtgggggaggtgacctttcagagggaggcggtggcgaccttctggtgggcggcgggggcaccttctcagcgggtggggatagaggctgctcggagggtgacggcggtgacttcttggcaggtgggggtggaactttcctggcgagaggcggcggagatttgctgcttgggtctggcggtgatttcttggcgggtggaggnnnnnnnnnngtggtgggcggcgggggcaccttcttagcgggtgggggtagaggctgcttggagggtgacggcggtgacttcttggcgggtgggggtggagaatttctggggtgtggcggtggagacttcttggcaggtgggggtggaagtttcctggcaagaggcggcggaggtttgctgcttgggtctggcggtgacttcttggcgggtggaggtggagactttttggcgggaggcggcggcaaggcaaggacccatgcatgcctccggaactcgagcaggctacagtcgttctgaaccttgcgttttccatgtttattgaagcagcgattgccagtgccgttattgttgtttccccagttgccagtgcccacgttggagttgcctgcaacaggcagcacctccatagcactgattaatctccatccagggctgcagcggcggtnnnnnnnnnntgtgccgttattgttgtttccccagttggcagtgctcacattggcattacctgcaacaggcagcaccttaataaaactggttaatctccatccagggctgcagcggcggtgcacaaaacgtatgccatttacatcctaccccttgctcacctatgttctcattaccgatgttgctcgtgccaaagttgttcttgccttttttgccggagccgatgttttcattgctgtctgccgcgcacgtcttctggcccatcttgaggcactccacggcnnnnnnnnnncgttgctcgtgccaaagttgttcttgcctttgttgccggacccaatgttttcattgctgtctgccgtgcacgccttctggcccatcttgaggcactccacggccaagagaatattcgtggagcgagactccaggatctccagggtgctcacacggatggctgtcatggacagtccaatggcatcaagggtcgaggtgcgaacggatcccgccttgctgaagccttcatgcctgcttgcagtgggaagtggatgcgcataggctgaggcatgcatgattcggagcacattcgatgccatgattgcttgatgtgaaatctgtggggttgatccactgatgtgcaagcagatgctctgtctcannnnnnnnnngaggcatgcataactcggaacacatgcgatgctatgattgcttgatgtgaaatcggtggggttgattcactgatgtgcaagcagatgctctgtctcacacacacacacacacaccatcgattgctcacttgcaaatggcatctgcactgtcaactgtcgtgaggtacacatgggctcctagactgcggggagtcgaaccaagtgcgaaatgttgggaatgcatgaagaacagaccagagatcataggccgacacgagcagattgtacgagtgcatggctgagcaaacaggttctttgagccccagaaagctcggtcatggacattggagcctagcccgagccacacgtgtgcgagtgccctgtgcggacaggaacgtcatcagtgccgcacacattcagtttcaaatgaacaaagtggatgtctcacacgttactgggcagcgcgacgaaagtggagctgcatatggcctgtggtgggcgaggatgctggggaggtcagggaatcacgggcacagtatgagttgtcggacgcgggatgggcaccccgagcgagagcgccaactcaccgccaaggcacatttggatagcagcagcgcaaccccagcaaggacaaacgtgttcggggtagccgccgatggcatgctgcaacgtacggaagtcttgcaagtccgcctgccgggggcactcgcaccctgaactgggtcctccgcctcaaaattgagtgtgcactaactttagtgcgccgtattccagcaatttgacggcaaaaccgagagtctctggcccatgcacccgtctctgaaccactcagggttgcggtctgacgccaggctcctcccggagaccccatgcgcaacgaggtatggccctgcacactccttttgacccagtggccggtgataggtcatccacccctnnnnnnnnnnagcgcaacgaggtacggccctgcacaagcctttcgatccagtggccggtgataggtcatccacccctcacggctccgagcacattgaacccgggattgacaaggtattgaccctattctgaacattccataggtaaggctgaccattgacagagtgtcgccccccggtcctcgcggggtattggaggcagagtgcatctgttcggcagtacccgccctcccgttacacccgcggctgacatccgcagcgtgcttgccggtccggaacatccaagcnnnnnnnnnntataggtaaggctgaccgttgacagagtgttgccccccggtccttgcggggatctggaggcagagtgcatctgttcggtagtacccgccctcccgttacacccgtggctgacatccggagcgtgcttgccggtccggaacatccaagcttgctggagatcacaatacatcggcatgttgagtacggctcatatgacatccaacgccattcttgaacccccgaaannnnnnnnnncacgtcggcttgttgagtacggctcatataacatccaacgccattcttgaacccccgaaaggcttcgtactggcatagtatcccaacatatccccgcacggtaagcgttaagaaaccgaccgcatcagcatcccgccctgattcggggaatggcatttcccatcacacataaccatccgaccttgtcgtggaatacctctataggtccagcgcagcatgaacatacgcaaggaacctcccatgagagttccgagcatcctatttcgcctgagtattcttgtatacaccttcnnnnnnnnnnggcatttcgccctgattcgaggaatggtatttcccatcacacacgaccatccgcccttgtcgtggaatatctctataggtccagcggagcatcaacatacgcaaggaacctcccatgagacttccgggcatcctgtttcgcctgagtattcttgtatacaccttcggtagtgagacattcatagatcgtgcagtactaccacgcccattaccatgcctccaaaattgttggggatccctccacacaggagcctggggagttccgcnnnnnnnnnngttcccatgcctccaaaactggtggggacccctccacacaggagcctggggagttccgcttgcctcacccgatggttatggcaagctacatatctcccactgcgaagccaatcgctcgtagagtgaactctggggcgacctgcgctggcaccaggcctttcccctatggctttccagcctgcccagcacaggctatgttgggccggcccaggccgccacaccgtacctcagcatgtcctatttgtatgtcccagcttcccaagccctatgcgctagtgcgaattcataccagggcatcctcgatcagactgtgaatatagtatccaagggcaaacagcccaacctcccaagaaatctggcccaaaaatgtttggagagggcccggcgccaaaagacatgccgccaccatgccaataatgcactacatataccaccgcaacccaggcgatcctgtgtgtaaacaaaaacgccactgtctgtcgcgaggggtaaatgtgccctgccataagagagcatcctgtcctggcacacagtgtgcccagttcttgccgannnnnnnnnngcatgtacgaccgcaacccaggcgatcctgtgtgtaaaaacaaaaacggcgctgtctgttgcgaggggtaaatgtgcccttccataagagagcatcctgttctggcacacagtgtgcccagttcttgccgaccaccatctgcagtgctttctggagaagagactgggctccatcgaggaaggccttgaccgcacgtgaggttgtgcaggagagcaaagaggctgcagcagataaaggtgagcctgcgatatgcatggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacccagggacaaaccagtcctgccctcctgcgcctcctggacgaggatgtcgcaccaccacnnnnnnnnnntcccatccttccgacaccacgctgcggatgctcccaatcatctgtacactgacacggggccatcgcggcatcctcggctagtcccggcggaaggcagggcgaggagcctgtgccagagtcagacccgacactcgggacgtctccctccctggcttccacacgcgggaccctgagacccagggacaaaccagtcctacctcctgtgcctcctggacgaggatgtcgcaccaccaccgcccataagcatgccggtgaacccggccctgccaccagagggtcatccagaggttggcgaggagcacacgagactggcggccagcgccatcctgatcacagaagggggagtgcagggggctcgcactgcatgggacagtatcctgacagcatcctttgtcacctgggatggatgctcgannnnnnnnnnaatcaggggcggcacgagggacgtcgcccggtgtgtttcaagtgcggctcaacgccttggcacttggcccccgaccgtcctcatgttgcatggacatgagtggttgccttgtgcgatgcgtgggcaacnnnnnnnnnnatggctgagaccatcctctaccagcggcacagcatgggtagagccccacgcacaatctcccaccctcagatggggagtggcaatgggcgtcatatactgcatctgaagggaaatgagggtcaggatggccttgcaagtgtttcnnnnnnnnnngtggctgagaccattctctacaagcggcacagcatgggtagagccccaccgcaccatctcccaccctgaaacggggagcggcaatgggcgtcatactgcatctgaagggaagtgagggtcaggatggccttgcaagtgtttcagatcgcgtttcctcttgatcgctggaccagcacccaggaagggatgtcgtgtgtgattgggggaatgctgtttgcccagggcagggcagaggctgtggggatccctcatggcctataatgggcggcatgagggacatcgcccggtgtgttccaagtgcggctcaacgccttggcacttgccccccgaccgtcctcatgttgcatggacataagtggttgccttgtgcgatgcgtgggcaaccccaatcggcccccagcaaggtcttgcgacgtggcaaaggagaggtcccgtctacggggggatccccgcagcccgatcaagtgttcagaggcgcttattgtaaaatttgaacatgggtcgggtcgatttgcggcatgaatgttcccgggatggcagcaccaaagggcttacatgattgcaccccgcgccagtttgtagcgatctgtgttgatcgacgccaggagatagagcctgggtgtctgggcatctctcacatgcagtcagtatcatcccttcgcagcttcatggtccagatgttgagcatgaagtgcaccggtgcgggctttcagtccaggtgcggctggggtgggtgctggcttactgggttgcttgtccgtcgaggcgcatggcgcgcggcatgccattgcgatcctgctcatgcatgattcgagtgatctgtgctgtgcaggtgcagggccatgcgccctcgggccgcgggcctgagggtccacgcagcgtcctcggtggcccaggtgggtgcggtggcgatgctgggtggggtgcgaccgcggcttgggcatggctcctgggcatccacgcatggtgtgggaccccggatctggatcttgccgcgcgctgctcctcctcaggcgtgctcctccccgtctgccgatcgctgattccttggttgggggctctgtatgctggtgcccaacctctattctcctcattggtaatccacagcccccctcctatccctccccagacgcaccaggccgcccccccggcggacaggaggttcgacgactaccagccccgcaccgccatcctcttccccggccagggcgcgcagagcgtgggcatggcgggagagctggcgaaggccatccccgccgccgcggcgctgttcgacgccgcctccgaccagctcggctatgacctgctccgcgtgtgcgttgagggccccaaggcgcgcctggacagcaccgccgtcagccagcccgccatctacgtggccagcctggcggcggtggagaagctgcgcgcggagggcggggaggaggcactggccgccatcgacgtcgctgccggtctgtccttgggcgagtacaccgcgctggcctttgccggcgccttctccttcgccgacgggctgcgcctggtggccctgcgcggcgccagcatgcaggccgccgccgacgccgcaccctcgggcatggtctccgtcatcggtctgccctccgacgcggtggccgcgctgtgcgaggccgccaacgcgcaggtggcccccgaccaggccgtgcgcatcgccaactacctctgcgacggcaactacgccgtcagcggtgggctggagggctgcgcggcggtggagggcctggccaaggcccacaaggcgcgcatgacggtgcgcctggcggtggcgggcgccttccacacccccttcatgcagccggcggtggaggcgctgagcgcggcgctggcggacacgccgctggtcgcgccgcgcatccccgtggtcagcaacgtggacgccgcgccgcactccgacccgggcaccatccgcacgctgctggcgcgccaggtcaccagtcccgtgcagtgggagggcacgctgggcgcgctgctgggtcgggggctggagcgcagctatgaggtggggccgggcaaggtcatcgcgggcatcttcaagcgcgtcgacaggaagcaccccgtcgtgaacgtcacggcctgaatggggcggggttgaccccggggcggagaggcacggggtggaggctgagccccgatgccggcgggaccgggggggccgagagaccgctgtcctgtgctggacctggacagccctgcgaccccgccgcannnnnnnnnntggctggaccggggggggcgagagaccgctgtcctgtgccggacctggacagccctgcgaccccgccgcagcacggcaaacccaccacccaccgagcacccagtgagccaggtggcatccgcggatgtgagcagggcgcctttctcccttcaactgtgccatgcatgctcttgcctggcaggtcgcccaaccgctcttgccttacatggcgtcggaccgacactcaccatcgctcgcacacacccctggtgatgggggcaagcgagcaagcataacggtgcacccaggcttgccggtcacacgatcatgcctgtaatgcgcagcaaaccaagccatgcagtgtgctccttcaggtcnnnnnnnnnngcaccatcactcgcacaaaaccctggttttgggggcaagcgagcaagcataacgttgcacccaagcttgccggtcacacgatcatgcctgtaacgcgcagcacaccaagccatgcagtgtgctccttcaggtctatcacacccatgaattcaccgggggatcgggatagaccaggaggtcaacaacagtgattggaaccagtacttgggcaccagccagtcatcaggctggcggccaccatggagccacatggcgaggcagtgtacggtggcggcccgctggctgtctggcgagggccaggcctcggccgcagatgcatcgcagccacctggtggcaggcatgtcgtcatcaagctgcttgaccatcactttcgccacaggaagcggcgcagtggtggtcgtcagagccccttgtaaccccctttccagagagcactgccagcttacagctggagcagtgggctgggctgcaggttttcggcgcagacctcgcgcgcgtccgcgaagaagccggcgttgaccaggagctgagccagccagcggcaggtcaccgcatcgtccctaaggcaggcggtgaaggcgggggagcgcagcggctcgggcgtgcaggcccgcagcgcgtcgcgcgcacagcggttgtcactcaggcgcaggtagcagcgcacgatgtgcttgaggaggcgcaccgagggcgcctccaccaggccctccaccatgctggacagcacggtgcccacggcgaagaagcgctccgcggtcgcgcagatgtacgccaggccctcctgtgcgcatcaggaggaggaggttggggtttgggagggtcacagtgggtgggtctttgaggctcccgcgaggggggggggggagacagtgataggtccagctcccaccactgcaatgaaactggcacgaccccccggccccagggcccatagccgccagggacacccccgccagcccacctcgtccaaaaggatcttctgcacgatgaaggtagccacggtcttggacagctcgctgccggtctccatggtgcggaggcagagggggatgatctcggtgttcagcaggaagctgatcaccgcggggtcgtccaccttgaccagggcgccaatgacccccaggctggtcaggcgcaggtactcaaagggccgggccttgctggtcgagttcaggaaggggtacaggaacagcgggatgttggctgtggggatgcagacgagggaaggagggcggaagggggtgggtacggagaaggaagagtgggctgagggcagcatccgcgccagcagcacatgtgtaaaaggcagggcagcaagtggtggcgttccgccacaccacgcaggctggcagctgctctacgagcagcccctgggaggagtgcccagcagctgcaatacgtccccctctcttgtgcaaatatgcatgcgcatccaggccaccagggtcccaccttccaggaacnnnnnnnnnnagcagcacccgcgccagcagaacatgtgtgaaaggcagggcagcaagtagtggcgttccgccaggccacgcaggctgccagctgctctacgagcagcccctgggaggacagcccagcagctgcaagacgtcccgctctcttgtgcaaaccctgcatgcgcatgcaggccaccagggtcccaccttccaggaacagggtccgcgtctcggggtgggaggccacacactgcagtagggccagggcattgcacacgcggttagagccggaggaggtgagctgcgggggctggagcagggggtagatcaccacgatctcctgcagcagggcagccaccgtgccaaagctgtgccacaggtagggggccagctctgggaaggactcccgcttcttgctcagctccagcagcgccgtctccttcttcacagggttggtcaggtccagcacgagttggtcctggggaggaggagcgcggatgcgggggtttgtgaggccttggggggcggcagagactgccgtccctctgtgagcgcctcggaccagtccaccagccgaaaggagacatctcggcgctggggcccatggaactacaaaatacacaccatgattcagatgtgtggcaagccctgccgctcctgtacgaccnnnnnnnnnnatgtgaggccttgggggcggcagagactgccgtccctctgggagcgcctcggaccagtccaccagccgaagggacacatctcggcactggggcccatggaaccacaaaatacacaccatgattcagatttgtggcaagccctgccgctcctgtacgaccctctgcccgaccgagtccgtgatgtaggggtgcaaaacaggggcccttctctgttgagcgtgcgtcaacaggggatggatctccgcataccaggactgacgtccgccttctcaacgaaaggaatcggtttcgcgctttgtggcacgcgctgagtacagagtgacttcaagcccctccctgcccagatcgcagggattgggcgccagcgcggggactgtggagctcgaccgactgtgcctgcgagcatgggccaccagctggttgcattgggcgcctttctctccagctgtcctcgtcatactcctccgccgctcgaggaggtctcgccggcatggcttccctgcagggggccaggcccctgggccccaccaacgcccgcgaccggacgtccgagttcatggccgtggtccagcgcctgcaatcctcgcaaggccctagttcttcaaatagacaggatcttataggtatgatggagagagtgtctttgccaggcctcgcggtgcccggtcattcgacttcgctctggcctgcagtgggaacacccggtgcagagcctccctcacccccgctcccccctgccccgcacgccatcatacgcacctccctcacccacccctgccccagcctcgcccacgccggcatcccactccgccttctctcgccacgcggctgccatcgggctgggcatccactccaccagccagaagctggcgcagctcgccgcgctggcgcggcgcacctccatgttcgacgaccccgcccaggagataggggagctgtccagcctggtgaaggccgacatccagtccctcagcgccggcatcgcggagctggcggccatgtcggcgggcccctcggcggggcccagccgccaggccgccgaccactcgcacacggtggtggacagcctgcgctcacgcctcaaggacgccaccaaggagttcaaggacgtgctgacgctgcgcaccgacagcctgcgtgtgcacgccgaccgcaggagcctgttctccgccgaggctgagccccggtttgggcccccgctgggggcccaggccagcttcctgcccacccagtctcgccaccccctcatgcaaagggtgcgaggggaatgcgtgggagggcgcgctggcatgggcagggtgacctcgtccggggatgcttccaagcgtgacccagggccgggctcagtgagcaccctttttggtgacaatgaccaacgcctgctcccccatcaccaccacgatccgcgcagaggaacgccgggctggaaaacgggcatcaccccccgnnnnnnnnnngtgcaaagggtgcggggggagtgcgtgggagggggcgctggcatgggctgggtgacctcgtccaaggatgcttccaagcgtgacccagggccgggctcagggagcacccttttcgtcgacaatgaccgatgcctgctcccctatccccaccacgatccgcgcagaggaatgccgggctggaaaacgggcatcaccccccgggcgacgcccccgccgccccaccgcaggcccagacccagctgctggcggtggcgccgcaggacacctacctcgactcgcgggcgggggcgctgcgccaggtggagagcaccattaccgagctgggcagcatcttccagcagctggcgcacctggtggcggagcagggggaggtggcgctgcgcatcgacgagaacgtggacgacacgctggccaacgtggatgcgggccaggcgcagctgctcaagtactacgacaccatctcctccaatcgctggctcatcctgaaggtgtttggcgtgctcatgctcttccttgctttcttcgtcaccttcatcgcctgaagcatggtggggaggtgggggggatacgaggtgattccgagccctgctccccccacccgtccttctccttgctggtctcgtttctctttgccaccctgttatcagccgcggcggtctgtatcaagcctcgcagacatctgtgcgtcccgccgatcgacgggggccaccacactggccacggagggggccatggcatgtgcagggttttatgtcgaggcgttcagcatgcagatcggagcccgggagcgccagagagggtcagagtctgcacatccactgccgcacagaatgcagcgaccaggaggtgatgtttctgccaccatgcagcctgtgtgggcaggcatgcccagagcaccctgtgcaggacacagggggaaggcctcgaggccctgtcagagcggcgctggccagccaggggagcacgccccctcagaccatgctgtcgatgagtgaggccctcatctcgttcacaatctgggaggggttgctcgtccgcagcttcagcacagactcgatcacggagagctctgttgttgttgtgtccaggccgcagaaggcgctccagtcgttgcacaccaggccttggaaggggaggggggcgaggagggtgaggaagcgcgtcccagggtgcagcccgccgccgcacccgatgccatgcttgagagtgcctcgctgtgtgtccaccgatgatgcccatgcgtccagcgccgggcctgatcacagaatgcacgaggccccaccctgcgcctctccctccccttttccgggcctgctcccgccaccctgattgtctgggtgtctgtacttgggaccccctccaaaccgacacagagccagctcacccgcgccgacgacatcgctgccgcggttgacggtccccgccaccagcgggacctggaggagggaggacagctcgtccaggtcctccacggtcgtcccgggagccaccacgcccccctgattcgtgaaggccgcgtaggagcccacgagcgtgttccccgccaccgtctggcggaacacctccaggcccagcacgtcggccacgatctcctcggtctcgcggtcgatgtctgggtggatgaggccgacgtagtcgttacaggcgatgacgttgcccagcgcagacagccgctcgtcgatgcgctgcaccaccacctcgtcgggcagcgagttccgaatgtgcatcagctctgcgccggggtgtgtgcatggggctggtgggagcggggagcggggggcgggtgctgggaggccggggagggcagtggtcgcagcaagggcacagatgccagggacagcctggtcgtcaggcaatggagcagatcaccnnnnnnnnnncaagccggggagggcagcggtcgcagcaagggcaccgatgccagtgacagccctggtcgtcaggcaatggagcagatcaccnnnnnnnnnnnnnnnnnnnnnnnnnnnnnnnnnnnnnnnnnnnnnnnnnnnnnnnnnnnnnnnnnnnnnggtgtttggcagcaggaggccgttcttgttgcccacggacatgcgtcccaccaggcgggtacctgccagggaggtcttgatcactggtatgtggtccgccagctccgcctcgaacacactgcgtgagggggagccaaggggaaggggaatgggagctggaaacctgcaggtcagtgagaccaagtcccgcccctggagcacgtnnnnnnnnnngctgcgtgagggggagccaaggggaaggggggtgggagctggaaacctgcaggtgggtgagaccaagtcccgcccctggagcacgtctgcctccgcatgcatgcacctgtagaagttctctgctgcgcccagcgccaccaggcagtaggcgtttgtgaggcgggcgaacacgccaacatcattgctgttctcgaactgcgcgcgagtcgccatgcttccggaggtgagactggtgtcctgcagcaggtgaccctccacttcgtataccttgtgtcgatgagatgaaattcgaagaagcacagtgttgccatggcctgtcccacctcacgtcttaggacggtctcctaatgctgcgccacatccctgtcgcgcctgcggcgcctgcggggagaggccgagctcagggatgctcgcgcagtaggacacactgctggccgcggacgtccaggctgtcaatgcatccaaacctagactgtgagagataagtcagggagtggcatccactcggggtgtggagacttcccttggcgtgagctcaggcttggccacgccacgtccgtcatggcagggcgcccagtcctgcgggtaagcgcctggtcctgggattgcgtggggcgaagttgcttgcagcacctctgattgttgcaccttgtgaggtgggggtgaccagcgttgcggaataagatcagggcctccctcagcctcgccgtcctacccctcacccacccctcgcagggcctcgtgacggagggcctccgattccgcgtggtggacgccaagggccaggtggtggggcgccttgccagccagatcgccaaggtgctgacgggcaaggacaagcccacctacctgccccatgtggacggcggtgatgcggtggtggtggtcaacgctgcgcaggtggacttcacggggcgcaagtgggaccagaagctgtatcggtggcacactggctaccccggcgggctgaaggagcgcacggcgcgggaccagctggcgagggagccggaggctgtgctgcagaaggcggtcatgggcatgctgcccaagaacaacatgcgcagggtgggcatatgtgatgggggggccaagtagcgggtgcctggcattctcaggctgtcgcgggagcctgtgaatacctttttgcccacgcatgcgtgcaacacacggcgtcatactgttgtacatccctcaaccttccaaacaggccatggcgcgnnnnnnnnnntaacacacggcgtcttacgttctacacccctcaaccttccaaacaggccatggcgcgcaagctgcgcatctttgccgggcctgagcacggcctggagggcaaggtggagctggtccccctggacatgccacctcgcgcccttcgggtcaagggccccgtgctggagctggaggagggctttgagcccttcaaccccgaggcgtattacaagcgattcggccatcgcctggccgcggcaaaggccgggcaatgaggatggtgcaacgcgcccctggggcatccagcgggcggatggagagcaggcaggctggtggcgtgccttcagcggtgggagatccagggcggggttcctcgcaccgcaggcacccagtgctctccacgagcgcagcgccagaccctggcgctggctgtgcgagcctcgagtgcctcccctggccaaggatcaaaacccgtcgccatccctgacgctgcataccctcccctcctcctcctcttctctcgaggcgctgaggttgtcatgcgcgcccctgcccaacttccttgatgctatgtctccttgcttctcactccatttcaaagaatgggttccctgcttctcagtgccgatatgcggtgacaggttgtggaggggagcaatgctcannnnnnnnnngacttccttggtgctctgtctccttgcttctcattccttttcaaagaatgggttccctgctttcagtgccgatatgcagtgacaggttgtggaggggagcaatgctcaccaaacaggttggaggggcgcaatactcaccaaacaggttggaggggcgcacagaagggctgcccaccccccagccatacctggtagacgggacgcaagtgccaggctatctcccgccccatccttcgccatctgctccttggcagtcactcgtcctgcatcgcaccatcggcctggggctcggggatgtcctcgggcttgctggtcagtcctgccgccgtcagggacagctcgtacagggtgttctccagcttgcgcaggcaatactggcaggtggggggcggaagaggtgggtcaaagtggggtggaggtgagctggcacacatgtcaggcttgtgtcctggaggctgcaagaggcaccctgccagcagacacagcatggctggaaggaggttgtccaggtgtactatacacccaggcattcacgcttcccccccccctcaccttgagggcatcgtatttcttcnnnnnnnnnntcaggcgttcacgctcccccccccccatcccctcaccttgagggcatcgtatttcttccgcagagacccattgcgcaggtcgaactggatgaaggcgaagaagatggactccaccaggtccttggcctgctgcactgccaccacatctcgcttcgtcgccctcaggatggcgtagcggtttagctcgcctgggtggtggagtgggtgtgagggagtcggtgcgctgccagggcagatgcaggcggggcaggaccctgcgaggctcgcaccgggcggagggtgtgtcccgagggtccaagctgacagcacgaagctggcagtgctgctgctgaacgcccnnnnnnnnnnnnnnnnnnnnnnnnnnnnnnnnnnnnnnnnnnnnnnnnnnnnnnnnnnnnnnnnnnnnnnnnnnnnnnnngcacgccacccaggtactcctctgtttccacgtactgcacggaggagctggggggaagccgaccctcctccaggtagcccttgaacaccactgcctctgcgtactggggggagagggaggggggagcttgagatgcaggggctgctgggctgctcgctccggggcaggaggttgggctgctgaagtcactttggggtcacaaggacctttggtggttccatcctctgcccagacagagggaaatgaacagaatcaggcatttaccagcacagggcaatacagggcatggtacccacaatccctgctggctgtcaaaagtgcgcgccaacagagcgacgaagtgcctcaaaagtatgtcgcgcacctcctccatcgcgttggaannnnnnnnnnatccagcacagtgcaatacagggcatggcaccacaatccctgctggctgtcagaagtgcacgccgacagagcgatgaagcgtctcctaagaatgtcgcgcacctcctccatcgcgttggaaaacgacccgtagcgcagtcccgggctctcctttatcacggggagcagctcctcggccgccttctctgcctgctgcaaccgcgccgccgcctgatcattctcgccacgatgcaggctgaagatcgcctgcttggccgccttttggatgtcgcggctgcgcttgatcacgcgctcccgctgctcatcataccccctaatctgcttctccagagcctcgaagtcacttcagccgtagtagagggaggggacatccgtggtgtgggtacagtgctgcatggacctgaacatggtgtccaaccatggcaatcacagctggcttgggtgtgctgcacgcctggctgggcacagcaccgcaatggcgtgcatcgcggcgtgagcaactcattgcaaaacgacttacacgaggtccatgaggcttgattgtttgcgggggacaccctcggccatcgtgctcctgcgctcttgtatggagcgcggccgacgttgttgaaatgtgcagatggcaggcgggggtccaatgctgcttctactctgtggaatacgatgctgcatacgatggtgtatactgcagcgcgctattctccatatcaggcactgccattggtgttcctcatgttgctctcgtactcgatgagcccgcggcgcgcagcagcatgcctcctgtagctctaaacatgcatgtgcattggctcaacccggctcttcaaggtcgcatcactctcttcatccatagacagaagagagtcacgaatactcagttcaggaaaaactcaacgctgcataggtctgccctccaacgtggaagtgatcgagcaatgtttgnnnnnnnnnntcatagacagaagaaagtcacgaatactcagttcaggaagaactcaacgctgcataggtctgccttccaacgtggaagtgatcgagcaatgtttgacggcgaagcctcgacgccgggtcctagcccccgcaatgccatagattttctcaccgtggtgcagcaattaaaggtaccagcacatggcggttgcttgagcttcgacggcgagagtttctgtccatacctctgcacacacatgtacacaatcacaccgccgcatctcccccccctgcggcattgcccagctcaccaagcgaacaggatgggtcaagcggggcgtcaagggcccagaaagcatcgcggatcacatgtacaggatgggggtaatgtccctcctcctctctggaacagggtatgactacaacaggtatggtcttggagaagaggggatgcatcatgttggcagagcggtgcccgagcatggcatcccagtgaaacctcgcacaagcagccaccaatcccctgctgcacaggtgcatgagactcgcactggtgcacgacatcgctgagagtgagttctgctctgcgttcaatgacaggtgtattggtggggttgctatggagaagtacgctgcgtcgccagggacatctctctgctgctcaggggaccagatcgtggtccgaatggccaatgccccctctgcaggcctggtgggagacatcacaccaacctgcggcgnnnnnnnnnncctgctctgcgttcaatgacaggtgtatttgtggggttgctatggagaagtatgctgcgtcgccagggacatccctctgctgctcaggggaccaggtcgtggtctgaatggccaatggcccctctgcaggcttggtgggagacatcacaccaacctgcggcgtgtctgatgaggaaaagcacgctttagaaagtgctggtatccagaaactcaaggccatgctcgggggagggccggcggctgacgagatggaggagctgtggagggagtacgaggcaggggagtccactgaggccgcgttggtcaaggactttgacaaggtgcgggccctgtcacggatcgtgacactacactggctcggtctgactgggcggggcccctgtcactgtggcgctccagggtttgacaccaaagtctttcgagcaccttctgccgccgacccacccacccacattcctcgtcgcagctggaaatgatcctgcaggcgcaagagtacgaggcagggcagggcatggtcctccaggagttcttcgactccaccgccggcaagtggcggaccggcctgggccgggcctgggcggcggagatcgcgtcccgccggccgggtgccgccgcccaggaagattagtcatgccccaaagtcgtaggcctccaggagctcccaaggcccgcccttgtaaatgtgcagctccaacccctggacggtcagggtgtggggctgccaggtgccccgcagctcgtcgaacaggccctgcgcctcctcgggggacaccttgttctggatggtgatgtgggcgcgatggccctggcggtcctggggagtgagccacggcttccactgcccggccagcctggcgcgcagggagtccaggggcttggagggggtgcgcagggcnnnnnnnnnnnnnnnnnnnnnnnnnnnnnnnnnnnnnnnnnnnnnnnnnnnnnnnnngggctccagcacggggatcaccatgggggagctggtggagcaggcaaaggccacgtcccggcgcaccgccgcctcctgcctccgatccagcttgtggaacaaggtcaggtgggcatccaggtagtttctctcggcagggaagtacttggttcgcaggccggtgaacagggcccgggaggcggggtcgagcttggccgtcagcagcaggggttccatgtcgtcgacgtcactcgcctgtgccatgcgaggtcttgggatgcagtcatgtgcggaatatgcgacaggatgttgatgtcgcatgaagacctgcctcatccctccctctgataggggcggtgtgaggtgacgaacgcctctccggcacatgggcggaactcccgggagcctctcatcaaccccttggggcatcctctcggagtgccatcatgacattacaaggtatcagtagaaggaatggcacacgattacataaaactaaacaagatcgccaacctcacgtcgttgccttctcgaggaggtgcacgggcgccagcacattcgatctgttggtctccacaatgcacccattcatgcacatctcgtctaggatatagtgcgcctggtcgcgtgtggaggaaaggagggtaagatgagggtttgcaatgcaacctcgttgtatgcagcaaggggtttcgcactcaagccacattactattggacgcgcctaccattgacacaagcggcaactcaccgtttccaagctatacatgannnnnnnnnnctgcaatgcaacctcgttgtatgcagcgaggggtttcgcactcaagccacattactaatggacgcgcctaccattgacacaagaggcaactcaccgtttccaagctatacatgatgtccagttcgcacacattactgaaccacttgtccagggtctccaccacgcagtggatgaactcaaggatgcccagctcattctgcaaggagcattgccataactaagatgtgtgagcggaggccaaggtcaggtcaagccagggagccagggctatgccaggaaggccaactcccccagcagatacgcatgctgactcgatctccaggcagcccggccctgcggtccccacctcctcgttgtcgacgccaacaaggaagaagagtgacgcatatcttcgatacacaaccttgtagttgtcatgatatacaatgttgcactacaggagagaaggaagccagggttactacacgacttatgcagtgacatcacaatcatcaggaagagagtaccatttcttgacgcgatgagaacgcctgcaatcctctcagttgggcctccccgtcaagctgcagcccttccaccctgcggcacctcgcacctgcttgtcggagcggacgagacactttcgcacgatctcggcttccaatgcacacctatcctctgtgcccaacatattctcagtatacttagcgaggcgcgtctggccctgtttgttgactaggaggatgaacttgatcgtcatcgtcacgccaggagccgggtcgacctcttactaagacatccgtacgcttacactcgcaggaagatagtgaatttgattgtatcttccacaagggatggaataggtgaggtcggaccagcgagtgtgggtctatggcatcgagctagcgccctatggtagtagttcccgcgcgctgcacattgcgcccccttgattcgcatcggcaccgacggtcctgcaccagcatcccagtccataaacgagcgatcttggcgtatgtcattaaattgcatatagaggtttcgtctccaagcagtcctgcacgggagaactacacacattgcagtcggtatcttacccacnnnnnnnnnnaagcgatcttggcgtatgtcattaaatttgcatatagaggtttcgtctccaagaagtcctgcacgggagagatacacacattgcagtcggtatcttacccaccagacaacccagcgcaaagggccatggtggagcccgtgtgcagattcttcggcgtggagattcctgcaggtattgttggggctgcataacgcatgataggcggccgtcagcacgcaggccgacgggtgttgttgagggggtgattgccgtgaggcacagcggccggcctcgcggcgatgtggtctctgctctcgcccacctgcctccccgttgcccgtaccannnnnnnnnntttggggctgcataacgtatggtaggcggccgtcagcacgcatgccgacgggtgttgttgggggggtgattgccctgaggcacagcagccggcctcgcggcgatgtggtctctgctcccgcccacctgcctccccgttgcccgtaccaggcaaggaggtgcagatcgtcgcggccgtggatgctgacatggagggctacgaggtcgtgcacgtgacccagattgcactgggcgccgagcctgccaagggaccccacaccatcttcatcagcactgagggtgagatggtcaagaggcgggtgggttgtcatccatgtgcctgacttatcgagcacgagcaggcgtggggttgttcccccttccagctgtgctagccaccgcatgcatgccagccatcaatccaagcgcaccacaagatggtcctgccctctttccccatgtcccccgcttcccagagtacaaggcagccgtgggcacccnnnnnnnnnnatggggttgttcccccttccagctgtgccagccactgcatgcatgtcagccatgattccaagcgcaccacaagatggccctgccctctttccccttcccccccgcctcccagagtacaaggcagccgtgggcaccctggatgcggtgcaccatccccacattggcgtcgactacactgtgagcctggagggcatcacgctgagccacacggggcgctcctccgtctttgtctccggctacaagaccatcgcgtccttcatgagcgatgacgacgacgacgagcatggcggtcggggctcctccgacgacgaggacagcgaggacttcgacagcgaggatcaggatgcgcccnnnnnnnnnncgacgacgacgacgagcatggcggtcagggctcctccgacgaggacagcgaagacttcgacagcgaggatcaggatgcgcccgcgggcgtgcccctccgcccgcgcccggccggcaccttggagagcagcgatgaggagcggctgggcgagggcagcgacggcgacgacagcgaccttggcagcttgctggacgaggatgacgaggaggaggaggaggaggacgacgacgacgacgatgaggaggacgatagtgaggaggacgtccccgcgccccgcgcgtcgggnnnnnnnnnngacgatgaggaggacgatagtggggaggacgtccccgcgccccgcgcgtcgggcaagcaggtgcgcgcccgccccgaggagcaggaggccgcccccgcgtcggcgaagaaggccaaggtggccgccgccgccacgccggcccccgtctcggcgaagaaggtgaagaccgcagcaacgccggccgccgccgcgcctgcgcccgcggcggcgtcaccgcactcgccctcgccggctgcagtggctnnnnnnnnnngcctgcgcccgcggcggcgtccccgcactcgccctcgccggctgcagtggctgagtacgtcgccgcgctgaaggccgtgctgcaggctcagggcccgcagcgggtgtcggcgctgggcgcgctggtcaagcgcccaccccaggtgcccaagctcaagtcgacggtgggcgccaaccccgccatcttcctgcacgacctcgtcaccgacatcgtgtccctcgtggagtgaggaggggagtgggagatggcggcgagggggggtggcgagcgtcgggctggctgcctcgagcctgggttggccggagccacagaaaaaggggcgctgcactcggtcttcctgatgatggtcgccgcggtcatgctgcctgcggctggaggcgctgcgcccctcttcactgtcgggacatcagagcatgctggcgcttctggccgctgtgaagcacattctcccccgtgaaagcgcatctcaccctccccgtccnnnnnnnnnngtgtcgggacatcggagcatgctggcccttctggccggtgtgaggcacattctccaccgtgaaagcgcatctcaccctccccgtcccctcatcacgctgctcctctctgggcgcctttgacgcatacaccaagaaccagacaggggaaggggagcaaggttccagaacacattgggggctggtggggaggcattgcatgaagtctcaggcccggcatgggaaggcgggctcgatgtgccatgcaagcctccccgccgtcgcccggcccgctacgcacccactactccatgagctggacctgccnnnnnnnnnnttgtgacatgcaagccttcccgccgtcgcccggcccgctaggcacccactactccatgagctggacctgccaggcctggtcgtcgtcgaagagggagaggtgcaggctgccgtccagcccccccaggtccaccgtcagcaggccctcgcgcggcagcgagcccagcacctgcgcctcccgnnnnnnnnnnnnnnnnnnnnnnnnnnnccagcgcgcgccggcccacggccgagtcgcccagctccagcgcggcgcgcagaccccggctgcgctcgctggactggcccatgcccagcgcctcgcgcatcagcgcgctggagcgcgcgctggagccggcgggctgcatgagccacc

SEQ ID NO: 37995 - DNA, 74 bp, Chlorella protothecoides
cacacacatgccagttgcctctgcctggcaaatcatgttagacggggggaatgccatccggatcctgcagcccc

SEQ ID NO: 37996 - DNA, 14216 bp, Chlorella protothecoides
  modified_base (547)..(556): a, c, t, g, unknown or other
  modified_base (1219)..(1228): a, c, t, g, unknown or other
  modified_base (1302)..(1311): a, c, t, g, unknown or other
  modified_base (1387)..(1396): a, c, t, g, unknown or other
  modified_base (1605)..(1614): a, c, t, g, unknown or other
  modified_base (1899)..(1908): a, c, t, g, unknown or other
  modified_base (2156)..(2165): a, c, t, g, unknown or other
  modified_base (2815)..(2824): a, c, t, g, unknown or other
  modified_base (3400)..(3409): a, c, t, g, unknown or other
  modified_base (4511)..(4520): a, c, t, g, unknown or other
  modified_base (5092)..(5101): a, c, t, g, unknown or other
  modified_base (5770)..(5779): a, c, t, g, unknown or other
  modified_base (5929)..(5938): a, c, t, g, unknown or other
  modified_base (6033)..(6042): a, c, t, g, unknown or other
  modified_base (6355)..(6364): a, c, t, g, unknown or other
  modified_base (7070)..(7079): a, c, t, g, unknown or other
  modified_base (7733)..(7742): a, c, t, g, unknown or other
  modified_base (10301)..(10310): a, c, t, g, unknown or other
  modified_base (10377)..(10386): a, c, t, g, unknown or other
  modified_base (11176)..(11185): a, c, t, g, unknown or other
  modified_base (12024)..(12033): a, c, t, g, unknown or other
  modified_base (12107)..(12116): a, c, t, g, unknown or other
  modified_base (12324)..(12333): a, c, t, g, unknown or other
  modified_base (13072)..(13081): a, c, t, g, unknown or other
  modified_base (13451)..(13460): a, c, t, g, unknown or other
ggccgcgccgcggcggcggcgccgcgtgaagccaggccgccagcgcgcgcgccacgtgctcgtcggcgacctcgccctccacctcgcgcggcggtgacgctgcgtcgccgtccgcccccccctcgacgctgacctggcgccaggtggcgccgccgcgccgcgtcaccaggtcgtgcgccaggttgtccagcacctccatggccagcacgaagcaggggccagggtgcgcaggccagccgtcggcgcgcgtggcgtcccgccgctgcacgtcgaagcgccgggcgtggccggagtcggcgcccaggcgtgccgcctgcgtggcggccagcgcggcgctgatctccacgatggagtaccggcagtcggcgtagatggaggggtggttggcccgcaggtggtcctgggggtttgatgagggtggaggttggaagaggaggcaggcctcgagaggatggagtttggaagagttggcaagtctcaaatcgatgggcgccaagtgcatgtcccccccccccgcaaggggcagccgagagggccctgtgactgnnnnnnnnnnaaggtctcaaatcgatgggcgccaggtgcatgccccccccacaaggggcagccgagagggccctgtgactgggcggcgggggacgcagagagccgtactcgacacaaatgcacatgcactgcaccctccaggctgatgcagtccccagcctcaccccatccacgcaccagcacattctgggccagggtccccgtgccgccgccgatctcgaagatgcgcaggccgcccggcgcgccggcgcggcgccagcgcgcggccaggcactcggcgacggcggcgccgtagtggggctggaagatctccacgggcgtcagccaagagacctggagggaagtgtacagcgcctgcacgcggttgaagtaggccagctcgttgcccagggaagcaaagtcgatgggcgcatggggggtgcccaccgaggggcccttgctgaagtagccctccgtggggtggtagagggagtcatggatgaagtccctcacctgcacttgcagtggtgcaccgtggttgggtcaggtgtgtgggcagcatggggggcagggcagctaggtggtcaggccagcgacccatggcaaatccaagagccctacactttactcaccaaccgcctgggaccgggctcgacggtggtgctcagggcccggcgtgctgcgatggacagannnnnnnnnnggggtcaggcgtgtgggcagcatggggggcagagcagctagggggtcaggccagcgacccatggcaaatccaannnnnnnnnnacaggcgcttgtgatagcaaggctatggctctcatcgccacatccaatgaggaggaggggtgggtgggtcactatnnnnnnnnnngcaggcgcgtgcgatagcgaggctatgcctctcatcgccacatctaatgaggaggaggggtgggtgggtcactatgaatgggccatggcaatactgtcaactcgctcgaggaggaaaataccaatcttacataatcattcgatcatacaaagacataatacgtatacaatgtgatatgtttgggaatttctcggcattctagaccaatnnnnnnnnnnccgaggaggaaaataccaatcttacatagtcgttcgatcatataaagacataatacgtatacaatgtgatatttttgggaatttctcggcattctagaccaatacttcgccgatcaattaatagcgagcgcatgaggccagggcgcgcgagctgcgaaaatcccgtcgaaacagggcagccacaggagatacacacgacaagtgagattgcatcagtactgcaggggagaaaacaccatcaatgggcatcctttcatgtgatcaactcctggataactgcgcccnnnnnnnnnngaatcccgtcgaaacagggcaaccacaggagatacacatgacaagtgagattgcatcagtagtgcaggggagaaataccatcagtgggcatccttgcatgtgatcaactcctggataactgcgcccaaagggtctgcactttaccggcatggccttcaccgtgacccagcaacacgtccctttctgcggtgtacgatgatttaaattcaccagatccggatgacctattcttaagcatttgaaaacgnnnnnnnnnnaacgtccctttctgctgtgtacgatgatttgaattcaccagatctggatgacctattcttaagcatttgaaaacgagtgcatcgaccaatgtccctagcggcagctctgcgggcagtgtggtccccgggccagtgtcgaaaggcacaccgatgggcagcgtacatccccttcagacagctgcagactgtacagtctgagctggaagagccaggcacagacaaaagatacatcgatagattggtggtgacagcgcaggccgggcgtggaggctccggatcctcaagctgcatacaaaagagcaacaggggtgaggcatgtgaggctgatagtgggaggattctggtgaggtgcaggatcgatggtgtagctagagcattcgttgctccaaggccaaagattatgcaaaggggtctgctaacttgatcccaagtcttaaaagccatgtgtatctcgatgccagcaccttcagttcagacctggccaatcttccccttcatggcaacatcacaggacgcaagatcaccgcagacggcggcaacggcggcagtggtggagacgtcatagtgcgggccagtggcaggtactcaatcgtcctggtgctggcgtgggcacaaaggggctggccccaccgccctcctgccagcctgcnnnnnnnnnnagccagtggcaggtactcaatcgtcctagtgctggcgtgggcgcaaaggtgctggccccaccgccctcctgccagcctgctgtcggcttgcagttggtgcgattcccctcctccattttacctcatgcagaatgaagagtctggcaggtgtcggccagctgcacaaagcccagcctggctcccacgggtcctcccgggtccagcatggtggcgcgggtgacaacgccacgatcctggtgccgctcggcactctggtgtcccgcatcctggaaccttccgcaatggatggcgcgggcgaggaggcacagcagcccgctcagggccaggccggggtcctgcgccgccccgccccgcgtcagcccgcagatttaggacgggaggaggccgcgccgccgccggaggaggcggagctccccccctggctcgcacgctggcgcaccgcctacaccggcgacgccgtcgatgccgaccggcgggacggcttcgacgacgaggttgggggaggggctggtggccagcccggcgctggcccgagcgcgggcgcggaaaagcgtaggggtccccggcactaccccnnnnnnnnnngggggctggtggccagcccagcgctggctcgagcgcgggcgcagaaaagcgtaggggtccccggcactaccccactgaggttctggcggacctggtggaggaggggcaggaggtggtggtagcgcggggcggccgcgggggcatgggcaacgccgcgatgcgctccctgcccaacaggtgagctggcggggctggggcatgcggtggtgtgatgttgatgcccgaggcatcccttggtgttccactcgtgactgcgccatggcctgacttaaatccaaaggcgtgtggcatgtctcatgcaggtgatttcagaaaaggtgcttctcaccctccccaaccatcacaggcctgcacccagggagtccacgcccggcgcggcgggggagcggcatcgactgctgctggagatgaagatcctggcagacataggtgggggggagttgccttgtacgtcgacttgctgctgtgtggagtgagttgctatgagaacaaagcggccctgcttaccctccgtagtaattgctgtctccacccagctggtaccacctggcgcctgggccgcacgcccacctccctttggcccccaccttcccctacaggcctcgtgggcgtgcccaacgccggcaagtccagcctgttgcgcgcgcttaccgccgcccggcccaaggtggggtcgtacgccttcaccacgctcatgccgcagctgggggtggtggatctcggctggggcgagcgcatggtcatcgccgacgtgccggggctgatcgccggggccgctgagaaccggggccttggccacgctttcctcaagcatgtcgagcggacgcgggcgctggcgtacgtcctggatgcctcggcgggactccacggtgcgatttcgtgtgctgttgtcgttcaggttgggggatagaggagagctctcgcgactgagggtggtggaatgatatgagaagaacgggatgttgaccatctcagcggtcaaagcttgagagcctcacccgggatccaggcccaggacgtgaaaagaatgttcaaagcggcgtgtccaactgtcaagggcacgctcttgaaacactctcccactcccaccgtcaggctcccnnnnnnnnnncatgagaagaacgggatgttgaccgtctcagcggtcaaagcttgagagcctcatccggggtccaggcccaggacgcgaaaagaatgttcagagcggcgtgtccaaccgtcaagggcacgctcttaggacactctcccactcccaccgtcaggctcccagggcctgcggccttggaggcagctcgagctattgcgggaggagatcgcagcctactcccccgcgctggctgcccttccctcaatcgtgatcgccaacaaggtcgacctgctcccccgcccctcactcgtactgtgcgcgctgcgcgaacgcacccacctccccgtcctggccagctcggcccgtgacggcacgggcgtgccagagctgctgcgcgcgctgcacgcgctgtgggccggggaggaggtggacggcacccccccgccctgcccgacctgagccaagacaaactgctgcggtgcacttccacagctgcgttaactgcatcccacacattctcctgtctccatacaaggctgcgaagaaccggcaagcagggcgagttggcagagcgcaaagcaagcggaagggggggnnnnnnnnnntgtgccagagctgctgcgcgcgctgcgcgcgctgtgggccggggaggaggtggatggcaccccgccgccctgcccgacctgagccaagacgaagtgctgcggtgcacttccacagctgcgtcaactgcatcctacacattctcctgtttccatacaagactgcgaggaaccggcaagcagggcgagccggcagagcgcaaagcaagcggaagggggggggggcgttaggtgtgttccaggatcaaccatttgggtgggaaaaacgtggctggcgcccgcaagtgcatttttgcgttctgggcagggacactgcctggcctagggaaggagccggcatggtatgacatcagccgtggcttggaaagcgcggcgctgctgctcaacggcgcagggccttgtagtacagctcgatgtactccagcgcgggtttggcccaggaccagtccatgcgcatgacccgctccgtcatctcctgccaccacgctctctcgctgtaccatgcggtcagcgctctgtgggcgtgggtgtgagaaagagcatggagggtggctgagaagcgggggaagccagggctgagaagtcgcgggccgtgcaatcacaggcaagatcttcaggctgccatcgcccttgcccaatgagtcacctgttgagcgcataatcgatgccggnnnnnnnnnntgtgggtgtgaggaagagcatggagggtggctgagaagtgggggaagccatggctgagaatttgcgggccgtgcaatcacaggcatggtcttcaggctgccatcgcccctgcccaatacgtcacctgttgagcgcataatcgatgccggnnnnnnnnnntttcagtgagggctgtgactaccaacaggcacgtctcgaagatacaactttggctcatgcagaatggactcccaggttgaagtcgggatgagtannnnnnnnnnggccgtcggtgccctcgaaggagaagccattgaccgccatgcccgcagcagcggccctttctacatcgtgatccacgtcaaacactgcatagatgtgtggtgagcgatgaggatggagatattcagtgagggctgtcgctaccaacaggcacgtctcgaaggtacaactttggcccatgcagagtggactcccaggttgaagtcgggatgagtaaaggacgacctccctgcttaaaagtcgtccagcacccctgtctttttcagcccaaagaggtgccccatcaatgccccctcaccggtgtcattcaatccnnnnnnnnnngaaagtcgtccagcatccctgtccttttcagcccaaagaggtgccccaacaatgccccctcaccggtgtcattcaatccgccggtctttcggaccacggggatggttccataccgcatggcaatcatctgcagggagcggcatgggcgtctcaagtgagcatttacgatgtgctcacaccctcctctccatgctcagcagcttccccttatgaccagtctgccctatccacagcgcccatcgtcccacatgccacggactcgcttcgcatgcctgatgtcgtttcccctcatcttccccgtcccacaagtacaagccaccaccacctgtgtgagcccgcagggctcgaacatggagggcaccagcagcatgtccgcccctgcgtagatcaggtggctcagcggctcattgtacgcaaaccacaggcgcgcacgatcggggtactgccgcgccaggtcagcggccagcgcgttgaactcggcctgcaatatgcggaggtcgtgtggttgggttgttggaggctgtgtggttgggtggcacggcgcgcgaggcagcgaggcaccaggctgttggtcactccacccatttcacagggagggctgcatcaagcaggctcaggcatcgcgccctccatcttcaaggcagcagggcagtgctgcgagggaaacctcctggcacggcccccatttcacccctccacatcaacnnnnnnnnnncgctgattactccacctatttcacagaaagggctgcatcaagcaggctcagacatcgcgccctccgacttcaaggcagcagggaagtgctgtgagagaaacctcctcgcacggcccccattttacccctccacatcaacggccccctcaaaactgatccccagcaacccgtacctcccccaccatgcaccctacctgcacgcgcgcgtcgggcgcggagcccagcagcacaaactggccgcctcgctccagggtgcgccaggccgcgtgcttgatcaggtgcacgcccttctggtgagtcaggcgcgtgaccacgcccaccagcggcacgtccgcctcgcacaggttcatcttggcgcggagctccgccttggccgccgctttgccctccgtgaaggtgtcggcgctgtagctgcgcggcaggaattcgtcctccgccgggtcccaaatctcggggtcgatcccgttgcggatgccgtggaacttggcgtggttgggcgcgacggcggggtgccccgacacctcctgcgcatacgtgggcgacacctacgatgtgcgttggggagggaggaaagggtggctgcttgggtgagggggaggagggtgtgtggacgcagagttctggcatccaggtgcggcgggggggggggggccnnnnnnnnnncggggagggaggaaagggcggctgcttggatgagggggaggaggggtgtgtggggacagagttctggcatccaggtgcgcggcggggagggccggccaggcgcgagcagggctccattcccacgcagggtccatacaagtctcgaatccacctcgacgcccttctccctttccaccatgcacgccccttcccccacacaatccacgcaccgtcgtcgcgacggccgtcgcgcccatggcgcgctcgatgaggtcagcgccgtagttcagattgtggatggtgaaggcggtgcgggcggtaccgcagtccagccaggtgcagggtgcggactgccagtcgtgggcatgcaggatgtccgggctggattttgggaggaggaaagggtgaggagggattgtgactaggggggcacaggagtaacttccagaggggacggggagcacggggtctggcagcgccgtcgccgcacgccccagcctgccgtctgaggcaggacagatccgctcgcccgccggccgccaagttcctgcctgcacccgccacccccacatcctcagacccacatgcgcttctcggcgtggtggcgcaggtactccagcgcagcctcgcaccagaccccgaaccggtgccggtcggcgttcatctcggtgtagatgcggccgacccagaacatgccgttgcacggctccaggaaggtggtgtgcaggtctggggaagaggaggtggggggcggcaatgaggtcacgaagcgggtgcagtgcacgcctgagcgctgaagctctaggggccgacaaggaccaggttcacctgcccaagaccatgccctcctctcggtccattcgcaagacaacttgcccatgtctagcctctctgcccgccagtgccccccccctccccccccatcccgcacccaccttctacgatgcccttccagaccttgatctccacgccattgtaccaaaactccttcaccagcttcaggtcctgcgacgccaccgggccgaggactcgtgtgtgaccggcgccaagggaccaactggcaccggctcacgcccacacatgggcaccggcggtgctccagacactgggtgacctcctcgcaccctcgccctgccaaaggcctccatcatcccgcgcgcaggtgctccccatcccgatctcgtccccgcctgcctcccccgccctggctctcccccgcctccccaccccacagcgcgtccctcaccttcccccaccctccaccgcccccgctcacctccaccaggtcgtagttgatgcagtcgtacttgggcagcacgatctccacctcatgcccctcctcctgcaccgcccgccccagcgcggtcaccacgtcgcccaggccgccctccttggcgatgggcgccatctccgccgcgacgtgcacgacgcgcagcgggtccagcgccccctgcccccccgccacgggcaggtggtagtccaggccgcggttgtcgtcggtgaagccgccgtgcgcgtcgcccgagtccaggaagaccaggtccaggacgtgcgcggcgcgcggcacctggatggtggtggcgtggaagccgcccacgcccgtggcgcgcatggcctggggcgggaagttgcccgcggtccagcggttgaacccgccacgcacccacacctctggccggccgcgcagggtggtgaagtcggggttgtacagcagctccaccgcctcgcccgcacgcggcgtggtggggcgggtgtacaggaaggcggcctgcgccgcgcgccgcgccttggccgcctcgtacttgatctccgccttctccagagcgcgcttggccgccaggtcctcctgccgcgccgcggcgtcggcgtcgcgctccagcgcggcgcacgccagccgcgccgccagctcggcgtcggccagcgcgccggccagcgcggtgtggtagtcgcggcgctcgttgttgtcccacgcctcgcgccgctcgtcgcagaacacaaagtccaccaccagcgccacctcgtccagctccacctgggggtgtggcgcagtggagggggtctgggtgttgtcgagatggctgggacatgacgtatgagagcatggcagggatacgtgggggaacacagactgtggtgcgggagaccgatgcgcgggggctgcagggggctgcctgctccaccaggcgctcgctgggcccttgaccatgaagcctgtctggattgggaggcttttttgcaggccagtcaagcacacctggacccgcccatcccacaacaacccccccttcctaccgtggccgcgacccaggtgccggagctgagcccgtgcctcctgacctgggcgtcgctcagtggctccagcttgaccatggtcttgccctgagccaggggaggaaaggggggaagtgttggtgggggacgtgggtggggcaccgcgcagtgccgggaggtgtgtcatggatgcgcgctcgacgagcgcgtgggcaggggcacctgccagcgcgccagggcactcattgcatgccctcccgcagatgagcctcaattcggcggcccggggactccttcagcgacaggttnnnnnnnnnncggtcttgccctgagccgtgggagggaaggggggggagtgttggtgggggacgtgggtggggcaccnnnnnnnnnncgcctgccagcgcgccagtgcactcattgaatgccctcccgcagatgagcctcagttcagcggcccggggactccttcagcgacaggttcccccccttcctcccctcgacccctcaaagtgcctcaccttgaggtgccagttgtcgaagccgatcaccgcctgggcggagtcccgccccctcagcggccccgcccgcaggttgtaggccagggtcgcgtgggcccccgcccgcggctcgccccccagccaggcgtacaccccctcccgctgcggcgcggcggtcaggtcctccagcccccgcctgcgccgcgccaccgccagcgccgcggctcggtgtgcggcgcgctccttgcgcacgcggaaggcggcgcgggcggccttggacgccgcctgcgcggccaccatgctctcctggtgcaggcgaccctcctcggcctccagctcgcggcgccgcgccgcctccgcggcctcgaacagctccaggcggcgcacgtgcagctgctgctcggagaccgcgccctccagctccagcacaaagttgctgccgctgcggggtgtgtgtgtgtgttttcgtggggggggggaagtgatgcttcgattccatcatcctgcaccgctccgcccccctcctccccctacccacccaccatccacactgtgctgcgcgcacgcctcacctgttgttgtcatggaccccgccggcctcgtcgtacaccacaaactcggcgcgggtgaggaggtcggggatgcccaagtctgcgcaccaccactcgcccgcctccaggctgnnnnnnnnnntgtgtgtgtgtgtgtgttttcatgggggggggggggaagtgatgcttgattccatcaccctgcaccgctccggccccctcctccccctccccccccgccgtccacactgtgctgcgcgcacgcctcacctgttgttgtcgtgaaccccgccggcctcgtcgaacaccacaaactcggcgcgggtgaggaggttggggatgcccagatccgcgcaccaccactcgcccgcctccaggctggccacacggcgcaggggcagcgtctgctgcgtctcccacccgttccagcccacctgaaaggggggggtggggggggcaagaggatgttggaaaaggtggggaagggatgtgccaggaggtccggaaggccggctgcttgggaatcgcacgatgcccccatcctccgcgccgccgccagcaagccctgttcctccccccagccccgaatagtccctcaccttgatggtggggcgggcttcggccgcgggcaggggtcccgcggcgcggtcgtaatacagcctgatggtggtgcccaccgccacccggccctccggcacggaaaaggtccggttccctgccgccgaggcggcgctggccagccgctggatctcggcggtggacaggctgggcggcgacgcttcctcacccttggacttctgagcgcggccgtgtgaatgtgatgaaactttgcggaattgaggtcaggcatggaacccccctactctgttctcagagaccctgtcgcatcacacctgcagccccgctctctcaagcaaaaatcacaccgtaatctccctctctcaccgtccgagacgccttgctggcgtctgcggaggcagnnnnnnnnnnaaaactttgcggaaatgaggtcaggcatggaaccccaatactatgttctcagagaccctgtcgcatcacacctnnnnnnnnnncgctgtccgtggaatcgcctggggtgatgggacagggttgtgatctgggtgaggaggcatgcaccatgaactgcaagcacactgctctaatgcaggacaaggtcactctgcccggctcccgatcctcgttgccatcagctgttaggagaaagcaaggtgtaccgcgacagcaataaaggcaggccgcgttgcacccatccagaggctnnnnnnnnnnagctgtccatggaatcgcctggggtgatgggacagggctgtgatctgggtgaggaggcatgcaccacacactgcaagcacactgctctaatgcaggacaaggtcaccctgcccggctcccgatcctcgttcccatcagctgttagaagaaagcaaggtgtaacgcggagcaataatggcaggccgcgttgcacccatccagaggctggctctctgctcccacagccaagccccaaccatgcacccacccgctacgccgagggagaacttgtccttgactgcagccaggcggcgctcggcatccgccttgttggatgccagctggagcaccagccgctggagggcttcgttctcggtctgcaaagtgggagatgcatggaatactggtcacccagcccttggcctcctcagggtggaggatgcagcctgagcatgcaaaaggatgatggaaatccttgcccagacaatgctcccaccttgagcctctggagctccaggacatggggctccccctgttctgcctttcttgcagccctcgccagggaatcggcttgggcggcctgctttgccagatcggtggcctgcgccttggtcagctccgccagcctgaaggagatgggcacgaggagtgaggcacaccgaggtcgcagggttgcgcaatccagcaggctggatcaggcttgcccatggtccaggagcggtgtcagcatgcatgcaagacgcccctggaagctgacgannnnnnnnnngggagtgaggcacacagaggtcgcaaggttgcgcaatccagcaggctggatcaagcttgcccatggtccaggagcggtgtcagcgtgcatgcaagacgcccctggaagctgacgacagcgaggcaactcactccttggctttgcccgggttggcattcctctgggtaccggccctggcagcggccgcggcagccttctgctcctctgacagcttgcgagccaatgatttggcagcactgtgaggaaggtgaggacagggtggcagtgacgcacagcttgcactcagggctccgagcttgcctcggatagcattccagtccgacaaggcccgtgtcagtaccagatgtgctgcttgggcagcattggcacnnnnnnnnnncgctctgagcttgcctcgggtagcattccagtccgagaagacccgtgtcagtgccagatgtgctgcttgggcagcattggcaccgcatgtgcaagcgttaatccctgtgcctgctcccaaggaccccatcccacctgatcttggctgctgccgccaccttgaaagcctggtgcggcgtgctctctggcattggcgctccattggtgtccgacgccttgctgcccttgctacggctggtaccggcctctccatttgccgataccctcacggggcgtcgagcagtggtagtcgctgggctgaagaccctatgtccaggcttgcaggcgacctgacctgcgagaccgaggtgtcccaccattgctcccgactgcgtcgttgctgcaagggggtgagcatgttgcggatgcagtttcgagagagccttgctcgtggagtgcaataatacacactgtatggatccctgcatgccacgtaccgcaagtacaggatccctgggcacgtatgcgacccgatacccccgggcgctccttggaccctatagaagaggagtaagccaaggccccctgatcttttggttttaaacttgtgcctgtttggatatcaggaatatgtaccggatgcctcacggacactgcttttgcgactgtggggactcggcgcaatggtagggccatgcactacgaaatccgcatgggctgacgcagaaaattcaaggaggggtgggaacaggtgaggctgctctctgcaggccccatg

SEQ ID NO: 37997 - DNA, 3649 bp, Chlorella protothecoides
  modified_base (98)..(107): a, c, t, g, unknown or other
  modified_base (2680)..(2689): a, c, t, g, unknown or other
  modified_base (3458)..(3467): a, c, t, g, unknown or other
tgtgactgctgaggaggcacccataccggacggcccgcctgcggcaccccaggacgaccctgcccccgccgagccagcccccgacgctgcccccgccnnnnnnnnnnagccccccctgccgaagtgcccttcccgcccccagcggcacccactgctgccggcgaggcgccggcgcccgtccccgccgctccctccccgcccccagcggcgcctgtgactgctgaggaggcacccgtacaggacggcccgcctgcggcaccccaggacgatggtgcgaccgccgaggcagcccccgacgctgcacccgccgaggctgcccccgacgctgcccccgccgaggctgccgccggtccctcagagacttgacggcggccctcaccctgacgccccagcccatttccagggcatcgcaaggcacaccgccatgctccccacatgacccatggacccccttcccggcggctgttgtccccgtaccccgtctaccctcccctgcccacgccgtgtgcgtggcgtgggtcccagccgtctgttgctcaccccctcccctgcctggagttgccacgggggcagcgggccctgacctgactgtacgcccccctgatcctgtctgatgtgaaacgcctggtcgttccaggcctcaagcaacgatacgaggcacgcagatggggttgtgcgctttttgttgggggggatggtgtgtgtgtggactgcatgggggaccgggcctcgtgcggccataccgaaagccgcgcaccgccatcgggggcggtgtgcgaccacttttaccgagccttcggccgcgagggctcggtgcccaccaatcgctcagtagccgccgtagccgccgtcggccggggcagctgccgcgccctcctcctgcgggatctcggtgacgatgacggaggaggtgaggaaggtcttggccacggacgcggcattctccagcgcgcagcggatgaccttggcgggatcgatgatgcccgcggccagcaggtcctcgtacgcgccagttgccgcgttgtagccgaaggcgggcgacccgccgtccagcacacgctgcatgaccaccgacccgttgtcgcccgcgttggaggcgatgagcttgagcggatagggcagcgcgcggcgcaggatgtcggcgcccatgcgctgctcgtcgttgtccaggctgccgcggaaggcgtcgatgcgctgcgccagctggagcagggtgcagccgccgccggtgacgatgccctcctccaccgcggccttggtggcgttcagcgcgtcctccacgcgcagcttcttctccttcagctcagtctcggtctgggcgcccacctggatgacagccacgccgccggacaggcgcgccacgcgctcgttcagcttctccttctcgtactcggcctccgtctcggcggccatgttgcggatctggcgcacgcgcgccgcgatggcctccgcggtggagctgtcccccacgatggtcaggctctccttggagacggagatcttggccgccatgcccagcacctcctcccccgcgccgtccagggacacacccatctcctccttcaccacggtgccgccggtgaggatggcgatgtcctccaggtaggaggtcttgcgctcgccgaagccgggggccttgacggccaccaccttgagcgcgccgcgcagcttgttcaccaccagcgtggccagcgcctcctgctcgatgtcctcagccatgatgaggagcgggtagccgccgcggatggcaccctccagcacacccaccatgtcgcgcgcggtggcgatcttgcggtccaccagcagcaggcggcagccctcgtactcggccaccatgcgctccgggtcggtgacaaagtagggcgagatgtagccgcggtcgaactgcatgccctccaccacctgcaggctgtcctccgcggtcttggactcctccatggtcaccacccccgcgcgccctacgcgcgccatggccgacgcgatgagctcgccgatgacggcgttgccgccggccgacacggtggccacgtcgcgcagctcgttgtcggagacctcggtggaaagcgcggccagctcggccaccaggtgcgtcaccgtgcgctccagcccgcggatgacctggacggggttcacccccgccgctacgatcttcatgccctcctggatgatgcccgccgccaggatggtggccgtcgtggtcccgtccccagccaggtcgttggtcttggaggccgcctggcgcaccagcttggccccgatgttctccacggggtcctccagctccacctcgcgcgccacggtcacgccgtcgttcacgatcttgggggagccgtacttggtctccagcaccacgttgcgacccttggggcccagggtcacgcctaccacgctcgccagcttgtccacgcccgcctgcatgcgcttcagcgcctcgccgtcggtgttgaagtgcagctgcttggcggcgcgggtgaccgcagcgccgcgccgcgcgggccgcgtgggcacgccggagcgccgcagcgcggggcgagggcctgtggaggtgtgtgtgaggggagtgaggggtcgatgggcggatgggagtggggaggaggggtggcggttgggggatgtccaaagcaaggtccacacagccaccacgtggcagaatagcatagtctgcaccaatcatgcgcannnnnnnnnnaatggggtgatgggagtggggaggaggggtggtggttgggggatgtccgaggcagggtacacacagccgccacgtgccggaatagcatagtctgcaccaatcatgcgcagccacggcacatcgtccggcctccgcatcccatgtttgaggcaagctggtgcatgcactcgaatgcatgcacgccggtgcctgtgcacgactctaccatgggctggccctgagccgtgaccctcgacaccaagcggggccccacccattccagccaaggaaacagcatgacaggcgtgcaccatgcgctcgatgcgatcatgatgcagccatgtcatgcccctgatacactgccggggcgcgtacatggccctgacggccggagtccctcacctccccatccccaacttccagaaacccgcagcgcaccttgcacgccgatcaagccgcgcgtggcggagccgctggataccatggcggaaatcatctgagaggagtggttgaggctcgagaagcacggtcagtgtgagcaccgtggagggatgcatgcaaggtctcgaaggctcccaaggccgggatggctaggcactcgcacacgccacggcacacacatcccctcacctcgctgttaaagaccaatatctaagacttttcactcgtgcctgtcgaggtggatgatgatcaaagagggtctcgccatgcattgtgcggcaaatggggcgtggcgaatggattgcgggtggaaagggcgcttcgcgcgagtcgaagatatgccgctacnnnnnnnnnngtcggggtgggggactcaccatgccatgtgcatggcaatgaaagtagggcgtggcgaacggattgcgttgggtggaaagagcgggcgtcggcatgagcaccggtgaagcgttcaagggggggaggtgcaaacgtgtgtgtacatggcatctgcagcgcgggacacgcaggagcaccgttttg

SEQ ID NO: 37998 - DNA, 61 bp, Chlorella protothecoides
aacaacaaagcctcagcactcatcccccacacctgccacacgagccggcagtagtttgggg

SEQ ID NO: 37999 - DNA, 15050 bp, Chlorella protothecoides
  modified_base (376)..(385): a, c, t, g, unknown or other
  modified_base (3235)..(3244): a, c, t, g, unknown or other
  modified_base (5170)..(5179): a, c, t, g, unknown or other
  modified_base (5392)..(5401): a, c, t, g, unknown or other
  modified_base (5775)..(5840): a, c, t, g, unknown or other
  modified_base (6090)..(6158): a, c, t, g, unknown or other
  modified_base (6677)..(6686): a, c, t, g, unknown or other
  modified_base (7169)..(7178): a, c, t, g, unknown or other
  modified_base (8328)..(8337): a, c, t, g, unknown or other
  modified_base (8784)..(8793): a, c, t, g, unknown or other
  modified_base (9396)..(9405): a, c, t, g, unknown or other
  modified_base (9494)..(9503): a, c, t, g, unknown or other
  modified_base (10661)..(10670): a, c, t, g, unknown or other
  modified_base (10768)..(10777): a, c, t, g, unknown or other
  modified_base (11438)..(11447): a, c, t, g, unknown or other
  modified_base (11528)..(11584): a, c, t, g, unknown or other
  modified_base (14870)..(14930): a, c, t, g, unknown or other
agcaatcccaacatcacgtcaccgaaagcccctgtaggtataagtgccctcgggttcctcagcatcgattatcggcgtatctagaagaggaaaattttcgtgtatatatacagagtcactttggaaagtcgtatcgatccctgtttacttcctaccgttgccgcaagctcacttcagttttcactgacatatatccgtgcgaatcattgggccgactaagccccttgtgataggtgagggatgatgtcatgtatagtgggtggcgcggtattgacagcgtagtgggttgtacggggaggagtgcttcacctgtaacgaaggaggacgtcgggagtgttgccgctgtgttcggggatcccgacaggtcccgtcgctnnnnnnnnnnatttaaagggaggagtgcttcacctgtaaccgaggaggacgtcgggagtgttgccgctttgttcggggatcccgacaggtcccgtcgctcactcgaaccccctcgattgttcccccacagccttcatcctggcttgtctgaccagcggccttctcctgggctcaacccttccccccgtcgccccccaccgtcgtccggcacccatttccaagcccaccaccgcgtccgcacccgtcatgactaccgcacctcgtgcagtttccaagatcgtgcgcggcaccaagcagatggaaggcgcaggtgcgcggaagcatcaggattctctgcttgaagtggggggggggaggggggttctgagcgaagccctggtggctggctgatgagtatggatgccgaggcaaacctgtgcactcagccaaggttgtaccacactcccttgagcagtgcttgctccctgcgctccagcatttcccacgaatcacatcccacttccacccgccccacttcaccctatcatcccgctcctcgatcaggcgtgcgcatctgccgcaccatcggcacgggccacctccgcaacctggaccccttcctcatgctggatgagctgaagatgccggcgcatgaggcaagcgccgggttccccgaccacccccaccgtggctttgagacctgctccatcatgctgtctgggaagatggagcaccgcgattcctatggaaaccacggcgtcatcggccctgggggggtgcagtggatgaccgccgggcgtggcatcgtgcactccgagatgccaaaggtcaccgagggcatgctgcacgggtgagcctggggggaagggggtgggttgggaactgctgagcagctggggccctatgctccagacaacagggaggaagagttggtgtgcagagtgtcgcatcgtgcattccgaaacgccctgcaactagctactcctcatacaattcggcggcatgattgactaacggcatgcgctgcactgagaatgaccggaccccccacttccccaccccaacaccacttcgacaggttccagctctggatcaacctccccgccaaggacaagatggtgaagccgcggtaccaggacgtgcaggccgacgccatcccggccgtggagggacccgggcacagcgtgcgtgtcatggcaggcagcgtgggcgccaccgcggggcccctgaccctgcgcaacccgggcctgttgctggatgtgcggctggagcccggggcggagtggagcacggaggtcaccccggactggaacggcttctcctacgtctacgagggcgccggcaggatcgggggcagcccagcggccgtggagaatctgcaggtgtttggcaacgagggcagcacggtgattgcacgggcggccgaggacaggccactcaagttcctgctggcctttggcaagcccatcggcgagaaggtgatccagtacgggccgtttgtgatgaatcacgagctggagatccagcaggcctttgccgactaccactcgggcaggctgcaaaaccccaacgacgatgtgtgggccgctgagcagtgactggcggcagagtggcatgctgaatctcccagctcgatcccttcttccaatgtacacaaatctgcctttacccctggctcatgccttgaaatcttcccatgatcatagccatgccacacgcctgaatgtgttcaagttgacccaatgtatctttcttgttgtaaatgccatggtggagattgccaacgcgtgaagaaccagcatcatcccttacaattctcaaggcactaccctggggccccccgcttggacacgaatcgggcgccaggtccgggtgatcaatgctccagaagaccagtagaaggcaggtacaatacccaacatctccaggttactatcgaatatatttcgtggtcccgacaccccgctggaccgattagagagcacctcgacctgctcgccgttcccttccatcgagtcacgctcactttcgcaggcaggacggtgcctgacagcatcagcctatggcaatgcatccctgatccttcaaaagcgcagcatttaatatcacgggcaggtgcattcgaaccaagaggtgtcttgcacggccccagcgatggcatcctctgacaagcgcaaggcggaggaggggttggcagagccctccgagactgccaagcgtcctcgtgtggaggatactgaagccgatgcacccgccaagctgtccttgaagctggagatcctggagcgggctaagaggaccctgcagcagaagaaggagtttctggctgcagccaagaaggcacaggccgctgccgccgccgcggcgagcaccccagcgccgcgccaagagcaagcacctgcagttgcggagccaggagctggcaggagccagaagccggctgtgggtaccgcggaggaggaggcgcccgccgatgagggcgccttctttgaccccgagatcgggcaccgtggcggtcggcgcatggaccagcgtcgccggggcggactccagtttgtcgaggagggcaagtttcagaaacaggccgagatctccaggctccgggtatgcggttgggttgtatgacgtatgggtcctcctgggtgggtggggaagtgtttgagagggtaccatgttttgtctcgtgcataccgggtggcttacatgctgcagagtgtctcggggccgtgcctgcctggctgagccggcatggcggggtcctgcaagggtcccttgacgcgatccaccccctgacactctgggcactcctcggcatcatagcctggaccgtgcgagcgcttctcttcccaggatcgcacatcacaaacatccacaaaacacnnnnnnnnnntgtgcgagcgctcctctccccatgatcgcacatcacaaacatccacaaaacacgatcacctcatggcagagggagtatggcgagggagcagcgcgccagctggcagcacgcaaggccgccgaggcggcggccgcggcggccgacccttcagacccgaacctggtccctctgggcgagcgccccccccgggaggcctcgcccgccccggctccggtgcccgctgtggagtggtgggacgcgcggctgctgacggacaagaccagctacggcgcggccgcagagggcgagccgtccatccgcgaggagcggatcacgcacctgatcgagcacccggtgctgatcgacccgcccggcgaggccccattgccgccgccccagcccctcatgctcaccaagaaggtccgtttgcgtctgtggaagtggggtttcaggggtatgaggagggttgggagtcagtggcagtctggggatctggacccaatgcctcacccaattgcatcagcaacggttgggcgtgagcatgtcaacaggtctggatgttgagcggttgcatatcgtttggcgcctcagcgccacacttcttgccaaggctcgccattttcaagatcctgaggccacagaccccgtcctcctgggccccccaaacaaaccgtcgcctgcgcaggagaagaagaagatgcggacgcagaaccggcaggcgcgcgagaaggagaagcaggagctgatccgtcagggcctgctggagccgccgccgcccaaggtgaagatcagcaacctgtcgcgcgtgctgggggaggaggcggcggccgaccccaccgccatcgagacggaggtgcgacgccagatgggcgagcgcgccgccgcgcacgaggaccgcaacctggcgcggaagctgacgccggcggaggcgcgggagaagaagctgcgcaagctgctgggagacccggaggccgaccccaccacctccgtctcgctctacaaggtgggcagcctggcccggccccagctgaagttcaaggtcagcctgaacgcgcaggagaaccacatgacgggcgtgggtctggctgtggagggcgagttcacgctggtggtcgtggaggggccgcccaaggcgcagcgaaggtatgtgaatgattcggtatgagtggaggatggtggagggggcggcagcgtggtattcttggggtgtggctgggtgccagggaggggggagggggagcagtccagaggttggatggatgagtctcgtcttgcgatgaggccctgcgactgcaggacagttccctttccttccttctcccttctccaaacacgctataacctgtgccgcaggtatgagaagctgatgctgcgccgaatacagtggaacgcagaggaggaggacgagcaggagggcatggaggaggcggaggcgccaaaggccccaaactactgccggctcgtgtggcaggtgtgggggatgagtgctgaggctttgttgttgcaatgccaaagcatggacaggcacgcttggcaaggcgggaggaggtgtcaacatcgcacttgcaccggctctgccactgtttctggccatcattcgcacaacagactcccccaaacaccctcatgttgacggtcatgttgtgccccctaatggaccctgcactcttcccacccacagggcaccgtgctgaagccgtcctttcggaagttcagggttgagacgctgcggaatgctgctgcagcaaaggccttcctggggcagtacaacctctcacactactgggacctggctgaggcatccgtgccagagtagctggcaagtgttgtgggcaactgtaaaccactcgaggcagcttcccagttcagtgggcacggccatgacgagaacatgtaaagatctgcaactgcgtgcgaggattcaatacccttattgttctcaaggannnnnnnnnntgaaaacatgtaaagatctgcaactgtgtgcaaggattcaatacccttattgttctcaaggaaatcagtgggggccaccaatcttgcctgtctcccgtttgtgtcaacaaccacgacctgggctggagcaaattctgaccttgtcctgcccaatttcacgactctaccaaaacccctctcccaaattgcacgcctctcgattacagcgagagnnnnnnnnnntattctgaccttgtcctgcccaattcacgactctaccaaagcccctctcctaaattgcacgcctctcgattacagcgagagtggaaaggcctcgtcgcgtgactatcaggtagaaggagtacttcagcctgctccatccccgtcacagttgcctccaggctcagaacctggtgtggtagtctcctgacttgcacagcttgcgcacccacttgtccaccttgtagctcgacttctcccacaccttgaggtactgcacccgcacgccgctggcagagtgcatcgggatctgcatggggataggggaagggatgttattgtggggagtgggtgccaagcaaggattcagggctagacataccccgtccacccccccnnnnnnnnnnnnnnnnnnnnnnnnnnnnnnnnnnnnnnnnnnnnnnnnnnnnnnnnnnnnnnnnnnttttggtccagtagactcactcccaaccagtgctgccccatcccattctctgtacaaaaccctatcgcccacccacccacctggaatgacatgctcatgggcggccggctccacgccttcttctcgcgcgtcgtggcgatctgctcgacgcttgcgctcagcgactgctctgcatcccccgcaaaacgcttgatcttccaaaccagcgagccgcgtttggggtcgtactttgccttgcctgcaattccannnnnnnnnnnnnnnnnnnnnnnnnnnnnnnnnnnnnnnnnnnnnnnnnnnnnnnnnnnnnnnnnnnnntacacacaagcacctgtgctgagctggaaggtagcacgcgctgtctgctccggcatggggatgaggacgatgacgttggtggcaaaaaggttggaggggaagctgctcttcagcttcacgctgacctccagccgcgtccggcccttttctgtgaccaggaccacagctttgaagggcgggttgatgccctctgtccagagggggaggtgaggaggcgaggtgaggaggtgtgtgcgtgcacagggtttgcgccccagtttggtgggcaggggcatgagacatgccacaaaccatggcctgggcatgcacctgacgcccaggccatggccagggttcctcgcctgtgcatcggtacttcatgagctcgaattcgccgtctggaggcacgaaagacaccacttgctcggcctggaagcgcccaaggttgacgcaggggtggaaggtgacgtcctgcacaccaaggttttaaatggtgcatgtagggattagaggagaagagaagagtgctggacggcagcnnnnnnnnnnccgcccaaggttgacgcagggatggaaggtgacgtcctgcacaccaaatttttaaatggtgcatgtagggattggaggagaagagaagagtgctggacggcagcttcaatgcctgcaccaaacttagactgggaatggtcctggcagcgcagcgcacacagagctttctaatgcacaaaaccctagaatcatcctctcagactccctttcatgtccccgccaaagcaccctcacctccagcttgtcattcagccccagcttgacgtctggcatgcccgacaggaagcacttcatgaccaccctgccctggacgtcgcaccgcagcacgctgcgaggaaagagggaacgtgttctgttgaaattcatgctggaactgaggttgacatgagtgcacagccaaggatccaagccagatcagactctaagaggttatgaaacatgtccatgctctattctgtacaacagacacagtccaatcaaccnnnnnnnnnntagatcagactcaaagaggttatgaaacatgtccatcctctgttctgtacaacagacacagtccaatcaacctcatcttgtcaaacaagttgccaccagcccacctgccctgagcgctcataagcatgttcacagtctcgatggcgtccaggaagacctcattcttcttgtattttatgctatcctggcgccagccaaccgcgcccgtcacctttggcaagggtcacggcatgattggatgcaagggaggcaggagatcagacatgttcataacaaccggagcctgataaccaaatgaacagcagataagccttaatcgtcaagcaatcagtctctacatcacctaatattcaaaccacgtcacacatactcaaaggcacccacctgaagggtcgcattctgtgccgccgcctccctcttcttcttcgtgctctccagcacaaatccctgcaatcaagattgtgccagagaaaagagctggaggctgggaacatggaaacggtccaataattctatcgagttgcatggcatcccattgcttacccacacagtgatcctagaaccttcacgaccgccccagcgtctcaaggatggacaaagctgcacttctccccccatttccccgctgcggcgggccccccctcccaccctctgatccacccaaaccacagcaccttttggaagatgagggacttcaggactgcgggctctgagatttgggggtagccaaagtccaggatctcgtccagcagctcgtagatgagcacaaagttggccttgatgacctcctcgttgaagtcgccatggcagtaggacttgatgaggtccaccaccttgctgaggaactgcaggatcatcatggcgttggagttggtccgcgtgattgccagcaagtacacgctccccgcccggaggtggataaaggaggagccgatgaactggcgcacgggggccgtgctggcagagtccagggacttggagttgatgacattggtgcggaaggcggcggggatgttcttgctggaggggtgggaggtggggagaagtggttgtgtgtactctgcaaactcagcaggtttccatcttctattttaagatcagccacctacgcagtcttaccactccgtcgcttccctccactcactcaatnnnnnnnnnnatcagcaggtttccatctcccattttaagatcagccacctacgcaggctaagcactccgtcgcttccctccactcactcaatgtcatcccggtaggttcgctggatgagcacgtcccccctgccgctgataaaatatatcgcgcccagggagtccatggcgatccagcagtttggcagtgcccggccaccggctcagacctctcgctctcccaaagtgtagttgccgtgcttcggcgacacgaattcaacgcaattccgatgtgatcgggatcgcgggggccctgtggctctccagcaccggcaggtgccggatacctttgtatccctaagaggcctgctgcaccagactgctccgagggagggatcgacagtctttcaagaccgtttacaagggtggggggagcccttgcttcctgcaggggccttcaggatgcccacacgcgtcnnnnnnnnnncggatcgacagtctttcaagaccgtttacgagggtggagggagcccttgcttccggcaggggccttcaggatgcccacacgcgtcggcgagagtcaacaagagcacagtgcgcaatagctggaaagtaaagaggggtttgcacccccccgcacctgtaaaccctgcctgcaccagggcaaggcgtctcttgacaccaatccatattgtcacagacccattctgctttgtactggtgtacattcgagctgggaagaagggcctgtcctccgcacccctgtccctgtcggtggtgtgcgtcgctcgcggcagtgcctgcctggctgtgcgtgacgccggcagggtgaccccctgatttctgtgcctggaggcttccgtagagcatggcggggtggctcaagtccctgggttcggtggtgcgcagcaccggcaaggccatcgactcgctgggcctggcactgcaaggctccctcggctaccgggagacacgtgagcggggatcggggaataaaaggcaaccgtgatggcacatgcatattgcgagggctggctgaatagccccgcgacgacccacaccacccttgccctgcagtgtcaaaggcccnnnnnnnnnnattggggcgtaggggggtgctggcggcaggatgtcctgcaagcggctcactgccaactcactcaacatcacccctcctcatacaacacnnnnnnnnnncacggcaaccttgatggcacatgcatattgcgaggactggctgaacagccccgcgacgacccataccacccttgccctgcagtgtcaaaggcccagacggtgctcccatacgctggcgccaagccggctatcgcggacagcgtgttcatcgccccttccgccagcgtcatcggcaatgtcaccctcggcagcggcagctccgtgtggtacggcaccgtgctccgaggtgagctggtgttggggggtgatggaaggacatggggcgttgggggaatgctggcggcagggtgtcctgcaagcggctcactgccaacgcactcaacatcacccctcctcatacaacaccctcacacacacacacgcaccatcccaggcgacgtgaacagcatcagcgtgggtgagaagaccaacatccaggacaacgtgttggtgcatgtggccaagcacaacgctgcgcaccaggagctgcccacccgcatcgggtccagcgtgacagtgggccacggcgcggtgatccacgccgccacgctgggcgaccgcgtggtcatcggcatgggcgcggtggtcatggacggcgcggtggtggagcccgagtccatcgtggccgccggcgcgctggtcaccccaggcactgtggtcccctcgggccaggtctgggcggggagccccgcccgcttcctgcgcgacctggcccccggcgaggccgagttcatcgccgccgccgcggaggactacgcccgcctggccgccgtgcacgcggcggagaatgccaagggcttcaacgcggtggagctggacaaggcgcggcgcgaggaccgcgcggcgcgcgaccccgagcacgacgcggcgcagggcatcgcgcgcgacccggagacgcgcgccgtcgtgggcgtggccgccagcacctgagcgtctcgcgggcggcccccagggggcagggaggtgtgcaggagaacggtccgcaggggcggtagtgagccgccctggcgccctgtgcgcagccgtggcccggtgtcaggagcggcggccaagagagtgctgagtcggggcaggcggacgttcctcagcatgcgccggcgcactggctctgcactgcactgctcgaatcctgtagacagcagcgaagagaagaggtgccgtgcagcgtaggaggttgannnnnnnnnngttaggtacttgcttggacttcccaccaccgtttattcagcctggcattgtctggaggcagtcgcaggaacagatccggtggtgcatgccaagcagtnnnnnnnnnntttaagtacttgcttggacttcccaccaccctttattccgcctggcattgtctggaggcagtcgcaagaacagatccggtggtgcatgccaagcagtgcagttgccgacgtcatggagcactgcagcagagcaggaaactcatcgatgccttcagcgcctgcgggactttttggaggggtccgccctgccattgccgtcatcaccccgcttccgccccgcgcgcctggccgcctccgactccgattccgacccgctgctgctgctgtcggagccagatgacgatgatgaggaggaggaggacgacgaggagtcgctggaagaggagccgcctgacgacgaggagtcgtctgaggatgatgagccgccagatgatgcagatgacgaatcgtccgaggacgaggaggcgtcgttcttggccgcctctgctgcagcccgctgcgcggcgatgagcgccggcaggttcttcagcgtctcgcgcatgcggtccgtcagtcctgcggggtcggtgttgggtgcggggggttgttgcaggttgggagggtagccgtggttggggcagcaaggacctgagggcagtcaagtccaccaccccagcagcaaggtttgggattccggggggctgaagctcgactcccatccaagacaaaagcacacaccctnnnnnnnnnntcgaggagtcgtctgaggatgatgagccgccggatgatgaagatgacgagtcgtccgaggacgaggaggcgtcgttcttgnnnnnnnnnnnnnnnnnnnnnnnnnnnnnnnnnnnnnnnnnnnnnnnnnnnnnnnnnatccgtcagccctgtgggatcggtgttgggtgcgggggtttgtggcaggttgggagggtagccgtggttggggcagcaaggacctgagggcagtcaagtccaccaccgcagcaaggtttgggattttggggggccgaagctctactcccatccaagacaaaagcacacaccctagcgccccgctttccatcccacaacccacggacctcccagcccgatggaggtgaagaagttgatggagaagcgcatgttgcgcgggctgtcggtggggaagatgccggtgtaccacgcggcacagcttgggtcctgcagcctcttgttgaggcccagcaggcccagctgctccaccagctcctggaacaggatcttgacaaagatgcgggaggaggaggtggtgtcctcctccgtcagccgcaccacctccagcacggaccaggggatggcgtcgctggccagcaggtgggcgaagagcttggccacgttgcgcagcttgttggtctccaggcggtggatgagcgagtactggcgcacgaagcactcggagaagcagtcgcagtactcgcgcttgagcttggagaagcgctcccccagcagcgcgtagtacctgtggtgcatttttgaagggggggaggttgggagggtatggcttgtgaggaccatggtcaggcgggagttcatgccgagatgtcggtcattatgtgcttgagctgcctgatgcacctcggcactgccagtgcatggcagcccttgctgcagggcgcctgcatggcaggtctcctgtaatgcacgctgcaggcttcgagcaacatcacagacaatctacaagtgggtacgccagctcactttatgaaggtcttctcctgggagcagcactcgatgatcatggtgcacagctccatctccaggccggcaggtatgccctgcaagtggggaggagggttgtggggaagcatgaggcacaggaggctcctttcacttgagtaagagacaatggaggtgcccatgtgttgtcatcaggttcaaacccacagttccagaccttgggcgccgaggtctcgatttacgccaccactgcaaccccatcgcactgtccggcagcttgcgcatggcaccccctctcaccccagcaaggcatcgaccctcccaaccattgcaaggatggcgacgatgactgccagctccccaacaaacccaccatcttcaggagcttgtgtcccgcctcttcaaagtccagggcagacatgatggtgaggtagatggttcgccgcaggttgatcaggtccgtctgcgtctggtcggagatggggcccccgacgcccgacggcccagcggcgtgcccgccctcctccccgtcctcctcctcctcctcgccagaggagctccccgactcctcctcctcctcgtccccgctttcctcacccaggatctcacgcctgatcgcctggtactcggcctcatgctgggcaaagtcggggtcctcctggaacacgtccagcatcatctgtgcagggtgggtggagtggtggtggtggggggggggtgttgagacgggaggactggcttgaacaatcaaggcagggtgctgcaaagccagcaaatagggtgcaaggggtatgatgaggagtgtggggtttcctcgaggcacgacggctgagcagtacccctctccagcctcaacgagggtcattcgctcccctcgtcgagtatcaccacatacacacacacacacacgctcttccccatcacaggccagtgcattctccgttctcccgcgcggccatacctgggtgtccagcttgtcgtccagcgacacctcgtgagtgatctgatcctctgtctccaccagatccaggtccgcgggaatcgcggggtgcctgtgggggcagggaggtggtggggaggcttgggcagggcaggcgtgagaatgtagggccggggacgggaaggcaccgcctcacatcctgccccagagtgcatcgcctgcagggcaggagagcagccttgggcccagcccctgccggtagcaggtccgcacaagcttgctttccctccatccagacatcccagcaacacccctcctcctcgtggtgccctcaccccagtgtaacccacccactcacccctgctgctcgaagccggccttgcgcacggcaaacaggttttctatgatgaactgagtcctcttgtcaatgctgccctcatgcaggatggccctgtgagtgaggggttggagcccggggtcaaatacagctcggaaacgtgagctggggcagtggagttcgaggcgtttgatgctgcatatagtctgctcgatggaaagaccttttgcacccaggcatggcaggcaactccaagccgtctacaccacaccccggcggttgattaacatccacacccctggctcggtccctccactgatgggggcacaggcccttgttcttgcatcatccccccatcactcatgagacccccacccccaccccacccaatccctcccacctgaatcggtcaaagacggaattgagcccctggggcgccaggtcctggagcagggcccccacctcggtgacaaacccggcggccacctccacgccgtcgtcggagggcgtctccagcaggagcatgagcacctccagggccagcacctcgtgcgccacctgctggttggccaggtgggccaggaacttgatggccgccaggcagacaggcttgtcgttacgcttgtaggcgcggcggaactgggtgaccacacggtgcagcagcagctcgcccagctccgggaacttggtgttgaacaccgccaccagcgcggcgtagacgggggtgaaggagggggacgccatctggctcttcatcaggctgcggcagaacaggccccgaccacgcaccagattctggaggggtgtgtgttggaggggggatgggggacattctcggggaaaggcggcacgcggagggtgtggtcctgctgacatgcccctgagtgatctggaggccaaggcacagtgccgttccctaagcaccctgccacccaacctgaagatgagcacccccgccccctcaccgtccacaagcacccgccacccactacagtacctcggagaagaactctggcaggatgtgcttgatgttggcggcgttcaccttgttgatcagcccgttgagggacttgcgcagcgcgtcccaggtcatgcgctggtactgcacgctggtggtgtcctgcgcctccgccagcatggccgccagcttgaaggggggaaggtacacgccccccgccggccccgcnnnnnnnnnnnnnnnnnnnnnnnnnnnnnnnnnnnnnnnnnnnnnnnnnnnnnnnnnnnnnggcgcgctcgaccgcgggcggcacggtacctgccgcggcgccggcaccgttgctctgggctttgccggcgccctcgccctgggcgccggcctcgccgcgataccgcgtggcgccgcggcc

SEQ ID NO: 38000 - DNA, 61 bp, Chlorella protothecoides
gccagttctctggtccccttggcttcgttggttgatacggtcacgcgtcaagccccttccc

SEQ ID NO: 38001 - DNA, 95 bp, Chlorella protothecoides
gtcagcaaatcgccaggcacgcaggggcatgcaaggtgcacgccgtacacgccttgccactcggccctccttgcctggaccctcaggaacggctc

SEQ ID NO: 38002 - DNA, 116 bp, Chlorella protothecoides
agtccgggcggggtggcatccagcccggggcccccggcgcagctcggggagtcgaggtcaagccccttcacaccccctgcctcctggtcgcgggcaggcgcctcgggctttcccag

SEQ ID NO: 38003 - DNA, 66 bp, Chlorella protothecoides
tccccgtttctgaaagcgtgtgtgtgtgtgtggggtgggggggatgaggagaggagggttgacgtg

SEQ ID NO: 38004 - DNA, 129 bp, Chlorella protothecoides
gggggggcatcaggagaggtttgcgtggcattgatacccggtctgggacccccgccccccgcagggcaatgcctcgcggccggcaacaacctgcactggttggcgaagagtgtcttcgcctgccttaca

SEQ ID NO: 38005 - DNA, 61 bp, Chlorella protothecoides
tctggcacgccagcgaggggatccaaccggtggcactcgaaaatcgacgcgatgtgtcgcc

SEQ ID NO: 38006 - DNA, 97 bp, Chlorella protothecoides
atacgaagctgcacatcgtaagttcattcactcttgcgcgatcgcgacgggtatcatgcgaggggtccctgtcgcacggccacagggtctcatcacc

SEQ ID NO: 38007 - DNA, 79 bp, Chlorella protothecoides
aggtcgtgggtcatgccttggcccccccccactatccatttattctgattgcggcagggcggactgtttgatgcagggg

SEQ ID NO: 38008 - DNA, 66 bp, Chlorella protothecoides
aggtgatgtactcggtgtagacaaacagcagcacatgcatggcctggcttctgcaggctgagggac

SEQ ID NO: 38009 - DNA, 61 bp, Chlorella protothecoides
tcctctaggaggtagcgggtctgggtggaggattggggttgcgcgtgggaggagagtgtgg

SEQ ID NO: 38010 - DNA, 72 bp, Chlorella protothecoides
ttgttatgttgactggaggaacacatggacggtgctgcaagcgcggggggggggggggggggggggcggggg

SEQ ID NO: 38011 - DNA, 107 bp, Chlorella protothecoides
tcggccccggcggtggggccatggacactcctggcacactccctgcgcagggcgcatacatgccccgctgaatcagccccagacccagtcctgtcgcctggctcacg

SEQ ID NO: 38012 - DNA, 146 bp, Chlorella protothecoides
gatgttggggggaccgctcggctttgcaacactatatccgggtgagtcatggttgaggcattgctcgccagccagtccatctgatagaggacatcctcaggacctgtcttgctcgtagccggcccggcagagccgggggcgtcact

SEQ ID NO: 38013 - DNA, 75 bp, Chlorella protothecoides
tattgtagtctcttggtacatgtcatggaggtattaactcaaaaaagcggatacccaggcacgtgctcggagagg

SEQ ID NO: 38014 - DNA, 189 bp, Chlorella protothecoides
gcgcctcccagccgttggctgcatgtttttgggggggtggggaaaatgacagggagggagggggttgcatgtatgtgtcagcgagctcagctggaccaggggctggccggcttgacctccacagtggcctccggcagtttcttcgagctcagcacatgcttcccccacctaccccacccacctaccctc

SEQ ID NO: 38015 - DNA, 72 bp, Chlorella protothecoides
ggtaccaacccagggttctccaaggtgggtacctgggccctgtccccacgtctggtgatgacgtgcccatgt

SEQ ID NO: 38016 - DNA, 88 bp, Chlorella protothecoides
ggccagcgccagctcaaaggcgtacagcgcatcgcccttctccgggtgatcatagttggcctcgggcgggaccagggcgttgaacttc

SEQ ID NO: 38017 - DNA, 80 bp, Chlorella protothecoides
gacatcaactagaggccaagcctgtgataatcgtaataaaaacagcaccccaaaggtccaggcagcagttcagtgtaggg

SEQ ID NO: 38018 - DNA, 61 bp, Chlorella protothecoides
accggaaacaaggggaagaacaactttggcaacaacaatgtgggcaacaacaatattggtg

SEQ ID NO: 38019 - DNA, 61 bp, Chlorella protothecoides
ctgcgcctgctcgggggaggccaccttgcccgtgccgatggcccacaccggctcgtaggcc

SEQ ID NO: 38020 - DNA, 61 bp, Chlorella protothecoides
ccccacctgtgagtaagactgcgtatgtatattggttgtcgtgatgctgcctgtctccgac

SEQ ID NO: 38021 - DNA, 127 bp, Chlorella protothecoides
gggcgctcgaccatgcgcaaatccggtccaccatgctgcgtcgtgatttatgtgaggcgcacagatcttcgtcgcacctgcgcccctgtttggccccccccacagctcgtcatgtctatccccagca

SEQ ID NO: 38022 - DNA, 61 bp, Chlorella protothecoides
ttcggagccgggcgggttgtaggtctgcgcgttgcggaacatgagctgcaggtccacctcc

SEQ ID NO: 38023 - DNA, 4203 bp, Chlorella protothecoides
  modified_base (1812)..(1908): a, c, t, g, unknown or other
  modified_base (2617)..(2626): a, c, t, g, unknown or other
  modified_base (2905)..(2914): a, c, t, g, unknown or other
  modified_base (3518)..(3527): a, c, t, g, unknown or other
  modified_base (3613)..(3734): a, c, t, g, unknown or other
cccccccttttcaacccccactcgccaggtcttgaacggcgacctgagctacgcccgggggtacgcagtgcagtgggagaccttcttcgaccagctggcccccacgctgcgcgcgctgcccctcatgacggtgatcggcaaccatgagcgggactggccagggtcgggcgaccgctttggcatggcctacgactccgggggcgagtgcggcgtgccctacgctgcgcgcacagggatgccgacggcagggccggaccgcccctggtactcattcgaccatggcccgatccatttcctgcagtacagcacaggtttgggggcggtgctgtggctgggaggatgggtacaaggggggggtaccttggatgacctccatcactctgtcttgctgcgtggccgccgggcaggcacggatagcgcatgcttttgctggatgaggtggcacacagtgttccctcccacccaaaggctgatgtgtgaaccacagcgagcaccagggagccctcgcttcacatacgcctgtgcctgaccaacatccgcagagcatgcgtttgaggagggctcgccacagcatgctttcatcgctgatgacctggcggccgtggaccgatgtcagaccccctgggtcatcctcgggggccatcgcccggtgtgtgtgtggaaggggagtttgattccatctgagggatgggggaaatcgcgagcggcacctggccatgtgccagccagcgtggggctggccactgctccgcagccgccccgcgcctacttgcatccccgtcgcccagcagcacgctcagcgtcaacccccttccctcatcaaccacccggccgtcgcagatgtacatcgacagcacttttgacgccgtgcggccagacggcgaccagtacctggcggcggagctgcgccgcgcgctggagccactcctcctccggcacggtgtggatgcgacgtggcacggccatcaccacagctaccagcgcacctgccccctggcgggcgggcggtgcttggcgtcgggggaggatggcgtggccgccggccctgtgcacattgtgctaggtgagtggcttggccggagcgagtttggatggtcttggccgagaggcgcatgcagggcgggcctggggtaccgcatgcttgcatggcgagcccggtgacagctctcaagctcgcactcgagcctgcagcaatcctcctccctcttacgccctgctctctgcaatttgcagggcattccggcgcatcgctcacccccaacacggagccgcagcggccgcgggagtttgtcagcgtgcagctgcagcatgggtatgtgcgcgtcactgcgaatgccacccggctggagcatgtcgtcgtttcttctcaggacggcagcgtcatggatcgatgggtgctggagaagcctgcaggatggtgcggcagccgcggcgtcctgcggcagggagaggagcgcgtggcggcggcatggccgtccctggaattcaaatcgcagcacagactgcggggttgcgacaccttttgatcttgctcaatgtaccatggacagcagaatgaatgcttttgagtatgtatacgaatcttttgaccatgacaagacagaagtagactctgaggggatgcaagttgcaccttgggcccccaagcccaccccatcccttgaagctccctcctggacccagcaccctgacgtggtggggcccgtcagttgacaccagttgtcaatttactgtgccccaagtgcacccgtggcctgctagcgtgtccataacagcggcttgacctccccacttcagtgtgctgagtcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggtaagggtttaatattagaccgttttcacccatgccatcccgcacaggcgccagaaaagggtgggtccaatctcatcgccgcaaccccttaaaccctcatgcttggactcctgtcctcgggatatgcacttgccaagctatttacccgagatccatgtttcggggccgccatactcctctgtgtggagctctttgagttagtgcagctcgtttatacgatcagtggacaccaagggcgactcacgggttcgacctgatcgccagctcgcggcatccccggctggcacgccgtcgctgtcccttgggaactccagcgacgccggaagatcgcgacagtgtcttgcttgcactgagatccctgctgtgggccctgatcagtttcgctgacacactgggatcggcgaaggaggacggactagaggctgtccacccagctcctgaacaggtaatttgcgtgatcagttgctgtcgagcgctaccatgccgctgctctggtttcttatgcttccggggaggatggaggggcctgcacgatacggtcgcggcctcaccgatgcgcgacgcggccggttgggtggggcagctgacggcgacgggggctcgaggtctcgagatgaccccaggcctaccggctcgcgcacagcccggcattttctgatgcgaacttttcaagctaccaggagggctgcagtcgcgacgctgctgnnnnnnnnnncctgatgagaacctttcaagcaaccaggagggctgcagtcgcgacgctgctgctcggccggtcccttgaacggggcgtcgaccgcacgccagtgcagcggcagcattttctggggccagtccctctcttccgccaccgatcaccctcactccatggggagagtgtcgcacccacctgctctcacacccttctcaatgactaggtggagatagactcctgatcttcgttccttggagataccagtcgtggctcgcgcttgctgcttgaatttgaagggannnnnnnnnnctaccctcctcaatgactaggtggagatagactccttttcttcgttccttggagataccagtcgtagctcgcgcttgctgcttgaatttgaagggagcctcaccagccttcatcagcaagcatgacggagcagggtgagagtggccccccctccaccactgtctcctccaccacacccgccctggccacctccacagcgtctcagccggtggttgtgccgtcgcctgcccagaacttccccctggcggcctccccatttcaaatccggggtggcccggaggctgccaccagtgggacggcgagccccgccggccagcaccagccacgcagtggccagggctctgctgggatgctcatcgccccgtacccgggcctcatgctggcaggtggggagctgtgtgagactggcgtgcactgcttcttgggtttgaggggacgatgtggagggtgctggtgtccccctgctgcaatggccaagcgcgctggcatcaaaccgtatgcctatgttagcagggctgggtgttgcgggccagcccggctgtcagttaaggccagttgcccgtgctcccaccggcctggagatgctgggctggcccttcccggnnnnnnnnnncgggccggaggctgccaccagtggcacggcaagccccgccggccagcaccagccgcgcagtggccagggctctgctgggatgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtggacggtgctggtgtccccctgctgcaatgagcaagcgcgctggcctcataccgtatgcctatgttagcagggctgggtgctgcgggccagcccggctgtcagtcaaggccagttgcccgtgctcccaccagcctggagatgctgggctggcccttcccggcccgtcgcactcacccaggccctcccctgcctccccgctcccaggctccctcggcaataacttccccggcggggcatcccccacgggctccacgcccacctccctcccgccccacccgctgttcttccaccccgcctcgcgcctggcggcggccgcggcggccgggggcgcgggcagcgcggccctgcagcagcatgcggcgctgttggccagcctgcccatgccctccagctctgcccccggccccggcggcggcggcggcatgacgcacgtcgagtatctcagcctgtacaccaaggcgg

SEQ ID NO: 38024 - DNA, 75 bp, Chlorella protothecoides
aggtcttgctgtctaggctccctggcagagaagggcaggcaagcgtgctgctgctcactggcagctccccgcctg

SEQ ID NO: 38025 - DNA, 123 bp, Chlorella protothecoides
cctgtgtgagttgcacgattttatggtgtgagtaaggtcctggcatggcatgaacagtgatgggggttttcgataaaaaccttcccgccgtcgacatctgccgcaccgtcgcgggagcgccga

SEQ ID NO: 38026 - DNA, 63 bp, Chlorella protothecoides
gtgccccgcaagcctgttgagctcatccaaaatcgtgacacactcacgcaatcactggaatct

SEQ ID NO: 38027 - DNA, 62 bp, Chlorella protothecoides
ttcattgatttcgctccagcagcggtgcttgaacttgtaactcgcggatccgcctctctcca

SEQ ID NO: 38028 - DNA, 73 bp, Chlorella protothecoides
ccatgcaatccatgcaccattgatcctggttgcggacctccatgcgcacctcaatcgcagggcgatctggatt

SEQ ID NO: 38029 - DNA, 61 bp, Chlorella protothecoides
acgcgtcgcgcagctgcctttcgtcagcagcgcggcagaggcacaggtccgctgacacctg

SEQ ID NO: 38030 - DNA, 85 bp, Chlorella protothecoides
catcgctgccggtggctggggctggaggcggctggtcgggcgcggcggccggggttggtggcggtgctgcatcgctgccggtggc

SEQ ID NO: 38031 - DNA, 70 bp, Chlorella protothecoides
gcccgtcctcggcttccttgtcctcgccgccctcgccgccctcgccgtgcgtggggctgccgtcctcccc

SEQ ID NO: 38032 - DNA, 17137 bp, Chlorella protothecoides
  modified_base (109)..(118): a, c, t, g, unknown or other
  modified_base (448)..(506): a, c, t, g, unknown or other
  modified_base (1101)..(1110): a, c, t, g, unknown or other
  modified_base (3208)..(3217): a, c, t, g, unknown or other
  modified_base (5351)..(5360): a, c, t, g, unknown or other
  modified_base (5912)..(5921): a, c, t, g, unknown or other
  modified_base (6003)..(6012): a, c, t, g, unknown or other
  modified_base (6075)..(6084): a, c, t, g, unknown or other
  modified_base (6147)..(6156): a, c, t, g, unknown or other
  modified_base (6427)..(6436): a, c, t, g, unknown or other
  modified_base (6738)..(6747): a, c, t, g, unknown or other
  modified_base (7595)..(7604): a, c, t, g, unknown or other
  modified_base (7686)..(7695): a, c, t, g, unknown or other
  modified_base (7864)..(7873): a, c, t, g, unknown or other
  modified_base (8026)..(8136): a, c, t, g, unknown or other
  modified_base (8852)..(8861): a, c, t, g, unknown or other
  modified_base (9038)..(9047): a, c, t, g, unknown or other
  modified_base (9471)..(9480): a, c, t, g, unknown or other
  modified_base (9564)..(9581): a, c, t, g, unknown or other
  modified_base (9931)..(9940): a, c, t, g, unknown or other
  modified_base (10735)..(10744): a, c, t, g, unknown or other
  modified_base (12270)..(12279): a, c, t, g, unknown or other
  modified_base (12859)..(12868): a, c, t, g, unknown or other
  modified_base (13361)..(13370): a, c, t, g, unknown or other
  modified_base (14042)..(14051): a, c, t, g, unknown or other
  modified_base (14520)..(14577): a, c, t, g, unknown or other
  modified_base (14984)..(14993): a, c, t, g, unknown or other
gcgcgcgcgaggacgcgggcgcgggcggcgtgggcgccggcaagcgccacgaggcggctccgtcgctgcacgagggcgtgcccagcgacgtgcagctgctgaccatgannnnnnnnnnccggcgccggcaagcgccatgaggcggcgccggcgctgcacgagggcatgcccagcgacgtgcagctgctgaccatgatggccacggagccgctgaccctggagcagatgaacatgctgcaggcgcagctggccacccccggcggcctgcagggcctgcacctgctctccggcggcctcaccgcggaggccattgcgcagctgggcctgcccctggaccagggcggggcgggggcctaccccggcgccccggggcttgaggcctttgcggctgcgcagtacgcgaccgactacagccagggcggcggcgacgcggcagccgccgccgccnnnnnnnnnnnnnnnnnnnnnnnnnnnnnnnnnnnnnnnnnnnnnnnnnnnnnnnnnnngcagtaccacgagtactacgtggccgcggcagccaacgcggggttcggcgcggccgaactggccgccatgcaggtggccccgctgccggacgacgccacgctggccgcgctgggcgggcacgccggcgcacacgccggctacggcctggacgcggagcagcaggcggccgcgcacgagcagtacgcggcggccgtcgcggcgcagcactcgcagatgctggagcagggcggcggccggcaccacgacgccgaggccgactactccaatgcggcgcgggaggggtagggcggtcgatggactgcgaggaggaggttgctgtatcataccctcggtagtgactcctgtggacacgtgcgttcatgtttttccatgacccgccccacacccatgttgcccttgcccctgacgcccctgtaccctgtggcacccaacgcttgtgaaacccttgacacaaagtggtggtgtggctgggaggaggtgtactgcatgcagcccagcaccacagcaagtgctctgtgcagcgcagcatgggcagagtgaacggtgcgagggtcgctgggagggtggcggccgcggctgggcgactggcacggnnnnnnnnnnttctgtgcagcgcagcatgggccgagggaacggtgcgagggccgctgggcgcgtggcggccgcggctgggcgactggcacggcatggttgccagagggagagaagggcaggcagggggcaaaggggccgggaagttttggaggccctgtgaagcctcagatctctgtggggtgggtgcgaggggggcggcagggacggtgtcactttgtcttggattgaggcaccctcatgggcacccagctcagacaactcaatcgcctgtcgcgggcaaagcaggacacggtggcaatcgagtcaagcactctcccccacccacccacaagcacacaccagagatgtcgtcgaagtcgatgtagtcgtcgttctcgcctccctcctcatcgccaaaggtgtcggtgtcattgacgcggactgcagcggtgggggtggttggaggtgagtaggtggcactcgacaaccatttgcgaatcgatccagcacctgaacccccccatgcatgcatgcatgcatgcatgcatgcatgcatggatcacccccactcagcaagccgacacaaccatccagaccacagtccaccctccactcactgctgtcgggcagctcgccataggccttgagcgaccgagcctcatctgccatgtacctgtaagacgcgaaggtgtgatcagctgatcaacggtgcagtgttgaggagcaggctcgtcagacacacaaacagggtatcgtcccagcgagaacacacccgcccgccgtccctgatcacttccccttcccacttttccctccagctcacttcaagatgacatccgccttctcgtcctggtagtcgcggaggccgaccagcaccacgtctccggcattcacccacaccttcttcctcatcttgccgcggatgtgacacagacgcttcacgccgtccatgcagtgggcctccaggcgaccgttcccgagcatgcgcagcacttgggcgtactctgcgaggaaagtcactccgttcatcaatgttgggggattgggcggcgacaaggagggccttgccaccgaccccagccacgactcccaccttggccatcctccttgaagatgagctcgcgcttctcctcgctctcgttctttcctctccgcctgttttttcctcccttccctgcgtgcgtgaggggtgtgcagcgatgaggagcgcaggcctggatgcctggaccgggcttcaagcttcaggcggcagtctgaaacggccagggaggccgccctggagctccaaaactcacccttgttcttcggcatccttgctgacgcagtgggcgcgtgatctacgatagaaaagggctggaatgggttggacaggcgacaatgacgcagaaagctcctcggggcgtggatgccctttccaccgcatgcacttcttgcgaggggcgctgggccacgatggagcagtgggggtcatgtacatgcgatcgcgcgggctcaatctaatacttgacttatgcagcttgccccacttgtgtcacatcgacatacattctagacctggagactggcgtgcctctaggcggaggaagcgatgcgggcagcagcggctgcccaagccctgcgactggcgctcaggtgcagctccctgcggaccctggcccccagctgggaggcatgcagtacctcggcgagtgtcgatagccaggcccagatggcgcgactcctgcctgcctttcagcagcgggcagggtttgctgccggccgagggatcgacacggagtccattgaggacggcctggcctcccccaagtcccccaggcgccctaagtccaagtccaggcccaagcccgcccagggaccggggcctgctccaaaggcagaatcggagacgcagcgccgggccaggcaggaacgcatgcgcctgctcttgcaggacgaagccagcagcggcaggaagggcgaggcggcacgcgcgtttgtagcaaagtgagtgggtaccaggggggacagagttgggatgatagtgacctggacaaccttgtcaggggagagtagggtggacggaccccgacctcctcatcgagcttggcgctggccggcgatgggcatggtcttgacaatgcagcatgcnnnnnnnnnnggcaaagtgtgtgggtaccagggggaacagagttgggatgatggtgacctggacaaccttgtcaggggagagtagggtggacagaccccgacttcctcatcgagcttggcgctggccagtgatgggcatggtcttgacaatgcagcatgccatccgccaaccccgcagcctccagttcacccccttgtccctcctttccaatcatgcagcttctttgccggggatgtgtaccagggcgacgcccttggcctgacctccgaggacgaccccgtccccactccggacgaggccgctggtcccagcgcagcagcgtcctctgccgccgaggcgtcaggggaggacgaggccgctccgtcggggctgcgcctggctgcccccgaggccatgaccgccgccgaggagaggacggtgctggccgggctgcagggactcaagcgcggatcccagaggtgcggggccccgctgctcctgccggtgctcagaggcgaacccctcatacatgcctgaaggtttgccgtcgtactccacggcttgagccccacaacaaagtcccctcccttcattccctggtccccaggatcgtgctgcagcagctgctgcagggcaagatcctggacagcgaccccgaggcgcggcgcgagtgggccgagatcgagcgctccttcgcgccgcccaccggcctgcgcatgcgcgtggtggacatcaagcgcacctccaagggcacgcggtcggggggcctttaccgcttcggggccatggtggtggttggcaacggcgagggcgtgctgggctggggccagggcaaggccgccgagctgcagtctgccgtgaagaaggcgtacgcccgggcctgctcgtgagtgtttgagggatttggtggggtccatctgggcactttctgtgggggttggtgtttactagctggggagggctcaggagggctcaggggcgggggggggtagcatgcttcagactctgtgtgcaagggagctccatgccatacccatgcaacggccgacgacacagccgctccatccaactcactggcctgtaagcatcccatcaacaccccccacacctcccactcttgcgcaggaacctgttccccatcccgcggtacaatggccacaccatcccggagggcattgaggccaagtttggccaggtgaagctcgtagtgtaccccaagtctgccggcagcggcatcatcgcttcggagatgattggcggcatttgcaagatggcgggcatccacgacatcggggtcaaggtgcacggatcccgcaatcgccggaatgctggtgagcttgtgcattcatttgttgtggttgggtgggaggagggaacggtcgcttgatgggtatggggaacggtggtggagcttgaattggggcttgggactggaacacaaagtcttggcagcctgtctgcccctatggtggctgtgccatcttgggcagggcctaggtggtaacacccacagcccgctgagtgctgcagctgagtgcgtcccctctcttccctgcactttcacagtcaagtgcctgtttgaggcgtttgacaagatccgcagccacgacgagatcaccgggcaggcgggcaaggtggtcgtggcgaggccgccggggcggtttgcccatgcgcggcgcaagctgcactaggctctgcatggacgcctggactggccggtggatgacagggagcggtttctgatcaagctgattcccttctccctggcatggccagccggcaggctcaaccacccttgccatgcactttgcaggtgcctggattaaatgtaagcaatgaatcatgcgctaccgcgcagcaaaaggccattctagggaagtcacaggccgcttgaggagcctggcactccgtataaatgcctgggtgtagagtgcttcatggccctgctcaagccttggcacgctggcttcagagagcacttggacagccccgcctcgtcttcgattggcgcacagccacgctgcagtcctgcacataccatgcactgccctcccgcaccagctggttgcggccgtgtccctgcagccggcttgcgcagcaggtcctgcgctttgtgcgccccccactgcgcttaggcagccctgtgtcccgctcagggtgctgnnnnnnnnnncgcgcctcgtgcgctccccactgcgctcaggcagccctgtgtcccgctcagggtgctgccgcggagtcgtgcacaatctcgcggaccgcggagaagatgcccgcggcagacagggcgacggacaggggcaccagcgcgcggcagagccagcgctcggcgcggcccagcggcagcaggcggagtgcgaggagggcggggatgaggtagcccgcagccacgtcgcccacagccgccaccagtgcgatgaccagggagaagaaggggatgccggaggccagggcccagctggccaaaacgccgacgccgctgaccagggtccaggcgccccagccccgccagctgcgggcgggtgcacggtgcttggcgaccactgtcagtaccaggtgcgtcagcacgttgatgttaatcttcaaggttgggggggaaagggaggggggggtgaggggagcaatatgacagaggaaggcatcaaggccatggcgtcgcaggagctcaagaacacaacagctcgcgccgctggaactgggcggcagttcatgtcgtggttttgtnnnnnnnnnngaggccatggcgtcgcaggagcacgagaatacaacagctcgcgccgctggcactgggcggcagttcatgtcgtggttttgtnnnnnnnnnnaaatttccagggcaatgcaccttctccccactacaccgcctcacttgctgaggtcgtaggccnnnnnnnnnngcatttccagggcaaggcgcctcctccccaccacaccgcctcacttgctgaggtcgtaggccnnnnnnnnnnactaccaggcccagcaaccgcggtggtactctttcgtgcactccatcctagacaagacctccagcttctaaacccacctggtacgccacgaggcagtggatgagcagcatggcgttggtgagcaccgtccagccgtcctggggcagcaccgatgtgatgggcctgcgtgagcagaggggcatggtggttggcgtgggggactggtctgtgagggtggggaggaagctcacaaggcaactaccgaacggacttggaatggccgcccatctcnnnnnnnnnngaccccaggctccagtagcccgtacatcccaggaggaggtagaaggccgtcatggtcacggcccccacccgcgtgaccaggaggaagttggaccgcttgcgcatggtcgaggcataccgaaaccagttctggagggtgtttgcaggggatcggagatggacttgtacatcattttcaagtattccggcgccatccgagttcgaaatgcgctgtcgccaccagcacccccgacacagctctccgcactgacccgccatccggcatccaccaaaccacaccaagccaagtccttgcctgctggnnnnnnnnnnggaggcataccgaaaccagttctggagggtgattgcaggggatcggagatggactcgtacatcattctcaggtattccggcgccatccgagttcaaaatgcgctgtcgccaccagcacccccgacacagctctccgcggtgacccgccatccggcctccaccagaccacaccaagccaagtccttgcctgctggccaccgtaggcaaacacgacgtccagcagggctaccagtgccagtcgcggcgtggtggaggctgggggcagccagtgggtggccgccgccgcccgctccggcagcggctccaggagcagcttgcccagcgtgaccgccaccgcggccagcatggtcccggtgccgaccaccgacacccagcccacgtcctccatgctgcgcacctgggccaggggcagcatggccagggttacgaggaggcccggggacgggccggcgcggccccccatcagcacccccagcgcctcggcggaggtgagatggatgacggcgggggagaggaggatgagcgtgtagacggtgccaaacaccagccagcgcccgcgccgcccgtaggccgcgcccgccaggcggtggtagaccgagacgtcggggtgggcggcggccaggcgcgtgaagagggagccggagaagagcatggccaagcccagggccagcagcgcgacgccggccgccagccagcccaggtgggcgaagacggagggaatggccagggcgcccaagctgtggtggtgttgggggatggcgagagcgagggtggggcaggaggagactgcgggattggactgcagagagctgcccaggcatgcatgcgggtgagcgatgtggcaggcnnnnnnnnnnaagggtggggcaggaggagactcggggatttgactgcagagagctgcccatgcatgcatgcgggtgagcgatgtggcaggcnnnnnnnnnnaaaatgtttccaaccccctcgcacaccacacacccaaacatgtctgtgaggaggatgaaggtggtggccttccagccattgccggcggcgtcggcgctgtggtggctggtggtcctctccagggtgatgtcctccacccctgcataggcagtgcagtgcttgggagtgnnnnnnnnnntcatggggcaggcacggcagtatgcagcgcagaggacagctggtcacccagcgctgtgatcgatgggtgcgaaaccctatcactgctctgcaaaaaggaaaaggttcaaatcccctcgcactccacacacccaaacatgtctgtgaggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcgcatcgattcagagctctttacttgcaagttccagctctcaccatcgtccccgagatcaagggggaaggacttgggtccagagtgggcgtcaggcaccgtcgccagtaagggtgctgttggtgcttcggcgtctcccacctccgacatgactctcgctgcgtactttgaagtttttcggttgagagttatcgagcatctagtacccaaataatggcgcctacgtttcagcatgcatgcaaaagtacgactccgctcgcgcggtctcagggcgccaccccgacatcggtcaaccggcatcatcccaataactttcagcagctctccagaaccgtaatgaccacgggtctaggtctaactattgcaccataagcatcctgatctggtcctgacggtcagggagcctcatggattgctgcactcctcctgccctgccctgatatgtatcgttccaaaggatcaacatgcggtgccgagtgggcaggggacaggcgcaaggcaactcgctgacgacgcatggggcctcgaccgccagggcatgccagacgctgctcccagggcagcgccatgcaccgccacaaagctcttctgctcaactctgagaagggcttctgactccaactccctgcacgcccccctcccccacccggctttccagccccccctcgatccatcaagcagtgggcatggccgtgtcgccatcgccgtcctcnnnnnnnnnnggcaccataagcatcctgaactggtcctgacggtcagggtgcctcatggattgctgcactccccctgccctgccctgatatgtatcgttccgaaggatcaacatgcggtgctgagtgggcagggacaggcgcaaggcaactcgctaacgacgcatggggcctcgaccgccagggcannnnnnnnnncctgactccacccccctgcacgccccccgcccccggccggctttccagccccccctcgctccatcaagcagggggcatggccgtgtcgccatcgccgtcctcctcctgctccagcggcgcccctcgcgccgccacaaacctctccacactggggatcatggcggtgcaggggtcgccggcggccaccagctgggcgtgcagcgcccgcgcgtgcgcatgcaggacctccagcgcagagaactcgcgcttgccggactgcgccagcatcgcgcgcaccagagcagccgccagctcagcgcggtgctcatcggtcagcaggcggccgctggggctggatgccgggtctgcggtggtggtttttttgggggggggatgatcatcttgggaagggagaggttcctgttccgggtcttggcagtgttgnnnnnnnnnntgggtctgcggtggtggttttttggggggtggacgatcatcttgtgaagggacaggttcctgttccgggtcttggcagtgttgnnnnnnnnnnnnnnnnnnggggtgcccttcatccagtcagacccctcactacagttaccgcatcgccacccccccaccccacacctgtgtaggcgaagagcgcaaccacgtcctccagaagctcgtggtcctccgcggtgctggcggcggggtcgaccacagcgcgcccaaactccatggcctccacgtcccgccccgccccgatctgcaagtgcacggttgaaatgggttgttgttggggccagagggacgagaggggagggtgggcggatgaaaggggggcgtgtaccaggggaactcaggctaataccccacagcccgggccccctcccaacttgctgcctggctgacacatcttctttaccccnnnnnnnnnnagagaggggagggtgggcggataaaaggggggcgtgtactaggggatctcaggccaatacctcacagcccgggccccctcccaactcgctgcctggctgacacatcttctttaccccttgcaacgatgccacccccaacatccagctcacacacacattgacaaccactcctcaccagctccgccagcttctgcgccagcaggcggaagcggatgcccgggcgcgcggccagcacgccgggcccgagcgcctcgctttcctccagcgcggcgtcgacgtcgcccgcgcgcacgtgcgcggccaggcggcgcaggcccgcctgctccgcgcgctgtgcctccgacacggccacggcgccggccaggacgtcgcgggccaccaggctggcggtgtcccacaggccgtggtgggtgcagtagttgaacaccagccgccccaccacgttgccaggcgtctggtggaggggtggagggtggaaaagagagggggagttgtatcgggcgagggtgggaagatgagatgggaggggccaggagggagtacttttgagggacatgaagtatcgacaccagtatcgggatgacttcatttgcccccttgcacaaaggacgaatctcgactcctggcaggccagcgcttcgcgcatatccctgccatgaaccaaaggtctgtgccccaccaccaccctctctcaaaagcaccttgctgatcttgtccagggactggccccgaatctcatcatgtagccgggcgacggcttgcctgtggaagaggctcgcatcggcctggaagggnnnnnnnnnntttaaagcaccttgctgatcttgtccagggattggccccgaatctcgacgtgcagccgggcgacggcttgccggtggaagaggctcgcatcggcctggaagggctggcccccgaagtttgccaccacctgtgcattgggacaagtgatgaggttccttggaggagtgcgttccttcgcggatttgtcatgtcaagctgacactgcagcgtgctgccgggcctggtaagaggcagccacaatcctaatactatatgagacattcgtggctggcggacgaccacctcacacccttttcactcccgacatgccactctgcacctcacctcctcgtcaggggtgcggaagccgatggtggggtagagcacaggctccatgacatgctggaaagcgacgccgaggtcccgcccattcttggtgaaggagatggtcctctccactcggtcaaataggacgccaatcacatcgcctgcgcggcggagggatggggggatggcatggccttggtcagtgtggtaatgcaggaagggagaaagcacaccaacactgcgaacggccgagcagcactcgcctgtcgtgaaggtgggtccgtacttctgcccatacccgcgaccgttgaagatgttgccatcatcgccatggtagccgtaggaccgaggctcccatcctgaggggaacaataggattgttggtggaaaagcgggtgcagggtgatcctctgtcctgtgagctggcctaccagactgttcaggcaatccaccgcaagcacagatcatttgccctccagcgttggtgccacctccttcccatcgtatactgtcctaggattacccacctgggagcctttccaacttgacatccgcagccgacatgcccactccaatgaacccatctcgccccttgtctacgatttgggcctcccagtagtagaagggcagggacttgctgacgggatagttggatcggatggcagcagcgtctcggtcatcgttgccagtgcctatgtacttgaccctcagatcggtcacttgcaagaagcgggagttgctactccggcgattgctgtcccaagcgctgggcagggcgccctcgtttgcggccatactcccaggctgaagcgctggctacagctccatccaaaaccgatgtgtggcgcagatgtttccttggatcctgttccgccagtctcgactactgactgcgcgtcaataatgaggccggaagagcttccgcaagtggttccctggggtctccccgaaacagactctgatggaagctttgcaatctcggtgcactttcaagcaatactttatccttcgaacttgtcaagtcgggtgtttgcatgtatatcctatgcaccccctgacctcccaggtctcgtcgagaggccccgatgggaagccataggagaagcgcgcgcgcgacttttctgcatggcactctctgcggtgttggctaaagcgacattccacagcgacaagcgagcttcgatggaactttgccatcgtagactgttattctgatatannnnnnnnnnctccacagcgacaagcgagcttcaatggtagtttgccatcgtagactgttattctgatatagtagttatatcgaggatccttattctcgtcgcgaatcctctataacatattctggtgctgcagacgagcatatcgtacccccacgagatgcactgagactcgttgctgacgcacatatgaccaaactctgaagcatggaagaggactacattgtgcgcgagctggatgtggtggtgtgctccggctctctgggcacagacagccaggtgagatcaagcctgttggcgcatgaccggcctgcatgtcatagaagggtgtccgcgtcttcacgtggaccattgaagtcgacatcgacatcccaaaccacatgcagaccgtgctactgcagtacccgctgcgtggcgcctccaggccctaccagtccagcggtgtggaggccgtgcagtacaagcccaagaacaagaggctccaggtagtgaagggcaggcaccatgtgcactttgatgctctattggcagccaacctggttagggcattgtgacgctcctagaccctcttgtcagaagcatgcctcggcannnnnnnnnnttctattggcagccagcctggttagcgcattgtgacgctccaagaccctcttgtcagaagcatgcctcggcagttagtgtgccctggagtagcacaccttccgtccaataccccccaacttttccacatgtgcaccacagatggatgtgcgactggacacaacgatccccgagtacaacgacaatgtggagcccacacgcctgctgaaaaagctcaccctgcagtcctccagcgtggagtgcggcacctccctggcggcagcctttgttgagggcgacaggctgatactgctccccatcgacgaggtggggtgggatggtgaagcaggggttggtcatgccctggcagaggccaatgcaggcactttgtgtcgacgcaggcccagtaccgtctagaacagtgccccatgacgtcgagtggaccccatgcatgcggccccgccccatgatctcccaacccagtccgcccaagctgctcaaccccctccgccgcnnnnnnnnnnataccgtctagaacagtgccccatgacggcgagtggaccccatacatgcggccccgccccaggatctcccaacccagcccgcccaagctgctcaaccccctccgccgccactgcatcacatcccaaattcccagacaacccccgaaaacccacacacaggccatgcagctgcgcccctccatggcgcacctggacgcagagagggagggtgggaagaaagcggcgcccaaggaggaggagggccccgacgctggcgtcctgatgcccgtcatggtgcaagtgaagaagcgggagacagaggcccagctggaggcgcgtttgcgctcctttgcccacatcaccgcccaggaggccgccgaggagtgggtgggcctgcagtaccatgatgacatgtccgaggtgatttgggcatggccagtgggaggtgtgacgagtgcttcgtggagatgtggaacgaatgaggggccgccgttcatgagccctgggggtgtggcgggcatgctttcctctgcgccaggctgctgagaagagtggacttgcctgagatctctttctgttggctccctccggggtcagtccagagggcacagtgaggtccccactccgccagccggcagcccacgtcaagcatcccctggcctccaccacccagcccccctcaactcaaccccnnnnnnnnnntcggcagcccatgtcaagcatccccctggccaccaccacccagcccccctcaactcaaccccccctcctccttccccggtcaacagacctcccagggcatcgcccagaagctggccgccgccgacgcgcagccggcactgcaccccatgcgcgccggggactacctggcggcgctggtcccggaccccgaccgcgatggcgccggggtcgtgcaggagatgcccatgggcgccgccgccaccgccgcagctgcgcggccaacgggcgccgcgccgcgcgccgggccgtccgccgccgccccgtcggcgcacccctccggcccggagttcccgcccgcgcaggttgcgggcatgggccgcgcgctggggcccctgttccaccacagcccggtgtgcaacctgggcgccatccgcggttacctccagcgcagcacggccgagcctgggctggcggcggccgtggcggcggnnnnnnnnnnnnnnnnnnnnnnnnnnnnnnnnnnnnnnnnnnnnnnnnnnnnnnnnnntgcacgtgggtgtgctggccaccggcctggtcctggagatccggcgggcatacgtcctgcgcagcctgggctcgcccgcgctggacccgctgcgcgacctcctgctgggcctgctggcggggagggaggcgctgaagcgcggcgacatcatggaggcggcgcgcgcggcgggcatcccggtcaccgacggcctctactccaaggtggtgcgcgacatctgcgtgtcgcgcgggtccacctggagcctgaaagtcacgtgaggtggctgctgcatggtggtacgcttggtgtggcggccaggaactaccggctctgggggacacccacgaggaactgagagtgagcgagggccttcccctccgacagggcactcctgtgcctgctcgccgtagaccttcccaactccnnnnnnnnnntggctctggggaacacccacgaggaactgagagtgagcggggaccttcccctccgacagggcactcctatgcctgctcgccgtagaccttcccaactcctatcatcagtgcccccaaggatcgccggtttgcctgcccttctgacgcccttcacaagctgacgtaaaaagtcgaaagcgtcggtaaactcagaccagggagcatgacacacgacaagcttggcaagtactagcccgcatcaggccagggcctgcatgtcagccttggcggcacgcagggactccagctccgcctgcgctttggccaggcgctcgctgtccgcctccttgacctccgcgggcgtgcgctccttgtagctcagcagcgccatcttcttctccaacgcctcgatctgcgtgggaagcggggcaagggggtgagtacacgggctgatctgggatactcatcactcatcctggccacagacctcgcaggttacagccgatctgtcgcccgttgagatccctggggcccctgcttccccatccattcaccgacacacatcacccccccaaaccccacactcctcccctcaccctggcggccgcctccgcttccttcttggccagcttctccacctccttgcccgcgtccagaatccccgccagggacaggtagagcgtggtggcgtcgtccaccaccgccacgccgcagcccgcgggcggggcctcccccgccgacagcagtgcggccgaggctgagtcggtgagcgtggccagctcggtggctgaggccgcaagcagcgcgcgccgggccccgtcggcgcaggccacgtgcagcgccgggcgctcccgcgtcaagccgtagtcggcgcgcagggagcggcagcggttgaccaccgccagcaggtaggccatgtcggcctcggcgcgcgcatcgcgagcgtcgggcgaggcacgcgggtactcggccagcatgacggagggggtggggaggggcgcgccgccgcgcggcaggcgctgccacagctcctccgtcacgtagggcatgaaggggtgcagcaggcgcaggcccgtctccaggcacgtccacagcgtggtgcgtgtggctgccagctcagcgctgccctctgctgcctcagcgccgccctttgccagcacgggcttggacagctcgatgaagacgtcgcagaggtcgtactgccagaaggcgtagaccgcggtggtggcggcggcgaactcgtaggcattcagcgcgcggtccacctcggccgtggcggcgtccaggcgggacagcacccagcggcaggcaaagggcaggctggcgtgggagatggggccctccggcggcgcgtagtcctcgcccaggttgagcatggcgaagcggatggcgttccacagcttgttgcaccagtggcgatatgccaccacgcgtttgatgtccaggttcacgtcacggccctgcaaggggagggcgtgaggaggggtgtaggatgtgtgtgatcctgaagtccttgacaggcaggcaggtgtggcaagggctgcctacgcggccctggagcagggcgtccacagtgggtgtggatcattttgcatcgcatgccgtggactatggtgggtttgcctgcccccagagacacgagcatgctctgcttgccttgctcagacaccgtctctctcgcctcccatgaccatacctcaggctcacctgggaagagtatgcgaccagggcaaacctcagggcatcggtgccgcactcctcgatgccgtcggggaagttctggacctggccctcccgcgcgcgcgccacctcggcggcctccaggttgccgccctccagcgatgcgtgcaggtcctgcaggctgatgccctcgatcacgttcacggggtcaatcacattgcccagcgtcttggacatcttgcgcccctgggcgtccctcacgatggagtgcaggtacacgtccttgaacggcacctcgcctgcatcaggtgtagggaaggggaatagatgagtggccatgcccgagctgcgagtgcggcgcaggatgccatccattccatggcgaggcagatgaggggctgacctcactaccgtacccagctcacaagtagaggacgctcactatacctcaaaactccccccccccaaccctccctctccccccc

SEQ ID NO: 38033 - DNA, 85 bp, Chlorella protothecoides
ggggtctgacagcagtgactgcagggcggggaaagcggggggcggaagattcaagttgctgctgatctctaaggagcgaaaagtt

SEQ ID NO: 38034 - DNA, 76 bp, Chlorella protothecoides
tgaggggcctggagggagcgactagggtacaggctggctgccgagttggtgggagctggcacggtgccggtgtcgg

SEQ ID NO: 38035 - DNA, 61 bp, Chlorella protothecoides
caattgtgcgggttcccgtcaattcctttgcgtttcactcttgcgagcatactccccaggc

SEQ ID NO: 38036 - DNA, 993 bp, Chlorella protothecoides
  modified_base (88)..(97): a, c, t, g, unknown or other
gatgtcggtgccgtaggggatccactccgccggcgcaaaattcaccgcctaagatttgagggggagagggggtttgggatacccagtnnnnnnnnnnctcgccactcggccctcccgcccccccgccgtcttcccgctcgaccccaccgcccggcggcccgcgctcctcggcgcccgcccgcgcgggtgcagcagcgccccgcctggccccaccctggacgagcgccaccagcagcgagtcgtggctcagtgtgaggggcttgccgctctggcggtacttgtccaggatgtcggtgccgtaggggatccactccgctggcgcaaaattcaccgcctgaggttcgagggggagagggggtttgggatacccagtgtatggctgtgcatgcctctgctttggcactttcccccttgtctatccgggcatccaccaaactcactcctccacacccccagccactcacagacacccccctccccctagctaccccccacacacgcctccacacctctgcgcagttgaacccggcgttgaaccctgcgtggtaggagtccggcatggtgatcatgaactcgcccgggcgctggacaaaacggtagaccggcacgccgcgcgcgcggagctcggcgggcgacagcagcgtgaccagctggtagatgagccccggcgcggcggcgaacaggcccggcagtgcgtcgcgcatcgcgtcctccagcgcgcgcgtggcggagggcggcacggtgtaccacaccttctccgcgcccatgtggtggtagttgaccgagtacagtgcgtggtcctccacgtgccaggcgaaggcggagagggcggagccgacgtagagccagggcaccatcacgcccgtgatcagctcctcgcccagcgcatggcgcagcaccgacccgcgtccccgcggcatgttgttcacgttccacgccgcctccgcgtacgccgcggcggcggggcagtccggcggcgcggcggcggccgcc

SEQ ID NO: 38037 - DNA, 762 bp, Chlorella protothecoides
  modified_base (216)..(360): a, c, t, g, unknown or other
  modified_base (437)..(687): a, c, t, g, unknown or other
tgcgatgcagggaggtgcccaggtccgaggaggcgagcagcgctatgcgccgcctccagcgaggcatggccgccgctgcgacagtcgtcctttccacatactgtgtgtcaaagggggaaatgtgtcccgggggcgtggctcatcgatacacggctgattgccagcgtgttacaagcatcctcaggcccaggtccatgggcgggggcaaagcgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctactgcatttcatggcagcccctctgccagaaaaccgccacccgcctgggagccctggcctccatcaccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccctcaaacacacacactcgcaccgcgatagtaggccaggcctggtgatgccgggagtcggcgggcaggctg

SEQ ID NO: 38038 - DNA, 71 bp, Chlorella protothecoides
gctcgtcaggagtcagagagccggcggtccgacagctgcaggtcggcaccccacgcccgacctgcaggcct

SEQ ID NO: 38039 - DNA, 212 bp, Chlorella protothecoides
gcctgactttctgcagccccgccatatcaacgaggtgtggcccttgccacggccagcgctgactgcaatcaaaatatagacaacaataagtctcaaacgtggttttatggttgagtgtcaacagattatgcactcgcgcaacaggcttgttccccagacagggccttgcgattgtgcagagaccctgctgtgcgtgccttcccttgcacagc

SEQ ID NO: 38040 - DNA, 62 bp, Chlorella protothecoides
cgccgggcgcaggacgggggccggcgccgcacccccctgagcactcaattccaccgccaaac

SEQ ID NO: 38041 - DNA, 78 bp, Chlorella protothecoides
agcgcatactcgccctgggtcaacccttcccacccattcgcttccggtatctgccaccctgggctcgtgaactcgctg

SEQ ID NO: 38042 - DNA, 90 bp, Chlorella protothecoides
ctcacaagaccagctgcgagcaccacttcttcatcaagcagctgaagcgggagccagggaagtccctcatcttccaccacaccattccgt

SEQ ID NO: 38043 - DNA, 91 bp, Chlorella protothecoides
tgcttggcaaactgcgcccctgtgtctgactcccaacaccccacacaatcacacacccacaccggcaggtcggtgactttgggtcggcgcg

SEQ ID NO: 38044 - DNA, 61 bp, Chlorella protothecoides
ggggcccgtgctgacctggctgggccccgcacccgccctggcgggtacgggccaggtcaac

SEQ ID NO: 38045 - DNA, 85 bp, Chlorella protothecoides
tttcagcgtccttcgctcagccatcctccagcccactctccaaccccctctccaaccccccttgcccagcgcagattccctgcgg

SEQ ID NO: 38046 - DNA, 61 bp, Chlorella protothecoides
gtcgatggtcttctgaccctccaactgcccaaagatgtacccgatgaggacatcgtcttcg

SEQ ID NO: 38047 - DNA, 75 bp, Chlorella protothecoides
gatgaattctgtgctgtgcgtttcaacaagggttacactttcccgtaacagattgtcgatggcgtacaagaaggt

SEQ ID NO: 38048 - DNA, 61 bp, Chlorella protothecoides
atcggcaaaccacggggtttggggggggggagggaggggaagcaggcccccccaaaaagct

SEQ ID NO: 38049 - DNA, 74 bp, Chlorella protothecoides
ctctgccgccgcagggtgacggagacaccacacccgtttgtcatccagtgccccgccgagtaccacccgcagcc

SEQ ID NO: 38050 - DNA, 91 bp, Chlorella protothecoides
catgaccaccgtcctcatgacaagccctgatgcctcccaccaccccctggggccccctcctctcctcgtcagtggctcgcctggagcgagg

SEQ ID NO: 38051 - DNA, 69 bp, Chlorella protothecoides
caatgcagcatactccaccacactctcatcaccccctcccatgcaggtcttctccgcatgcgtcatgtc

SEQ ID NO: 38052 - DNA, 116 bp, Chlorella protothecoides
gggtagattctcggtggcaatgcagcgacagatgctcacgtgcgtaggaactctggcggaggatgggtccccgagctcacgcacacatgcaatctgaagagaagaggctcgctgca

SEQ ID NO: 38053 - DNA, 67 bp, Chlorella protothecoides
ggcgctgctggaggccaccgcggggccccgtgccgcacaccgcggcagccagggcgtgctggcccac

SEQ ID NO: 38054 - DNA, 61 bp, Chlorella protothecoides
cgcctgctgggtggactcaccccccttgcagccatcgaaactccaactctccttccgtcac

SEQ ID NO: 38055 - DNA, 67 bp, Chlorella protothecoides
cgacccgggccggaccaagatgttcaccgctgtggatgaacacgccaacgtgacatcctgctcttca

SEQ ID NO: 38056 - DNA, 61 bp, Chlorella protothecoides
cctagtttctgaggtatgcatatatttctcgcgaacatcaatcgtgcctccatccatccgc

SEQ ID NO: 38057 - DNA, 61 bp, Chlorella protothecoides
tgagcacgggcctgtccagtgtgaggcagggaagagagacaaagtgcacgcatggagggag

SEQ ID NO: 38058 - DNA, 61 bp, Chlorella protothecoides
ctggaccctggctcgcccaggagcggactcagtcccgcccagtagtcagggaacatgtctg

SEQ ID NO: 38059 - DNA, 73 bp, Chlorella protothecoides
aattgatgagcagatttgcgttcacctgcccgacatctctttgcgtgtgatgctgtgtaggacgcgtattaat

SEQ ID NO: 38060 - DNA, 80 bp, Chlorella protothecoides
tgcgcaagcggtgtctgagcgcctgggaggcggtgcggagctgccagcggcagcagggcaagccattgctgcgcccactc

SEQ ID NO: 38061 - DNA, 97 bp, Chlorella protothecoides
atgagaggaggggcggtatgagcctcatcgcatcaggcagtctgagaagtgccagtccaaggaaggcctccatgcgcgatggaattggtgcatgcac

SEQ ID NO: 38062 - DNA, 7924 bp, Chlorella protothecoides
  modified_base (730)..(777): a, c, t, g, unknown or other
  modified_base (3828)..(3837): a, c, t, g, unknown or other
  modified_base (5036)..(5045): a, c, t, g, unknown or other
  modified_base (5306)..(5315): a, c, t, g, unknown or other
  modified_base (6253)..(6262): a, c, t, g, unknown or other
  modified_base (6783)..(6792): a, c, t, g, unknown or other
  modified_base (6890)..(6899): a, c, t, g, unknown or other
  modified_base (7103)..(7112): a, c, t, g, unknown or other
  modified_base (7172)..(7181): a, c, t, g, unknown or other
  modified_base (7665)..(7674): a, c, t, g, unknown or other
cggcgcggcgcgagctgctggccgccgcgggcgagtggaaggacgccgcgcccgcgccgcgcctggccgccacgctgaaccttaacgtggacgtgctggccgacgccagcggcaccaccgccagcttcgacgaaggcggaagccgggcggggaccgcgctgtgcgcgctggccgcgcgcagcagcgcacgcgccgtcgtcctcctgcgccacggcaaggacctgagctccgagctccagtttgcgcccctcacgagccacaccgtgaagcactgcgtccggcccctggtggtttacgatgtcgaccgccacgcggcggccgcggcggctgcggcggccggcggcgccgcggccgacatcgagtccagcaacctcagcggcgccagcagtcagaaggcctccagcgtggcctcctgagcgcgctgtgcatggcgggccggctccggggccacatggagatcctgggctttgcgaggctaggtgaagcatcccactttccgcagaaagctctacccctgtttttttgtctcttttcctcctacttgcacaattttcctagcgatgaccaccccaggggagggccgtctccctttcctaccccctcccggagcagcatgcaccattggggccacgccgtcgtcgcagcgcactgaccaaacgcacgcgcactgttgattaggcattacattcggcagtacaaggggggggggggggggggggcgcgctggggnnnnnnnnnnnnnnnnnnnnnnnnnnnnnnnnnnnnnnnnnnnnnnnnttggggaggaggagggttgcaagatcctcaaaccagccagctgaaggaccgacttgaggcgtgccagtgggcgacggtggacgccctggtcggcaagtggggccgcagaggtggctcccgagaaacccccctcctcgcgtcgccgtcgacagatggatattccatcctcccttccccaacacacctccctcccgacaccacggtcccctcccaaccccatcactcccccgccatccactgcgcggcctggcgcgcgtagtaggtcaagatgaggtccgcgcccgcgcgcttgaggcaggtcagcgcctccagcaccgcctcgcgctcgtccagccagccgttgcgtgcggcggcggccagcatcgcgtactcccccgacacgtggtaggcggcgatgggcagcggggagttgtcgcgcagcaagcggatgacgtccaggtagggcatcccgggcttgaccatcatgatgtcggcgccctcagcctcgtcggccctggcctcccgcagcgcctcgcggtaattggccggatcctgctggtaggtgcgcttgtcggcggggatgacgcggcgcgaccccggcgccgccgccgcaggggccgaggccagagcgtcgcggaaggggccgtagaaggccgacgcgtacttggcggtgtaggccatgatggagacgtgggagtacccctcgcggtccagtgccgcgcggatggctcctacgcgcccgtccatcatgtcggagggcgacacgcagtccgcgcccgccgcggcctgaggacggggggttgtgggggaggcaggagtgagagaggggaaggtgcggtggggagtgggtgcctggttgcgggcaggtgcggagcactggcggagagaccagccggctcgctgcaaacagcccccgctcccagagcaagcctggcgtcattcggaagagagagtgatccccctcccgaaccactcccctgtgcctttccccgacctcctatctcccccccccccaaaaaagggcaggcacgcacctggctgacagcctggcggcacaggaactctacggtctcgtcgttcaggatgacgccgtcatcgcgcacgatgccatcgtggccgtctgagttgtaggggtccagcgccacgtcggtgaacacctccaggtcggggaacttgtccttgagcaggcggatgctgcgctggacgaggccgtccgggttgaagctctcttccccggtccgcgtcttcagatggtcgggggtctgcacgggaggaaagggtggggtgagtggaaagcttggagggggcaactacaggggtgtctctgcccaaggaaaggacccatgtcacaaccaaaagtccatttccccagcaggcataaggtagctggccagctgcacatcttccctgaattgccccaccattcgcgaccatgcgatgcgctgtggcgcattcaatctccacccacccacccacccactcgcccgctgaccttgggaaacaagaccacggagttgacgccgtaggagcgggcccgggtgacctcctccagcaggcccgacttccagcccaggcgggagacgccaggcatggagtcgatggggatgttggcctcgccgtcatggatgaagacggggaggatgaggttgtcgggacgcaggacggtctctgagaaggcgcggcggatgctgggcgagcgccggttgcggcgggggcgcgagggtaggtccagggtgggcacgaccggggtgccctctgggacgctagcctgtttaggtgggggaaggtggctgggattcgaggttgcatttgagggaatcgcgcagcacaagaaggcactcatgtcatactgactacagcttaatgacacactctccagcacatccagcgcccatttggaagtttctcgtgattctataggcgagacccaagttttgagtatttttaatgcatccgcaacaaggccaccaccatacaacagtcctctggcacgtgcctttggcgggggagggggggccgaccactccacctctgcgatggcacgtgtgggagccctcaagctcgtatgctttcttgactggaccactggcagcctacggcatgtgccatgcaagcctgtgacattgggtgccagtcccagggacatgttgtcgaacgatggcaaggttgctggagcaagtgtcgggttatgcaagtacgctaagcaggtcccaggcgcgtgcgagctcgaaatacagcaaaccaatgtatattttcctgatattggttggatgccagacgactaccccttcaatctcctgatagcgcccgcgactcctgcaacatgccccgcctggatccgatctggatacgggtcgcgtaccatgacaaactctggagaggtactacaccgcccggggtgggaatgacctccgagaatcgcgcctgggcaagtactgcaagtgattgaagctgttttctcaagttgctcagctccgtctaatcattcaaggtggtctttctgcgcactgcaaaggatcactttctgtcggacacctttgtcagcccatcacctgcaggtcttcccattgggactgagcccgatatgatgctggcgcgctgtctgcgcgcccttcaggcatcaggcacggcattcgttccctcgttggcgagggctttggcatcacaggtcaacacctgcgctgtggcctcgtctgcggtcccccagtggacgcccctgggccccggctttgcagcggggcttgcgccacgggaggtagttccccaccctagaccacagcagtgtcaaccaacgcatctgctggacttcagacatgtcatcctgatgcagcccgtgcctatgctggacctgtggcctgacgaagaagtagcaggtgggttggagtctgctgtcgtgatggactcgaggctttcacctgggagtcaatgcatagacacacgccggggggtcctgtgctggtgcatgtccttaaaattggcaaacgaggcactgcacttcctgggcttctgttgccatcccaaactcagcctcgctccccttccccttcctccacttgccatgtttgcacagannnnnnnnnnatgacaaacgaggcactgcactgcctgggcttctgttgccgtcccaaactcagccccgctcacctttcccttcctccacttgccatgtttgcacagagcccagcaccgccccaacacccctgtcctgcatcaagcgaacgtaccagcccagcgtcatcatcaggaagcggcggcatggctggagggcgcgtcacgccacccgctctggccagaacgtcgtcgcccgccggcggctgaagggccgctggaggctcacggcctaaaggggcgcattgctcccacacaagcgtggacttgggattgagtggcgacgtggtgatgccgacgcgtggatgtaccacctcgccagaggcccacgacggtgtacaccctggctgcgccatgcatatccctcgcagcgtgtgggctgttatcctatggcgaagcgccctgatgggtgcaccctgtctcccaccctccctcgtgtgtaacgcagctcaggagatgattccagtcctcccaccagtcgtcttcccggcgcatacctccacatcagtgcgtctggtacagccagtgcggtgcccatcgttgcccccctccctgctacaaacggcacggctcccagtacaacagcccaggcaaagtcgacgctcatcgccggccgcggccgcgtccccgtccccgcatgccgctgccgccgcggccgccgccgcccgctgcggccgccgcgtcaggggcctcggaccttgggttccggatggtctcgtccaccgacagcacgaggcaggcggcctctgccgccgacgcgatggcgttgatcttgaccagcgctggctcccagacaaaggcggcgtgcgtgtcggtcacaccccccgtgttcacgtccagcccgatgcgcgcgccggcgccgtccttggccgcgtgcttctggcgcagtttgttcagcacgtcggtggcgtcgaagccggagttgtccgccagctggcgcgggatgacctccagtgcgcgcgcaaaggcgttgatgaacagctgcgccttgccggggatggcacgggcgtggtccctgcagagggtgtgggtagattgagacccagaagggtggggcacacaggggcacgctggctgctcgggattgagaagcacactgtgtggcaggagcacagcgaatcacaggcggttgagcggggcgagttgaggtcaggcgctcctcacccgccacnnnnnnnnnngttgagacccagaagggtggggcacacagggacacgctggctgctcgggatggagaagcccactgtgtggcaggagcacagcgagccacaggcggttgagcggggccagttgaggtcaggcgctcctcacccgccacccttgtcagacccagtgatccccgccctctggagactcgggtcctggcaccggtgcacccgcaaccccgccagcagatgccgcatcacacggtgtcgaggcaattccacgaagtgcctgcgccnnnnnnnnnngggcaccgatgcacccgcgaccccgccagcagatgccgcatcacacggcgtcgaggcaattccacgaagtgcctgcgcctcctccccaacccccacacccttacctgaggtgcttggagacctccatgtcgatggcgcccccgccggggacaatgagggggctcttcagcgtccgccgcacgatcatgatggcgtcgtgcagggagcgatccgcctcgtccaggaactggtccgacccgccacgcagcatgatggtggcagtctgggcgcgggggcagcctgcggcagcaagggtgggcagggagggtggcatggtgccccgtgaagctgcacgtcgcggggctgacaagagcaagggtttggtgcatgatgcgcatgcagcaagcctgccctccagagccccatccgcccgcctgaccctcgctcagggccgcaccacccactcttgcacacccttgaagatgttgtatcgctcggcgccgatctggcgctcctcgaaacgggcgcaggtgcccagcgcgcgctcggcatccagcgagttcaccgtggtctgcacggcagcgcccgtcgcttcagccacccgctgcaggtcctcctcgggcacctgcgagggggagggtgtgaaggggaggtaagcagccggagttagcgcggggggtggggggggtgggggttgttccaaacgtgctgaggcatgggtccgacggcaacgcaagggcatgccaggatggccagacaaagaggcatctgtccctgagagatcaacatccatctacttggggggagatgggttgtatgagacccgcgggccctcctcacatcacagggaaacctcccgttgggcctccatgtcaaaaggatagccctgcaccccttcccaagtgttcaagcacaccaatcccctcttgccatccccaagccagccacagtcgttgagnnnnnnnnnntaagttcaaacacaccaatcccctctcgccatccccaagccagccacagtcgttgaggatatgtgaaaccgctcacccgcccagcgcagaagatgtcgcggtccgcaaagtactgtgtggccaggtcgcccacggcaaggcgggacagcacgatcttggccccgctttgtgcgcacttgtccagcttgtcgtagatgatgttccactccgcgtccacaatggactggtactgggtggggtcgtccagccgcacctcagcattctccttctccgacttcagctccagctcgatgttaagcagcaggattttggggtcctgggtgattgaaagggagggagggtgggagggagcaaagggggatggtcagcatggagggcatgcctcaggatgcgagagtccaggaggacacgtgaccagacacatacttcaaaagggatcgaggcatccacgactgtatggaatcagcccccacctcgtcaggcatctgctgtccgcccccccccccccccccccccccccnnnnnnnnnncatgtgtgggtgtgggtaggtggtggggaagggggttggatgagggagaaaggggtggactgagctgttggatgactatggccaggcctcgtggtgannnnnnnnnnggctcacatggtagctcttaggctgcatctcaaacccggcgtaggagaaggtcttcttgaaggccaccccatccaccaagaaggagtccttcagcgcaccaccctgtatgtgtgggtgggggtgggtggtggggaagggggttggatgagggaggaaggggcggactaagctattggatgactatggccaggcctcgtggtgannnnnnnnnngccctgcccttccccccaaaccatgtgcctgcatcgaaacccacctgcactttcttgatnnnnnnnnnntctggcttctcaccggctcctgagttccttcccctcctcctcccattgcaacgcaagtctggcccatcaaggaggaccatgcccatgcctctttcctgctgcaacaaacctgccacacacaccctaaccctcccctcccccccaaaccatgtgcatgcatcgaaacccacctgcactttcttgatgcccagcatgcgcaggtccaggagggcggggtccaggctgcccaccgcgtcgaccaccatgcgcgcgaagaagtcgcgctcgccgctgaccagcttgctgttcaggctcgtctgcgcgcacttctccagcagctcgttccgctcctgctccccccgccccgccgcgatgtcggtggccagctcccgcacgcgcgccaccgccagctcagcggcctgtcggtaggcgcgcatgatgaggcgcgggtgcacgccctcctccacgaaggagcgcgcctcgcgcaggaactcggcggccaggnnnnnnnnnnccggtaggcgcgcatgatgaggcgtgggtgcacaccctcctccacgaaggaccgcgcctcgcgcaggaactcggcggccaggagcaccacggtggtggtgccgtcgcccacctccgcgtcctgggacagcgagatgtccaccagggtctttgcagccgggtgcactatgtccagggtcttcatgatggtggcgccgtcgttggagatggtcactccgccctgttgggggggggggggggggggggggggg

SEQ ID NO: 38063 - DNA, 88 bp, Chlorella protothecoides
gggcgctcgaaaccagggtctgagcaggattaggaaggggatcgcggctccctaggcgccgctgtggctgacaggcgtggtgacccag

SEQ ID NO: 38064 - DNA, 75 bp, Chlorella protothecoides
gcgacaccccgcacccgagacatgacagtcacccccgacaggcaaaacaaccacccttgcctgaatgaaggccgc

SEQ ID NO: 38065 - DNA, 61 bp, Chlorella protothecoides
cgggtgcagctcaggaacattcagtgctcgttggcaccttggctagacatccttggcaacg

SEQ ID NO: 38066 - DNA, 80 bp, Chlorella protothecoides
ggtcgaggtgggggagcagatgggcgaggtggggggagcaggtgtgagaccatcaagcatcagcatcacatccaccgtca

SEQ ID NO: 38067 - DNA, 64 bp, Chlorella protothecoides
gagcggtcaggaggcggcgagcagtcaggaggcagcgagcagtcaggaggcggcgagcagtcag

SEQ ID NO: 38068 - DNA, 78 bp, Chlorella protothecoides
gtgaagtgcgcctgcagacatggggaggagaacacaccatgaacagaggacacggggagggtacgggagcccgcaata

SEQ ID NO: 38069 - DNA, 61 bp, Chlorella protothecoides
cgcctgactcccaaggtcgccccttccgggcgcccaaaccctcctaaaacgccctccaacc

SEQ ID NO: 38070 - DNA, 1331 bp, Chlorella protothecoides
  modified_base (249)..(313): a, c, t, g, unknown or other
cccgccgccgccgcctgggcgcggctcaaggccgccgcgctggcgcccgcgccggacgcgctggccgccgccctgcgtgccgacctgggcctccagctctggacggggcacgtgacggcggtgcaggaaagcctgcgctccgcgctcgcagccccagtggaggattcgggtggggccgcggcgcggggcggggatgcggggcgggaagcctcgcaccgccagctccaggctgggttcatcgtgcagtannnnnnnnnnnnnnnnnnnnnnnnnnnnnnnnnnnnnnnnnnnnnnnnnnnnnnnnnnnnnnnnntggtcgtgctgggtggccgacgccgcgacctacgtcctgcgctgcgccgcgctgtgggcacggcgccgcagcgccgcgcccgacgcccccctccacggcggcaccaaggccgtggcggagctgggcgcgcgcgcgggggcgggcgggccttggccgccgggatgggcggcgctggtggaggcccacccagactgcgtgccggggatgcgctgcctggccgacacccacttcatcaagcgcctgtccacctgcctctccacggccgtggcggtgaggggggtggtgggctctcctgtgtttatgtggtgccgctgggaggctgcagggtctaggtttgaggggatgggcggggctgagatgtgacgagagcagggcgccatgccctgaatatgctgcgtcacccaccgggcacatggaggaacccacgcgggtatctgaatccccttctgttaaacccttccctccccacatcacacacagtacgcgcgccagatgcagaagatggtggacggcgggcgctcgaatcactccgagttcctggtcaagtccatggcccgcctgaacgtcatctacaagcccatggcaagcatacgtgagtggcgtcttcctatttctgggatgggggggtggggggtgggggtgggggtgcttgaaacgtgagtccaaggatgggctgagcatggtctgtgggcatcgtggaagtcctgagccggccaaggcagccacgcctgttgtgttgagcaaggtcgcgcgacaccctgtgcgctgcacgacagatctccagcgaccccgaggtctcaggccccacatgccagccccattactcatccttacgtaacccagtgcgcgccatcgccgaggacgccaagcagcgcgaggcggcgggcggggagggcggcgccccgccgccggacccggcctcgccggaagtcgtggcggcggccgtggccggcatgggcggcccctggcgcctgcactaccccggcgccgcggcgggcatgggctggcgccggcttga

SEQ ID NO: 38071 - DNA, 66 bp, Chlorella protothecoides
tgcgggcgtgggggtgggaggggacaggtcaacaagggggggggtgccttgtcagaggtatggctg

SEQ ID NO: 38072 - DNA, 67 bp, Chlorella protothecoides
ccagggcttccctgcctgcagcgcctccgttgcccgctggaaggcgagcacgcgatcgtactccgcg

SEQ ID NO: 38073 - DNA, 77 bp, Chlorella protothecoides
gcccaaggccagccacctcctcctcctccagtccattccctcagttgagggtccagcctcagatgaggtccagcagg

SEQ ID NO: 38074 - DNA, 159 bp, Chlorella protothecoides
tcgaagagaactccccgatatcgatgtgtgtaatgcttgggagctttgagggtgctcgtctttttgcagcagctgtgcacgagtatgaatcccagagcagagtgctagagacgccactgcccccataaatgccttgagtagcgtttctagtgggaagga

SEQ ID NO: 38075 - DNA, 71 bp, Chlorella protothecoides
cgaggatcatgagacgcccatgcaggtgggtgcacggcggtggtccatacctcgtttgcgaggcaatgggt

SEQ ID NO: 38076 - DNA, 61 bp, Chlorella protothecoides
ccaccttcccatcggtcatgcaaatgtagagtttatttcagcgggacccttcccccccccc

SEQ ID NO: 38077 - DNA, 63 bp, Chlorella protothecoides
cccgcagagcctccatgcacaccagcgcagccgtctcacctgccaagctcccacctccaatac

SEQ ID NO: 38078 - DNA, 74 bp, Chlorella protothecoides
ggcagcagctagattgtgaggcagcgcgcccgaggatcctcccatcaccctagtgccgaccgccgccagccacc

SEQ ID NO: 38079 - DNA, 76 bp, Chlorella protothecoides
ggaaaccctcagatcatgctccgcctcaccggtccttgcgatccttgtggtgctgactctgaactttgtaaagatg

SEQ ID NO: 38080 - DNA, 8686 bp, Chlorella protothecoides
  modified_base (541)..(550): a, c, t, g, unknown or other
gtggccgccccgcggagcgcgccccccgccgaggcctcgccgcccggcgcctcggggtcctcctccgcgatgtcggccagctggccggcgcccaggtactccgacaggctgctatgcatgctgagcacgctggcctcgctcaccgcctccgccccacccgccgaggtggtgcgcgacaggggcgccgatgcgggcccgccgcgatcgccgcccagcgacccctcgccctgcatcagcgacaggcgcaggctgggatccagcggcgccccggccatcgccatcagcgcggcctgggtgcgaggggggaggggggggagcgggggacgtcgaggtcggcaggtccgactagggatcgtgagggggcctgcgccgccgcgggcgcggggcgcctcgccaacgcaggactcgggagagccccggctcagacagcgcccggaccttccgagctcgcacggcactcttcccctcccaccagacacggcactctcctcctcacgcaacccccctccccccctcctccccccccacaacacacacacannnnnnnnnngacgcaggactcgggagagtcccggctcagacagcgcccggaccatccgagctcgcacggcactgttcccctcccaccagacacggcactctccccctcacgcaaccccccttcgcccctcctccccccccacaacacacacacacctccgacttggcgccggtgaccccctgcgcggcgcgcaccgactcgaagaaggggtgcttgagcagcgcgcgcgcgcggggccgtgcgtcgcgcggcagcaggcacaggttgatcagcgcggagagggggcccgggggcaccttctgcagacccgcgggccgcacgcccagcgacaccttgcggtagatctgggccgcgttcttgcactccgcataggggtactccagcgtgctcagctccagcaggcacatgccgaaggagtagacgtccacgcggtcgtcgtactcctcctcgtacagctcgggggccatgaactctggcgtgcccagcaccgactggggcgcggtgcgggagcggagcagcgtggccaggcccaggtcgccgatcttgaccacgccgtcggagccgttgatgaagatgttgtcgcacttgaggtcgcggtggatgatgggcgggttgtggccgtgcaggtagaccaggccgcacaggatctgccaggcccagcccttgagcacctcggggtcggtgtggcggtgccggcgccggtactggcgcagcgtgccgctggtgaacagctcggtgatgaagttgatggtgccggcgcgggggtcgtaccacgaatcgctgaaggacatgatgttcttgtgcttcagcgccttgagcacgcgcacctcggcgaagatgcgctcccgttcctcccggttctccgcgtccttgttgttcatgaactccatgccgcggacctggttccaggccagctcgatgcctgcatttgtggtaatttttttttttggggggggggggggagagggggatggaaccctttgtgctgccccggggatctgggcatgcggagcacagggcacgccggcgagcgcactccatgatcgccgccgtcccagccccctccacgcgcccctcccccattgctcaccctcctgggtgtcaaaggccttgtacaccaccttgcaggccccgcgccccaggacctgatcgaactgcggtatgcagagggggcggcaggcctggggtcctgcgcgtggagtatgcatccccacccagggaaccctgccctcatcgggacacccccttcccatcccccgcatttaaagtgggacagcccatgccctgcgcccagcctccgcccccctggaccactcaccctgccatatctaccgctggggtccatctccgcgaacgttgggccgtcgtagtcgctgtcggggggctccaccccggactgggccacatctccggaggcagggtgctccgtgaggctgccctccgccatgacgccaggcctccgcggagaggccgtgaggataccgatcacgctattccgcgcaagcgagggcgacatgcgcgggctgggatagggtgtaacagtctgggcagaacgccatgacgctcctggtaggggaccggccgcgggctcgcgctgggattccaaagggttcctctaatggaagatatgctctttggcaagcagcgggacccagaaggcactgtcgctgaacgcgccgggtgacggaaacgtagttacccgtcaactccaacagcgctcccaagattctgccccggctagaggggactccaatcccgttcaagtctcatccaagaattgccacaagccgtcagctctggccgattcgctacctgtgcgggcacaagtccgggacccaccagcaggtaggggttcgctccttgccaaaacggtaaggcggccccgggacgaacgctgggccccgggggacagatcgcgtctgcggttcgggcgccgaggggggcgtggaggcaccttaacattcacaattttgccccaaatccgccggaagcatctgttgagaaccttaagagcttgaaattgctcacagaaggagtcagctgctccgagaatccagtcaggctggtctgacgctcgccctggttcccctgcgatgacagtgctgggtggcctggcgagcctcctcgggcgcgggaggcgggtcacgcggactggattcacgcagctcacgtcaaagaatggacctcgtaatttctataagggaaagggctgtcttccgacggggcagcataccaagaaaggtgtgaccccgtcaggagggggtcgttgggggtggtgagggatgcatctcagagacgtattgtatagaagcagacacgacggtagcaacatctcaagttccccatgccaacaggcggatacgtccagcaagcatggcggatgcctgagattctggtcccagacctcagcaagttcaatgtaggtgatccgggcggggaggctcgacggtgcagtcaagggacccctcacacattcgaatggctttaccagatatggcaggcagcatctaacacctggtgtcctccactccctgctcccacccctgtgcagctgaagccctacgtagcggtgtctatctcacccgtttccaagtagcccttctcatctaaatatcggccctgcctcagcttgagtgactgccgagccgcttctcctctctacatgaacaccttttcataccgaaatgaattgcttgaattgacgtgtctgtggagtgtttgcgtggtgtaaaacctgacagagttggaagagggttgtacagggggagacatgagattgcagaggtagcaggcttgatgctcacatttaaggcacacatctgggatgcactgcattcaaaccacctcgagcacgcaaggttagagtgtgggttcgattaccattctgtgccttaacatcctgcattgacccagtgatgtgtctacgaaagccgcgtgtccctgtcacgcatggacaccctgcaagttgggctctccatgcatttaccgctgcatgatcctcgacccatactccaggctatggctatgggctaatttagatatgacctcgagcgcaggaccccctgctcgactgctggagtgatctcccaaccctgcgcaagactcgccgcgactgccatcggcgtagtggccggactagacccttcattcctggtctagactccctatcacaaacccctcgatgctgcgctgggctgccgctcgcggctggctcttggcccgagcccagcccagcgccgagtgtgcctggcgggccttctccacccctgccgcccctgcagcggcggcagcgacgggggcgcacgccgccatcccccgccccgcccccaccctgtcccggcgggtgcgccagctcatgcgggagtaccgccagctgtccaaggcccggctcagcgcgctggtggtggccacctctggcgcggggtatgtgggcgccagcggcgccgccgtcgactggcccggcctgggctggacggtggcggggaccgcgctgtgcgcggcctcggccaacgccctgaaccaggtgtacgaggtggccaccgatcgcctcatgcgccgcaccgcggcgcggccgctgccctcggggcgcatgggccgaggccacgccctggcctttgccgccgccaccggcctggccggcgtgggcttgctggccgccaagaccaacggcctgaccgccgggctgggcgcgggcaacatcgtgctgtacgccggggtctacacgccactcaaagtcgtgtcggtggccaacacctgggtcggtgcggcagtcggggcggtccctccgctcatgggctgggcggcggcgtccgggggtttggacgtgggagccgccatcctggccctcggcctctacttctggcagctcccccacttcatggccatcgcctggctctccaggtgtgtttgaggggagagggggggggcgacacctttgaaggagggatgtgactatggggtagggtgcgctggaggctggcccctggtctcggagggcggcgatcaggacctaggaggcatggctttggaggggagcagcgctggcgcggcgccttttctctgatccacctcacctacccctatgcatcgtcccccggcccgctgcatccgcaagtgacacaggcacaccccacacatcaccatccaaccccttccaatctcaacacccccaaacatgccagggcggactacgcggcagggggccaccgcatgctgtccttgctggacccgacagggaagcgagtcgcggcctgcgccctgcgcaactgcttctacctcttccccctgggcatcctggcggcctggctgggcgtcacctccccctactttgcctacgagtcgggtgggtatttgggaagggaggagggcgggggaggcgagacgtgctgtgtcctacatcatggcagtctgagcaggggaaagggagtccgggcgcaggttacaagtgccgttcatgtcatcccccctagcaaagagctcgctggaacacctccgcagagtccttccgctcgtcaccgttcctcaacctcctacatacactctcacaaacctcacagccttcgtgacggcgggcatgacgctgtgcgccgccaagttcacgtcctcccccaccaccgccaacgcgcggctcctgctgcgagcctccctgctccaccttcccatcttcatgggtgccttcctgctccaccgccagcccaacaccagccaagatcgtccgggcctgctctgggaccaggccacacggctgggactggccagggcacgcacggagggcgagggcggggccagcacagcgtgggctggtgagcgggggttggctggtgattgctgggctggggcggctggggcgcatgggaaggggccgtggagaccaagccgagattttgcgtgccgtcgtgccgcactgagcccgtccatcgccgccgcccatgttacccccacccacactaccctcgcccaggctcgacggcgccgagggccagcctcttcggctggcgcatggatgaggagggcgtggccccgcccgtgtcgctgatggtggccccgcggatcgggggcttgccgtcccttaggtgcccctccgtggccctcgcccaggggaccgggagcgaagaccgggcaggggacgacaaggagaagctgcgatagccctgggcgctttggtggccgacccctcatccatgtgctccccacactcctctctaccccaattactccttgaagaattccccacttgaatgcctggcccgcagagtaattgtgtacaacatgatatcgaggacaggagtgttggcacctgggatgctcgggtgctcgtcctgatgacgctgcattgtgccatggacaagagccccggggcagcgccgcactcggcaaagcccacaccgacccaccgtacaaacaccccacaccagcccctcaaatgaggggcagctgcatggtgcccagcttgtctgccagggccacatgcgcgcgtatgaggttagaaaagtagagggtcagcagcacgtcgttctggctgctggacagcgcctcctcaaattcatgggccgggaagcgcggcaccgctgccacggcgtccgccagcgcccgaccgacagccacgttaccgggcgtcttgcccgcctgcgggtcgaagaggagggtgaaggactcggtgcgtgaatggagtgcagacgggtgcggtgtggaggaatgtcagtagaagtagcgaggaacgctgactggagcggtgcgcagcgctgaagctgcgccatgtcttccaatggcccaaggcttacgtgtgggtgctgtggccagcgcctgcatgcatccgtctccctttccccacccctgaaacacgcaaacaactggtcccccattccaccacccaccacgacggcgtcgacgtaggcggcagcggtggagagcgcggcgcgcaggcggtgcagcgcctccaccacctcctcctcctcctcctgggcccccagcctcgtctcctccgtggccagcaggtcggtgcccagctgctccaggtcggtggaggtgatgcggcaggccacctcttggaactctcgcgccagctcgcggccctggatggaaagcgcgcgcgaggcgtgcgcacgcacggccagcgcgccgtcgcggaggctggtgtccacggtgagcagcgccgggctggcgcactcgttggcgtagaaggactggatgagggcgtcggagccggacacctcggcgtgggtggagaaccagcccacgatctgctcgcgcgggttgaccttctgctgcagcgccgccatggtctggtggtgctggacgtcaagcgccacctgtggcagggaagaaggggggtgggggtgtcatgaggccacgagaaggtgtcactgagatgaaacgaggtatttactgcaaaaatttggatgaaaagggtgaggaagatgatcctcatccgtggatgggggctgaaatgcccggcagtgccagccggtacctgtgcccaccaatggtctcacccacctcaacaccgatcccaaaacatccaagcatcctcacaccgcacctggtcgttgttctcgctgtggggtacggcgtagcagctccgcacgtcaatgatgccgtcagacaccgtgcccagcagggtgccgatcacgcgcttctgtccttggttgcgccgaatgtaggcatcgcagattgtgaacaggaccacggggtgcacctgcacggtggactcggtgaagcccagcgggagcgtcaagggcgccaccatgacaccctgatcccctgtgacggcagcagctgcgagcggagttgcgcgacgctaattcgattggctctacacgcaagccttcttgtttccacacacggcatatggtatgggcatggcccattcgacggtgcaggagggtccgggagagtggctcactccgcgcctcggcaattcacgagcggagcattctgcagtacctccaggcggctgcgtggcggggtacgcgctggagtgaaccgattccctatcactcaggtgtctacatgaagcacagcactgcgagcctgaaggtgctcggggctggagactcgtagcagggagctccacgctgtgcgtgggtgctccgggtcatgctgtgctgacgccaagctgagatgaccggctcatgcaggtccgcatggcggcctgccagacttattctgactgggagtggccttcaggccagccccagatcctgagcggatggcgatggtgcgactccgcccttctcgcttcccgccggctgcttggcgtcggcctgcgccgcctcctcgctcccaacatacccggcaaggactgtgacggcgccgatccattgccgcagcatggtggcgaagaagagggccatgatggggagggtcttggggagctggccgccactgcaaagggtggtaatgttggaatgtggtcgttgatatcggtgtgaggtgtgagatgcggccgtgaggtggggcctgaaccatagggatgtccggggggtatggaattcttctcgctgatgcaagagataactttcacatcagacatccagtgcacccaatccagcatcgaccaggagataccaaacattcatgaaaggccatcctgcagccctccccctctcacctgaggagcagcagcgtttgttggagcaggctgctcgccgacttcccggactgggcccccaccacatcgatggctgccttgcctgtgcatagaggtggagcgtttgctgtgaaacttgccagccatgagccatgtctgcccggctctgccgtaaggagattgggaagagcggccgtctggggctcctgcaccgccgtggcacgtggttgccaagcagacgggaggctccctgacagcaggggggacccatggctgccctcgtcacctttgctgcgcgactcgtcgtccagcccgatgtacaccatctcctccgcgggcttgaacagcgagaacttggcccccttgacgagcacctggagcagggctcccagcatgaccagcgtcttcagggccatcggcccattcagggtgcctgcttggggaatgcggggtgtgcagggtttgctttggggagaaagcacggagaccagcctcccacaaaacattaaacacacccccgactccccacggccacctcgccaccccttctgcccccg

SEQ ID NO: 38081 - DNA, 108 bp, Chlorella protothecoides
gaggttgagaggggcgagcggtcctgtggagtaagggtacttcgcaagaagccgagggggctgagcgtgacggctgccgttcgcggctgcgatgaccatgcagttccc

SEQ ID NO: 38082 - DNA, 98 bp, Chlorella protothecoides
tgggcggagccctgaggcagcatgggatgacgcaccctcctttcagcatcgcattccccctgactccagacaccccgcccaacctctcacctgatgag

SEQ ID NO: 38083 - DNA, 61 bp, Chlorella protothecoides
gctgctggaggttgtccttcgagtttggggacccgaccctgccgctggaccaccggtgtcg

SEQ ID NO: 38084 - DNA, 9287 bp, Chlorella protothecoides
  modified_base (622)..(631): a, c, t, g, unknown or other
  modified_base (1067)..(1136): a, c, t, g, unknown or other
  modified_base (1557)..(1629): a, c, t, g, unknown or other
  modified_base (2145)..(2227): a, c, t, g, unknown or other
  modified_base (2354)..(2486): a, c, t, g, unknown or other
  modified_base (3077)..(3086): a, c, t, g, unknown or other
  modified_base (3482)..(3491): a, c, t, g, unknown or other
  modified_base (3953)..(3962): a, c, t, g, unknown or other
  modified_base (5847)..(5856): a, c, t, g, unknown or other
  modified_base (6231)..(6240): a, c, t, g, unknown or other
  modified_base (6540)..(6549): a, c, t, g, unknown or other
  modified_base (7896)..(7905): a, c, t, g, unknown or other
  modified_base (8326)..(8335): a, c, t, g, unknown or other
  modified_base (8822)..(8831): a, c, t, g, unknown or other
ggggtcggcggccgacggcgcgcgcgaggcggagcgctggcgccgcgctttcctgcgcgccgccgcgctcaccgcgcccgtcttcgccgtggccatggtcctgccccacctggcctgcatggcctggctgtatcaaactcaactggcgggcttccccgcggaccaggtgctcaagtgggcgctggccacgccggtgcagtttggctgcggcgcgcggttccacgtgggagccctgcgcgcactggcgcgtcgcgccgccaacatggacgtgctggtgtcgctgggcaccaacgcggcctacttctactccctgctctccatcctgcaccaccacgccgcctcccaccaccagaccctggcctacaagcccaccgactttttcgagaccgccgccatgctcatcaccctggtgctctttggcaagtacctggaggcgggggccaaggcgcagacgggcgcggccctggccgcgctgtgcgcgctggcccccgccactgccatcctgatcgaggggggcggcgacgagggcgagcagcatgcagacgggtgggttgcccccgacgccccgggcacgcgccccgagcccgccgccgccgacccctccccctccacgacggagcgnnnnnnnnnncgccatcctgatcgagggggccggcgacgagggcgaggagcatgcagacgggtgggtcgcccccgacggcccgggcacgcgccccgagcccgccgacgccgacccctccccctccacgacggagcgtgagatagactgcgccctggtgcacgtcggcgacctgctcaaggtgctgcccggcgcccgcgtgcccgccgacggcgtggtggcgagcggggccgggcacgtggacgagagcctgctgacgggcgaggcggcgcccgtggccaaatcccccggcgacgccgtggtgggcggcagcctgaacctgcgcggaacgctgcgcgtgcgcgcgacgcgcgtgggcgccgactccgcgctctcccagatcgtgcgcctggtggagggtgcgcagctggccaaggcgcccatccaggccctggccgaccgcgtgtcnnnnnnnnnnnnnnnnnnnnnnnnnnnnnnnnnnnnnnnnnnnnnnnnnnnnnnnnnnnnnnnnnnnnnngcctcgatcacgttcggcgtctggtatgcggccgggcgcggcggctggtacccggccgcctggctgccggaggggcacacgcccctgctcttcgccctccttttcggcatcgccgtcctggtcatcgcctgcccctgcgcgctgggactggccacgcccaccgcggtcatggtcggcacgggcgtcggcgcggcgcacgggatcctgatcaaggggggcgacgcgctggagcgcgccgcgggcgtcacccacgtcgcctttgacaagacggggacgctgaccgcggggcggccacgcgccgtggacgtcgccgtcttcgcgtcgggcgtggccgcctcggacgccgccctgctggccgccgcgctggagcaggagagcgagcacccgctggcgggcgcggtgctggcgctggccgccggcnnnnnnnnnnnnnnnnnnnnnnnnnnnnnnnnnnnnnnnnnnnnnnnnnnnnnnnnnnnnnnnnnnnnnnnnntggccgcggagaagggcggcgggggagcgggggcggaggatcgcgacggggcgaagccaatcgcgctggcctgccccgcgccgcccgccgccgccgccgccgccggtgcgggcctgccccaccagcgcatgcagggcctggcggggcgcgtgcccgtcgtgcacgattttcgtgctttccctggcgagggcgtcagcggccgcgtgccgctgtaccgggacgctggtggtgcgcagggcgacgccgccggctgcaccaggccctggacgacggcgcgcggcggcggcaacgcgctgcgcctcacgtcacagcacaggtcctggttcgccgcgcccgaccgcctgcgctctgccgcgggcgcctcgggagcaagcgagctggaggtcgcggtgggcagcgcacgcttccttgagcagcgcggcgtggaggtcgcgggggacggcgcggcggacgcctatgtccgcgccgcgcaggcgcgcggctgcaccgtcatcctggtgtccgcgggcgccgcgnnnnnnnnnnnnnnnnnnnnnnnnnnnnnnnnnnnnnnnnnnnnnnnnnnnnnnnnnnnnnnnnnnnnnnnnnnnnnnnnnnngctggcggccgtggcggtggccgacccggtgaggcccgaggcgcacggcgtggtggcggcgttgcgcgccgccggcgtcggctgcacgctgctgaccggggacaactggcgcaccgcgcgcgccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaggtgctgccagcggggaaggtggccgcgctgcgcgcgctgcaggccgcccccggcgcggtggtggccatggtcggcgacggcgtgaacgacgcgcctgcgctggccgccgccgacgtgggcgtcgcggtgggctccggcgccgacgtcgccgtggaggcggccgacctcgtgctcgtgcgcagcgacctggaggacgtgctgggcgcgctgggcctcgcgcgcgccacgctgcgccgcatccgctggaactacgccttcgcgctggggtacaacgcgctggccatccccgccgccgcgggcgcgctctacccgttcttccgcgtccagctgccgccctgggtggcgggggcctgcatggccctctcctccgtctccgtcgtctgctccagcctcatgctgcggcgacacgtgccgcggcgccgcgtcctgcgcgacgtcctcgtcgtcaaggggcgggaggaggcggcctgagcgtgcgcctcggtgtcgccccccctcgatgatccacgtccctgtgctctttcatgccttggtgtcggccctcgttatgcatccccccccccctcttcttgttcctccctgtacgnnnnnnnnnntcgggaggaggcggcctgagcgtgcgctcggtgtcgcccccccttgacgatccacttccctgtgctcttcatgccttggtgtcggccgtcgttatgcatcccccccctcttcttgttcctccctgtacgtcctcatgtcatgctggatgatatgctcccgttgcacgcgcgagcgagctcgatgtaacaccccggtactcgcctgattgattccatgcatgtgtctccagtgagagaggaagctgcgcggcacgtcgcacgcatgcttaaattaaccctgcccccccttgcatgcaccttgcgccccgcatcgaaacagtaagctgcactttcggttgtattcacacaccaagcacataagccagccctagtccgagcatagggccgtgggcagcnnnnnnnnnntgcccccttacatgcaccttgcgccccccatcgaaacagtaagctgcactgtcggttgtattcacacaccaagcacataaaccatccctagtccgagcatagggccgtgggcagcatgcccatcgttggacagaacctgcaggagaccacgccacaggacacacggtgcgggtacatgggtggcatgcgcgcatgtatatgtgtgatgcacggcgcaaatgaatgtgattttgaataagtcgatgaatatgggggggggtaatttcgtgccccgcgcgcgcgatggacggggaatgcccacgccggtcccccggagaggggttgcccatgacgacgactcacatgtcgggcctgccaggcgctgcgcggcgagccccggattccaagccagacactccctccccccacacactctcgcagggacccagcgtcctggccatccgttgacagtcggcgcctccnnnnnnnnnncccaagccagacactccctcctcccacacacactcgcagggacccggcggcctggccatccgttgacagtcggcgcctcctgcgcgtggccctgcacgtgcgccagctgcaggacgccacccgcttctacaacgagatcctgggcctgctgctggtggcccccctggacgttcccggggctcccatccagcgggccctcctgtcctccgacctctccccctccgcctttggcctggagctgctggcaggggggcccgcgctggaggccctggcggggtcctggtccggccacttcatgctgacggtgccggaccgcggcgcctgcctggccaagctgcgcggcctggggctggagcgctgcatcctgagcgaggaggcggcggtgatcccggtgcgcaacccagcccccgccggctcccagacgctgcaggacatcgtggccgcagtggctgacctcgacggctacacctggcgcctggtggagggcgcggagcgcgccgcggctggcgcgggcgcgggccaggacgatcggatggtggcactggcggcccacgtccctgacctgggcgtggcgctggcctgggcctcgtcagtgctgggcatgcccacgctgcaccagtaccagagctcttcgggtgcgtgcggttggttgggaggttccgcgcagatgtctcttggttgaccgactttgggaggagtgggagggggggggctgggggggcatcaattgcagctggctgggccaggacaatgcgtcctttgggtgaagatggggctgctggggggcagggggtggcagctgcggtgcacggtgctgtgccatcatgcccgtgggggcagcatgcttctccggtgtgcattccaggcctacacaaacagccctggagaccaagaaatccacatccacgagcgcaggctatgccacggcgctggtgggcttcccccacgcccagcatgccggctcaacggggcccgccctggagctcatccagggcgacacggcggcacaggcggagagcgggctggcgcacctcgtcatctccacctcggacctccagaagacggtgcagcacctgcaggtgtgctggttggagagggaggagtgggttctgcagctgtcacgggaatgctcatgcggatgctgagttgcaggcgagcagtacctctcatgctgctgtgatgaagctaggttactggctgcccagggcagcccggctgggaaccgccaggcacaatggcatctctccgtgatacaagaatggctgtctcaggaagtcagtgccaaacgcagactccccccctttctgtgcaaccacatgcagctgcttcgacagagcgtcgaggcggtccagctcggtgcaatggacgaccccaccggcctcgtcagcgccgcccgcatcaacggacctggcaatctccgcttctgcttcgtccaggcagacgccgcgtgacaaaaccctgcaggtgcccagccttccacgtgacatgtaggatgtcttccactgacatagcttttgagtatggaggactgattggggctgatacctagaatagcatgagaatatcctgcagggatcatgacaggccaagcactgtgtgtggactgactcgattggtgccttgcaatttcttgggatagcattttggtataccagtgggagaggaggaattcattttcgctgcagcatctgttatgacgtccacgcccagccactctgcagcgacggtggtaggatgatggatggcagagggcatgggcttcacagacgctcctgctgcttccgtgtcgtacgttctcaaaggggaacctgcagcagttgggcaaatttctttgccaggcagtagcctgaggacatctgggcggcagccccagcgatccacgctnnnnnnnnnnattctttgccaggcagtaacctggggagatctgggcggcagccccagcgatccacgctcctcgccacagcatccgctctcgcacacgccagcgctcactcctcgggccccagcatcatcttgcggaggaagaccagttcgctgtgtgccagcttgtatttgcggtcaaactgtttcctcaccacactgctgttggcgtgggtggcctgcacgccgtcagggaggagggttggcttgatttggccagcaccaatgagactgtggctccatcaacctgggtgagtagcaggcatgcatcgactgccttgagaaggcctgtctgacagtgctcaccccccgctccctcccatacttcaccttgtggtgggctgcctcnnnnnnnnnnggtggctccatcaatctggatgtgtagtaggcatgcatcgactgccttgagaaggtcggtcggcagtgctccccccccgctcccccccatacttcaccttgtggtgggctgcctcaaccagagcacccaggtatgtgagttgcgtgagggtgggccggtccacgatctgagaggagagaaacagagcctggttgatgctagccccagtgcaggtgaagcatcccatgtaggcatcctccggcgagtagcagcgattgggagtcaagcacctcgcgaaaaggtcccttccccctttcctcnnnnnnnnnncagcatcccatgcaggcatcctccggcaagtagcaacaatcgggagtcaagcaactcgcgaaaaggtcccttccccctttcctcccagctccacgcgtaccgaacgctcggcctcccagagctggagggcgaggttgaacaccgtgacagtctccccccgctggatctgcaggggtttgaggggtagaacctctggagccatgtgcctgtcagatgccctccagttagcagtcggtccagcacccccacatcaagagcaacatgctgcaagcaccccaacccccggctgcgcccgcccctcacattgatgttcagcaggggcgtcagcgcgtcaatcaccctggcgtggagggggtgcagcctccccgccagcccagcgcacaggacccgcaggatctgctccgactgcgagtaggcctgcgcatgcgaaggagtggtcccaggattgagttcttgctgtcacttgagagtgaccaaaggaattgagcgccggggtccactggcagtgaggcagcagggcccaaggcctatgatgcactttgagttccctctgcatccctgagcctttccccccccaatccaccttcatgttgtgcagcatgagcccctgctgccagaggaggtcggcgcgctgcaccagctgctggggccccaggccctgctccgcgaccccgggggccacgctgccacagccgcagcacttccaccactttcccgggaaggtcaggggcggtggggcgtggtggtggtgggagtggtcgccgtgcccgccgcagcactggctgtggtctgccgcctccgcctcggctgcaggcggggagtcggccgcgccaggcggaggggtgctgggcacagactcgtggcccgcaacgggggtctcctcgcccgcaggcatcccttcctcctccacgtggcccgctcccgcggcgctggcccctggcgcggcgccggcggcggcggcgccgccgcccgtcgccttcctgcccttgtgcttgccggccccccgccccatgcgggctgcgtgcggccccgccgctcgccgctcgcgctcgcacgcctgggcctcgtactccgccgccgcgctttcctggttggccgcctcgaccagcacatcgcggcggcaggccaggcaccacacaccctgcgcaaggggtcatgtgcccgtgcaattgaaccggcaaggaagctctccggtctgcacacgggcttccgcggcggaggtcaatcgcagggcgcgcactgcctgctcgcacggctcctgacgagggctaccacctcctggcctcggttgacgagcacagtcccctcgttttggtaagctgtgcagtcagcccctgcagccaacannnnnnnnnnaggtctgcacacgggcttccgcagcggaggtcgatcgcagggcgcgcactgcctgcacgcacggctcctggcgagggccaccacctcctggcctcggtcgacgagcagagtcccctcgttttgcaaagctgtgcagtcagcccctgcagccaacacgcaacgcacctccaggaagcggtcgctggaggtggccaggggcgacacgcaccgcgtgcaggcgcatgacaccccgcgctccatcgccagggtctgcatcgtgcggaggtttggaggcgcgtgacgtcgcggaggggctcgcgtgcaggctgagggggcgattggcacggagggggccgcgcctccagaccattgggtcggcgcctcgccgcaccggtccagtccaccccaccccaccagcagcagcgtcgctgcatgcctctgnnnnnnnnnncaggggctcgcgtgcaggccgagggggcgatcggcacggaggtagccgcgcctccagaccattgagtcggcgcctcgacgcaccggtctggtccaccccaccacaccagcagcagcgtcgctgcatgcctctgactgcatcgcacctgcttcctgacgctgcgcggctcatacaggggggcaaaggagagcgtcaggggctcgccggccttgatgggggtcacggcccggacatacacggtatcgcctgggaggcagggaagggaggggggggaggggggggcaaggtgagcgcagtgagctgccccccggttcttctgcgtcgcaggtgctcgcaatccatttcggcagggcacctgcagagccctgaggggcgcgcacaccgcaggcgtgaagcagccaagctgtgtgagcgccatgtcctcctttctcatggttttgctcgatcccatgcccttcccctgccgtcgccgcacgcccccttccgnnnnnnnnnnccctcctttcttatggttttgctggaacccatgcccatcccctgccgtcgccgcacgcccccttccggcgcaaccccgatgccaagggacgggcggatcgtgcctggccccccctctcgcctccccccccctccgtcacctgccgctatccagatgcagtttggcatgcaggagtgggagaaggaggccaggcccgggaacagggccagcccggcctcggtagagggccccgtgcccacaaggttggtcgccagcatggccgcccgggcctgcagctccggcagcgtgccgggcgcggcgtagcccgccagcttcccgccagccgccagcgccgccagctcggcgtgcaccgcccgcagcgcggggcccagggccccacgccagggcgcggggcgcttgtcccaggaggagtgcaggcaggccacatccgcaggcccgcaggccaccagcgggggc

SEQ ID NO: 38085 - DNA, 123 bp, Chlorella protothecoides
agagggtgccgcagcgacgacacatggaggcgcagacagagcgttgtctgtgggtccagcgcaagcagcagcccctgcccccgcccagcctttggtggaggaccccaaagcccccgagtcatc

SEQ ID NO: 38086 - DNA, 146 bp, Chlorella protothecoides
acacccaccacatgtaagccagggccaccgcgggagcacggcccaggcctggactgaggaattggggggagggcggttggtttgcctgagaaagtccagggagatctgctccgagcgcctggcagcctaggtcatgcgccatgcgg

SEQ ID NO: 38087 - DNA, 75 bp, Chlorella protothecoides
cggcggccagccggcgtttttggccctcccactgtggcccccgacccaggcactctaccgacgtgggcgagccgg

SEQ ID NO: 38088 - DNA, 68 bp, Chlorella protothecoides
tcaaagaagtcacgcgcctgcacgtcccatggcacgccgccggcctgttgccccgtcagcgaaccgtc

SEQ ID NO: 38089 - DNA, 115 bp, Chlorella protothecoides
ctggtcctcgccaccagcaccatgccccctgtgcctcctcgtcctcgtagacacactccctgccccaagaataaagtcaaacatccaacccctgcagctggacctgtccctggac

SEQ ID NO: 38090 - DNA, 91 bp, Chlorella protothecoides
acagccggcgcatcccaatcagccatggggcctgcactgcaacccaggagcagtgcacagttgcagagcctcccacaggcgaccccctgct

SEQ ID NO: 38091 - DNA, 10242 bp, Chlorella protothecoides
  modified_base (980)..(989): a, c, t, g, unknown or other
  modified_base (1656)..(1665): a, c, t, g, unknown or other
  modified_base (2179)..(2188): a, c, t, g, unknown or other
  modified_base (4268)..(4277): a, c, t, g, unknown or other
  modified_base (4904)..(4913): a, c, t, g, unknown or other
  modified_base (5149)..(5158): a, c, t, g, unknown or other
  modified_base (5498)..(5507): a, c, t, g, unknown or other
  modified_base (6471)..(6480): a, c, t, g, unknown or other
  modified_base (6911)..(6920): a, c, t, g, unknown or other
  modified_base (7127)..(7136): a, c, t, g, unknown or other
  modified_base (7621)..(7630): a, c, t, g, unknown or other
  modified_base (8754)..(8763): a, c, t, g, unknown or other
  modified_base (9022)..(9031): a, c, t, g, unknown or other
  modified_base (9236)..(9245): a, c, t, g, unknown or other
gcggcggcgcccgccgccgacgccccggcggcgcttgcgagcgacggcgcgtctggccctggcgccgccgccgcagcgccctcgacgggctccgtccccagcccggactccatcagcgccttcacgacaccctcctcctccacgacagccgacaggtcgcccagcgtgcgcagcgtggcctggccccgctccgccaccgcgtcgtccggctctgcgcaggccagcgtgcagggcaggagcaaatcgcgcgggtcgcggcaccaggccgcgcaggcaccaagcgcgccacgcttggcggcagccagcgcgctcggcccggcggtcagcgcctcggcgccgttcagcagcgcggccagcgcggcagaggtgccggggacggaccgggccgggtcggcgggtgcggcgctggcggggggcggctggtacgtcagcagctggcaggcaaaggagaggaagaaggcgcggtcggaggcatcggccaggaccgggggcgggccttcctctccgccggggcttgcgtacctctgttgtgacgagcagaaggagaatgtagcggcaaggggtatgggtgcagactttccgattgtgtaggcagcaatcttcttgcccatgcctgaggaggcatgagcatgatccgagtcatgccctgcacgcagccggacagtgcagccacctcgagatcaccttgtcaaagtgtgggagcccccagaggatcagtttcagaaacatgctctggtgcgcctcctgtctgcgagccagccctgggatcagggtctccagctgcgggcagggtggagggggcaaagtacattgttggccatccatcccagtatcagctggtgaaccatacacaatggcaaacccgctgtgaatggggttgtcattccggcgacagccacccagacactgcgcgcggtgcgccatttactgcacacggacgcacagccaccgcaaggtacacccacgtgtgttgtgcccgnnnnnnnnnnctcctgcgacagccacccagacattgcgcgcggtgcaccatttactgcacacggatgcacagccatcgcaaggtacacccacgtgtgttgtgcccgagcagcccgggcccatgcccttccaccagacctgcgccccccccactcaccacgtccgcgacgtcggccggggtcgcccgggcacctgccctctccaagtacactgctgcaaagttgcgggacatggggcccgcgccgggggatgtgtacacccctgccagctcagcgagtggcaggcgcagcgtggggaggggctggatgcgctgtggacgtgcagggcaggggtcgggtggaggctggggttgccaacgcgagggcagcctcgtggagcgctttgcatgtgaccaagagatcctaaagtgagcgacgggctgacccctgggcatccccccaaccagggccgatcaggcatggcagtgctccaagctaacttgcaccaccacccctgcctgccttgttgacatgtgagaggatggcaagcacccgcttctgtacggtgggatctcccaaagagagctttttaatcacgacgggaagcaacctgacgaggagctgcaggaacgggtgcagggagaggtgctactcattgaggatgtggtaggaccaccccagcaaactttacatgcgcgcnnnnnnnnnntgggtgcaggaagaggtgctactcgttgaggatgtggtgggaccaccccagcaaactttacatgcgcgcgggcacagggcctattgattggggatgtggaatagactgagtctactgcatccatccagcgccgcatgcgccctgccctgctctcctctcaccttctcgagggcctcgtccggggtggaggccagtcgtgtcaagacgactgtcagtgcctccgcctcctgcccaacgtccgccatgattctcgatggaattccttagggcgataatgggatggagcggcctcagatcggacgtgatcatgcctctcactggccctgtcgactgtggctccgtgagtccggaccgcgagatcctcacggagcgcccccgagcacaccgccccattcctatcaggtgcccctcaccgtcacagcagttcgcgccatggacctgattgactgcccccttgtgatcatatgcctttattgttcaacaaattcatcaagggcagcgtgtcaacggctcnnnnnnnnnnatgcgcgccatggacctgatcgactgccccctagtgatcatatgcctttattgttcaacgaattcatcaagggcagcgtgtcaacggctcaaggggccgcgccggtcatgctgcagtcagggcgggccggggcggggccagccaaggtaggagcagtggggcgtgtgtgtcaaagcatccgggaccttcaggcccgcttgggcttgctgggtaccaggtcttcccgtcccagggagccaaaggtggagaagaggaggagggccgcgatggcaaggacgcaggccgtggcgccgccataaaagcagccgacgtttcccatgccgcgctgggtgctgatgtcggcgagccgccccgccagcgagttgctgtaggccagcaccacgcctgggtgtgggaatgggtgggtgggagatgtggctgggtcagccaggggtcggggctgggctgcccagctcgggctgcagtgagggaggccccacctggggcggctccctgaggtccctccagccgctgcccccaaactgcatgccccattccccctggcttccaaaggccccttcattccctttcagcagcacctcccatgccccaacccccgctccttagtctccccctccataccacacccacccaggagcatgtcggtgaaggaccaggccgtccccgccaccttgcccagccccgggatggtggccgaggggatgtaggtggacagcatgccgatggtgacgccgtgggtcatggccatgtgcacgccgatgagcagcgcgcccagcatcatgcccggtgtggaggggaggagcgcgaaggccgcgttggccccgatgagagcaaagatgcccagcacaaccacggcgttgcgcgcggcgacggagcgcttggcgcgcaggccggcgggcgtggccagcgcggcctgggtcaccatcatgatggaggtgagggccggcagcgaggcgcggtccatgaccgttttggcgcggagcgtgacgaaactggcatcgaagcgcgcaaagtagaggatgcccactacggccagcgcctgccagtaggcgggctggaaggcacccagcagcgcgcgtgccttgcccaccaggcccaggcgcgggccgtcaccggcggaggctgcggcggtcgcatccgcgcgtggcccagcggcgtcgcgcgccggtcccaccaccacgccgcggaaggcggcggacaccaggaccagggccagggtggcgggcagtgcggccagcgcaaaggtggccacgtagttttgcccgctcagcttgtaggcggcggcggccgaggcggcgcccaccagcgcgccgaaggtggccatggactggcgcagggagaaggcggcggctggggagtcgcccgaggcggcggccagctcgccgatgagggccttgctgggcgcctcgcggatgcccttgctcacacggtcgaagatcttgccaaaggtgatccagtagaggcaggccgaggcgccgaagccggcgtacaccgcgcccgaggccgcaaacatgggcttgttgatggtggtcagcagcgtgccgaagatgaccatgcgcgcgggggtgagcaggtcggcggccgtgccggagacgctgccggaggccttggacaggaactgggccaccgcttgcaggttgccgatctgggggaggggaaaagggggggggaagggactgtgcaccaggcagggtgacggggtgatgggggcctgggccaaggaggcttctttccaagtctgctgctggcggaatgttgtgtccagcgaccactcagcacggcggcacatctcagcacgacgtgggcgtggacccgccgtgaccacgtacacaaccctccctgcacgtcatgtgttgcaccttggagttgctgaggtgcagcacctcgctcaggtacacgggcaggtaagtgtcgtggatgagggtggccacggagcagagcatttgggctgcaggggcggggggagtggggggcccggtcaggctggtcaggccccagggagttggcttgcaggaacagaatcatgccgagcagcctgcctcgaggtggggccgggcaccgggctggacagctgatctcnnnnnnnnnnaggcccggtcaggctggtcaggccctagggagttggcgtgcaggagcacaatcatgccgagcagcctgcctcgaggtgaggccgggcaccgggctggacagctgatctcacctgtacagagcgcgatgaggcgcttgttggcctctgggtccgtgaaggggctgaacatgctgaggaagcccgtcttcttctcgggctggggcgctcccgcagcacccaggctgccggctccggacgcagaactggcacggggaggcgcgggacccattctcctttgtgcaaatgaatgcaatagtacatttgggcgcgggatcacgcgctgggtggtcagaggaccgacgagggtgccacgcccacgcagcgacgggacgacagctcccgctgcaaacatgcccgcggcggccattaccgcttcgtacaatacccaaggaaagactaactacagtatatacaatgctcgggtacagcagctgaattgcctcgtaattgaggccacgatggttgccggatcatttggtaatttctgtcgaaggaccttactcatctgccagggcgcgagggggcggcggaatctgggccgagcctcgtcatgcccattctcaatctgctggaccgtctcttacgatnnnnnnnnnncagggggcggcggaatcttgggcgagcctcgtcatgccccgttctcaatctgctggaccgtctcttacgatacttaatgtttgcttcataccttgcttcgcgtgcagcagcatgtcccggatcgtgtaagacccccgaaggacgatcgcaaccctcctccggaggctgctgtgccccagcgtaatcatgcaggacagttgtacagttatatttcttacaggatgcaagaggaaacnnnnnnnnnnactatgccccagcgtaatcatgcaggacacttgtacacttatatttcttacaggatgcaagaggaaacagtgtaatcgctcagcggaagagttcaagttcgtcgagggcgcgcgccctgagtaccggaggaataacactacaagtcctcgtcaacaaacccactaggaaacatgagcctaaggggaccgtacgatgtacacgccctactatttgatttttcattctgaatgccagtgtgccaccccacatcttcgtgtctggcgcaccagctgcgaccgtgcacccaggactccgcccaagcctcgttcgtccatcgacagctcgcatctagcaaccgtnnnnnnnnnnggagccgaaggggatcgtacgatgtacacgccctactacttgatttttcattctgaatgccagtgtgccaccccacatctttgtgtgtggcgcaccagctgcgaccgtgcatccaggactccgcccaagcctcgtttgtccatcgacagctcgcatctagcaaccgtcacacattttggatcgtatcgccgagcagatttcgtaagagatacacccacccatctcttcagcgtcgccacgcgtctgataccatgaccccgccggaacctcaacccaccgagaccgtgattcgcttcaagaacgagtttggagagacgctcgtgggctggcttctggacgctggttccaaagataacaccgtgatcctgtgccatgggtgaggagcagctgcccgagatctggagatggtctgcctcaggggccgttgatggtgccccggggtagttcctggccggtttcagcagcacctacagacttccatccgccaggccttttctgtcgctgaaacaaagcactctaggccagattcccacacacaccaaccctggaccccctcccttgcacaggtacatgtccaacgcgacccactgccacttccagcgcctggcggccgccctcgccagagccggggtgtcctccttccgcttcgaccacgccatggccgtggacggctcgagcgagcggcgccggtctttcctaatgggcaatcacgcccaggaggtgggtggatttcgtatgggtaggcaagtgccaagatgggattgttcctcgcactgaagactcctcattctcgcagacccccgctctgtcgacttctcaacgtgcctctcctcgcctcccagcgtgccacccctcgccgtgccaccccacacccctaggttgctgagatccaggcggccgtggacgcccttgaaggcgccggatacaccactcgcgtcgtgctgggccacagcaagggcggccnnnnnnnnnnccattctcgcagacccccgctctattgacttctcaacgtgcctctcctggccttccagcgtgccacccctcgccgtgaacccccgcttccctaggttgctgagatccaggcggccatggacgcccttaaaggcgccggatacaccacttgcgtcgtgctgggccacagcaagggcggcctgaacgcgttcatgtttggcgcccaggtggccagcccgccgccgctcgtcgtctcgctggccggccgcttcaagccgcgggacggagtgctacagcgctttgggcccaacatcctggatcaattggttgccagccccgccatgcccaggaaggaggcaaacggcatggagtgggtgctcaccctcgaggtgggctgccgggaggagtgggtggggtctgagggaggagtggacgcgatatgcccctggaatnnnnnnnnnnactcaccctcgaggtgggctgccgggaggagggggtggggtccgaaggaggagtggacgcgatatgcccctggaatgatgccgctccccgcaacgcacaatgccacacccctgagccaaatctctggcgaattcgtgaagcccgcgcgcgtccactccagcagaagctcggcccggttcatgcccatggtcgatcatcaggattgannnnnnnnnnccgtgaagcccgcgcgcgtccactccggcagaagccctgcccgcttcatgcccatggtcgatcatcaggattgatgccatcttaacaatgccgcgccccttccccctctccctcccgcaggatgtcgaggagcgggtgaacatcgacgtggaggccctcgccacgcgctggcctgccggcacccgcctggtgctcatccacggccgggaggacaccacgatcccgtggcaggaggcggagtacctgggcgggctcctgccccacgccaggacagtctacatccctggggccaaccacaacttcaccgaccacgccgcagagctggagggcgctgttctggaggccgtcctgggcgcggccgcctgagagcggcggcgtgggcgggtgcggtgcagtgggaggctgtagacctgtgttgttggtgactctgcaccgagccaggagtgccactcaaagttgacgggtgataccctatgcattgctcnnnnnnnnnnccctgtgttgttggtgtctctgcaccgagccatgagtgccactcacagttgacgggtgataccctatgcattgctcgagaacagggcgacaggcccccactgactgtccatgtgagcagagggcctggtcttggaggcattacaagtcgtggggcagaggacaggcgggcattggcatccagcagtggtcccgcctcatgagctgaagaactcactgagcttcaccggcccggacgccggggcatcgtcggcgcgggacgggctgtcgctgccgctgctgtcgctgctggaggacctgcgccgcttcttcttcgacttggacttctgcggcgaaagtgggtggcgaggggaggccctgtcagggtctgtgtgcgcggtggggaagagccacacagcgttcccgtgcagcatggcatgccatctggacgccgagaacagactgcaaggccaccacagcagcatctttgattcacctcagactcagtgcacaaagcttccagactcaccttgtgtttgtgcttttcttttttgtgcttggaagacttttctttcttatccttcttgctcgacttccgtttggaatcgtgctgtgggggattttgaagagtgaagattcagaaccctagctgaggggcagagcacacgctgagctgattcgtgtaaatattcagtcagcaagccattgaagaaggggcatctcaagtacaaccgatccccattcccatcactctctgcgctacctttgtaatgccgggtgctgtcaagcccatccgggcggccctgtcagctgccaggccctctctatactcccctgtgcacgtgcgatgcattcctcagtgagaaagggaacactgtacacttgtggggcccatccagcaaagtatcatgccagtgccactcacgcatgagggcatcttgagcttcttgcgcctccaactctcttgcctcggcgtccttttgtcgctgtttccactcctcatagctatatgttgggtaagggaatctggagtcagcgtcgggagtcgcaccgcctttataacagtgtgtacacacgtcaacttacctaggccgttctacttgtagtgctgctagtcgggcttcgtgccacgcggcgctgtggaatnnnnnnnnnncacacaagtcaacttgcctaggccgttccacttgtagtgctgctagccgggcttcgtgccacgcggcgctgtggaatgacacatcaactccatctcccgtgttggttgtgtccgcaggatcgccgtcccgggacgtatgacgggacatctgggcagccttgtgctgctgatttttccccatagcgcctcctgctcgccgggaagatcacaactgaaagtttcgcagctgaagagctaaatttatttgagctatctcagnnnnnnnnnncgcgcctcctgctcgccgggaagatcacgactgaaaatttcccagccgaagagctaaatttatttgagctatctcagatagttttgtatgtggggacattcttggtgtcgatcagggcactgttcattcattcgtagctttggcctgagctcccagaggttctttcttttgtctctgtcgcgtcagcgaacctcgagagcagagnnnnnnnnnnattttgtatgtggggacattcctggtgttgatcagggcactgttcattcactcgtagctttggcctgagctcccagagattctttctttttccctgtcgcgtcagcgaacctcgagagcagagcgaaatgccgagccctgatgatgtgcccctgcataacgccagacattatttaccagaggcaaaaattacatcggcacctcatctcacttcctgcccgtagggttctgtgatcccaggtgcacgtgccctcacccagccctccttcacgaaccgtccacccgccggacacccaacacgtgacacaatgctgagggctctggcttctcgcggccgccagctgaagcagctgcggtccctggcggtccgtggctacgccaccgaggctgggaagaccggcaagagtgtgagtagtgtgtgatcagcagggctccagccccaccacgacctgactccttcaccatcgtgtaccaggctcttatatcgaattaatataattattacaatcctcgcccctaatcgcagagcctgcccttgatcctgggcctggctggcctgggaggcggtggttactacgccaagcagagcggtttgctggatggcctgctgggttcgtccgccatcccggcgaccccctccaaggtacgtgcttctgaagttgttttcgcccggtgcattcccggtggcagtccggtgctccatgtccgaagcccggtgcatctcccttgattacctcagccttttgtccagctcagcatcttgggatgaggggtgaattgtgcttcctcgccctgccagcaaacctcaaccgccttgcttcatgcctcaatggataaacacctgttctgcctgtaccttgaggtctgcagcgcctgagcttgcagtttcctttctcaaggccccgtctccctcgtctccctctcctggcccccctcctcctccccccctccctccctcaaccgcctcccctccccccaacccccattgctcaaccatt

SEQ ID NO: 38092 - DNA, 61 bp, Chlorella protothecoides
ccggcggcgggatcgagagccgagtggggacgtcgccgaggagttgctggccctgcaggca

SEQ ID NO: 38093 - DNA, 77 bp, Chlorella protothecoides
tgagatcgaggcagcccaggtgggaaggggggcgtgggcgggtgggcggccctgtccggccttcagtgtggcaatgg

SEQ ID NO: 38094 - DNA, 72 bp, Chlorella protothecoides
ttctgtgggcatggtgcatagccataaattactaaattgttctcttttaccaggccgcgcacatgcattctg

SEQ ID NO: 38095 - DNA, 61 bp, Chlorella protothecoides
ccactggtcccagtgtgctgacagtggctgtttgaaatgtactcggagcacctgcttgcag

SEQ ID NO: 38096 - DNA, 71 bp, Chlorella protothecoides
tgtgcatgggagggtggagtgtctggcatggagatctgctgtgatgggcctgcactgcactcaagtggcca

SEQ ID NO: 38097 - DNA, 61 bp, Chlorella protothecoides
ctcgcttggagggcgtcaaccagcccaacctcctgcctcagggcagcgagatcaccccgct

SEQ ID NO: 38098 - DNA, 80 bp, Chlorella protothecoides
gcggcatggtctgagaggggtgatcacatcacggtgatagggagcgcgattcacccgcgggattcagtgccctcctcatg

SEQ ID NO: 38099 - DNA, 222 bp, Chlorella protothecoides
acggggtgcaggcacagtgcaatgttggggacacattgttggccagtcgttccagcgggaggaccccggttgtggtgacgttgtcccactcccgccagcatacccccttgagacacagttctgacccggcatggcgccccacgcttttccgaccttggcgattcctgcggcctcgtaggccttgatgtcggtcatggtgttgccgtaggccgcgtacacatc

SEQ ID NO: 38100 - DNA, 112 bp, Chlorella protothecoides
aaggcacagacaaactgggagatgagttgctggcaggggaaaccgcagtgcatcccgatcgagtcgcaagcacaacatgcattaggtcgtagatacactcacgtctccatct

SEQ ID NO: 38101 - DNA, 80 bp, Chlorella protothecoides
tttggtggctggcgcagggtcgccatggcatgcgtctgatcctcagttacaaactcatcgacctcactgcttccaggatt

SEQ ID NO: 38102 - DNA, 117 bp, Chlorella protothecoides
cgtcgtgcacgcattgttgcctgcgggggggaagtggggcgccgagggaggagtgcgcgcgctgctttgcatcgctggcagcgcggtgaaccaggacgggcggtccagcagcctgac

SEQ ID NO: 38103 - DNA, 61 bp, Chlorella protothecoides
ctggcaggatcgggccgggccctgcctccttacagcccccccccgcccggctggggtcagg

SEQ ID NO: 38104 - DNA, 85 bp, Chlorella protothecoides
gctggcccagtgcggtcagcctctgagtgtcgcagggagttggcttcccaactctccatgcaacgctgggcatgcaccgggtccc

SEQ ID NO: 38105 - DNA, 97 bp, Chlorella protothecoides
tgccgcacgcgctcgtcgttgcagaaggcccacatctccctgcacggtgcatcgcagaggcggcgtcgtttgttttctggggggggggggggggggc

SEQ ID NO: 38106 - DNA, 198 bp, Chlorella protothecoides
caggcccagcagcacgcccgtgcggctgaacgcgtatgggacgggcagcaccgagctgtgtgtggaaggtgggagggggtaggggatggacgacagcgcaagggccatggaaggatgcgtcaggacccgtgaaccccctgtccgccaggctggggcctcgctggagctgcggcatcgccatgccaaacactcggggcc

SEQ ID NO: 38107 - DNA, 79 bp, Chlorella protothecoides
cccgcccgcctcccgatgcgaggactcccggcgcccctccctcgcctcccccgcccgcctcccgatgcgaggactcccg

SEQ ID NO: 38108 - DNA, 70 bp, Chlorella protothecoides
aagtgattgaggtatggggagcgggatcccgaccccagcctccctgcggcttccagctgggttgctaccg

SEQ ID NO: 38109 - DNA, 2554 bp, Chlorella protothecoides
  modified_base (152)..(372): a, c, t, g, unknown or other
ccatgaagtggggcgtcttcctcttctttgccggtaagcgggcaggctcgtgtgctgatcggtgcagggtccacgctgtctgctgccgtgtggttgcagatgggagggctgtggcttactgctttctgcagcacctgatgcaagtcctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgacctcaagaaggccgccctctgaatgcaaccaccatgaaaacccaactcaatcgctctgctctccccaggtatcagtcccttggaccgatcagcacttccctatggcctcccaccaaaatattctaaacccaaccagagctcccctctccccagatgtttcccggcttgcacgccttggctgaaccctttggcacctttttcatggcaacttcgcctggttatgaacgaaattttaccgctggggctccttcccaaacccagttgcttgcatccatgtggcatcttatgtttgccccctacccactactaagctgacattttgggtcagtgaaacctctcgagctcaggcttgcatccccaattctctgagcgacttagacccctgccaatgtatcaatgctgaaccctcactctgcaaagatgcttgtgctctcttttggaagttgtgtaatgcgatgacagctacatacttttacacttgggtaatgagccagatctcaccaaacatgcctatctgcgctacagctcatcctttgcagaactgcatccacctggaaggcttcctgggccttcgaatccgtgacgacgccctatcagcatggtagctacgcgtaaaactccctaactctcactaaatgcttattgctggtagacctctggaggtgcattgagatggagcacgacacttgtggcattgggtgctcttggctttggtgctggagacggcaggccacagagcagctcgagacttcaaccctattggagggttggggactggccacttgtctcaaataaagaatgcatgtgtgttctccttaatatctcgagtacgtggggagattcaacgatggattcaacagaggggtatttaaatttgggcccacagtacaccattgcttaccctcgcagctcatggttgcatgtatgggtaaagaggcttgatcgcaacatcctcaacaatttacttgatcctatggaggccgatgcattctagaaatgcgatccttcacatcccacccaccggtaagtggctgccgcttccagcctttcgaatccgctgctgcgggtacttcagatgagagtttgttgcttccgaacaggaggtatcagggcctcccatagcgaggggacgtgcgatgccatgtcaaaggcaatggtgctcccatttagcatcgtatgtctccttcatgaagtcgtgagatactctgtgcttctcatgcaaggtatctgcaggaaggttgctgctggcaagcatgtctcatctacttgatgaaagcctgcaccgaaacgaaaccaaagtcgtacaaggacccaatgaaggcgttacacagccagcacaatgttccttctatcaatcactaaaggggttggggcattgtcacataaaattctcttactttccttcgacactttgcgaaccacccggggttgaatggcagtaccacaacctcggtggtaggacagcatctatatgcaaatactcgacattgacaatggcaagctctcgatctttgtgacgccgcatcccagcagcaacaagccaaattcctacatcggcaatggcaggaggtgccatggccaacgttgctggcgcaaatgtcgaccaatacaatggccgcctaaacagctttgtcctcggtggccttcatggctgcctgcggtggtttactgtttggtgagagtgaaatgtgatatttaggctcaggaacccgatgcgtgcgcgtcttggcaagcgcaacaaaggcgttcgtcttttgcgtcgtccggccggaaccttgcaactatgactcactcgcaccgtatcgaccctttttgcaggatacgacattgagttcgttctttgtgtttggaagcgtcctcaactacttcggaagccctcctgcccttgaccttctgctgtcgttaatatgccttctcggactcacgtgccgtgcagggtgtcaccggaggagtcaccgccatggccgccttccaagagaagttcttcccggacgtctatacacgcacagtcgagggtgtaactactcacagtccctattgcaagtaagcatgcaaacatctgtatacctcggttaactcgggcacttgctcctgcttatagtatggaaatgtttcctgatcaccgcaatcaccttatccccactaagtacgacaaccaggtcctgcagaccttcac

SEQ ID NO: 38110 - DNA, 81 bp, Chlorella protothecoides
agcaggccggcagggggcccttgccggcactggcacccgccgagcttccccgtcaacaaactctggcatcacgcaaggcac

SEQ ID NO: 38111 - DNA, 92 bp, Chlorella protothecoides
ttctggtgtcattatgttctggaggtcaagaggccagaacaaccttttgccaaccccccccccacacacctggtcgggcgtgaacttcccct

SEQ ID NO: 38112 - DNA, 66 bp, Chlorella protothecoides
gatgggtggtggtggtgtacaggggaggggaggggaagggaagggaaggtgccccgaagaaggtgc

SEQ ID NO: 38113 - DNA, 117 bp, Chlorella protothecoides
ccgtggcctcaaacgcgagcctgagggggctgcccttgaagaaagagccgacattaaggtggggagcgttggagccgccatgtcagtagctgcagccgctatcagccaaggaggtcc

SEQ ID NO: 38114 - DNA, 62 bp, Chlorella protothecoides
acaagctggccagcaaccacatctagagcatgagaatcactcgtccggttggctgggctcag

SEQ ID NO: 38115 - DNA, 66 bp, Chlorella protothecoides
gagccgcagaacgtgcacctggcggggtttggggtggagcattggcgtgtggtctgctgaggcatc

SEQ ID NO: 38116 - DNA, 96 bp, Chlorella protothecoides
tcccagctcctggcggtgcctctgttgacatgagcagggggggaaccccttggcaccctcgcaggtccagcaccgagaggcctcgcagctggacag

SEQ ID NO: 38117 - DNA, 67 bp, Chlorella protothecoides
gatcccatcaggagtcagaagtttacagagtggacccttgcgtggtgggtggctgctcttgccttga

SEQ ID NO: 38118 - DNA, 76 bp, Chlorella protothecoides
cgagtgggttgtgcgcagcccgggcgaggtagggtgtgcgggggccggcgtcggggggccggggatcgggtgcggc

SEQ ID NO: 38119 - DNA, 64 bp, Chlorella protothecoides
tcaaggcttgatcatcagccgcccacccactccacctagccactcccacccacaagagctacat

SEQ ID NO: 38120 - DNA, 61 bp, Chlorella protothecoides
aagagcaagccggtccttgaacgacgtgggaccccacttcccgccgctgcgcaagtgcctg

SEQ ID NO: 38121 - DNA, 157 bp, Chlorella protothecoides
cctgctctttgctactggcatctggaccaataacatccatgacaacattgacggcaaggtgaggtgaccgccgggggcccatctgggattacatgcattccttgcgcggcagcacggtttatgcattgcccagcttagggtggaagggcgcattgga

SEQ ID NO: 38122 - DNA, 61 bp, Chlorella protothecoides
gtggcggatcaggccaaccgcggcatccacctgctgggaccccacggtcggccgcgggacc

SEQ ID NO: 38123 - DNA, 213 bp, Chlorella protothecoides
agctcatcttggggccagtggtaggccggatggttgattgcgcatgaacagggtctctactggtaacgcttgatgttgaggaggctcagtgccatggcatcagttcagggcatgtctccaggacagtgagaaatgcatgacacaacagtggtaaaccagcccaggcttctgctccagcagctgcgctgatggttcaactgtcccacctcgcca

SEQ ID NO: 38124 - DNA, 71 bp, Chlorella protothecoides
gccatcggtcgaggcgggaaccgctggaggtttctacgactcgaatggcacctggtgcacaggctactggg

SEQ ID NO: 38125 - DNA, 85 bp, Chlorella protothecoides
aggagcacaccccagacaccatgaaaataccgtctacccccgaactggcgccagtttgcacgcacggcagctcccagtccctctg

SEQ ID NO: 38126 - DNA, 104 bp, Chlorella protothecoides
gctaggaccgcgttccaggctgcgcgctctggtgccatgcacatgtgcgctgctgtgctcatggagggacaatgtttacacccaggcagtgtaagagcacagcg

SEQ ID NO: 38127 - DNA, 61 bp, Chlorella protothecoides
cggcccgggctccggcccgtcgaccgcgattggcgccagcgagatcgtcggcgtcgtggtc

SEQ ID NO: 38128 - DNA, 5648 bp, Chlorella protothecoides
  modified_base (490)..(499): a, c, t, g, unknown or other
  modified_base (751)..(760): a, c, t, g, unknown or other
  modified_base (1176)..(1185): a, c, t, g, unknown or other
  modified_base (1737)..(1746): a, c, t, g, unknown or other
cgcgcccagcgccgccagggggagcaccaccgccagggccacgatcgcggccgtggaggcgccgccgccaccgccgccgtcgtccccggtcggcgagggcgggggacccgccgcgtccgggctcgcatctgcgggcgcgctcgtccccgtgccgcccagctgcacctgctgcaccgcgtcctgccccgggttgcagtccccctgcaccccaaacatgctctccttgtcgccctcccctgccagcagcatgcgccagtcgctgtcgttcagggggagcgcctctagcggcggggacgtcgtgtccagcagcccgtccgtcgcgtagatggtggagaagcaggccgtgccggtgaggttggcgcccacactcatgccgcttgagggccgggtcagcaagatctgggggttgtttgtgtcctcggatgcggtgaggcacaaggtgggggaagcatcaggcagggcggaacatgcaggggtctgggctcctccnnnnnnnnnngctcatgccgctcgagggccgggtcagcaagatctggggtttgtttgtgtcgtcggatgcggtgaggcacaaggtggggaaagcatcaggcaaggcggaacatgcaggggtctgggctcctcccacactgctcaaaaaggctctcaatacccacagcggccctagatcttccaaccaagcacacaagcaccttcctctccccccccaatccaccccatccccacctcctccccgtcgccaggacgctgcacnnnnnnnnnngcccacagcggccctagatcttccaaccaaccacacaagcaccttcctctcccccaaaatccaccccatccacacctcctccccgtcgccaggacgctgcacccgtgtctcccccgccagccccatgtccagtcccggcagcgccagcgtctggttctccgtagagttggacgtgaaccaggcagggcagtgcccccccggggtcaagctggacagcagcacgcccagcgtcccttccaggaacgaggcgttcaggcctgcggcgggaggaacaacggcgtgggtgagtcactgtatcagagcgggtgagcgagcggcgcccaggacgcagggtcgtgccaacagcagatgcacaagacgggcagggcacgcctcccgcctcctgtgtcaatggcgagcggcagggcagcaacccnnnnnnnnnncgcacaagacgggcagggcacgcctccccagagggcctcctgtcaatggcgagcggcagggcagcaaccctcacacattgtgtgagcttcagatccgggccgtccggcgccagcgtgcgcctgtggtggccacccccccaatttccagcacctgaagtcaccccaacccaccggcggcttggggcagcccttccaggacgtcagtcccggggacaaagaacgtcgctctgctggaggtgtccagcgcggcgctcatcctcatcctcagtgcctcctcggcacccagctccagcgccaccgccgccacatcctcccaggcctccgtcagcggcgccgaggaggatggcagcaggacgcgcatggcgtttgtccagcacaggctctgtgcaggtgggaagaagccgtggcgggcgataaaatggaggttgggacgatgagtgcagcggcatatggagcagactgcaactgacagctgcagctgctgatgtctcggtgcctaaggccccttccctcccctaagtcccgctcccccacatgctctccgacccaccnnnnnnnnnngacagtgcctaaggccccttccctcccctaagccccgctcccccacatgctctccgacccacctccaggccctccacggagctcaggttggtgggagggatggggggcgccgggatggggcggtccagcaccaccagagtcgaggagttgcagaaggagtaggtgtccaggtaggtcgcgccctgggtcgcattgtacgaggtgggctgggcgccgtcactggcgtaaaacaccttgtacgggtcggcctgggcatttgtatgggaaggcgggggatgatactggcgtgtgacgcagagtacaccctcaaagtcctgctgtgcctgtccacctgctccattggcctctcctgcaaccccaaaacaaccggcacagcgccctgccctggggcctgccagccctctcacaccccgccatccctccgacccactgacccagccacccgccccctttgctcacccgatcgccgctccagtacacctgcaccgtccatggcagggtgccgttggtggacccagagatgggcgtgagcagggtctgccgtgccgcgggctgctgggcccaggacccggagtttggcaggatggggcccgaggtgtcggtggagatgtggaagagcaggtcaccgatgccctcggggcgggtcaggaaggagcgccatgccatcccctgacccagcgagcatgctgcatcgccgtctgcgaggaggcagactgggggacggggtctgtgcacgccgttgagttgggggggggggggccatgggcacgccgctgttatactggggtacacatagagtcgggggagacacatcccaaaccccctgcctgatccatgcccagcaagggggctggggaagagcacgcttgtcgggcccacattccggctgcagaatctcaaatcccggcgattcctcctccccccagggcaagcaggtgcccgacctgggcagtctacgagggactcatcggtcggtatgaagagggtagtcctgtccgtcagcaggaagttcacacctgagaaatttgaaacgcgaagaaaggtgaggatgccgcgcatccgtgtaggtctgggccgcgaatgtgtgcggggccttgcaggcgggcatgggaacagtgccgacccctgtcggccaggcaatacgccccacccgagaagcggagcgcgtcgttccagatgctgatgttgtggtcgatgcctgcttcttccagcgtgctctcaagggacaggcgacagttagtgccgagggcctggccaacacggaaggagcaggagggagggaacgctcacatcgagcgccggggaggggggcacagatggttgatggcacataaggtagcacgcaagaacatacctggagaggagccgggagttcggcgaacacagggtcgagtatagggaggagccagcaaaggacccaaacagcgcatactcgacccccgccgtagcctcgccgccccgcccctgtgcggcaaatcatggagcagagaacattacatgatgtaggggcctgatggcctcggggggtcgagtctacatggctagggggttcccaagtgtactaggggatcgcacttccggcggacgattgggtggggtcggagccagctgcagctgcccctctgcaggcggcacacaatgcgaccggcgaaagagaccttccggggtcacagcaggtagaacaaactcagaaaatatagatgttgcatgtgtggaggacacgagcagggctgggtgtacggagaaaccgacatcaccttgatcctcctcatggtggccagccgctctcgtccggctgattcctcgaagcagaccagcgacattcatggcacgagaaacattttctaattggttgcgacgcaacgattttggatcagcaatccagacgtcgaagatgatgggggtgaagtacttcaccgttacagtttcctgcagctcgggccgggaagaatcaggttcgcgggagctccatcccgagggcccccgcacgcgcacccaccaagagatacttcccctcccgacgagtgatcgactgcaccgatgtggggcaccaagacaactacacacctcaagtagaacacgttacggcccacagaacctattctatcccggcgaggcaataaatgccatggtgaacgcccggccggaggacattgagctctcccgcctgcttgaacaatgcgagtctgcagctcacattgagcgcgaacgagcgctatcccaagtggcgtccttcctgcgcgacgccggtgtgtggattggtggcggcagtctgttccggaagtcacgacggcgtggccttctgaagactcccatccttcactcccacatgcagagggcgatgatcggcagcgattccagctgcaaactggatcactgcacctgatatccattcgggaccggtgggagagccggtatgccggcctccgagtcgcccagttcctccaggaggcaggggatggcgacgtagattttgcacgcaccctcatgacagaatgctgtagaattctcgaggtaacatgaggtgggggtgggcagagaatgcagatgggtttgcccactgtgttgggcgctgtaattgggtagcgaccagcgggagatgagcaaggagcattcttggtggtcgtccactccacaaacgctgccaccctcctccctacctggcgtgctctttcaggatcctgagcctcgtgtacggacatgtgtgggtgagttgctgggggccctggcccggcagcacggcatcatggtgtggcaggccacctccagcaccatcctcaccagcatccatggcaactttgtgcgttgtggggctgagcagcagagcgcaactggttctcagttttggcgtaggcgcttgctccattttcagtcatggcgtctatacatctacattgaacaggagccgcctgcagcaccgctcgcctttcgatctcccgtctctcccaacccatgcaggaaagggagggcacgaggggggaggatgaggaccgctcctgcggttcctgcagccgccaagttgccccctccccggcccccttcctctcctccctgctccagcagtcataccgtgtggagcggccggggacgggggacatgcggcatggtgcagagggctggcgggctctggaaacctccttcaaggtgttgattgcagacgtgtggaggcgtgtagaggggaggattaagacatagatcaagggtttggtcacctggggtgtgggggaggatcaggccactggcttggagctgtccatccgtcgtctcttcacatcgcagcggccacctcaccggactgccaccaacacatgacggcagcaattgcacgtcatgcagttttccacacatcagcttcaacacccccccaaaaaaaatcaaccacccaggccatgcacggggtcatggccggcaccgggccggccttcgccccatgcctggacccggagctgcacggcgtgctaatgcgcgcggcggtgcacgccaaccgtttcgtgcgcgaggcggcccacaacgcgttggccgacgcctgcgtcgtgctggccgcgcgcgacgtgtcgcgtctggaaagcgcggcgggcgactacgccggccgcatcgcgctgggcctggctgactcctggaaccgggttcggtacgcggcggtggcggcggcgcgggcgctgcttgcgacgctgccgcgggacggctggcaggccgtgctccccgccatcctcccaggcctggcgctgaaccgacactgcgacgcggagggcgtgcgcgccgcggcgcaggcggcctggcgcgaggcgctgggcgaccagggccgcgcctggctggcgcgctgcgccctcggcgtggccacttactacgtggagcaggcacgcgcggccagccatggggtgcgcgaagcggcctgcgcctgc

SEQ ID NO: 38129 - DNA, 125 bp, Chlorella protothecoides
ctgatgcgatgtgctggcaggtgtgaggcaaacttgaatggctggccactggccatgccatgagaacacctcgagtgtcccctgcagaccaaccttgcacccccctcccccctccccttccctcc

SEQ ID NO: 38130 - DNA, 61 bp, Chlorella protothecoides
cggcccgctcctctctgttgaggtgggtgagggagtgggaaaggggtcctagggctggaac

SEQ ID NO: 38131 - DNA, 72 bp, Chlorella protothecoides
cgacccaggcctggcacggggaggggaggggcagatagttctgaccagggcgggggctgcgacacaggcatg

SEQ ID NO: 38132 - DNA, 61 bp, Chlorella protothecoides
gcacctgcagagcggtgtggctgtggatgggcaggtgatgcctcagcgcccagacacgctg

SEQ ID NO: 38133 - DNA, 5894 bp, Chlorella protothecoides
  modified_base (1070)..(1079): a, c, t, g, unknown or other
  modified_base (3218)..(3227): a, c, t, g, unknown or other
  modified_base (3512)..(3645): a, c, t, g, unknown or other
  modified_base (4547)..(4556): a, c, t, g, unknown or other
  modified_base (4651)..(4660): a, c, t, g, unknown or other
  modified_base (5041)..(5050): a, c, t, g, unknown or other
gtcccccagcccctcccccgtgccagcccctagtcccgagattgctgccgcctttgcctcagctacgagtgggtgaaatttgtcaagacagtgggcatacccgagtcattgctgtgcagagggatgcgttgctgttcatggtacccagcatattcttcagctccgtaggatgattgcgtgcgtttcagtctatgtgaggactgtcatgtgtaagcaagaacaaggctcatcctcgatttgatagatactgcagcagcctgacgctcccgcagtcctaatcgcagagctgtcagtacagcccgtacattgctggaagacaagattaggcgtgacgagtcccaaagcgtagacctgaaacccagtttgggagacctcagattgaattcatgtggcccccgtcaaactcctctgctcagtacacgtgacaagatcgtcggacagcccaaggatccgagcccgccttcctggcgctactaatgtagctgccgagtcggggacgcgcatatcacgccacagaaatatcctccccatcggcgcggaattgagtctccacctgaaatgcagacgtcaggaaggaccgccgtacgactgggagtgtgcatgctccttcttctcctagcaggtggatcaggggatgatggcagagctagggttgcgaaatatacctcccgacgccccatttgcggtcggtatggactaagtttgcccttaatacatgaatacccgagccgagctgaccgttggcccctagtcgagttcctgcggggttatcgacggcgacgtgaccggggtgtcggtcccctctcatcaacgcacctaccttcccctgcagcgtcgcctgtgcactcggctgcttctaggtctctcaagaatttcctatggactgaggaagaagccccaggtaaagtctgggagggggaggggggggtacggaattggctgacgaccggagcgcaccaatctccggctcatggtctcgggggcgctggaatggtgtgtgggcgcacaccccgcacggaccggaacccacactcccccacctctgctcaccttctctacagagcctgcgnnnnnnnnnncagatggtgtgtgggcacaccccgcacggaccggacaccctactcccccccctctgctcaccttctctacagagcctgcggtcgagactcctcccaccgcggcagatgaagtggctgaggggtctgatgatcctggcgcagaggggcccccactggagttccacaaatcgcctgaggagtccccgtccctggcttcatcccccagtccctcaccggtggagacgagcgttcctgaaccctctccctcccccccggagctcagccccacacttcccggatgatagattcctgactcaccccttgacgagcgctggggggtgcagtgcaggagccactccgaagctgtgcaacatagccccgccccttgcttctcacacgacccaaccttgcgaagaatctacaatgccctacacgtagtgccgttctgccctccccggctgcgaccccaccatacccttttcgccccccacatgcattgcatgtgctgtcctctgcctctcaccgggatgtgagatgatgcttggctttcgtccatgtcctgctcaatggggaggtgtgacctgtgatgtcacggacatgccctcccgatgacccataccgccttatgtgttgtttgaaagtttagacctgcacaattatgtaagaagttctccattcctttatgttaccagggagcagcagagagtcttgggcatttctgtcccacaattgttgaggaataaacttgttgtgatgggggctggggagaagggataccacgtcaatggctctgtggaaggttgaatatcactgcaagggtcgctttctggatgaggctcaaaattagcttaatctgggaaaatttgactctacctgatcgcagtgcatcagatctgatcgcctggttctgcatttggtaccttgagcagcaagaatgtttgaaaccactgcattgccagcctgtcccagcgactgatggtcgcgagaagcataagcaacccaacagcaccgcgcacatagcaccaagtctaccaagcattattacagagtcacaacccggtcggcaaaggcgctggacgcagcttcaaaccagcagaccacaggtccagtggccgcgctcgtcgttggcggcggcgcgtcttcggtggattacataccgttgaaggctggcgttcctttcttaaaatgcccgtgtattctataatgaacactgggggacctatcccgaccccgtactcgttcgtcggcgtgaaggaaaatgcggatgctccaggcttgcagaggacctgtgcaagcagccatcggccatgtaggaccgcatagcgatcacacgcattaggagccttaatacgagcacagtcccacgtatcatcgttacggacgacatcgcgaagcctccgaacaaggcacggcggactggcgcgaagtacaactaccgaccgccgatcgtctttgcaatcaatggacgcgagatctcaggcgtggattgcgatagttgctctgacactcagcccgatgtctggattgatgaaagctttccgtggacattcatggcccaattgatcatctgaactcatagagcgcagtcaggtggggagtggtatgaagctatgttcgcggaagaccccgtgccacttaacggaacgaccgagtttcagggtcagactcgaccccggcgggggaatgagcatccacccagctggcctacatgaagcactctgccgcagccgaattcatcaaatcagtgtgaccggcaccagcagcaccctcgctctccccgccaaccccaccatggccccgagaagtatcgtcctgcaggctctgttgctgaccgcatgcctcctgggtaggttgagggcaggtggttgcatgcaactcctcatgtctctgcagggtggcattctgctgctgaaaggcctcccatcttctcagaatgcattacgaacagcgtaaagtgctggaccaacttcagcggggcgtaaactcctcctttctgtaggtgtgcatgcgaatctccaaggcgctcacctatggggcatccactcgggcggtgagtttagggttcgcccactgtgcgctttctctggaagataaacctagcctgcgagcacagggtttaccaagaaaaaatcagcatcgatccttgacaagaatgcgggnnnnnnnnnncatggggcagccactcgggcggtgagtttagggtccgcccactgtgcgctttctctggaagatggacgtagcatgcgagcacagggtttcccaagaaaccatcagcatcgatccttgacaagaatgcgggagggaccacaaggggaacccccgcatgccgtcttcacccggcttcccgtgcgtgttccaacaacgcatgggtaggggcggagggctcgaacatcgtcgaagatatcatcgacgccaaagcaggtatcgaaggactcgatgcgccgcgtgcatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcccgccggatgtctccccaaggttgcgatatacctcactcatcgccaccacgcagatttcatcgccaagctgttcggaacaggtgattgagaggcgcttcacacgaggcgccgaggtccatggttgacgtgcttgctgagcccagtttaccaccacccggttgtgcaatgccacctcccacagccctcgatcgtctggcccgctctcccgccctgcgaaagccgccctgtcttgctgaaatattccttcagaatcacctcctctgcctgaccctctcccccaccctggctccctgtgctgcagcatccccgaaaaccacctcgcagggcttcacaggcccccaaggcggagccgctacctctggttcggctgaggcgggcgggtccactgacgcagacacaggaagtggcagcgcagctgccgggaggggccctggcagcgccggtgctggggctggcagggctggcacctccgccgggggaaggtctggaagcgcctctggtggtggtggaacccaggccggcacctcagctggtggacccggggacagccccgctggcagtggggcggcggaccgtgccggggctggggacgtgaggtccgacagcgccgacggggcggcgctcccgcccacagccgagtcgcgtgccggggacatcgagagcacggacagcgtgctcagcgtcatccaggcgaacccagatctcagcagcctgtacgacgcgatcgaggtgacgccccgggtcggacgggtggtgcatccactgtgtgcaccggttgggaagtgcagtcgcgcagcgagcacaccctgcgctgcatgtgggattcacccatcccactggggttcgacttcgcgcccccccgtcacctgcggcacagttttgcgggcttgcggccnnnnnnnnnnaaggagtgggacgcttgcgctcgaaagtatgcagacagactctgaggagcacggcgcatggcgccatcgcatgctcccttgctcgtcgcccccannnnnnnnnntttcacccatcccactggggttcgactccgtgctcccccggcgcctgcggcacagttttgcgggcttgcggccacgctggaggacccggcgctggtggccacggtgtttgcgcccaccaatcaaggcacgccacgggatgcgcgtggggtggcgctgtgggcacggggaggggtgggacggttgcgctcgaaagcatgcagacagactgtcaagagcacggcgcgtggcgtcatcgcatgctcccttgctcgtcgcccccagcctgggctccagcggattcaaagatcccctgtgctgccctcccatcacagccttccaagaccttgccactgcccttggacccgacgcggatgccgtgttcacaaaccgcgacctcgtcnnnnnnnnnngttcaaagatcccctgtgctgccctcccattacagccttccaggaccttgtcactgccctgggacccgacgccgatgccgtgttcacaaaccgcgacctcgtcaagactgtgagtgaccgagtcggcttgcattctcggcagagcgctgaagctcgttgggtccggggcccaagggtgactgcggatcccgtcgccactcgcagactgcgtctggcccggggcagtgcagaagcacatgctccgcctctcggcatcactcacccagccgtccccaagtgcaggtggtcctgtaccatgtccatccccaggaggccctggccgctgccgacctcacagacgggcagacgctgtcgaccctgaacggcgcggaagtaatcacggcgagttggggtgacgtcctgggtgagcatcaccaccatgtgatgctgggacataccatctctctcagccctgaccatcccatgtcacctgcgccgcccctggccgccatcgattaaaggccctaaccccttgcgttacctgactttcctcacagccgattgcttggtacccacctcctcccatacgcctcactcttgtgatgcacaggttgcagttgctgacgcagctgttaagctcgatccctctggggccgccagcaaccccaccattgctgtccctgccgccgtcgcctctgctgacatcccggccgccaagtccatcatccacatcattgacaaggtgggagccgtaggatgtgggcgctgcgcttactatgccagatcatctaatgcatggagcgcattttcaggaacaggcgcggcgctctcgccacaagcccacacgccctcctgaccccccccc

SEQ ID NO: 38134 - DNA, 63 bp, Chlorella protothecoides
gccgccggcagccccgccaaggggcctcggaatcccgtgcaggagcggcacatcgggcggctg

SEQ ID NO: 38135 - DNA, 72 bp, Chlorella protothecoides
gcggcttgcatgcgggcatgggaaggcggcggacccaaacggaaacggaagaggcggagccgctgcctgccg

SEQ ID NO: 38136 - DNA, 61 bp, Chlorella protothecoides
acaaccccggtttgctcactgtcggggtcccctctccccatcaaagtcggagcaggcggcg

SEQ ID NO: 38137 - DNA, 61 bp, Chlorella protothecoides
cttccttttattttctacgtgcaaggtctcgcagttgtgattttcgcagactggctgaggt

SEQ ID NO: 38138 - DNA, 64 bp, Chlorella protothecoides
tcgctccagcttcccggtcctgctgcggtacacatggccctgcgttgaagcgaaagtattatgg

SEQ ID NO: 38139 - DNA, 103 bp, Chlorella protothecoides
gggcatgcggggcgcggcatcggaccctgcctcatcacgccgccgcgtcgccgagctcatgtgcgcggccttgatgggcggccagggcgcgagagtggccgag

SEQ ID NO: 38140 - DNA, 61 bp, Chlorella protothecoides
gccgcggaagggcacggctgggctgcggccatgagcgggaaacagtgcgtcagggagtggg

SEQ ID NO: 38141 - DNA, 61 bp, Chlorella protothecoides
agggcatctgcaggggaggtgatgggggggcgccgggtcttcgctggcctttcagatcagt

SEQ ID NO: 38142 - DNA, 69 bp, Chlorella protothecoides
gtgtacgtgtgtgcgatggtcttcctgtgctgccggggcggaacagggcggggagtcgcgctagtatgg

SEQ ID NO: 38143 - DNA, 88 bp, Chlorella protothecoides
cgagtgcggcatgcacaccccattcaaacatagccccctactccgatccttgtcccaaacgcgcacgctgatggcgagaaacacggca

SEQ ID NO: 38144 - DNA, 61 bp, Chlorella protothecoides
tgggaagcaagggaagagtggtggggcagggacagcctggtcctcctgtcatcgacgtcgt

SEQ ID NO: 38145 - DNA, 64 bp, Chlorella protothecoides
acccatggcagagccggggggggggcctccctctgccatggcaacgcgaaacgctctgctccac

SEQ ID NO: 38146 - DNA, 117 bp, Chlorella protothecoides
gcctgtcggataactatggtaaggctgtgtttgccatgccgcacatccctacctcccctgttgcaagggccttgagttctagactcccgcactcccctgccccacagcttggctcct

SEQ ID NO: 38147 - DNA, 61 bp, Chlorella protothecoides
ttcctggtgcgcatgcgcacatggctcgggggacagagccaacccggcaggcttctgacgc

SEQ ID NO: 38148 - DNA, 61 bp, Chlorella protothecoides
gaagaaagcgcagcgcaggcgcgcggcggcagggggccctggcgcgcgcccggcctcctcc

SEQ ID NO: 38149 - DNA, 104 bp, Chlorella protothecoides
aagcaagagtgagggtgcgcatcggcatggacgtgatggtcgcgggctcggcacgatatttctcaaaggcaagccagtcgaacgaccaagcgggatcatgctag

SEQ ID NO: 38150 - DNA, 118 bp, Chlorella protothecoides
attgtcactaggacccttgtacaatctactgctacacggcggggtagattttctgcgtcgatcaatgcgacccgtccccaaacggcattgcttgttgcatggaagtcaccagctgagg

SEQ ID NO: 38151 - DNA, 99 bp, Chlorella protothecoides
ctggagtgccatggtgggcagctcctgtgcccgggaggcggtgcgactggccgctcttggcacgttatcgcaaaccgttgacagcacgtgggagtttga

SEQ ID NO: 38152 - DNA, 61 bp, Chlorella protothecoides
gctcagcgtcaccgccagcgtccccgccgcagcggcggccacgcctacgcgcagcagcatg

SEQ ID NO: 38153 - DNA, 72 bp, Chlorella protothecoides
atcttcgactcgtgcgaagcatatgttgcgtacgtctctcagtcatgtggcagattctgccacaacagagta

SEQ ID NO: 38154 - DNA, 149 bp, Chlorella protothecoides
agtcgcacgtggcaggggtggaccaggaagcgcaacttgttgcgcgacgggggagggcccctcgagggccggcgggggccgggccggtcgccggccgaggctgccaggtaggagggcacgtggggcagggcaggggtcgacccagggtc

SEQ ID NO: 38155 - DNA, 64 bp, Chlorella protothecoides
ctagtgactgctttcatccggataatagtgcacacctgtaactgtatgcctgccacatggtgtt

SEQ ID NO: 38156 - DNA, 71 bp, Chlorella protothecoides
ttgcagcaccttgctgctccgtggcagaaacgtaaagcaatcctgagccttttgatagccacataaaggag

SEQ ID NO: 38157 - DNA, 412 bp, Chlorella protothecoides
  modified_base (152)..(343): a, c, t, g, unknown or other
ttgacttgtcagtcatatccatctaggactgcttgccatagacaggcaataccttatcttgctggatgcttgctcctcaccccgcaggaaggtgagggaagccgtgaatgtgctggacatcgacgtcaagttcttcccctgccccaagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagacaccctacttgtggtctgggatgccattttaggcaaaccttcatgccccctactttctaggcg

SEQ ID NO: 38158 - DNA, 61 bp, Chlorella protothecoides
cccatcccccagcccttctcccagcccttcccccagcccatcccccagccccagccccagc

SEQ ID NO: 38159 - DNA, 61 bp, Chlorella protothecoides
gctcgcagcctgcccatgtcactccggggcatcccgccgcaggatcttcgaggcacgtggc

SEQ ID NO: 38160 - DNA, 61 bp, Chlorella protothecoides
cttctcctgagaccagccccagcccttctcttgaggactcccccagcccctcacccgagga

SEQ ID NO: 38161 - DNA, 123 bp, Chlorella protothecoides
gtgtgctggctggctgctgagtagagactgagagcatttgcatgaggtccggcttacctcgattaaccatctcaatcctccgtttaacgcctcccacctctttgcaggcttgacagggctgct

SEQ ID NO: 38162 - DNA, 70 bp, Chlorella protothecoides
cagctcgtcctgctgagcgctccgtgcctcgggcgccctctcctccttctgcagcccgggggcgctcgct

SEQ ID NO: 38163 - DNA, 61 bp, Chlorella protothecoides
gggaagccggccctggggctcagcgcctcacatcccgccaacggcgagccgccccgcctgt

SEQ ID NO: 38164 - DNA, 61 bp, Chlorella protothecoides
tattcgcctatgagttgcagataccaacttcaagaatcacatcctcaccccgccacagcca

SEQ ID NO: 38165 - DNA, 108 bp, Chlorella protothecoides
gccgagaggtcggtctggtcgacctcggcgcagcaaatgtcatcgggggagctgagggccggggcgggctgggtgggcatgtcaccggcgccaggcatggggcatgcc

SEQ ID NO: 38166 - DNA, 206 bp, Chlorella protothecoides
atcgaactgtcaagactcagaggtccaggccccccaatgatacgattggagatcatgcacgcattggggggccccatgatccagccctcacccttcactgcagggcattttacgccatgcaccagtcggtgcaaccccccccggtgttccactcccccgtcctcccgtgcacctgtgcgcgcttgcgccgctcggcctcggcctgc

SEQ ID NO: 38167 - DNA, 147 bp, Chlorella protothecoides
gtggctatcctttatgcaaagggtctgcggaatttggacactggccctgctcacccctcgagcatactcagattgccagtcccagcatgtctgcccatcacgtatacagacccccacccctttctcgacccaccgcctcactcctcc

SEQ ID NO: 38168 - DNA, 61 bp, Chlorella protothecoides
gcttacagcttcctctacggcctgtggaggtatcagtgggacgccgactgcgagctcttcc

SEQ ID NO: 38169 - DNA, 87 bp, Chlorella protothecoides
tgggtggccgccaacgcgccggcgcaaggcacccaggcgctctgctcgactcaatagggtggctgcgatgcacccatgatgactgcc

SEQ ID NO: 38170 - DNA, 89 bp, Chlorella protothecoides
ttcctccatcaataaaaacaaccaggccttgtttaagatccagactcactgaagggttatgggtaccattatggggcctgtggcgctgc

SEQ ID NO: 38171 - DNA, 8950 bp, Chlorella protothecoides
  modified_base (5803)..(5847): a, c, t, g, unknown or other
  modified_base (6084)..(6138): a, c, t, g, unknown or other
  modified_base (7364)..(7410): a, c, t, g, unknown or other
ttcctccccccccccccccccccctccctcttccctccagcccaccagtcccttgtagatcttgagaacgccaaaggacccggcgacgctcttcagctgggtcgccaggctcaggcccgacttctgctgctgaatcatgagaaactcggcggggcagccaatgaaggccgaggacgcgccggcagacagggcgatgccgatggtggagatgccggtggggttgtagcccaggtgctgctggtgcagggactccagcaggcggttcaccccaaattgggtggcggtgatgggaaaggtagcggctgagttgacctggcatggtatggtgggtgggaggggtcatggggtgtacattgttggagtgcttgtcattggccgcacagatttgggcattccgtgaatttcagcgcagtatggcgtgcttgtccatcttcagtgcacggatgacgagggccggacccctcccttttccaaagggcacgtccctgagatcaagaaacccatggccatagagtatcgcccactcaccgccaggccgcggtacagggtcatgggcgatcgggggatgggacggccctcctgcagcgcgtttttgatggcgatggtgggctgcatgatgcaggtctccgtgaaccccgccacgccaccaatggcggtgtgctccaggggcgtgaccgagctcatgacgacagactatgctcccgctggtcagactctgatctcagtactccttgtgagtggagcaggagctgcacaggatattttggaggtccgcagagctgtggatgagaagggctgacgcgcaggtctcccgacaaagtgctcaggttctggctagggcgcgccttgactggaaatgcgagactgtacctcaccacgtcagggaccacgctggacagtccaaccagttcctttgcccttgagatcagtcatgctgggtcatggtgcgccttatctccctctgcggctgtttggaaatagctgcgcctaacttgcccgcgcccagagggctcccgctttccagccttgatgggatggagggagtcgggctatgatccagcaggtttacatcatcagacagtaagcaaggatgggaaaattatgagctgtcaatatttgctttgacatatggtattgttacataaagctttgtctcccctgcagccagcatggtagctgggtcagcagcaccttccatcaaaccattcaagtctgccacgatgctggaggccagatcccgcgactggtcgctgtacgagcagaaggcgtgggtctgccccggaatacgccgaagctgtgttctcccgagtctctgcacagtgagttgggctcgttctggcactcttcacaacttcaaatctcggatggcaaccatcaaagccaggtgccatcccgtagggtggacagccactcacgcggtgcagggattcccttcacccctccccaatacaccttctcgagcagctgctgctgccaggcggggcaccacatgtccccctccgccaggtacgccgtgaaggagggcagcctccgaacgtcatcccagggcagcgacccctccagctcagcaaactcggtgctggccaggaagagcgcgttgcgcaccgagtccgggcgcagcacgagccgcgtcgccgccagagcgtgctcctcctgcatccccgactgcactcgcaccacggcactgcgcagcgcgggcggaagaatgatgggaatgcttgggcgagtgacggcccaaagtgtgccaaagggcggctgctgttgggggcggccagggaagaggctacggccctgcgaggccccacaccgctgcacctggggccccaggcccggcagccgtgccctccccgtcgcagcgcggggtcttgaacagccgcaccggccccaccgggccgcgtgcgcgcgccccctcctcccccccccctttccctccctcccacctgagccaggggtgcggcaggagctggaggggggccaccagccgccccacccaccgccagcgccgactcaaccaggccaggctgcgctgacggggacaggctgggtcgtgctccaggaaggggtacatggcgaccacggcgcggacgcgggcgtcggccgcccccgccgcggccttgatggccatgtaggccccgatgctgtgggccagcagggccagggggggctggccctcctggctgaagtgctggcgcagcaggtcactcttgtgctggatctggtcgctcagggagaagacctgccgggggtaaggagccctcggatggcggggggcaagatgccgcatggagtctaccactgcatgcccctgtcccctgcgaccactttgtttgagcggctggaccacgtcagggagaagaagatcggccttgaagcatgcctgacgctggactcacctcaacccacccaactccagaccaccccgcacccccgaggttaggccctggccgtccatgcccagctgggacacgcatgtgatgcaggccctgcctcgcagaccctggtgcaggctgtgcatgaagggctcatagtactctgccaccccaggattgccagggatgatcaggacgttcaggcgaggggggcctgcagtgacgtggagcgagcacgctcgagcaatggtgcgcatgttgctacacaaacacacgcaaaggacagatctactgccccgctcaccttgggagggcaggcgcaggacgtgggtggggtggcgccccaccgtccagacggctctcgccacctgggtgctgccggtcccagtcttcataacccaaagtggcctgctccaacgtcaatgtatcattgcaggaggatatcaaagaaaatgcaggtctggagcatgcactggccatagcgtcgcactgctgatgctttacaggaatcgtcctccatgacaaatatgccagcccgagcccgcaggcatttcacgtatttgtgcgatcgcttaatggtgcagtgaatgctgctttatatgcaatgtatctacatgacgcatgactacgtttgcactaccctggcgctcccctcctcgccgcgatccaagtgcacacccaccagatcactggactgcctgttcaggaatgtaggcccctctgatcgaccgcatccgccgactgttatttgattaaattattttatgtcttgattacatagaacaccgttctaccactcgtaatactgtgccaaggatacacgacgctgaggcatggcggacagtagagcaccagggctcgcccacccgggagaggatcatgaggcgccaccaccgcctccaccacgagtcgaggtgccagggcccctcttgtcacccactgtcctgggcgaggacagcagctccctctccatcagtctccacccagcgtctgtgctccagacctcccatgatggccggccacgacacttcggtctaaactatgacctgcagatgcagcaggtgagatgttatgtggtacattggagtgcatggattggtgtcatcctctgaggacacggtatccgccgccagtgccgctggcgggcagaggatcacatccttgctgcagcagctgcctcgcgccacgtcatggacccgtgctgccatcgcattgctgaaccttcacccctccctgccacagcttcatgaagatcagggtgtgagggaccataagtggtgcacccaggttggtcagggctggccttttgggtgggacagcgatgcgccatgctgcatgcaggtgtcccctcggcccccgctgtgccatgccccacaatcgaacacctgctgaaaggtatgacatgccacgcctcccaccttgtcatgcatgcagtaccttgggcccgagacgcacgtcagggtgaatggcctgcggcccggtcggacatacgccatccgggtcagggtccagctcgtctgcgacgaccctgaggtggagctggcgacgcccccgccctcgcccatctgcaccaccagcaccaccccgactcccccccaagcccctgctgctccgggactctccagccggcagaggaacgcgctcaaggtgcggggtgctgtggtggacacagccttgcctctccgccgtctccgtgccgggatcgggaacacctggttgcggggctggggtgcactggctggcatgggccggacaccctgcattgcctgggcaatcaaagctgacaacctcctcccctagcccgggttccatccgacctgtctgcctgccctgcacagttcaagtggtgcgaccctgacgagaccggtggcagacctatcctggagtgggtcctgcaggtggcgggccctggcgtgtctgaagacccccaggtgactgcgggtgacttctgtgacgtgtgggagggattacacggattgacgcagcatcgcagcaggagaccttgccaggtcaatttcggtggggtttgccgtgctttcctaccatacgccctggaaggtaccacaaaacccagccggtgcaccgctctgcttcaccttggcaatggtaacgtgtctgacacaggggctgcacaccgtctaccggggcgccgacacctcgttccttctgaagaggctggcgtgcgggactcggtacaccgcccgcgtcaaggtggggcatgcaggggctggctgggatgattctgcgtcggggtggcagggtgtgggtgtgagcctcgctggcgcccagccccccatctggcattgtgacggggagtggatgcctgtttgggcctgcaggaacaatgagttccacattgtcctctgcaggccatctcctgcattggagagagcccctggagcccgacctgctctgtttcgacaccggcggcggtgccggccgcgcccctggcgcctgtcgtcgtcgagcgcgacgccagcagcgtgacgctgacctggcacgccccgcacaacaacggcagcgacctcaccggctacctgctggagctggatgacggcgggtgcggggaggtcacgggggtgaggtggtgggattggtgtcgcgcgtcatgtctttgtgagggccactcgcatctgtgccaagcgccgctcgctgcttggggtcggccgtggggcgtgcatggctccaggggtgtcctcggctggcacgcgacttgagtggcttccacgcacacatcacccatcgctgcagcggcgatggcttccgctttctgtacacgggcctggcgctctcacaccgggccgccagcctggtcagcggtgcagtccatcgcttccggttgcgcgccgagaacggcgtgggccacagcgtgtggagcccggtgctggaggtgggcacggccgccacgaccccgggcgagccggaggggctggcgcggctgggggccaggctgacctccgtcagcctggtctggaaggtgcgtgagtgcgtcggggatggcacggaatgtcgtatcggagacggctgccacatcctgttgcccggcggggccaccctccgcaggacggccggcggagccgcaggccctgcccgccggaccacactgcctcgagtctgcatgttctgcccaaccaccgctcacgcctgcctgcccaccgcccctgcaggcccctgcgtcggacggcggctgcccggtttcgggatactcggtcgaactgaggcccgcctgcaaggcggccgcccgcaccaggccagactcctttgcgccggtgactgaggtgaggcggcgggcgggcttgacccgcggggagtgctgtgccggagccccggcggggccacgcctggggaggggcggagaggcatgcaggcggcgcggccgggcccacgtccccacaccgcctccacgaaacatgcgcccccccccccccctcccnnnnnnnnnnnnnnnnnnnnnnnnnnnnnnnnnnnnnnnnnnnnnggagtgctcgggcccgtcctgcacgctgacctccctcagccccggctgccgatacctggtgcgcgtcgcggcgaggaacgaggtgggccggggtccgacctgcgtggcactggcggtggccaccgaggcgcacgtgcccgagccgcccgggccggtgtcgctggtggagcgcagcacggagggaggtgaggagctgcggggcaggggggatgtgggtggaagggggggggggggggnnnnnnnnnnnnnnnnnnnnnnnnnnnnnnnnnnnnnnnnnnnnnnnnnnnnnnntcacgcaggagccgcaggcagggatggaatggcagtggggtggcctcgctgcgctgccctttcctcctagtcgtccacatcttgggggtgcgaggagtgcctgttctgggggggtcctcgtgcgggcgtggcccctcacagggtcgcgtgcccgctggccgggagggtcgccaggacggtctccgatgccgtcctggagtggctcctcccatcggcgccggcgtgccctgctgcgaccgacccccccccccgtcccgcctcagggctgtcgctggcgtgggctgccccgccccacgacggcggctctggcatcacagggtatcgattggagctggtcttcgccggctggcaggaggcagcggaggggaggcagcctgcgcaaggcatgggggagggggagatggggagtggagggctgcaagggggagtgggcgaggggcgcagaccgcaccaggttcctaccgagtgcacggacgcgcgcgcgtcgcatgcctcgtgctgccgccgtcctgcgcatgcgagccatgcagggccaggggaccagccccagcaccccatcagcaccacgcccgtggtcaggaccccccctctcggccccaccgaatgcgtgtgcaggcagcgaggtcctggcatgcgactcgagctcggctgtcgtgcaggccctggagccgggcgcgctcttcacggctcgcgtctgtgcgctgaacgcgcacgggtcttccccccacagcgcgccaggtcgggggaggtggcggttgtggggcggggggtgggcagctggtgtggtcttgcagtccccgagtgggcaggccctggaagcctcgccagcgagcaggtgcttggccccccagggctcaaacgccagggaaacagccacgatgcgcaccacaaacccctctccacacccagtcctacctgcccccctcttcccgcccaccccggcagtgaccctggagacggcgcccggcaggcccgccgccccagaccggccccgtctcctccgcgcttcgggcgccgatctgacgatcggctggagcgccccctacgggcggggcggcggcgtgcgcagcttccagctccgcatcgcgcccgccgctgcgtgtctgcgccccgagagcctgcccggggagccgcctcgatgcagcgcccaggcctactccggccccgccacgtcctgcaccggtgagaagtgtgtgtgtgtgtgtgcgaggggggggggggggggnnnnnnnnnnnnnnnnnnnnnnnnnnnnnnnnnnnnnnnnnnnnnnnacggcgctgcagctcgaagcgggggaggggcgctggggtgctgggtggccgaggcccggcagggcgccgccgtgctgcacgttgagaaagccgctacgcatgctgggcccgcctcactcccctccacccgtcacgcagtgcctgacctgcagcccgcgacaccctaccgcgcctgggtggcgggcgagaacgcggcggggaagggggagtggtcggcgccgctggagtgccggacccagcctgtggggccctccccaccccaggccctggctgtggagccgggtgcgcatttcagccgggtggcacggtctcgatggggtaatcttcttttttaggaaaccgccggccctgcgccactcacacccacccgactccgctccacgtcgcgcacagtcggctgccgcggcgccgcgctgtcctgggcgccgcctgcgctggacaatgggagcccggtgctggggtacgccttgcaggcggggcccgctgctcgcagggccggctggagacaggtccatgtgagcgatgcagctggagggtcctgcgtcgcacgggtgcgagacgaaagggcgcggtgcctcgagggagttgtgaatgcaccggagaaacgagtccgatggcctcgctttcttgggctgatggatccttcaaggctgatgcagactccggcatgtcgtgaaaatcccggcaggcacggctgcatctgccttttggatgttgagatgcactccatggcacgaaatgctgcgccaggcaggctgcaggtcgatcgtggtatgcctgagcttcccccccacacacccccccccgccggtaggtgaccggcctcgatcccggccaggaatgggttttccgggccagggcctggaacgaggctggggaggggccatggtcggaggtcgtcaccctggccctgccacccgacgtgccaggtgtgtgactgtggggtactcaagttgggagggggttgaaggctgtgtctttgcatggttggcagctcaagtcgggaggtggagtgtgggccacggggcaaggcgtactgtgcggtgctgcagagcactgtcccacagggcacgctcggcatttgcgtggaaaggaagtggttgagagcccgccctgccccaaagccccttctggcccagcccggcagccggcagggagtggctggtgattctccggtcggcggcctgcgatcatcccgccttccccccgacccaactcacctccccgcacagatgcgccggcgggccccaccttctccggccgcacgggcacgagcgtccgggtgcagtgggaggcccccgcccacgacggcggctccgccataacggcctacgtgctggaggcgtggcggcgcgacggcctcgcaggcgcctggacggccgtgtactctggccccgccaccgccgccaaggtggccgacctgccccccgacacggaggtcgccttccgcctgcgcgcctgcagcgcggccggggccagcgcggcgggatcggtggccgccgtggtcaccggcccgcccccgccccctcccccgccccgc

SEQ ID NO: 38172 - DNA, 68 bp, Chlorella protothecoides
ccgcggaggtggggccggccgcggaggtggacgctgccggcaagacggccggctacggctcaccagag

SEQ ID NO: 38173 - DNA, 61 bp, Chlorella protothecoides
ccctcatccccgacgatcagtgcaggcaagacccgcctaggaaggcagcccactcccggga

SEQ ID NO: 38174 - DNA, 70 bp, Chlorella protothecoides
atttgacatgcggtgaccgccgcctcaacacgactgtgcagcgctgtgactggccattcaacgagacacg

SEQ ID NO: 38175 - DNA, 75 bp, Chlorella protothecoides
gcgacaccccgcacccgagacatgacagtcgtcccggacaggcagaacaaccacccttgcctgaatgaaggccgc

SEQ ID NO: 38176 - DNA, 81 bp, Chlorella protothecoides
cctctgcatccgaaggggtaagggtatgcctgaatttcatcaaacgatttgaaaatcgtccgactccgactcaatgtccaa

SEQ ID NO: 38177 - DNA, 112 bp, Chlorella protothecoides
aaggcatccctcttatgtgatctgatgtaacgaggaagaaggaataatcgcatggtcgctcaacatcggggaagcagaggatgtgcgagcatgagaggcgtgcaagcttaca

SEQ ID NO: 38178 - DNA, 112 bp, Chlorella protothecoides
gcaaggttggcgctcagcatagtggtatttcggggggagggaggggggcaaagagaacagaacatggtacagggggtggggttgagcgtcaggcctccccccagagcttggg

SEQ ID NO: 38179 - DNA, 74 bp, Chlorella protothecoides
gcagggccaggtccgaggccgacaaggcgaaggaggcgaccgagaaggctagcgtggcggtagctcgagcgacg

SEQ ID NO: 38180 - DNA, 163 bp, Chlorella protothecoides
tggggtgcgtagcgcatgtctcctgcaggcattatgatgacaggggcgagtgtgagggagacctggcgagctgtctttccagcagacaaaggaagccaggggaaatagggctgagcaaatctgatccaagagatatagagtgcaagagactcatcattccagc

SEQ ID NO: 38181 - DNA, 330 bp, Chlorella protothecoides
tgaggaatgggacagccgctcaggagggcgtcactcaggtagacggccaagaggatcaggcaaggagagtcgtcactaccgcggagcagctgccaagagaaggcgccggaggcccagaggtggctacctcgtgtcctgcccctgggctgcaaaataaaactcgtgaccctagtatggtagaaaatcaatcccccggcgccctgcctccctaccatggccgggtgccatcctcaggtaggggttggttgtcagacagactagcctagtccttggctttgccggaaaacatctcatgctctggcaaacctccaccagcctggaactctttgt

SEQ ID NO: 38182 - DNA, 5584 bp, Chlorella protothecoides
  modified_base (1135)..(1144): a, c, t, g, unknown or other
  modified_base (1320)..(1329): a, c, t, g, unknown or other
  modified_base (3694)..(3703): a, c, t, g, unknown or other
  modified_base (5026)..(5035): a, c, t, g, unknown or other
ggcgcgccgctctccgtgggtaacgctcacccccccctgcccagcgacgaggaggcggacagcctggagggcgccgggtctgagggcagcgacctgggggcgggcgcgcgcctgcacgggcatgcgacatacatgcccaacctcggcgcgggcgtgccgggcatctccgccacacccgccagcggcgcggtgcaggacatgaacccccaccacaaggtgggggtggcagaggatgccttggtgtgttactgtgctcctgaagagtatctacccacccttttaagttccgtatcgttggctcacgacatcaccccaccacaccacaccaccccccccacacacaccacgcagacgcgccagctccagttcctactcgtcgacatcctgcgcgagtttgcggcggcctacggtccgctggtggtcatcctggaggacgtgcactactttgacaccgcctcctgggtcctcttctggctggcctctaaggagctgccgcgctcggtgctcttcctggccacgctgcgccccgggtttgctcagcccgccgccagtctgcgcgggcaggaccgcaaggcggtgctcctgcgcaaggtgcgcgaggcctacaaccgcctgctgcgggagcccaccacgctgcacctgcagctggcgccgctgagcgcggccgagacgcgcgagttcgtggcgcaggccctggcgggcatccgcgtgcccgaccatgtcaccgccatgctgtgggagaagtccagcgggcacccagccttcctggagcagtttgtggtgttcctgcagtactacagccgcgtggcggcggccgcgctggccacgggcgcgcccgcggagtcggggcccagcaccttccagctggtgtcgcacggcatggagttcatccgcaacaccgtgggcatccactccatcatacaggacagggtggaccgcctggcgccggagtacgcgctgctgctgaaggtggcgtcggtgggggggctcaccatctacgtcgacctccttcaggcacgtttgctggttcctgggagggggcttggggccagggaggaggggggggagggcatcgcaaggcttggtggacatgcaggtagcctggggtcctggacatgctgcgcagagggccacnnnnnnnnnngcatcgcaaggcttggtggccatgcaggtagcctgggtcctggacatgctgcgcagagggccacatgctcccctgctccctcccatcgtctacacaccatccccttcgcctcgaccaccccacccccacctcacacccctctctgccaaccacgaccccgcacgcaggcggcgcannnnnnnnnngtcgtccacacaccatccccttcgccttgaccaccccaccccccacctcccacccctctctcccaaccacgaccccgcacgcaggcggcgcacccgcagtcgccgagcctggagtcggtgcttgcgggcttggactacctccagtcccagcgcttcgttcagcaggacgaggtcgacgagaacctgtggcgcttctgccaggtgctggcgcgggacgtggtgttcgacatgatccccatcacccagcggcgcgactggcacgggcggctggcggcggccatggagcgcctggcccccgacctgcccctgcccccctccaccatcgcctaccactggctggaatcgtgcgcggggcttgaggtggcgcagtggccacgcgcgctcaaggccatggagtactgggagcgcgcgggcgtggcggccgtggacgcgggcacgcccgccgaggcgctcaaccttttgcaaaaggcgcaggacgtggcagaggtgctggaccgctactttgcaacacacacgcgcagcgtgtggatgatcgccggcggcgaccgcggcggcggcctgccggtggtgccccgcccgcgccgcatccactgggagcgctgcatggcggccatgggctggggcgcgggcatcacgcgcgaggggaccacgcagtgcatggtgcactgcctgcgcggcctggcgctggcgcgcgtggcgctgccctgggaggaggcctacctgtcgcaggtacgctggcgccggcgcctggccatggactggcggccccgctcccgcctcctccgcgcctgcttgggctactccccggagccggtgcacgtcgccttcgagcgccgcgtggccatgctggaccacggtgggttggtctgtgggggggggggtgagtcgcggatgggccatgatctgagtggggaggggaaagaggttctgaggtgcaggcgggaacggggttggtggagcggggggcagcgtgctcgtggggtgggcatggcagggcacagggggatgggtgaggagggcaggaatggctgccatgccctgccccgtcccgagagcggccgggtttatttcgagggtgcatgtcgatgccggtctacgggaatgggcttcctcccacccctgcatccctgaaagaggcgctgagtaggagaaagtatgttttgcctcctgacattcttcatggcccctcaccccttacaactcatctgcaccccatcaccgccacaacacatccacagactcgctattcctcatgcgcccgctgccgctggagccggcggcgcaggaggggggcccctgcccgggcctgatgacgcgcttcctgcccagcgccgacagcgacccaggggaggggtcggagggcttctgctccgacacctttgcgccctgcccacccaagccggagctgtgctcgcgcgacgaggtgctatacatcctggagatgctctgcaccgccctcctcgtctccaagcccctggacctggagggcgtgaagtacctcatgtgggtctgccgccacctcaaggtgagattgctcatggggatgggatggggggtggttggtggcaccgggatgctcgggttgcaagccaggcactggggccaagccgccttttgcggagaggggcgggtatgatcgtggtccaccaccagatcacggccagcctcttcaccgccgcgagggcggtcagcagccttcgagtgccacccgtcgaccccaacaaacacacacgcccctcgcagagcacccagaagaagaggggccggtgccgccgcctccagggcatcctggcagacgccaagaccgcgctgagtcaggcggaggcagagaagcgcatgtccctgcgcgtggcgccgctgctgggcctgtcagagcacctggccggcgccgaggcggggaagaaagcgtgagtgaagcgcaggagcgtgcgccaacggcgccgagcgttgtgaacggaggcacgagcggcgacccacccgcgcgctcgagagcgactggtagaaacaaacagtcggtcgggctgaaacagccctggcctggccttgaaacccatctggcaccccaaccccttgctagcaatgatcgtcttgtgtacaaaccccttctttctgatcctatgaacccatgcccctggcacttcatgctccagccagccccttggatccccccacgccggcgtctcattatggcggcggggcaggtagatggcttgcacctgattttaaaggaccagcgataaggccatggtcagaaggggccaagatacgggagaaattgtcggtgggaagtgaggatggtatcgattctcaaacaaccccttcttgggacagtctgatgcgtgaggtcaagactaacgtgacatgnnnnnnnnnnagaagtgaggatggtatcgattgtcaaacaacccccgccgtccttgggacagtcggatgcgtgaggtcaagactaacgtgacatgatcttacgtaatttcagggcgcccagcttctccgacaaccaagataacgccaccttctgtccacaacacatgtcttttgccctcggccggtgcgcccccaccgtaagacaccccacttaaagcttcttaccataagaataccttccttctcctcggagggtatggtgaggtgacttgctcgagcagcatggcgacggcgtccgtgaggccgaccgtggtgcagggcaacggcgccgccttctctcactctctgcgcccgcccaggcaccaagcacacgcatggcggcaccagcatggtgctcgcgatggcgagcgggccccgcgaacatgcatggtcgcgcaccggcacaccctgcccccgctgtcggccttccaccccttgctggccaccgcagccgacacgggcgactttgccgctcccgagcacaaggagtttgacgtgctgggctggggccaggccatggtggacttttccgcccacgccagcagcgagtacctggaggagctgggggtgcagagcggcgagcgcaggttggtggcttgttttggtggagggttcgtgtgcatgtggcctgcctttacccatatcaatggttctgtacctcttccaaaggtctgcatgacgccctgacatgttcaccctcctgcccggccatctcatgttgttttctcctcctcaaacaaacaggctgatcgaccttggccggcgcacctccctcctcacgcagctcagtgagggcgggtatgcggtgcacgccgcgggctccctttccaacaccctgctggccctggcccggctctccgacgcctctgcacgcctgcatggccgcccgcccctgcgcgtgggcatggccccgctgctcggctccgactcactgggcgccttttatgctgcctcgctgcgcggcgcggggctgggcctggtgggcgacccctcgccgggctccagcacgggcacagtgatcgtgctgacgggggaggacgcgcagcgcaccatgctgtcctacctcggccacgtcccggcgctggaggtgagcgacgagttcgcgcgcgccatccgccgcagccgactgctggtcatcgagggttacctgtgggagatgcccggcgccgcggcagccatcgaccaggtggggagtcgccgttgagagcggggttgtgggtggctgggtgtagtgggctgaagtccaccggtctttgctgcgactgtcagtgggagactgcagggaggctaggannnnnnnnnntagtcgccgtcgagagcggggttgtgggtaactgggtatagtgagctgaagtccaccggtctttgctgcgattgtcagtgggagactgcagggaggctaggaagagctcgagctctcatgttggatacgtggagacttctcgtagaggagggagcccctctcccccagcgtcatatccctgcattcccagccatgcccaccaatccactcacccaacctgcaggcgatgggcatcgcgcgcgaggccgggacgctcatcgcgctgacctcgggcgacgccggggtcatctcgcggaaccgcgaggcggtgcgcgcctgcctggcgcgccacggcgcggatctgctcttcgccaacgccgccgaggcctgggcgctggcgtctgaggacggcgcggcctgcgcgccgagccaggacctgcccgcccgcgccgccgcgctggccctggcccccctggcgggcctggtgtcggtgaccgacggcagcgcgggttcgtgcatcgcggccctgggcgcggccatcaccgttccgccgccctggagccggcggcc

SEQ ID NO: 38183 - DNA, 107 bp, Chlorella protothecoides
ccgccgttcccaaaaccaccaggtgtgcgacggggggggacgcaccgctgcccacccccatgctggagccggaggccgaggggcacctgggctttgaccccgcgtcc

SEQ ID NO: 38184 - DNA, 61 bp, Chlorella protothecoides
ggaggacaaggagctgcattagcgtccgttaccttgcccagcaatgcggtttgattcagag

SEQ ID NO: 38185 - DNA, 92 bp, Chlorella protothecoides
tcatcgggtggtcagggaggcaggagggaaggcatgatgagccgcgccgcgcggtgggtgcccatgctccgataccatccctggtcaccccc

SEQ ID NO: 38186 - DNA, 164 bp, Chlorella protothecoides
tttggagataagccggaacagtggagccacaatgagctgcattggatcacaccgaggcctgtaagaatatctgaacaagtcatcaaaattgaactatgaccctcgtcggcgtcaatggcatgaacctccttcctacctgtgctttgccctctgcctgattttgg

SEQ ID NO: 38187 - DNA, 551 bp, Chlorella protothecoides
cgaggccgcggcccttcgccgcgcgcgcggctccgctgccgctcgcggcggcgccgacctccgggcccgtgtccccgtggccggggtcgcgccccgatccctccttgccagctgcagcaagggggggaggtgaagcgggtggtggggagggagaggtgtgtggcggtcgtcgcgtccaggccgtgggccacacgacacggtacgggaaccagtggctggccgaggtcagtgggagcacgcgcccaacaatcggcaagccacaccgcagaccccgctcccctcacccactccaccccgccgccccgcccacctttccgcttgcgcacggggccagccacggggccgacgcccgcgccgtcgtccgggacctggcccagccggtccaggcccagcttgctgcggtagttctggtagtagttcttgatctgggtcagagtcttggccggcaccgcgcggcgcagcgcggcccagtcgcggccccagccctggaaggccgcgtagaacgcgtccttctcctcctgcgtccagtacgacgtctgggcgcgcttgcc

SEQ ID NO: 38188 - DNA, 73 bp, Chlorella protothecoides
cggcaagccacaccgcagaccccgctcccctcacccactccaccccgccgccccgcccacctttccgcttgcg

SEQ ID NO: 38189 - DNA, 64 bp, Chlorella protothecoides
catgagttcatcctggacatcaggtgggggaggtgggggtcctggcctgcagtcatgcagctcg

SEQ ID NO: 38190 - DNA, 61 bp, Chlorella protothecoides
agccatgaggagtggcgctggaattggcggggccaggggcatgcgtcccactgcaagccct

SEQ ID NO: 38191 - DNA, 180 bp, Chlorella protothecoides
agccgccctgctgctgcatccaggggttctcagagtctcgccctcctgtactcgccggcccgagaacagcacggcaaatcgcaagtccatcctcgcagcccgcatgcgggccccctgcccatccccccgccgccgggatcaaaccctctcacctggagcgcgagagcgagctccggatcg

SEQ ID NO: 38192 - DNA, 61 bp, Chlorella protothecoides
ccggcactcgcccggcgcggcgccgggggccggcgaggtgcctgcgggggccgagatggcg

SEQ ID NO: 38193 - DNA, 61 bp, Chlorella protothecoides
tggtaccggtgtccaggaacccagtgccatctgggatgcttcccggatgaagtgggcacac

SEQ ID NO: 38194 - DNA, 73 bp, Chlorella protothecoides
ccgggctatggaaaaggtgccaggggtgcgggctttctgcagcgccaggatgtaggaggtgcggccgaaggag

SEQ ID NO: 38195 - DNA, 99 bp, Chlorella protothecoides
attcccatctcgaaaaaggtactgaggttgttgctgtattcctttgccccgacccagaatggcgcacagttgcacggtgcaggcacaccatgctttgtc

SEQ ID NO: 38196 - DNA, 17853 bp, Chlorella protothecoides
  modified_base (935)..(1032): a, c, t, g, unknown or other
  modified_base (1161)..(1170): a, c, t, g, unknown or other
  modified_base (2278)..(2287): a, c, t, g, unknown or other
  modified_base (3524)..(3533): a, c, t, g, unknown or other
  modified_base (5360)..(5369): a, c, t, g, unknown or other
  modified_base (6214)..(6223): a, c, t, g, unknown or other
  modified_base (6811)..(6820): a, c, t, g, unknown or other
  modified_base (7066)..(7075): a, c, t, g, unknown or other
  modified_base (8056)..(8065): a, c, t, g, unknown or other
  modified_base (8802)..(8811): a, c, t, g, unknown or other
  modified_base (10244)..(10253): a, c, t, g, unknown or other
  modified_base (10794)..(10803): a, c, t, g, unknown or other
  modified_base (11502)..(11511): a, c, t, g, unknown or other
  modified_base (12039)..(12048): a, c, t, g, unknown or other
  modified_base (12722)..(12731): a, c, t, g, unknown or other
  modified_base (13081)..(13090): a, c, t, g, unknown or other
  modified_base (13494)..(13503): a, c, t, g, unknown or other
  modified_base (13959)..(13968): a, c, t, g, unknown or other
  modified_base (14369)..(14378): a, c, t, g, unknown or other
  modified_base (14487)..(14496): a, c, t, g, unknown or other
  modified_base (14875)..(14885): a, c, t, g, unknown or other
  modified_base (14988)..(14997): a, c, t, g, unknown or other
  modified_base (15397)..(15406): a, c, t, g, unknown or other
  modified_base (15775)..(15784): a, c, t, g, unknown or other
  modified_base (16206)..(16215): a, c, t, g, unknown or other
  modified_base (16661)..(16670): a, c, t, g, unknown or other
  modified_base (16935)..(16944): a, c, t, g, unknown or other
  modified_base (17474)..(17483): a, c, t, g, unknown or other
  modified_base (17557)..(17687): a, c, t, g, unknown or other
ggccggggccacgccaggcggcggcgcgcgcggccaccgcggccgccaccacggcctccgccgcggccagggacggcaggtagcagcgtgcgtctagggggagggaggccaacgggtacatcgcaatggcgtcgcgcaacgtgtcgccgggggcgaggccgcgacggcggcgagcccccgcgccaatatcaaactcaggcgcctccgcgccgtcggcgcgacgtagcgccagctctccgacggctgccaggtcggccaccaccgcggccagggcgccggaggcgcagggttcgccgccgctgcctcccagcgtgcgcagcgtggccgcctgcaggtcgcgccacggcagatacgaatggccctcggcgttggcggccgctcccaggcactccagcgtgcccgccccggcccggctagccaggtccctccggcaggcgaggcgcgcggccacggcgtccagccgcgccaggcccaggccgcggccggaaagcgcggcgtagggatcgcaacgcagcgcggcctcgaccccggagcctagctcctcggccagggcctgcgcgaccagcgccggcacgcccgcgcccttggcgaagaggaaccccgcgcggctgcctcccagcgcgtcccatgcggccttgatgcgcgcggccttggccgcgccgacgccggggcagcggcgcaggcgcgccactgcgtcaggcgccgacagcactgactcgatctccacgccaaaggtttcgaccagggccttgtgatagtgggggggggggaggggggggttggtttggtggaatgggggccagtttaggacaactcaatgagggaagggttgtcactgaggagcgagatggacatggaaagacaaggcttgtggtgctattcatgcagtccatcccatccagggagtcatgcatgggcgagcccaggctcgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaactctgccaaaccagtgccttccccccaaaaagccgataggaagacacaaccccagacaccttggcagtgacctgccccacacccgggagcacgccgctggcgaggtagagcgcgagctcggcgnnnnnnnnnnaggggttggttggtttggtggaatggggggcagttcaggacaactcaatgagggaagggttgtcactgaggagcgaggtggacatggaaagacaaggcttgtggtgctgttcatgcagtccatcccattcaggaagtcatgcatgggcgagcccaggctcgagcaccaaggcagcaacctcctctggttcccgcagttttccaaaggaaagggactgtagcaccatcaccaaccaactctgccaaaccagtgcctcccccccaaaaagccgataggaatacacaaccccgcacaccttggcggtgacctgccccacacccgggagcaccccgctggcgaggtagagcgcgagctcggcgtcggaccgcggcgcgacctgcaccgcctcgctcaccgccagctggcgcccatactgcgggtgccgcttccagcttccctgcagctgcagggcctggccctcggccacgtgggccagcgtgcccaccacggtgatggcctccgcgccgcgggggctgtcgatccgcagccgcagcacggcataccccgtctccgtggatttgaaccacaccttctggaccacgcccccaacctccaccacctccccctccgtgctggcggcggccagggcggaggcggcccgggcatggggcttggttccaggggaggtgcttggtggtgcccgtgcgagccaggggctggcagcgtgcgacgtcgatgccggcgaccaggcgctgtgatttcgaaagcatcgagctcctgctgatgcatgccggggtgcgtcatgccgcgtcctgtcgaagttcagccatggagccagttcggtgccgtgtgccctcgctcgcccggaggtccacaaggacgggcttcccaggcacagggagggcctgccgaggccccaggatccatgccagccgtcttgggtcttcaccgcatgcatgaaagagagccagggtctcatctcccctccaaacacactgtcagagacaggttcgcgccagtactggagagcagccgcatgacaagcagagacccacttggtcgatttgcaggacgttcttattaaccgaaattcatgccggtacgtcgtggttactcgcgacgctctgtnnnnnnnnnncgcagatcgttcttatcaaccgaaattcatgctggtacgtcgtggttactcgcgacgctctgtatgccgcatgaagattcaatgctctggagatcgtgcgccccaaactcccaagccatgcgcagcacgacggatgcatgcgggttttcgatttcgaatagctcagcaagtcgtgctgatcgacgaaggaccaggcgatcgcgaatagattcagtgctccagctcatcgtctgcgcctgtttgataagggagagtgcccgcatattggcatggcgtctcggagcgctgttgcggaatggacgcctgaggaggtacgcagcattgcaatggccctaggagaaggggtcggcgatacaggcaagcttgcgccaagcagctatcacaatcatactgcacaacccacagatgtatttcctggccaaggatgagctcatcaccatcgtcccaaacttctctctgctaacggagaatggcactgcacaatgcatcggggtgcgatgtgaatgtgcattggagggttgaagaacgcctacatgctgaacgacgcagtgaccctctccagcggccccttttaaaagttaatctgtatgccatacccctgtgtagggcgagttcggaccattcctaccaaacagagagtgcaaggtgcccctctggctagccctcactctgtggaagaggaaacggtgcacaatgaaaccacttccctggatgaatgtggaccacttggaaggtgtggacctggtgcttgtgaggttgctgggaggttcaagtgcatgcgttccatttctctcgcccacaggttggggggcttagaatgggcatgcaacagagctgcttgcctctaacccaagtatcagaagcagtgcccgactctaccacctccccctccccacaaattctcccagctgtcctcaatctggatcgaagagatgccacggctttccagcccctgcccttccactacattgagatcgcacactttctgttcactgccggcaccgacgaggcgctggcctctggaatctttggggacaatctgacgcgagtgagtcttggcttgcagggttgcaaggatcacgctggtgttggagcttcagcagccaggggtgccttggtgcttggtctcacatatctgtgggttgctgagattatagcaaaccgatgccaaagagcatcaattctgtcttctgtgtccccccccatcaatgtctcctctccccttcagatcaaggannnnnnnnnntatggagcttcagcagccacggatgccttggtgcttggtctcacgtatctgtgggttgctgagatcatagcaaaccaatgccaaagagcatcaaattctgtcttctgtgtcccccccccaccaatgtctcctctccccttcagatcaaggacctcgtggagttggtacagaaggcgagaatggccaaggtgctggccggcctgtccaccctccagggagccatgacggtgaagctgaacaacctggctgccatggagatcaacgcagtgcgccctttcttcctgggagcactcgacatgttccatgagtaccaaaaggtgtgctctttgagtcgggggtgatcatggtggagtgagcctgcctgcactcatgcttgcatctgggcgacaaaatgcactcaggctcagcaaaggccagacttcccgctcccaccccccatgacacagatggacgaggcggggctggatgcagggggtgcctcgcagggtctatcccagtcccagtccatgcgatgatgttgtgagcacttttggtaaatgacgcaaagaaatacaaatttccaactcttggtgtgagggccctgagacacacacagtgctcctcaccataagaacttgaaatggaaatgattcaggggttatgtgcgtccttgcatcccaatcagccagcaggaagatctgagaacttccttgtccatatagacttccgagcagctcccatgggacacatgccctaagcatgcacatggcatgccaccgcatgcacagatggagggttactcaaatcatgctccttacccctcctcctatgaccccatgatttgatgggcgtgcaggaccccgacgctgacgctgggcatgggaaccgggatgatcaggggacctggtatggcgaggccgcccggcggactccgaaactgctggagctcccgctgcctgccctctccctcatcttcgacatcgccataaagaggcatcgcatcgaggctcggttcctgaaatcgccggcggtccgatcatgggagaaggatccccgcaagtgaggcatgagtgtgattctcttcgtgacgacctccaagccccggcccccttgacatgaacgccagggtgcccttcccccgaccaccctcccaaaaccagcaccttttccaggccttctgccctggcctacttgccatcaacattgcctcctctccaccctttctcatgcagcacactgcccctcctgtgcaaggccgccccggcggcctgcctggcggcggggctgtggcacgacctctccatcaacctgtccagcatcacggcctaccgccgccccgtcttcgagggcatgatcgccgccaggctgggcaccgcgcgcgcgctggacgtcagcccccccgcccgcgtgtcctttggcatcggcacctggaacgcctggctcctgccccacctcaccgcctcggccgcgccagccctgcagcggctcacgctgtactacctgcgacccgaggacctcaacatcccccagctgccggggtcggtggaggccctggccctgcgcttccagggcagcgcggcggctgacgaggacatgctgcaccagctgtcccgcctcccgcacctgacttcgctggacatcagggtcacgtggtgggtttgcaaggtgtttgacggcagggcagggtgttgactgggttcgatacgatgggaaaggagctgctggacggcctgagcggttgaggttccctttcctaggtgcatgtgtccctcggcaacagcccacaaccgaaaatcagttgcgttcctcaaaacaccctcaactccaggcccaccctgcaaacctgcnnnnnnnnnnacaacagcccacaaacaaaaatcagttgcgttcctcacagctctctcaactccaggcccaccctgcaaacctgcgtaggcctgcgctgctggccgcctttgggccagcagccgtgccggggtcctggagcctcatacgcaaactcacgctgcgcgtcggcgagcccgccccggcgggcctggatgcgggcgaggcgctccggggcctctctgaagcctgcccccgcctgacctccctggccctcttcctccccgccatccagctccccgcctccctcgccgggctgcatgagctgcgccgtctggcgctgcactccccagaggcgctggtggagggcctggaggccctccaccagtccccgctcctgctgctctcggtggcgggggtggcccgaccccccggcctgtcctcctcctttcttcgcctggagctgccggagagcaggctgcaggaggtcatggaccagctggggtccctgtgcagcctgcgctgccttgcgctgcgcggccgcatagcgtgggacacgggtctcacacgcacgctgcgccccgcctggccgcgcctggccgtcctccaggtggcctgccactcgacagtggatgtgcgcctgcccgccggcctgcgggtgctgagggtgcaggacaccgacggcgagcagatgatgccgggcggcaactttggggccaagggacgcctggacctgtgcctgcctacgagcttgcaggctctggacctggtgtccagcaggcggggcgtggagtggcaggacaaaaggaaccccggcaccctgcgcctcctgggcctggccaggcattgcagggtgcacccagagctccctgcagtgnnnnnnnnnngaaagggaaacccggcgccctgcgtctcctgggcctggccaggcactgcagggtgcacccagagctccctgcagtggagagggtggtgcacagcagcctcgatttctgggagggagcggcgttgctaccggggatccagctgtcgccggatgagctggctgtgctcatggacactagggaggatgcgtaaggagtcaggatggatccccaatgtgtaatgacagcccacatgtttatgaccctggacgtcgaaacctgtcagccggcgagcgcgcgctctccgaaaacgtaaaacttccgacagtgcagcacatcccttgcatgccgacgccttggggcagtacagattctcatgcatgctttctgagaatgtgaagcatggggtaggatgccagagcgatagcaatgccggccctgccggccgtcagggctcatgggaggagcaggccagggaccgagccgcgccgcatctacaggctgatgggtcgcgaccaggaccacgaatacaagatgtgagattaatttgggtgcacgggagcgtgccatagccatgaattggccgcctcgatgtacgccgaggatctcacnnnnnnnnnncgattaatttgggtgcacaggagcgtgccatagccatggatgggccgcctcgatgtacgccgaggatctcacaccccgcattccataggctgctggcctcgacagacttcagggaggctgctgtcgcccagttcacactgcaagacgtcatagaagatgctgtgagccttgtataatgatgcttggttgtttccctgtgtgctgatgacgcatggtgggtgctcaactcactgcatcattccgtcnnnnnnnnnncaggatgcttggttgtttccctgtgtgtttatgacgcatgatgggtgctcaactcactgcatcattccgtcagtaaagaactggaacctggatcacaggaggagcgtggaggggtggtcctgccaccagcgaggatgctggacaagctgacggaggtgttccatggagcaggagtggatgtggggggcaccgcaacaagctcctgtacgtgtgcctgctggaggcagggatccttgctcttgttcctggccacgctcagttagagagaaagcacatcctctctgcagggacggtcacggccaaggtggaactccagcagggtctgagccagagcgtgcggtgaggtacagcatgggccatgcggattcagtggttattgaagccttgcatggaggtttccgtgatatctttggctggaagaagactacctaccatgcagatgttgccctcgtgaagggcgaggcatcgggacccgatctcatgctccacccccgctgcaggcttccaccccaggcactcagcacaatcgttgctgcagacagggtcccagagtttgtgtttggtgaggagaggcacgttgttggctgcatgccttgggtcccatgctcggtcagtcccagttgcttgctcctgccagccactgcaaagcagcggcgagggtctgagccaggctccttcatccttgtgcaaccccttgcagacctgctggcacccctgcttcagagaggagcaagccaggaccagctgacagatgaggagctcgaacaggctgtagagtccgaggtaggcagctccgccggcatccacacatggatgatgggcgggtccgcacggcgtgccacacgctgcagcatgtgcacctttggcgatgcaatgcctgtgacccccgtgcctccccactcccacgcctgatatcgcacagatgtcccgagtcctgagacacatccagcctgccactggcagcgaagggctgctggaggnnnnnnnnnntgcacggcgtgacatacgctgcagcatttgcacctttggcgatgcaatgcctgtgaccctcgtgcctccccactctcacgcctgatatcgcacagatgtcccaagtcctgagacacatccagtctgccactggcagcgaagggctgctggaggagctacactacatcgacaatgacatgtcgccgcccaagaagcttcgaatggatgcatccgcctcagagccgtgcagcccaaaggggcccgactcccggggctgtacggaggcgctcttctcggaggaggccagcgtgccttccacccagtctcagcccgtcgatcagaaactggcggtcgagggccatctgtcgccatcgcaggaccacacaaagccgagggtcgtggctagacattcccgccgccagcgaatgcttggtgctggtcccaaggcaaccatcatccgccagccccaatgacacctggcgacagacagcgacgtagcgagcccaccttccttgacgtctgcagattgattcgtgaccaatctgaccccctcctccttgctcattctctccaagctttgacccctaatgggtgtttgccgaccgagacatctgttcaaatggtttcaaaagcatcgcgacgatcttcagagcgcgatgttagatacacatatgccacgcgctgagccacgacttcaatcttgttttcactcgtgcacggataagaatatattctagctccgattacatcacgcccgnnnnnnnnnngcttgttctcactcgtgcaaggatagaattatattctagctccgattacatcacgcccgtaaagccgctcgacgaccgatcgctgtcagctggggcctccacggtggacgccatgtccgccgtggaagcccatgtacagcagctcacggtgcgccagcaatacctgatgggctggttctgtcttagagatagaaaataaagagcagtctcgtcacaggatccacctgacgatcacatttctgcgcgcaggtgacggagctgccctcctcactggcttcgatcctggcccgatttcccaacctgaggcccgccaagaaggccccgaatgagccgaggaccccttcaaaggggtacggcgtacaatccacccagcgccaagccctggcgcagggcctcgtcctgctcatgcagcgagcgtccgacctggacaccccagacctcacccaggtgccatggggctctcgaggattcagtgtgttcccctgcccctccacatgccctgcgatcccactgcttcccaacccaccgcccatcaccacgctcccctggcccctcccgcgtccagctgtgccgcagcgccctccaccagacttttcagcgggagccgtggatgtggtccctgctcctgcagcggcacgccgacctggtgctggcgcacgccggcgctgccagactgctggcgggcgtgctttcctccctgccggacgccatgcaggccagggccctggagtcgctggcggggcacctccaggcagcagcgacagcgacggctgcggccacgggagcgtccgcacgggatggcctggaacccttcctggcgctcgccctgaatgtcctcgaggctgggttcccgggaggcttgaagggcggcgggaggggggaggctgaagaggcccaagatcctacacaggacacaactcagccccccgacttccgccccagccccgcctccgcgcccgccctccgcctgatcctcgtggccgggacggccacgaccagcctgggacgccggcgggcaatccgggcgctcgccgcgcagctgtcctgtgccgccacggtcgcgcgcatcgtcggcgcctggggtgagggccgggcagcgcagcgggcgcggcgcatccaggccctggccctgctgctggcgggggactgcgcgagccgcgctttccagccggtcacggaggaggcaggggctgtgcagggtgccaggacctcgctggccgcgctttccaccctcctggcggtgcactgggagctggcgcagtacctcgccgcgctaggtatgagcggtggggcacttctcatgtacgaggacccttaatttgttcctgccatcgtgtcagatgagtggggtgcggcgtagcgccacgctgactagctctacctcctccatgttcccactcatgtccccttccacccctcctcccctaacacannnnnnnnnngattcgttcctgccagcgtgtcagatgagtgatgtgcggcgtagcgccatgctgactggctctacctcctccatgttcccactcacgtccccttccacccctcctcccctaacacacacaaaagaacccccctctcaccaggcagccggagctccgacgcggtcgactggccgcccccgctgcgagcccagatcttgcggctactcctggacccagacggcgtcggggcccgccaggggtcccgcatcggcctggcgccaccgctgctggcccatgcgcttggcctcgtggctcagggcccccttgcgaccggtggagaccacgctgcgcatgctgaggccctgcgcctcgtctggcaggggcactgcgcctgcatccaggcgagtgggtgagagtcagaaggttcttcctcgggagggtgccgcgggcggtgccaggttcctcgggcacattggcgagtctcctggaacctgggtcgggggcattcctgccccctcatctcacacatctgctgccggctattccccctctcatgctcgcnnnnnnnnnntggggcactgcgcctgcatccaggcgagttggtgggagtcagaaggttcttccttgggagggtgccgcgggcggtgccaggttccttgggcacattggcgagtctcctggaacctggatcagggcattcctgccccctcatctcacacatccgctgccggctattccccctctcatgctcgccaattccctgtggtcccatccgacaccaagcccttctgcttttgcagggcctgacggcgccacacctggtgctccaccccggggtccgacacggcgggccagcgctgatgactgcctaccgcctgcacgacgcgctcgctggggcggggcggccgaccgtggtgcagaagagccagcctaccccaaagggcacaggcaaggcgacaaagcggcagcggcaggcacaagaggcggcggcagcccctccccccgacctgctcgccctcctcctgggcggggcaggggcagggcatcagtcacagggggaaagcgcgtcgcagtggggaggcgcccgcgacgcgcgtctagcggccggcagggtcccagaagaagcggaacgacccctccccagcaacagggcgagcatggaggaagggagcctagaggcctctgcagtgcacccactcctcgcgatgggtgatgctgccttgcaacccatgcagggcaatgggcaggttgccacccctgcaccccttgnnnnnnnnnncctgcagtgcacccacccctcgcgaggggggatgctgccttgcaacccatgcagggcgatgggcaggttgccacccctgcaccccttgacctcggtacagaagagctgcatgccggggaagcaggactgccagcctccagtgagcccccgcggcgccgaatccagcctcagcgcctggatgccgagctcccgctgctaccaatccctgcgccaggcccgccctcccggggtcggagtggagcctccggcgagcagccggactccgactccgggtctctcccgccggcgcgggtgctgatgcgccccacccccgacatgggcgaggaggagcgggaggccatgtgggcggcctacatcgccgacaaggagtccatgctggacctgctgggggtgagtatagggtggcagggtccaagggggctcgggggagggggcgctgccctataaattcacctgcacagcatatggcatgtttcaggctcagcaggagctcataccatacatctttccttcttgaagcgccttctnnnnnnnnnncaaatttacctgcacagcatatggcatgtgtgaggctcagcaggagctcatatcatacatctttccttcttgaagcgccttcttcccctcctcactccaggacgcccggtaccgggactggttcgacgaggactccgcgccgccccccgccgcgcgcggcgggggcggcgtggatggcgccctggacgccgcgttcgggggcgggacggcggacggcgctccggcctccctgcccgcttctttcctggagaccagcgtggccgcgccgtggcagggcgccggcgccgcctgcctgggcctggccctgtgcacgctgcgcgcctgtgacggcgcgggggaggtctatgccggggacaaggttggggcagcgaatggacccctggcctgggtccaggccctgctgcccccactcgagggaagtgatgccgtggcgctgggggtgcaggccgcgctgggcctgctgggcttccagagccgcaactgctggacggccgccatgcagggtgaggggggtggaggggtgagggggtggggccgtctgctctgaactaggctcggatcggcgctcggtccctggactctgtgctgttcaggggcgacctgtccacatccctctcctgcccatcgacgccccactccgtctcacctgccccgccgcaggggcctccagttgnnnnnnnnnnatctgtgctggtcaggggcgacctgtccacatcgctctcctccccatcaacgccccactccgtcccacctgccccgccgcaggggcctccagttgcccgctgggcatggtggggctgacccttgccctgcacctccacgagctggtcacgcgacgtgcacgctgggccgcgccggtgtggctggaagctgtgctgaagctgctctgctggctgatgccactggcgcgacaggaggcgaagcaggctgctctcgcgggtgggtcctcaagttggggcgaggggggggttcagtgcgggggttatgggtaggtgcgccaaggccctgcacccagtccgtcgcactgttgcannnnnnnnnnagggggtttcagagcgggggttatgggtaggtgcgccaaagccctgcacccagtccgtcgcactgttgcaggattcagtgtgccgtccgtgatcctgctttcctcccacacacaacctttacagagcgggtggctcgctatgcgccgctggcgctgctaccagacatcctacgagaggtcctgagtagcacccgcctgggcccatccaacctcaccccatcctccgctactgccctcctggacctggaagcgaccccgggcagagccccagagctggcggtgcgtgggtggtggcatgagcgatgtgttgtttcagacaagtattcttttggcttgcacgaggagctttcattctaccaagtccctcacagtgcaggtcggcctgggcaccccctccctgcatnnnnnnnnnncggcagagccctagagctcgcggtgcgtggttgctggcatgagcgatgtgttgcttcagacagggattcttttggcttgcacgaggagctttcatcctaccaagtccctcgcagtacaggtcggcctgggcaccccctccctgcatctccgtgtcgaccacattcgcaagcacttctcctagtaaccccttgcttacaccctcacaggacaaggctgtgacagtctgggcatcactggcctggctcgccttccatgctgcagggcatgcagactgcacggaggaccccttgccggactgggtggtggaagaggcactcgaccaccctgtggtgggggtccggggcgacaccctccgcgctgccctggattggctgttccgccgcctggcggcggcagctgcgggatggacggggattgcaatcttcgcgacgcccgcagacccacagacggcggannnnnnnnnncgtggtggggtcccggggcgacaccctccgcgctgccctggagtggctgttccgccgcctggcggcggcggctgcgggagggacggggatcgcgatctccgcgacgcccgcagacccacagacggcggacgacgcggcagcgacaccagctacgacggcttcggccctgctgccggtgtgggacgtggcggccacctgtgcgtgcgaggtgctgctggacgccatggggggggcgccatgtcgcgacctggggcgtcgcgggaaagcgagggccgatgcgagtccgcgtcggccgccctctccgtgcgactgcgagccggcgggtcgccccatcgtgcccggcgctgccccgccggccttgctggtgagtggcgccctggacctgatggcagcctgcctcnnnnnnnnnnggctacgacggcctcggccctgctgccggcgtgggacgtggcggccacctgtgcgcgcgaggtgctgctggacgccacggggggggcgccatgtcgcgacctggggcgnnnnnnnnnngtcgtgcctggcgctgccccgccggcctcgctggtgaggggcgccctggacctgatggcagcctgcctcgcctgcgcccgccggcccctcgcccgcctggctgccgagctggatgcgctgacctgcgctcatgcggggcggggaagccgggacccgcgcgccgccaccccgccccacgctgcgcacgctgcggcggaggtcctggccctgagcctggagctggccggcagggtgggggggtgcctcgcggtacacgaagcggcggcgctcgaggcgcgacgcctgctggaagaggtgatggggctgcaggcggcctgcgccgagctcctccgcacctgccccgaggcctgcgtggcggcgctggcctccaccgccgacnnnnnnnnnnncctcttcgatccgggggagccgggcggcgcggacggcgccgacgccggccccgcgtcgccggaatcctcgggcgccgacgccccgcccgctcagccggcgccnnnnnnnnnnaccctggggagccgggcggcgcggacggcgcggatgccagccccgtgtcgccggaatcctcggacgccgacgccccgcccgctcagccggcgcccggcgccgggcggaacgcggcggcccggcgccgtgccaggctggccagggtgactaacccttatttgaaggccgtgctgtgtgaggaggggggcgagtgcgtgggcgagggggagctgtccgaccttgaggactttatcgtcgccaacccggagcgagactatggctccttcatcggggcccatttcccccggccgcacgagagcgaaagcgaggagggcagcggggagggtgctgccccaccacaggaccatgactgacgagggaggggaggagcccatcaagtccctgggctcgtctccccttnnnnnnnnnngccgcaggaccaggactgacgagggaggggaggaacccatcaagtccctgggctcgtctccccttgcattcaatcatgccgcatgacaacgctctatacactggggcgcagaccataagatactttcgcattgctgttgctgacgcccatgtgacactgaggctttcagaagccgttttcttctcgtatcagtcgctgggtcccattccttgaggaaacagtgaaaatttgtttcgcaacttgatgctgtcgggagatgatctaccacagcacgatgcaatcggcgcctccggccacggccatgatcagcaatgcgctatccaaatattcctttcgacctgctgattgggacagccggatcgagaggannnnnnnnnngccacagcacgatgcaatcgacgcctccggccatggccatgatcagcaatgcgctatctaaatattcctttcgaactgctgattgggacagccggatcgagaggacttccgcgtgatccatcagcacttctgcacagcccctattcgacgccatgccctggcatcggggtctggcatgcttgctcattctagttctcgccgcgactcccgtacttgcaaacgacagcacttcaactgagtctctgaataaattctgcatcgtcgtgcggacgtacaggggtcatgcagacgcggagactgggctgccgcgcctccttcgctctctgcagcgtcagagcttcagcaggcgagtggtgccgggatggttccctttgtgcaagtcatgttggactgcccttttgtgagctcttatgacggcctgnnnnnnnnnntaggcgagtggtgccgggatggttcccttgtgcaagtcatgatggcgtgcccttttgtgagctcttatgacggcctgtagacccgatctctcattcccaaaccccctgcagatgggaagctgtcatcctggtcatggatggagctgccttccctgagctgcacagcatagtggccgcgtctgacgacccccgcatctgggtctttgcggagtgggtgagtagcagagagctgccgtggttggtgcatgggtaaagtgcccgggtcctccttccccttgacaagtatctctcatcaagccctacagcgcacccatcttcgcacagattgggcccgactttgcagccaagacggaggatgggatgtggtcgccctactaccatgcccttttatacaacctgacagacgatgcagtgtttggtgggccaacgggcagtggcatccatgnnnnnnnnnncactaccatgccctcctgtacaacttgacagacgatgcagtcattggtgggccaacgggcagtggcatccatgtgaatcacgctctgtggctccgggggctgcatgaaatgcaccacccatcacttgctacctcagtgtctgaccccctgatccactgttacaatccgtccgttcgcttatcccacgttgggattttgtccttgccgtttctctctcagtgtccatgaatccacccccccagccccctcctccctccgccctgcnnnnnnnnnngcatgcaccacccattacttgctacctcaatgtctgaccccctgatccactgttacaatccgtcccttcacttatgctacattggtgttttgtccttgccgtttttctctcagtatccatgaatccaaccccccagccccctcctccctccgccctgcagcctgccccgaggacaccacctggctgctggtgaccaacggcgacaacgagtacgccgactccttcctggcccgcgcggcggccgaggcggcgcgcggctcggccgacgtcgtggccttcgacttctactcgcgctaccagcgccccaccgcgccgcagtgcgaccgcctggccacgctgcccgcccccgcccccgcctgcaagcgcaaccgcctggcctggtgccacaccgacctgggggcctacgtgctgcggtacgcgcgcttcctgcgcgagcggcgcggctttggcgcgggcgcgcgcgccgtagcggcgccggacctcggcgcggagcacgccgacggcctgctggcggcagcgctggcggccgnnnnnnnnnnccgcgcacgtcacagacgcctgcctgttcagccactcgccctcgccgcaggcctgcgcctggggcgggggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgggggcggggcgtgcgtgtcgcgccaggacctcgactggatcatggagcacgacccgggggcggaggtggtggcggtggccctgtcctctgatggcgacatagcaggcaggcggatggggggggaggagaggggtgtggtgtggatgtggtgtgggggtgggc

SEQ ID NO: 38197 - DNA, 61 bp, Chlorella protothecoides
tgtatacttgtaaaggatgatgacgtcgggggctccagtcacgaggaaggtcccgccaccc

SEQ ID NO: 38198 - DNA, 61 bp, Chlorella protothecoides
cgagcgggggctgctcggccgggcgcaggctccgccccgccagaccacgccggcaccttgc

SEQ ID NO: 38199 - DNA, 243 bp, Chlorella protothecoides
cgccagtcacaaggatcgttggattatggaagggccagagagtgcggccggggagggaacggaggagccggcgccgaagcgcatggcaccccagcagggccgttgagcacagcatgagggtcccctgtcttcgcagagatactaaccaaccaggcatggcaggctcgcggtacctcaatctgttccgcacaccctttctgagcctctcctgggccccccctctacctgctccttgctcagctt

SEQ ID NO: 38200 - DNA, 97 bp, Chlorella protothecoides
cattggaggaggacaccgagcggtactgcctgtgggaggaaggccgtggctccccatgcatccccgctgtgattggttggtgttgggcaaagggttg

SEQ ID NO: 38201 - DNA, 606 bp, Chlorella protothecoides
agccacgccgcgggtgaggcgcggggtgggagaggggaatgcctgtcggttggagttgggttttgaaaggggggggggtggtacacacagctggacgcattgcatgtggtgtctggggactgcacgcgcggtttcggcggcgtgaccgttcttggtccagcagcccctcgaccatttcgcgtcccccccgtccgccccccacccactcacccacctggcgcagggatgtacaacgagcagcagcgtggctgggtcccgcccctgctctcggcggccgatctggcggcggcccctggcacgctgccccccagccccagcgaggccgagtgggagacgccctcgccccccgccgccggtctgggctccctgctgctcccggagtacgtgtcggaggatggcagcctggcctccgaggcgcgcggcggcgccggcggcaccgcgcgcggcgtgctgcgcccgctgggcgacctcaccccctccgcctccttcgcctcctccgcctcggcgccggagggcgcggcaagccagaccctggagctgcacctgctcgagcgcaaggggcgcgagctgctgcgccgcttccgcgtgcccgcccacctcaccccc

SEQ ID NO: 38202 - DNA, 61 bp, Chlorella protothecoides
gaagacacaccctctcatcatcggcttcatcttcttcatcatgatcttctctggtaagacc

SEQ ID NO: 38203 - DNA, 160 bp, Chlorella protothecoides
cagatgtaaagactgggatgggcccgatggcggaaccacagacccttgcaccccctcaacctgaaccacgctgcagctcctgacgtgccataagcaccatggctgggtcagggaacgcttgttggggtctctgcgtgtacagcgcctgagactcaggcag

SEQ ID NO: 38204 - DNA, 70 bp, Chlorella protothecoides
ctgtggggtgactcgaggatgctacatcatatgatccccaccccactgagcagtggtgccagagagatgg

SEQ ID NO: 38205 - DNA, 164 bp, Chlorella protothecoides
ggtgtcgcaaaccgagagggatggcgccgaggtgggtgcaaagagggggttgaggtgactgtgttgtattcgtattccatgggatgcgtgatttaacaatgtatgcctctgattgagcagccagtggcacgtgagtggtatgagctgacaacttccatgtgttg

SEQ ID NO: 38206 - DNA, 240 bp, Chlorella protothecoides
ctggacgacatgcgctacttcctcagcgccaacagcgcgcaccccgaggaccacgacgagctgctgaaagtggtgagccggacgggtgtgcggtcttcacttccgccgcccccgtgccccgtgacaccagatcgccggcccccgctcccaaccctgcgcgctgctctgtgcttcagcaccccgcacacaccccttccccctttcctgctccaggcttttggcgggccggccacgctgtac

SEQ ID NO: 38207 - DNA, 129 bp, Chlorella protothecoides
gctgcatgcttgccaggtttgtcggctgccgagccctgcagacatgaaggtgatgccgtcgattgcttgagaggactggggacatactctacactcactgcgctccttggctccgagcaattccatgaa

SEQ ID NO: 38208 - DNA, 61 bp, Chlorella protothecoides
gtgggtggggcgggtgtgagcgacgaggaggcggggcctcacacctctgctgcaccacacg

SEQ ID NO: 38209 - DNA, 134 bp, Chlorella protothecoides
ttggttggccggtctggccgcgtcggggcacgcgctcagtcccctgcacctgtgttggatttccatgcggcctccagcgatgtttcagaggcatcggcgctgctggcgctgcgccactcctccgcctcgcttgc

SEQ ID NO: 38210 - DNA, 61 bp, Chlorella protothecoides
tggatgtcaatggcaccctgtattccgtgggcgatgctgccgaacccgcattccgagagct

SEQ ID NO: 38211 - DNA, 79 bp, Chlorella protothecoides
gttgcgaccagaacttgtatattcgaatcgcctctctgtcctagtactatcgctcctgtcctcctactcgccctccgct

SEQ ID NO: 38212 - DNA, 79 bp, Chlorella protothecoides
gagtggtgatggggcggaaggactttctactgtggcttgaatcacacacccatgagttgggtctgtgcagtgccaatca

SEQ ID NO: 38213 - DNA, 162 bp, Chlorella protothecoides
cagcaatcgtgttctgaaagaatcgacgctgctgggctcccccttctctgcaaatggagtgctccatcctctcgacacccaaccccttcctgaacacacgccacagggccagcatcgtcggcatggtccctgtcagcacctgcggaaagacaggagcacggc

SEQ ID NO: 38214 - DNA, 108 bp, Chlorella protothecoides
gaggacctgaccatctaccgcagcggggagggcgccggcggtgtgccgcagcacggagaggcgggaggggtccccccgaccagcgcccctcccaaggtcgaggcggcg

SEQ ID NO: 38215 - DNA, 114 bp, Chlorella protothecoides
ctgacaatgtagagcaagtggaacacaatgccagtactgttaccggggggctggctcccacctcaatcttccaggcacgtttttccaaagtcggccagcatttggaccatgcgc

SEQ ID NO: 38216 - DNA, 73 bp, Chlorella protothecoides
ccagctgcagggcctgcccgccgaggtgggggggtgggtggtgccgcgagggcagaggggcgtgggcatgtgc

SEQ ID NO: 38217 - DNA, 104 bp, Chlorella protothecoides
gatgatgctgactgatactttccctgctgcgcccccagccctgttgtgtgtggacaccagcctcgcgcgtgacccccctctcccaccacccaccactcgccaca

SEQ ID NO: 38218 - DNA, 78 bp, Chlorella protothecoides
cctgaggatagcgcgccggcctagcccaatgcctggttggtgcttgctccccagcagcctcaacagcacatgcgcatg

SEQ ID NO: 38219 - DNA, 191 bp, Chlorella protothecoides
ccagcctggtgcaggccatccagaagtgagaggggcgcgggtgcgtcggggcgcccagcgctccgtgcagggagggtgccgggagcaggccggcgagggggcctgctcccgagccggtcaaggcgtgagacggggcacgcgcctgccgctccctcggcgctcagtcgacgaacacttgacctccagtcgct

SEQ ID NO: 38220 - DNA, 61 bp, Chlorella protothecoides
gcggcctggatgcatgcagaggtgttgccgtaggggaactggaggctggctactgccatgg

SEQ ID NO: 38221 - DNA, 62 bp, Chlorella protothecoides
ggacttgaccatcgtcatccagaacatcgtccggaagcggtccgggaagtcacgtaggaggc

SEQ ID NO: 38222 - DNA, 73 bp, Chlorella protothecoides
tcatgggcgcacctgcaccataatacccattgagccccccccgcctcgcccaggctgcacatccggcgcggcc

SEQ ID NO: 38223 - DNA, 61 bp, Chlorella protothecoides
tcggccaggagcttcttcacgagggcggccacccgcccctgcacgtcaccgccggtcggac

SEQ ID NO: 38224 - DNA, 106 bp, Chlorella protothecoides
ccacgatcagcaccgagcctcggcacagctccccctgggctgcaggtgcagacgggggtgtgggagggaggttttttttcagagtcggctggctaggaattggcgg

SEQ ID NO: 38225 - DNA, 87 bp, Chlorella protothecoides
cgtcgagggcgggagcttgctggggtcgagcccctgtgcgaccctgtttcgcgtggagtcgccagcggtggggccgctcgcccctgg

SEQ ID NO: 38226 - DNA, 99 bp, Chlorella protothecoides
cggggcgcctgccgctcccagacctggcgaggggggggggaggaggcgtgggcgcgccagagtggccctcgcacagaagtgcacactgtgcagattccg

SEQ ID NO: 38227 - DNA, 35692 bp, Chlorella protothecoides
  modified_base (916)..(925): a, c, t, g, unknown or other
  modified_base (1711)..(1720): a, c, t, g, unknown or other
  modified_base (2207)..(2216): a, c, t, g, unknown or other
  modified_base (2696)..(2705): a, c, t, g, unknown or other
  modified_base (2881)..(2926): a, c, t, g, unknown or other
  modified_base (4262)..(4271): a, c, t, g, unknown or other
  modified_base (5043)..(5052): a, c, t, g, unknown or other
  modified_base (7000)..(7009): a, c, t, g, unknown or other
  modified_base (8525)..(8640): a, c, t, g, unknown or other
  modified_base (8730)..(8739): a, c, t, g, unknown or other
  modified_base (8810)..(8906): a, c, t, g, unknown or other
  modified_base (9388)..(9397): a, c, t, g, unknown or other
  modified_base (9996)..(10005): a, c, t, g, unknown or other
  modified_base (10208)..(10217): a, c, t, g, unknown or other
  modified_base (10341)..(10508): a, c, t, g, unknown or other
  modified_base (10621)..(10630): a, c, t, g, unknown or other
  modified_base (11738)..(11747): a, c, t, g, unknown or other
  modified_base (12743)..(12752): a, c, t, g, unknown or other
  modified_base (13690)..(13699): a, c, t, g, unknown or other
  modified_base (14567)..(14576): a, c, t, g, unknown or other
  modified_base (15406)..(15415): a, c, t, g, unknown or other
  modified_base (15892)..(15901): a, c, t, g, unknown or other
  modified_base (17378)..(17387): a, c, t, g, unknown or other
  modified_base (17731)..(17740): a, c, t, g, unknown or other
  modified_base (18359)..(18445): a, c, t, g, unknown or other
  modified_base (18853)..(18862): a, c, t, g, unknown or other
  modified_base (20214)..(20223): a, c, t, g, unknown or other
  modified_base (20782)..(20791): a, c, t, g, unknown or other
  modified_base (21464)..(21473): a, c, t, g, unknown or other
  modified_base (21910)..(21919): a, c, t, g, unknown or other
  modified_base (22083)..(22092): a, c, t, g, unknown or other
  modified_base (22336)..(22345): a, c, t, g, unknown or other
  modified_base (22894)..(22903): a, c, t, g, unknown or other
  modified_base (23092)..(23101): a, c, t, g, unknown or other
  modified_base (24020)..(24029): a, c, t, g, unknown or other
  modified_base (25134)..(25143): a, c, t, g, unknown or other
  modified_base (26184)..(26193): a, c, t, g, unknown or other
  modified_base (26517)..(26526): a, c, t, g, unknown or other
  modified_base (27005)..(27014): a, c, t, g, unknown or other
  modified_base (29008)..(29017): a, c, t, g, unknown or other
  modified_base (30219)..(30228): a, c, t, g, unknown or other
  modified_base (30291)..(30300): a, c, t, g, unknown or other
  modified_base (30477)..(30486): a, c, t, g, unknown or other
  modified_base (31051)..(31060): a, c, t, g, unknown or other
  modified_base (31337)..(31346): a, c, t, g, unknown or other
  modified_base (33673)..(33682): a, c, t, g, unknown or other
  modified_base (34620)..(34629): a, c, t, g, unknown or other
  modified_base (35392)..(35401): a, c, t, g, unknown or other
cgtggctgggcgcgcgccgcctcccgcgcctgccacgccgcgatggcgtcgccgccgccgacgcgcagcacgtcgcgcgcggcctcgaaggtgcactcgccgtacggcaggccccgccacttcaccaggtagcgcgggccggcggcggggccgctgctgctgccgtagccatggtcctcgccactccccaccccgccgccgccgcgctccgccaccaccctctccacgcgcgagtgctcctcctccagctgctcctgcagcgcggcctgcaggtctgaaagctcgcgctcctctgcggagagcgcggcgcgacgcgcgcgcgcctcgtccacgcgccggcagtagttgagcacgcgcttaaagccggccagctggctcagcgtgctcagtgtgtcccaggagcagtgcaggtacgagttccgggcccacttgacgtagaactcgcgcgagtcccagggccgggtggggttggtggggacgccctccatgtccctagggttgtgtgtgtggggggggtgttttgggggtgttcagaacagggaggagaggaggtggtgtcaaggggggcaggaggaaagacatatgagtcttgctggacagggagacaatgcgagcagaggataggagagaagagcaggtttcacttccggcattgctggcagcaggtggcccctcagatgctctctgacctcccctgcaggggcctctttgcaagggcgcgcacaaccctgccccccctcacacctgtgcttgatcacccgctccacctcatcccccatctcggccagctcctgagggctgagcaggacaggggcgacgcggcgccgccgcgccgccgcgcgctgctcggcctctgccgagtcatcagatgagtcattgccggacgaggccgcgccgctgctcccgcgcagactgnnnnnnnnnngcgcgccgccgcgcgctgctcggcctccgccgagtcatcagatgagtcgtcgccggaggaggccgcgccgctgctcccgcgcagactgtcggcgctgggggggcgcgacacgatgcgcagcttgaccctggggaggggcgcaggcgggggcgcccggcgcgccggcggggggctgcgctcgtcgtcctctgtcgacagtggtgtgggtgggtgtatcgggggtgggtgcgggagtggggcgccacgcaagcggccagggggaggggccagttgcgccagcctaccagctggcacaggacgcacacaggagagcatacattgcaagctcccgcccctccctcgtggccccaaaaggctgcctgcgacctgtcaatctcgaatcaccttggagcatgccgtcgtcccactcctcctcctcctcctcctgatcggcagcatcatcggacgatgagtcatcggcgacaaaggacgtgcgggcgcgctgcgctgcgccgcgctgtgcccgccgggcgggggcgggggcggcgcgctttctctgcgccggcggcgccgtgggccggcgggccgagatggccgcctcaaagtcctcgtcgtcgtcgatgggcgaagcagaggcctctgcggatgtggatgagggggctatttgaggcagtctaatgtaacacgcagcagggaggttggagacactagctcgatcatagcgcagaggcaaacagggcttcaccgacttgcactgggtgcttccaatggcaacgaccacccaccaaactcgtcgtcctcctcgtnnnnnnnnnngggcaaacagggcttcaccgacttgcactaggtgcttccaacggcaacaaccacccaccaaactcgtcgtcctcctcgtccacttcttcttcctcttcttcctcctcctcttcctcctctgcatggaagtcagcatccctggccctgcacacaatagcaaagaagtcggagttgccttcctagtgagcagcgcatgagctctcgcagacgctccgctttcagccgccagccccacgccctgttgtacctggccacctcgctctcctcctcctcctcctcttcctcatcgtcatcctcattgaggtctggatcctcccagtcgtgggggtcgggtgggccgccagccggcttgctggaccagtcaccccccaccattggggcagggaagaggggtcaccacggccgccttggcctcccttgcggcggtctcggcgtccacgaggttaacaggatgtacaatctacaacctcacctccactttacccannnnnnnnnngggggcagggaagaggggtcaccacgtccgccttggcctcccttacggcggtctcggcgtccacgaggttgatgggatgggcaatctacaacctcacctccactttacccatgccttgagcgcctggcgatcgtatgggtgctgcaccgtctcggtgttttgtcagagggctcgctcgcctcggcctgtgcagctggctcacaacgagcccacttccacgtattgtgtttcaagtgtgaggtctggattgtgatttacccgtgcggccgctggtagcccctcgcgtgcgtcagggggcaccccgcagcagggctgggctccacgcccgtggttttccggcaccggctccctcccgtcagggtgcgtgcttgccagcacctttcaatgggacagaaacgtcttcctgtacgccgttcattcccgggccacccaccctcctggctggtcttccgacagggtatcgaggcgttcatcgcgcgnnnnnnnnnngcagaaacgtcttcctgtacgcccttcattcccgggccacccaccctcccggctggtctcccgacagggtatcgaggcgttcatcgcgcgctgtccttgcacagagagaggggagtggggatgagggaaggagacaggctccctgcctggcacacccttccttttatacccaggtnnnnnnnnnnnnnnnnnnnnnnnnnnnnnnnnnnnnnnnnnnnnnnttccgaaggaggggtgggcagggcaggcagtgcagtctgtgcgatgggtgctccccggttggtcccggcacgtgacggccggagagggaaactctacgaccgctccagcgcccgccacgctcagtacttgacgtcgaagccgacgccgaacttggggggggcgttcaggtccagggcattgagctgggtgctgagcgcgaccttggtcttgggctgcagctcctgctcgtagagcagggacaggatgccgctgttctccagcttggccttagtcagcgcaccgccggccaggcgccgcgaggagccgatggcgaagctggtggcggaggagcccaggtcgcggctcacctccgcgccaatggtggtgtcggcggccacgcggtgggccagcagcacgctcagcgcgttggtgtcggtcagcagcgcagtcagctggtagtcgggcgcggtgtagccgacgccggcggtccagcgtgtgagcgcggacttggaggcgtcaaaagtcccagacgcacccagggtcacgccttcgtaccccgtggtggccgccaggtcgaccttgggggaggaggccagggacaccaccgacttgagggtcaggtgggggagcgagtagtccaccgccaccttggccgtctccagctcgggcacggtgccagacaggcccagggtcaggccgggggccaggtccttgtaggtcactgccgctgccagcttgccgtcgcgggtgatggaggacaccagggtatagcggggcgccacgtacacactcttcaggtcaatgtccaggcggtcgcccttgctcagggccttcagcccaaagtcctggggggagattggaaggaggggtgggggggtgggggggttcatcgacaggctgcgccgggggcctgcggcgtcgggcccatggaccacttgcttgcccactggccaggtccaaaccctgggtatggtgcacagatgcaggggtgcaacacccagcaccccggtggtgcccagccggggacacaacccaggggcatgaggcgaggagaatcaacggctgcccgacccgggtgcagcgggctgtcccggcaaaatacccactcattccctgctcccgaaaccgcgacggaaacgcaccacgccatcagaggtggtgctggagatgctgaccacacggtcgaactggaagacgccatcgcggctcccgtacaggaggtctgcacggggggcggggatcaggggcggggttgggaaggcggaggggcctgcaggctcgatccctgccctcatgcgatgcttcgggatacatgcagcgtgtgcgaagagcatccagcctcacggactaaggttnnnnnnnnnntgatgcttcgggacacatgcagcgagtgtgaagagcatccagcctcacggactaaggttttgtcaaccccccgcccctgccactcacccttggcggtgcgcccgagctcgccaaaagcgggaatcttcgccatggtaatgttgttggggacctgaaaaacaagacttcaggatctgggcggaataagaatggtttgaggcgtcgcggggtggtggccaggcttagaaggagcctggaaggtgcgccgggacacgctgctgctgacagcgagcatttccattttacgtaatctcgtcatagtgattcggttcatgctgacaatgacttgaataaacgtacagaatacctggtggctctcattcgagtgccatacagcgttccatttacatgcaaaagctttgccggacacgcaaatcctctgcaccccctggcctatcgtcgtgagggggaaggctgggcaagcaccactgcttgctgtgatgtcccagacgtggcgtcggcatttatgctgcgccctgttgatccagccacccagaacgccatcttaaatactccatacactccgactcctgctacaaacacggcgcccagggctgcgcagtatgttgatggataaaaaggggtgggtgggtgattatggaaatcattgccttcccatgtgtctggctctggaatgatcaaatgcttctagggatgcactgtgcggtattcatgtggcatttttccgaattgcaaagcaactcctccctcgccaggctaccagctcacctcnnnnnnnnnngtgagaaggggtggatgggtgaacatggaaaatcattgccttcccatgtgtctggctcggaattatcaaatgcttctagggatgcactgcgcggtattcatgtggcattttcccgaattgcaaggcaattcctccctcgccaggctaccagctcacctcctgcgcccatggcgcccatggtggcaaacatgcctggaggatccggcagaggctcctcgggccctggcacggggcctgcttagggttcggaagggaggagggacgctgaggcgcatgtgatatatgacgaagcgccaaaagctctgcgcaaccgtcccattgtacctggttttggagcacctcccgcctccgagctgaagcgatgccttggtccgggtcgcgatgccagccgtgcattcctcacgcttctacacaaacccgtgagtcgactcatcagggctgtgcgcgtgtcagaacacgcccgaggagcaccacgactgcaccctggcaacaccggtctacagaatgcggcagcaattgacgttacagatgagctgagagtacttgaggcatcgtcatgtcaaggaagcaaggagtaaggctgtcgaggtcttttgattggggacgcagatctccgggtatgcatgcagcccgggaactccctagcaagaaagtccatcagatcccaactgagctttgccacctccacactgggtccgaacccactatggctttttgtcagaacacatctcaatcagctcatcacatgctaccaagagatcggcgcggaagatgggaggcgctgtacctatcgtctgtcaggctggaacgacctgcctgttgactttgttccaaggcgatccccgggtgcacaaatccaccatctgagaagaacccatttcgtaccttggtaccttgataggcttcaggtgattgagggtggtgctcagcgtctaccgcaccgcgagccggccgtcgcgaggtcacggggaggggggactgacagctgcgcgtcgcaatgccacgactcccggacccatgcagatggaccgatccaggggcaggccttcaccgagtcgcctggtgcgatccagtgtggcacctggaaagaagccggggacaggcgtgaaggcctccatccatgtctccaccggagctctggccccaggccctgccgatgacgctctggtgggttgggccagggcgtgacctgtgaagaccttcccgaatggcaagcatggcagtttactcactcctatcagaacatctgcaatgccctgtgagataggctgcctgcaggctgttccgggcggccacccagtctggtggagcttcaggcacccgctcgtgactcacagggactccctttccctcccacaggacacggtcctggtgctccccccgcccggccagctcagccttgcccctgccgcgctggaggaggaggtgggccggcagctgcagtgcctgctgcccggcagcgacgtccctgcgatcgcgtgggcgccgttgcatgcggcgttcgtggcggaccaggcacgcaccgctgcggccacggtgtgccacctggcactcgcccccgggctgtgctgcgcgagcaccgcgccctgcatgccgggcatggaccccgagccgccggagcccgcgcccttacctggcccccgcaccgaccgtgggacgcagaccccccgccacctgccacgcagccgccaggtgcagacgcagagcgcgccccgtgccacagcctgcggccagtgcgacgccgtgcactccgccgccctggtgggagcagggcccggcgcctcggagcccggccgacgcgcccccggcgccggtgtcggcggcaagcgccgcgaggacgccggggcaatcccacctactgggcgtggccccaaccccccgggcgttctcggcggcctctcgtgtggtgcccccgggcccctggccaccctcctcgcctcagccccannnnnnnnnnccggggcccggtcgacgcgcccctggcgccggtgtcggcgaaaagcgccgcgaggacgccggggcaaccccacctactggtcgtggccccaaacccccgggcgttctcggcggcctcccatgcggcggccccggccccctggccaccctcctcgcctcagccccacccccgccgcagcgcggccggggcggcggcgttcgcgatcccggcgcgggcagcgccacgcaggaagcgctggagccggcccgctgcgtcctggagcgcatgctgatgcagaacgcgctgcgtggggtgctgctggactgccggtactgggacgacccggcggacgaggtgcgggcgcgggagggcacgctgctgcccctctggctcttccccgcgccggggaatgcgcggcacgccgtcaccgcgctggcctggtgccccgggcaccccgacctctttgccgtggggcacgggggatttgaccccgcgaagcccctgcgaggggccgtcgccgtccactccctcaaggccccctcccgtcccgagctcacgctgcggctgccgacgggtgcggggcggctggggtggagggagggaggatgatccaggctgggcgtgggagcctgcgaggcatgaagagcatcatgcccgctgcacacctcagttgaagggggcaccagctggtgtctccaatcttgcgagcccctcttcccacccctcttgcaggggtgatgtgcctcgctttccaccccgtgcatgccgacgtgctggccgtcggctgccacgacggctccctgcacatctacagcctgatgggcaggctgggccaggccgaggacgcccccgcccctgcgcccctgtacgcctcccggctgggggaggggggccgctgggaacccatgtggcaggtgactggggacaagggcttagggggccggatgtagaggtgcgtctgcactcccctttctttgaccatgtcagcggtgcaaacaccgcggcagctgcgtggagctgggctccttctatcccacaataggctctcatagggggccagggaccaactcaaagtgtgcagctcctcgctcagattacatggttatatccctacgtcaatcttcccttccctctcaaaggtggtttggcgtccctgtgagggcaatgagctgcggcttgtgacgacgtacagcgacggtcacgtggtggagtggcatgcagcccgcggccgactgacttgccaggtggcagatggggtgactgacaggggctgggggctgggttcggtctacctgcatgaaacctttgcctcaccccaaagatctcttagcaagtggttgccacaaggccccgtctcttccgctcaccatctgcatggcattcgtgtttctctggcaagtgctgcagccttggggagcatgtgcaggcatcagccaggagaagtccttgctggatcatccagcacttcccactcgcacgcaggacctcctctccatccatgctccccccattgagggtggctcggagactgaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtcagccctacctgcgatccagggagctttatattggtcaactctgtgtcctgcaaccccgcaggctgcttgtgcctggacttccannnnnnnnnnctttcttggcaagtgcttgccacaaggccccgtctcttctgctcaccatctgcatggcattcgtgtttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctggatcatccagcactccccactcgcacgcaggacctcctcaccatccatgctcctcccattgagggtggctcggagactgaggacgaggaggcgctcgaccttgcaggtgagatcagatccatgggcacaggggagagtgcggcggagtctcatcctctcacggtgtcagccctacctgcgatccagggagctgtatattgatcgactctgtgtcctgcacccccgcaggctgcttgtgcctggacttccatggcagccaggcagacgtcttcctcgtggggacccatgagggcacggtctgcaagtgctcgacggcacacaccacttcacccctccaggtgcagtccccgccatggttggacagtggctggcatcgacgccacccaaacctcgaaggcttgttaccgtgcgcatcagcaactcaactccccagatcatgcgcgcctatgtcccgtagcatgcagcttgttgcagggnnnnnnnnnncggagagtggctggtgtcgacgccacccaaacctcgatggctcgttaccgtgcgcatcagcggctcaactccccagatcatgcgcgcccatgtcccgtagcatgcagcttgttgcagggccttgccatcaggggagccagggctgcggtcattgcaggggcgccctggcagggtcatcagtgacccatgatcttccggccacacctcgacgcccaagatgccccctcctttgatgcccctgcagacattccgggcacactccatgccagtgtatgcggtgcggtggagcgacttccatccacgcgtgtttctttcggctggtgctgactgggccgtcaggctgtgggatgtgaatgacccaaaggcaagcccggaaagtgggttgccttggtgcaaggatatgaccgtgggtggatgcgatggccagcgtgcccggcagctcgtgctttggagtgctattgtgctctgcaactctctctgcttgcctgctgcttcgaagtgtcctcctgaaaagcacattgatccattgatccaccgcccctccatgctcgtccgttgaaaaaaggcgttggcgagctttgacctacaggcccccgcannnnnnnnnncatgaccgcgggtggatgcgatgggccagcatgcctggcagctcgtgctttggagtgctattgtgctccgcaactctctctgcttgcctgctgcttcgcagtgtccccctgaatagcaaattgaacccactgatccaccccccctccatgctcgtccgttgaaaaaaaggcattggcgagctttgacctacaggcccccgcannnnnnnnnnagtcattctgtgattgggaaacggaagttggacacggaatgcattggatgacaggaggagattgctggatagtcttgacgatgtacacaatattgaaacatcggtcatccagagatctcacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaggatgcattggtacgcgtgtgtctgacccgtttgcgagtcgtgaaggtacatgaaagctgttcaagtcttgcccaagcatggttgagccccgtcacctaccccttcatnnnnnnnnnngcagacgtagcatggcttcccggggcgtctgtggtgtttgccgccgccaccgagaacgggcgggtccatgtcttcgacctttccaaggacagacgccacgcgctttgcgtacaaaaggtgtgaagactgggcagggtacgtgctttgagtgtatctattgagtctcggtcattctgcgattgggaaacggaagagttggacacggaatgctttggatgacaggaggagcttgctggatagtcttgacgacatacacaacactgaaacatcggtcatccagagatctcacctcatgcatgatgctcgcagcttgctaacaagacaaaactcacaaagctggccttcaaccccaaggagcccctgcttcttgtgggagacgacaggtggggcgtttgggttagggttgatggatgaaaaggatgcattggtacgcgtgagtctgacccctttgcgagttgtgaaggtagatgaaaactgttcaagtcttgcccaagaatggttgagccccgtcacctaccccttcatgggacctaggggacctgaactttgagccctccccactccttgtcatgtgcagaggagcggtgacctgcctcaagctgtcgccaaacctgcgacacatcagcaaggcagtgacggctggcgggccgaccccgctgggaagccccaacccatcccacacagtgccgcggccgatggcaaggctagggtctcccttggatcctggccctgtggccaaggaagaccatgctgccaccgcaagggacagggcgttgggggagctggacgctgcgatggcagccctcaagaagattcgtgacagcacaggatcacactgtctctgaacacccgttgtcaagagcggaccaaagcacttctgtcgttatcgattctcccatctcgcccattgtgcctgggacggcagtggcagacaccataccccctttagggatgatgagtaatttccgcagaagacgtgaggaaggtaataggaaccgcgcgcgcccccggagactcctcagccaccccaaccgaaaacaccgtgagtcatacataaaatcccttcttgtgtatctgtaaccaagccccgctgcacctaccaggagcnnnnnnnnnnccccctttaggaatgatgagtaatttccgtagaagacgtgaggaaggtaataggaaccgcgcgcgcccccggagactcctcagccaccccaacccaaaacaccatgagtcatacatgaaatcccttcttgtgtatctataaccaagccccgctgcacctaccaggagcgccaagtatacccccttcggcaaagtcctcgcaaacaccatggttggcggagtgcaccctattcccggcaatgggcacgtcccagccggtaagatcatcggccccgtgctcggcctcttcaccgcagtggcggcagtgttctatgcccggcacacgtccgcgacggtgcccaacaccatctctcgggtacggtgtggatccagggtttggcttacccggacacatgcactgtcttggcccacggcgctgatgggttcgactccaatcttccacccgcccatgtatgtttgcgcaggattgggaggacgcgtctgtggcctacgccgctgccgctcccttcgagggcgcccccgacaaggtcgccttcctgaaccccttcttcaacagcatcccccctgccaaggccgtccgccctgccgagtgataccgttgccatcatgcccactgtgccttgcttggaggggatgtgtacagaacgaacccctcactgtgggcgagacgggtcagacagcggtcgggatcattcggccgcctcgccgcagaccctgcgctcaggggcggtgcagctcagccagtctgtgagcgaggcggcggccttgggtcccaccttggtgggtcggctcgtccccgtgcgcatcatgcgctcgatgccagtccggaaggcgggcagcgtcgcgctgtcggggtgcatggtgggaagagggtgtcccgtgtttgggcgtggagcgggtgagtggtcgggcggcggtgcgccctgcgtcgagcccttgataccagactcgtatcagagatgagagggggggagtgggcctcccggctgcccccatnnnnnnnnnntgggtgtccgtgtttgggtgtggagcgggcgagtggttgggcggcggtgcgccctgcgtcgagcccttgctaccagacttgtatcagtgatgagaggggggagtgggcctcccggctgcccccatccaagcccccccctcgccacccacgcacacacagaccagcacccacacctgccatgtgcccgggccagctcatccatgagcctgcccaggttgccaaagcggccaaccactgcgtgcgcaatgctgggcagcacggacggcagcttgcacaacgcctcgatgttctgctgctcagcgccagtcaccgggtgctgggccagcagggcctccatggcggtcccgcaccgcttgctgtgtgcctggaaccactgcaccgactcctgctccagggtgtggtatggtgtgtgttgggggaggggggggttcgaggtgcccaggtcgggagaagggttgtttgggggtgccaggcccaggaggaagggggttggagcctcaggacggcgggggtgacttgggaagcctgcacagggtagagccggtagcgtccctcgggaaccccagcgccacccaagaactgcaggatgctacacggcggttgcccccaccgagtcccagcccccccctgctcacgctcttggcaaaggcgctgcgtgcaatggcggtggtgagcagcagcacgtgctcggccgcagcgtgcccgtcgacggcctccctgaagcccaagcccgggtggctgacggccaggccggtgacgaggtcctccacggccgcgcgggagaccgcaccgggcgccgcgccgcccgtgcccatgtgctgtgcatgctgagcccgctcaaggcgggcgaggtgtgcggtcaggccacagacgaggaggtggggccgggcggcagggcagtgcgtggtcagcgtgcacagcaggccggccaggccgtnnnnnnnnnncaggcgggcgaggtgcgcggccaggccacagacgaggaggaggggccgggcggcagggcagtgcgtgctcagcgtgcacagcaggccggccaggccgtctgcctggaccgcctccacgaactcggcggcctgcatggcggtggggagatggctgcctgttcggggctgcagaggcgtcttggatgggtaaagggtccagcaggccctgcggcggtcttcccaccaaccaggcacggcgaggctagggagtaagcttatcggcgcgcagacgcatcggccaggatcccccgtactgagctacggattccgcaccttgaagcagatgaggacgtggggcacctcgacctccctcaccctggcttgagcaccctgtgcaaagcagagtgcagaattgctgagcgtgtgccaagctgacgaggttcatgctgcacgacacctcaggcgcccagctgtacttggcaaactccatgacaatggtcctgcatgggtgcaatggcagcaccgataccccccacctcaagctcacttcttgtccggggtcttccagcatccgcctggtccagcgcaccgccctgtactgcgccagccccacgtcccgaaccacaaaagccaccgccttgtccgggggacccgtctgcgtctcctggagcttggctggggaccagggggagggttgaacttataaagtggccgatgttcagggtgcgacgagaactgggatgccaggctgggctggttctgggatatggattgagaatgtaaagtggcttctgaaccctggagtacctgcctcagttgaatgtgtgcgtcctcccccacacgtgacccgctcaccgccgatggcgagccccaggtcggtctccatgannnnnnnnnntgtctgcgtttcctggagcttggctggggtccagggggagggttgaactcataaagtggccgatgttcagggtacgacgagaactgggatgccaggctgggctggttttgggatatggattgagaaatgtacagtggcttctgaaccctggagttcctgcctcagttggatgcatgcatcctcccctacacgtgacctgctcaccgtcgatggcgagccccaggtcggtctccatgagtcgggggtccagcagcaccgtcatgtgctgaagcatctggcgctgcgatgagaacgaagccgccagcttcttctggtcctggagcgctcgcttcagggcctcgtcccgcgctttctcctcggccgtacgccgcttcttccttgcacgcggcggtgcgggctcccctgccactggcaggtgcatggtgacctgggagtctggctcgctggcattgcaggctgatgcagggagctgctcttgcgtctcgtgatccacgcaccctcgtgagtcctgtgtgatgtgcagggttagcatggtgaggcgtctggctgggggttcatgtgcaactcaaaggcgtcgcctcatgcctctgcttctatcacacctgcgaatgcgccacatcatcctttggagagctgctctcctgattacggcgcaggtctggagacgatgccaggggtggggaggtcccctcccctgggcggtccctccttgtgggcacctgggaggatcggcggtgggcactcacagcagtcccaactttataatcacacaccctgccccgtgcaatgaccatcattttatgttgcaagatgataaacctgaggggtgnnnnnnnnnnggtgggcacctggtaggatcagaggtgggcactcacagcagtcccaactgtatgatcacacaccctgccccgtgcaatgaccaccattctatgttgcaagatgataaacctgaggggtgcaggcttctgtgtcactcagcgttagatccacgaccgtcatgccccctgcagatggtcagtgcggatggtcgtgcgcggatgatgcagcgagctgtacctctgctggcacgcatgataggcttgcataccgcatgtttgtattatcgagtctctcctcgcgccttgagcttgctcgttcccagtgatcatcagggacccatcttggctgtcgaggggcacgtgattggcgctcgattccctgccttggccggatgttagctaatgggtactcgcaaaagactccgatgcaggtactaaattttcagaatcagtgggttttcaaccaactaccattgccctatgtttgccaatcacgcnnnnnnnnnncaattttcagagtcaatgggttttaaaccacctaccattgccctatgtttgccaatcacgcttcactccaattcggggctgcccacaagctgtcagtgcctctcccctcttcctcatcctgcattttgtcagtgtgcgctcacaactgcacatgggcacgaggcagaactcccgagatgacggcagtaagttggtgggctgctgcagcccgacagtcagatgacatacgcagggtgcctcttctacacagattgttcagcaggcccatgggcactagattcttctacaaggctgtcggttgcgattgcacgaggcccagatcaggccgtggcatccttcaggtacgctgtgggaaagaggggcaaagggaatggtttgagtcacgtcaacagatcggctgccatgcacaaatctccccatgtaagatcctccagagtgggcactcatgctcaccaatgaggtcagcacggtcctctggcttcttcagaccggcgaacaccatcttggtgcctgcagcaattttatggtaggggaatcgtttgaggtgagaaagccacactcatagttcccaatcaatagagctgctcaatgtctggtctgtaggcaccacgcgacccctctccccctccaccccctcccgctccaaccctgcagcaaggacacacctgggatgtacttcttggggttgagcaggtagtcgtagagggtgctctcgctccactccaccgccttctccttgttggccttgctatagctgaacccctccgcgttaccggacacgcgcccgaaaaggccgccgaggttgggaccctgcacgcatccagcgacatttccttgagtacatgtttctgagcacagtgcaccgcgcaagcagcgcgcttgcaatgtcttgcataccttcggggcagagtctgagggcacacgcattccgagtctatcccagccctaccctcgtccgactccccgcgaatcttcacctgcttgtggccgccacccttctctgcaacgtggcactgagcacacttcagcttgaagatcttggctcccttggccgcatccccagcgggagcgtcggcgaacgaagccattgggcaggaagctacttgcagggttcagagagaaaacaacgctttcgattgtgtactactaatcagcaatctcaagtgctgtttagggtccagtgggagattaccgcagcagttcggccctgggtcgcgtgtctcagtcgatgagtcacgggttcccgccaagtcctccagctttgccaagatcggtctgtgcacactccccagcaccaaaacaagaacgaaatgaccctaaaatcacgcttcacaacttatgcactgttaaagatatgcacatgattcaaatcacgtgctggatgtgtacttgtgattgaagggccctgacaagttcttaactaaacctgtcaaagaggcttctcaggcttgaatatcttctgtacatcgtaaacatnnnnnnnnnnaaacttattgcaatgttaaagatatgcacatgattcaaatcatgtgctggctgtgtacttgtgattgaagggccctgacaggttcttaactgaacctgtcaaagaggcttatcaagcttgaatatcttctgtacatcgtaaacatgagcataatctctcactggtccttggggtctggcacataccctgctgctccaaagcccaatgttcaggattattttccagtttacagagcctggggggcacattcacagttttcacaagagttgctcggcctgaaagatacctaggattgtttattgatgatcaccaagcaataggcgactcccctgtgcgttgtggcnnnnnnnnnnaagtttacagagcctggagggcacattcatcgttttcacaagagttgctctgcctgaaagagacctaggatggtttattggtgatcaccaggcaataggcgactcccctgtgcgttgtggcttgaccgggcccaggtcgccgcagacgcagcagggcaggcctccccccccggggaggccgtagggttcgaccccctcgacccaaacccatagtgcgaccacattgtcggggacccgtcctttcgacttcgaattaccatattaccaccagtgacctcccgcatcccttgctcgtcgttgcctcagtttgtctctctgacgtgagccggccctgcaccgccttctcccggcctcctgaactcgtctccacgcgatgcggcagggtgtggcttccgccctgttgaggggtctgcaggcgacccgcgccagctccagcctggctgagagctccaacctggtcagggcgtacagttccgccaacacccccatcaccgcgaccctcttccctggagatggtaggcagccggcgccgtggtattttggacatggatgaggtatcgatggctgcgttgccggtagatggtgctgtgagttgcgactgtggctaggatcctttgtnnnnnnnnnnnnnnnnnnnnnnnnnnnnnnnnnnnnnnnnnnnnnnnnnnnnnnnnnnnnnnnnnnnnnnnnnnnnnnnnnnnnnnngaggccgtgcagaccattttcaaggccgcggaggcccccatcgtctgggacgagcagcacattggcaaggaggtggacccgcgcaccaacagcttcatcacccgcgagaatctggactccgtcctgaagcatcgcatcgggctcaagggccccatgaccacccccatcggcaaggggttccgctccctgaacctgaccctgcgcaaggagctgcagctgtatgccaacgtgcgcccctgcgttaggtgagcgggcccggtgcatggggggaggggaggtcttcggtgtgaaggcggcaaggaagctcgacgcaggccggctgccctgagcagtgcagggactgacaatactacatgccaaccgttcctccttccccacccccaaatcctgcagcatccccggctacannnnnnnnnnagtgaaggcggcaaggaagctcgaagcaggccggctgccctgagcagtgccgggactgacaattccacatgccaaccgttcctccattccccaccccccaaatcctgcagcatccccggctacaagacgcggtacgacgacgttgacctggtgaccatccgcgagaacacggagggcgagtactccggactggagcacgaggtggtccccggcgtggtggagtccctcaaggtgcgtgggaatggcctcaagggtcgggttggaagggtatttggctggatgtggtagcctgctgagcatatggagggtgttgtgcgagcatgggcctgccccctcagcagtacctttggggagggatttgccgaccaccagcgctgtgttcttgcccccccctccacacatatatccccccacacgccccatcatcccacaccccattgtccctcaaagaatgccctcaacctccaaactattcccaccttgccaacccagatcatcacacacgtggccagcacacgcgtggcggagtttgccttcgactacgcgcagaagaacaaccggcgcaaggtcaccgccgtgcacaaggccaacatcatgaagctgaccgacggcgccttcctgcgctgcgtgcgtgcggtggcggagcgctaccccgacatcaagtacgatgagatgatcgtggacaacacgtgcatgcagctggtcacccgccccacccagttcgacgtcatggtcatgcccaacctctacggcgacatctgctccgacctctgcgccggcttgatcggcggcctgggcctgacgccctcgggcaacattggagcaaacggcctagcgctcatggaggcagtgcacggcaccgccccggacctggtgggcaaggacgccgccaaccccaccgccctcctcctctccggcgtcatgatgctgcgccacctgcgcctgactgacgtggctgggaacatcgagcaggcggtgctggccaccatcgcggaggggcagtacctcacccgcgacctgggcggcaagtcggggaccaaggacttcaccaaggccatcatcgggcacctcaagtgatcgactggtgctggagctgtttgggggtgtggcggggctcggggcaccacagcagatcccgccccgcccatgcccactttcccactgtcttgtcgtgtgccaacacccctttcccatcatccccagaacactcccttctgaatgtaacactgtgattaacccttcttggtgatgttcacgatgcggtgatcgcatggtgggacggaagtggggcaatgtatgggtgtatgtgtgttttgggggtagggtcagcgtcaaggtggcagaggaggtcnnnnnnnnnngagtggggcaatgtatgggtgttttgggggagggtcagcgtcaaggtggcagaggaggtcatgcctgttggtcagaagtgtaatagagaggagtgaggtggtgcgtatcacatgtgcaccactcaagtgacgggacagggaatatcgacgagggctggcttcgccgcattggtccccagaaagtggagctgtgcgagagaacgaccaaaaagtcgatgttctgagcgtacgagcagggaggatgtgatgcacacgactcgacgtctggatcctgcatgtctagggtgcccgaggggaatggtaggggtctggagtttcatggccagggtcaggcagacacagaagactcgtcggcggccggttctcgcgcctcatcgcaggttgagcggagtactcctcgcccccatcgtcgcccctccggccggcgccttgctacccctcgacggcggcggtggcggcgtgctggcggtgtccgcctccttgtcctcctccagcaccggatcccctctggtcgaatgcaggtgttcatagaactgcaggacggcggggtcggcgcggnnnnnnnnnnccccccccctggtcgaaagcaggtgctcgtagaactgcaggacggcggggtcggcgcggagggcggcgggcgcgatgcctcccggggcgatggtcagccccgccgcgccgcgcactctggaaagcgcgacgtaggccatgcccggctcgaaggcgcgcgccaggtccacctccactgcgtccaggctcatgccctggcagcggtgcacgctcagcgcccaggccaggcccaggggcagcgcctcgcgcgccgcgccgccgcgcccccccgagcgcagcgtccagcgctcgggcgcgacgacgcgcgtgggcccggcggcgaaggccacgacgggcaggccgcgagcggcgtcgaagccggccaccacgccgcgtgcgccgttgaccaggccctcgcgtggcgccagcgagcgcaggagcatgacctgcgccccggtgcgcagctccagcgaggcgcgcgcggggcaggcggcgtccagcgcctcgctgggggcaccctcgtcccgcgcgtggaaggtgcggccggggccgggcagctccgccagcgccgcggcgttcaccgcgtccacgtcggcgcggtgcgtgaagaggcgcgtggaaagcacggcggggggcggcggcgcggaggcgcccataccggggccaggatctggggcgtccgccggtcctgcccnnnnnnnnnncggcggtggcgcgaaggcgcccgtaccaggggcaggatctggggcgtccgccggtcctgcccgcggcgcgcagcggcgctgcagctcctccagctcggccgcggtcgccgcgccgacgcgcaggcggcccagcagggcgatgaagccttcgtccccggcctggcggtacacgcgagacagcacgacgctggcctggacgcagcgctcccaggcggaggactggaagcagaaggcgcggcgccccgagccgcgggtgaccgggggcagctgcaagcagatggtgaggtggaggtccaagtgcttggggaccatgagcaaaggaggcagggcgaggacccagggagcagagcagggcggaggagggggctcatgatacagtgcaggcgtgcacaaggccgtgcaaagagccctgcatgcaattacatggcccacctccnnnnnnnnnnctgaagggcaggcgtgcatgaggccgtgcaaagggccctgcatgcaattacatggcccacctccagcaggccagcaggcaagactcaacccctgatgtccatacagcatcctcccagccccacaaaccctcacacgctgacctggtggaagtcgccggagaggnnnnnnnnnnctccaaacagcagcctcccacccccacgaaccctcgaacgctgacctggtggaagtcgccggagaggatgagctggatgcccccaaacggggcctgggagccccgcaggcgccgcgccagctcctccagagcagtgaacaggtgcgcatccagcatggatatctgggacgtgacaaaggggtatcggggtgtggcggagctcgacccgtgccgtccaagactggcctgcgcccgctgccccccnnnnnnnnnntgtgacaaagggtatcggggtgtggcggggctcgacccgtgccatccaagactggcctgcgcccgctgccccccccttgtcccacctcgtcgatgatgagggcggcggcgcggcgccagcgctgcgcgctctcacccagcccggcccgcgccgccatggcgtctatgccgccctccgccctgcccaccccggcaaaggcgtggatggtggtgccgcccagcgcgcaggctgccaggcccgtgctggccgtgacaaaggtcgtggaggggggcaggaccgacatgatggccgccagcagccgcgacttgcccgtcccggcgcaacctggagcgaggcaggggttggtggtttcgggagtctgctgactgcttctggcgcataccctggccaggacgcgcccgggcagcctctgttgtcgccacaagccagaatgccaacccttcctacttggctgttgaggaccctctggcagaattctttcatcccaagggacgccattgcacccccccgcgcgcacacacctgtgaagaacacgttcttcccggcgcnnnnnnnnnnccccaagggacgccactgcacccccccacgtgcacgcacctgtgaagaacacgttcttcccggcgcggaccagggcgaccgcccgctgctgctcgggggataggtctgtgacgccttggcagggccgagaggcgacactcctccgcgaccccgacgacaccgccgagctggcgggcctggaccccgagnnnnnnnnnncgtgacgtcctggcagggccgagaggcggcactcctccgcgaccccgacgataccgccgagctggcgggcctggaccccgaggctgcgggcctgggtttcacctggccgccgccgaagaagcaggtggaggccagcgacggcgctggccgcggctcgctcaccgtgacgttcaggtcgcgtgccaccagcgggcggcgcgggggctgcgcgctcgtcttcgaccccgtgggcactggcacgtgcccagaggccttgaccggcccgcctcccaggcaggcgtgcagccggtcccgcaggccgcacagcgccgcagcatcggctgaagtgagcgtgagctggacgcagcgcggcaccgaccgccacgcctccgtcttcacggccaagaagcgcatgcccagccgcccctgggccgcgctcccaccgtacaggacgagcggggccttgcagggcagggccagggggcgcggcttggtgtgcagcaccagggtgtgcaggccgcaggcgtcgcggcagagctccaccatcgtctccttggggggctgggcggccacgaaggagcccgaggcgtcgccctgctccaccttcacctgcgtgccggcggagggagggtgcagagggctggtgggtggctgccccttctccgtcagttggccgtccaggtccgggacacaggcagataaacagccatgcaatgcgatacatgtatacatcatattcgagtgcatagtagcaaaagtagtgatctggatgccaccaagggcggactcggtatgaacccaacccctcgcacccgtcggacacccacccaccacccacctttgctgtgaaacgcattggaagactcccagggctaggacgtcattcctcagtgcttcactatgatattatagagaaacgaaacgtacattctctccagannnnnnnnnnttcagggctaggacgtcattccacagtgcttcaatatgagattctagagaaacgaaacgtacattctctccagattgggggttgcggcctcccaatgcagcgacctctaggcagcgatcgctctggaccaacggtcacccatgacaagctctggccgatggtgagccgcgactatcagacaaacacactggcaatgtccctgaattgggtagtgcatccttgtgctcatgcgttccagatcgcgccggaaatgggcctacagatgtgcgcgcaaaccggtggtcgcaacagatcaatggtgcgagattttccagagctgctgaagggctttaacacacgttcaaggacgaatcatgggagaacacgccatcaaggggcgtacacactggaagaaggtctagctgagaagaaggtgtacaaagctatgatcatgtatcagagatggctggcatgcctgcagactgtccacaggacccatccatctcagcccatgaagaactgcagcgcattggccagctggctcagcttcccctccgcctgcgcatccgccaggtccaccttgcggtgcagcatggccgaggcctccctgcccagcacgctctgcacgctgcgccccgacgcggcgacgtcctcctcgacgccctcgccgcgcagcgcgggcgccaggtgcgtcagcagcaggttgaggaaacgagccgcgtgtgcgcgcaccctgtcgccgccgtggcgcagcacctcgcacacctgctctacgccgcgctggcgcacgaactcggagaaggcggagggctgctggtgctggacggacatgagggtgtcgaagcaggagcaggccagcaccggtgtggcggcggcgaggcgctgcagcagcagctgcggcggggggggagtgggggaggaaggtagggttggctgggcagtgatcgtgccgtccacatgcacatggactccccagcagaggctgcaggcaagtacctgtccacccatgttgcgcacacctccattgggctgatccaggactcatacactctgcaagccccctgaacctccctcgcaattcttgcctctggatcgccacacctggatgatgcctgcctcgcaggcnnnnnnnnnntttgcgcacacctccatcgggctgatccaggactcataccctctacaagccccctgaacctccctcgccatccttgcctctggatcaccacacctggatgatgcctgcctcgcaggcggcgcgctgggtatccggctggaagaggcacgccgcctggagcacggacaggagggagaccagctcgggctccgagacctcgcgctgactgggctcggagctgggggccatggccagcgcgtcccttgcagaccccacgatctcgtggtgatgcgcggtgagggcctggaggacggctgtggaggtggggggccccaggctcagcccctgatcgatctgcagagagatgcggaagtatgcctcctggcgtactatggacagcgggctggcggctgagggacaagggttgagaggggggcgtcagggcaacatataagcgtctgcttggtgcagcactttctagcatggtgttaatggaaaggaaggatgggctgcggagcgtgcaagtggtatctgcatgtgctgcggacacagctgaggtgcagccaaagacctcccccaaggagggaccccttcattacaccacgtccttctacatactacgcaccatcactgaaggcacggcgaagttgcagagcttgtctgctctgagcttcctccctgcaaaatccagaggtgatgagagtgggatgtgggattcgatgctcacggcagtcaacataccggcttcctcctgtccgatccaggcacaccgaaaggcgggcccttgggcacatgagaaatccaatctcacaaacatgagccttacctaatgagggaagcgagcatgggatcggcggccagctgggggtccagaacctccatggcgaaggtgggtctggccagtggccgtggagagcaacacctttccccttaaaaggacccaaaggcggatctaagccttagacatttatacaggatagacctggatttatctcaagcagagctcacaaattcagcgatatgatctttgaagcggagtgagcgtttcgagtttcctacacnnnnnnnnnngcatttatacaggatggatctggattcatctcaagcagagctcacaaactcagcgatatgatctttggagcggagtgagcgtttcgagtttcctacacccgcattgcacacaaaactccacgagcgcactctgtacggaatcccgtgttcacgccgagaaacagtacttcattgacctcatttgggccgatcactgctcagtttttgggatcccatgcgtacaatgtctttatgtcggtcctggatcacttctgccgagggtgcatgacctcaccccggtgggacacccacctttcccccctctcgctggtgccgcttgaaacnnnnnnnnnncctgacctcatttgggccgatcactgatcagcttttgggatcccatgtgtacaatgtctttatgtcggtcctggatcacttccgccgagggtgcatgacctattctcggtgggaaacccacccttcccccctctcgctggtgccgcttgaaacacgacctcagaatgggtgatcaggatgcgctgagcacctacgaccagattcggctgaccctgtcctccagctactacaccctgcgccgggccttgaagctgaaccggctgcgcgacctgctgcagcagtcggccctggcgcccgacgcccccatatggattatggggcaggagtatgctgccagccccgaactggggcaggaggagcaggaggaggtgagggagtggtggagacgagggcgtcggtcctttttgtgtgtttgtttggattgctacccatagtaactctccctcaccctcccttcacgatccaacaggtgctccgannnnnnnnnnaagggtgtcggtcctttttgtgtgtctttgtggattgctacccatagcaagtctcccctaacctcccttcacgatccaacaggtgctccgagaactcgtctgctgtttccagtccatcatatggatgacgtaccgatcccacttcgccccaatcagtgagcctgatggtgctggagagggtgggagacagcccaggacaccattcaacagggtcggatgtgtgaatgatgccacctgttgtaccagtaacacctgcgctcgctgactgggactcaagagacagtgcccggcctgtgaaggtggcgcctgttgcctcttgttggctgagtgtcttcacctcagctccttccgtcgacagcagcttccctctacccactccacactcttgcagcggtaggagactcgcacctacgaacggacgcggggtggggctgcacgctgcgctcgggccagatgatcatggctcagggcctgcggcgccacctgctgggctccgactggcgctggccggaagaaagcgtggccagcccgccgcccgggctggccagcctgctgtccctcttccacgacctcccacagacctcagccccgctgtccatccactccctctgcgagcatggccgggcctgcgggtgagatgtggggcgaagggtgggggcttgtggagtgtgaaaggaggccagcacactgtcattccgtcgctgttgcaccttgcggctgtcagggttctcttgtaccgcccctccacccacctgggcctccggatcgctgcaacactgctggcctgtccaccaaccggccgtcctgctacacacacatagggtccaggcagggaggtggctgggcccctgggtcatggctaagtcgatggaggccgtcgcgagaaccagcaggcccctcctcgacgcagggctgactgtggccgtgttggacgagcctggcggtgcagtgccccagctgctcatcagcaggtgtccagggatgcatgcccttgcatggtcattttggcaggggctcacccatcattccgaggccaagcaggcacctctgacccgcccgacccgcctcccctccccagtcacgaggatctctggggtggaccctttggcggagaggccgcggccggcccagagcctgggccggacggaggggccggcccttcctcctgcgccaagcgcccagggctgatcatgctcgtcccacttgtgcttggactgggcaaggtgaggggtggactatcgggagtgaagtgggcctccctgatgcgacgggccgtgggagggtacagtatggacctggcaaaccctgctccatccaccggccgtcggagcagggtatatgataatataatgcgactggactgccttgcagaatggggttgtcccttcacctctcccctgtccccatctgcgcagttgaaccctcgttacatcccccagctgcaagcggtgctgaccatgccccagagcatcggcatcgtcgggggccgtccagggtcctccctctactttgtgggcacccagcaggacctcctgctctacctggatccccatgaggtgcaggaggtgaggtgctgggcgggtgtcctggagtgcgtctgtattgagggggaatggagtggtgggaggaggtttcctcattgggactcttcaggcctggggtgctggttgactgttttctcgtcgagtggctttctcatgtggtgagtgggacttgaagctgtcgattcttcaatgacagcatggcatcgcgcaggcttcagcgcccatctccctccccctctgtgccctcaaactctttccaggccgctacgggggacgagcactggaggtcgtactgcggcaccacgctgcgcacgctgcccttcaccgccatggacccctccctggccctgggcttttacgtcggcagcaagggtgcgctgggcgatggtctcactgaccttaaaaaaagaaatgtaataagcctgccgcatccagtgcctcagccaccannnnnnnnnncctcactgacctgggaaaggaaatttaatgagcctgccgcatccagtgcctcagccaccacccccaccctcttcctcttcctgcacacagaggagtacctgggcctgtgctcggcgctggagcagctggaaagcaggtcggggggcgccccgctggtgtgcgtcacccgcgcccggctctccatggagcacgagtcgccactggacgagtgggagcctgatgagctcaccagcgaggacgagggggccgaggtgatgcacgccgaggcgggcgcgctgcatgcggccgaggagggcgacgcgggcaccgtcccttctgccgcgactgtcctcgacgccggcacgccgacaagggaggccggcactgccttggggggcggggcgctgctggatggggtgggcctgccaagcccgcagacggacggagcctcctccccgctggccagtcatgggtccaggcagctgtccacggctcgctctggctgggagatgctctgattcctggccgccgccttcacagaccatgtaccctcacgacgcactctgctcggtgctctgatacccagccctggctgcccgagcatgttgtttgtacttgtaagaccgtcccacattggacgtacttttaggatgaggaagctggtatgcgggatggggcccttcctgccggcaggccccgcctctggccccgggaaaggacggagatggatccgtccggattcgagtctgtctacgtcaggcacagcgaaacacaagcaccccgcaggccgctcccgcagcccagcagcctgtaaatgttcaatcgggacaagctcaaggccctggccgatcaggccaaggccgctgggggccggctggccaccagcgcccaagccggcatcgcccaggcgcagcagaactttgccgcgcagcgagctgccaaccctgggtcaggtattgagagctgcgtttcaggatgcaaagccacaatgaggttgcgaatgtcgcttcccgtctgctacgccgatcccaacgcaacaccataccccaaatcccccgttcacaatgcagatctggccgctgaggatgccatccgactgctcacagcccagaacgaggccctccgcatgcgcctgaaggcgcaaaaaaggctgtctgaggagaatgagcacctacgagcggccctggagcagctgcaggtgtgcagttcctttgtctgcgggnnnnnnnnnntgacgcccgcgcggaggccgtgtccgcgcgggccgccgcccaggacgccgctgcggagctggnnnnnnnnnntaatgaggtgaatcatgcgattctgcgtgagtgggagtttcattgtccctaggtgttgggccgctcagcacctccatttactccaattgcaaatttccagggacgagacgagggcgtcgcggcgcctggccccgcctccgagcgctccgagctggagtcccaggtggagatgctggnnnnnnnnnncaatgaggtgaatcatgcgattttgcatgagtgggaacttcattgtccctgggcgttggcccgctcagcacctccatttattccaattgcaattctccagggacgagacgagggcgttgcggcgcctggccccgcctccgagcgcgccgagctggagtcccaggtggagatgctggtcgcggccctcgcagacgcccgtgcggaggctgtgtccgcgcggtccgccgcccaggacgccgctgcggagctggccgccgcgctgcgcaccgtggaggagctgcgcagcgagcgctgcagcctgagggagctgcaggccgccaccgcggaggccgccgcacaggcggccgcgctggagagggagaagcgcgggcttcaggccaccctgggggtggagcgcgtggagaggagggagctggagctggcccaggccgagatcgagggcctacgcgtttgccttggcgagtcgcaggctgcgtgggcggctcatgttgcggcccaggagctgcgtggacgtgaggcggggcccgaggaggaggaaggggtgcagggcgctcccggtgccgcnnnnnnnnnngcgggttcgcctcggcgagtcgcaggctgcgcgggcagctcatgttgcgacccaggagctgcatggacgtgaggcggggcccgaggcggcggaaggggtgcagggcgctcccggtgccgcagagctggagagggttcaggctgagctggcacagacccgcgctgagctaggacagacccgtgcagagctgacaggagcgcaggcagaccttgcacatgcccacgctgagctgccagggcgacggcgggagctcctggctgcagagcagcccttggannnnnnnnnncggcaccgacccgcgctgagccaggacagacccgcgctgggctgacaggagcgcaggcaggccttgcacacgcccacgctgagctgccagggcgacggcaggagctcctggctgcagagcagcccttggacctgcagaacttgaaggcagtgccgcaccccagtgtccagccagatgcagggctgcccgcggcctcggccccacgcgtgcggccggacagcgccgactcggcatcgcctgggccggccagccgcgacctggaggagctgagggacctgctgagtggggcgggcagcctggccagtgacccaggggccggacccgtgcaaagatcggtctccgtgccggtaggcaagggcgaattgagaggagacgatcggcatgagccgtatcttgaggaactggcgctgtgcttgccctgcaatggcgcctgtgcaaccgcagctgcattcgctgatctccaccaatcgtcaatacccacacatgagcacaatgtcccgcacaggtccctggggccagcaccgctgacgctccagggagccatggcactggcgggatcgctcaggccctcctggatcgcatggccgcctccatccgggccaccgaggggtcgttcgcaggactgtctgaggacctggcacaagcacgcgctgacaaggagcgcctgacgcaggagctggcggccttgtcagagcgcgccgagcgtgacagggccgcggcagagcagcgggcggcaggcgccgaggcgagggccgaggagctgcgcgccgatggcgccgcgctttccagcctccgcgccgcggagcaggccctcgaggcgctgcaggcagagctgcgggccgcgcacgagggccgcgacgcagctgtggccgggctggcatccctgcgagcgacggcggccgctgaactggaatatgcacgtcaggaagcggcggctgagctggcaaatgcccggcaagaagcggcggctgagctggcgaatgcctggcgagaagcggccgctgaagtggacactgtgaggcgggagacaggggccgaggcggaacgattgaagagcgagactgcagctgggctggagcgtgagcgggtgcgtgcggcaggggagttggccgccgcgcatgaaagcgcggcgcaggctctggccgcagcgcgcgccgaggccgcggccggcctcgcggctgcgcagcaggcagcggacctgcagctggcagctgtgcaagaggaggcagatgcgctgcggcgggaggcagaaattgctgcggcagcctcctgccaggcctcggagtcggaagtgcagaggttaaaggaagagcaacatcgcctggaggcagccctggcagcggagcgagattcctccatggacgccgtcgaagcgcgagaggcggaagcaacagcggccgtcacgcgcgctgaggagcgggtccgcgccgaggtggaggcggtggctgtgagggaccgggctgagctggagaaacaggtgcgggcggcgcaggatcgtgccacggaagcagggggccaagctgaagccgagcttgcacgccaggccgaggcgctggaggcgacctcgctgcgggcctcctcagcggaggcgcgctgcctctccctccatgcaacaaccgacgcgctgagagcccagaccgcggcgctgcaggagcaagtcgcggcgctggaggctggggtggctgcggcaagctcggcccggtcccagagcgcagagctgccagtcgctgcatccgggcaggatcgggcgtatcaagaagcggagctcaatcccggcgctcgggggcacggcaacaagagcggcagtctaggagcggtgcctgcaagggctgggcccgggagcggagcatccgaagtctctgagattccggtgagtgggcatggttgtgttactcttgcggtggaggcagcgcccagggggcgacttttcaaggttccccctgccacgccaccggtcctgctgcagcgtgacagcatccgtgtttgaccttgccctctatactgattgctggactcaccctccccaccatcttccctggcgtgaggctcatcctgtttttcatccggaccatacataattactgcatcattcaaatgcaatccccaactccaggccgctgaggggagtcctgcagaccagcaaatagccgacgaagctgagctgcgaggaaggatccgggatttggagctggcgctggtcgagaggtgggtggctgagggtgcccaggaatgtcgctcccatgagaatctgcgctatgctcctgctcaccaataccctgcacgcctcgagaccccacacagtgagcacacgcatgccctacgggacnnnnnnnnnntagaatctgcactatgctcctactcacaaataccctgcacacctcgagaccccgcacagtgagcacacgcatgccctacgggacacatcggcctcaatcctcaaggaggagattgaggagatgaggtgaggacgttgcaggatgtggcagcttggagggataccgtgtacaggagtttggccagtgagccatgctggccatattccccagcgtctcctatcccagctgcatcccctccacacccacacggcaggcggcgggactgccgggagtctgtgagcctggagtacctgaagaacgtcgtgctctctggcttctacaccggccagctcccccccacctccccgctcgttcccgtacttgcaaagctgctgcagttcagtccccaggagtcgcgccagattgctgccaaggccgcccaggcctcgcaggcctaccgcctcctgccaggcttctgagatccacccacctgacggcgctgctgtaattacgtgtgctgctcatttgcagctgtccctccgttggagtgatgaccgagtgactacgggagagatcaagtgatggatcgacaaaagccatgaccagcttccgttcagggttagtccaggactggctcagtacgccatcctttttgcggctgcgttgcctatttaagaatcttgtcagtttgaaggttgggtcaatccaaaaaggtgatcgtcccaaggaattatgccttgcatgtggccgcacgcattctgttcagcacagctgcaagcgtgctggacgttatcgacacatctagcctacccgtaccccttacctcgagaatttgcaagcaggggagcatagatttgccagacttgaatatgatgagagctcccatatcaaaactcttatgatctgtcattagtgtaagagtgggaagcgacagcgcgtcatgcagttgcttcaatctnnnnnnnnnngagactcgtttgatctgtaattagtgtaagagtggaaccgacagcgcgtcatgcagttgcttcaatctcagcatgagcatgagtttctatttgaaaggcgcctccagcccatcacgtgacagctgcggcgcgcgcggcgacatcgacaggtcaaaaccagggtggacagacagttctcggtgggccggggtacgagaggacgtcgccaaggcgccatatgctataggcgcaataccggtggtaggaggacacccgtcgcccagcgatctagcctgatggcatccgtccggagcgagtgctccgatttcccgagcccaggcctgtggaaaaaagtcgaaacctgggagacggcagatccccaggactccatcccagcgcagcatgggccatccatgggtgtattctacacctccgacaccctacttgctcccacctcccctgccgcaagcgtgcgtgggttgggagcgcaggatagcggcccgggagacctctgcctcctggaagagggcatgcaggggcatgcctgcgatcaggaccaaaagctgcagcacgatcttggagacctgcaggcaagtggaggtggggaatgcgtgtcgtgtcttggcatggggggtactgagggccctgctacctgttgttgcaccatgtcgtgctcggacgtccaagcatcaggggggccgtcatgtctgcgagagtccattcccaagccggccgccgcacgccgcaccctttcttcccgcaggacgtcctggaggccgcgacnnnnnnnnnngcgtcatgtctgcgagagtccatcaccaagccggccgctgcacgccgcccccttccttcccgcaggacgtcctggaggccgcgacccgacgcgctgagggcgccgaggcccgcgccgccgacgctgagctggcgctggactcggcgctggacgtcgtgcgcgagctgcgcgctggcaacgccgagctggcgggcgcgctggaggaggcgcgggcggcctcccgtgacaaggccgcgcgcgccgaggcgctggcccgagagctggaggagtggcgtggcgcggcggcgcgcg

SEQ ID NO: 38228 - DNA, 62 bp, Chlorella protothecoides
tgacaacgttgaccttgcaggccctgttggagcaccgcttcgtgtcgcacagttccgtccac

SEQ ID NO: 38229 - DNA, 61 bp, Chlorella protothecoides
agaggatgacgaggtggtgggtgaggggggggagccgggatcctcgacccccccactccca

SEQ ID NO: 38230 - DNA, 108 bp, Chlorella protothecoides
gccatgcggggtggaaaggtgcgagttttccagggggtaagaaccctcaatgccgcggcacggctggcatggcatagtccatgtgtcaagatgaccctctcagtagcg

SEQ ID NO: 38231 - DNA, 61 bp, Chlorella protothecoides
attatcatctaccgccacaacccccacaccagccacgacgaggacaccaggcagtgccacc

SEQ ID NO: 38232 - DNA, 78 bp, Chlorella protothecoides
tgaggctgaacacaaactatttctcgtcccaaacctgtggaatggacttttgccagctctgcactacctcgtcgccct

SEQ ID NO: 38233 - DNA, 61 bp, Chlorella protothecoides
ccgggcgggatggatggatcctcttggcaggcctcctcctcccctgcgtgccagacctgcg

SEQ ID NO: 38234 - DNA, 105 bp, Chlorella protothecoides
agccgtgatcacacatggtagaggtcctcgtgaaccgggtgtgaggttgcagaatccttgtcctgagtgagctgtgcgcgcacgatgacgcatgcctgttccggg

SEQ ID NO: 38235 - DNA, 61 bp, Chlorella protothecoides
cgctgggcgcgctgcgcggcggcctcggccttccgactggcgcgctcagaggccgccgcct

SEQ ID NO: 38236 - DNA, 62 bp, Chlorella protothecoides
gctctctgctgtgggacgccgactgtacatctgggcacacagctcgggcaccccagagcctc

SEQ ID NO: 38237 - DNA, 61 bp, Chlorella protothecoides
cctgcccctggtgtacctggccgccaactctggcgcgcgcgtgggcctggccgaggaggtc

SEQ ID NO: 38238 - DNA, 61 bp, Chlorella protothecoides
ggggctgccgctgctggccgcatccgcagatgcccggcatgtcgacccggtcgccgcagcc

SEQ ID NO: 38239 - DNA, 8083 bp, Chlorella protothecoides
  modified_base (334)..(343): a, c, t, g, unknown or other
  modified_base (865)..(874): a, c, t, g, unknown or other
  modified_base (985)..(994): a, c, t, g, unknown or other
  modified_base (1156)..(1165): a, c, t, g, unknown or other
  modified_base (1918)..(1927): a, c, t, g, unknown or other
  modified_base (2396)..(2405): a, c, t, g, unknown or other
  modified_base (2706)..(2715): a, c, t, g, unknown or other
  modified_base (3385)..(3394): a, c, t, g, unknown or other
  modified_base (3800)..(3809): a, c, t, g, unknown or other
  modified_base (3913)..(3922): a, c, t, g, unknown or other
  modified_base (4024)..(4033): a, c, t, g, unknown or other
  modified_base (6267)..(6276): a, c, t, g, unknown or other
  modified_base (6858)..(6867): a, c, t, g, unknown or other
  modified_base (6923)..(6932): a, c, t, g, unknown or other
  modified_base (7122)..(7131): a, c, t, g, unknown or other
  modified_base (7877)..(7886): a, c, t, g, unknown or other
accggcacatctgcacgcgaaagggttgcaggtacaaagtgaggggcgtagttctccgacgctcttctacacggccaggcgtcgaccacaaaaggggtcaagtgcctggtaaggctcaggaggagcctggttcaatcagacaacaccatttgactcccagggtacaccctgacgtcaatgtcaggctggtaaagggctgtgactgggacataggtgcacaatggagcacccacatgtctaggatcccacccctcaacccggcagcccctcccaattccgggagtaacccctccttccccttgtgcacacttgcctgccatggccaggcacaggnnnnnnnnnnccagcccctcccaattccgggggtaatccctccttccccttgcgcacacttgcctgccatggccaggcacagggtcctcagcccccgagtcgccatcgctgtcacacactcctccagctcacgccggaggtcggcgcccagcggccccgcgccccctgcgccgcccgccacgcggctgcagcggccgagcaccacctccgctgcgcccttgcacagcagacgcaggccgccgcccgcgccgccgcggaccagcacgctcgacatcttgcgctccgaggagaaattgaagaccatggccacgtcgtcgctcagcgcggcgcgcacgtcgcggtagtcgcgctcccagccgcgcgccagcatgagcagcgcgcactccgtgcggttgcccacgaaatccacgccgccgtgctcgccctccaccaggaacgcctgatgtgcgaggaggaagggtgaggtggaggggtccggaggaggagactcaagcaggaagaggactgaggccccgaatgggtagtcggaggnnnnnnnnnnttccaccaggaacgcctgatgtgcgaggagtaagggtggagtagaggggtctggaggtggagactcaagcaggaagaggactaaggccccgagtgggggggaggggggggnnnnnnnnnngaaacccatttgcagaggaatccatgccatcctcctccaggtgatagcataaggatccctcaacaggtacacaaagttcacacggcacggccaaacagacccaggctccctccatacgtgaacacaaccataccaccgccccgccgcaccttggagttgagnnnnnnnnnncacaccaagatcacacggcacggccaaagagacccaggctccctccatacgtaaacacaaccataccaccaccgccccgccgcaccttggagttgagggagatgttgtccacgatggcttcacccacccctgatcccaaatcctgaagcaggggcaggcccttggtggcagcccccgcaaaccagccgtcgacgacggtcatgcggttctcggtcagcgtcccggtcttgtcggagcagatggtggtggcgccgcccatggtctcgcaggccgccagaacgcgcacgaagttgttgtccttcagcatcttgcccatggagtatgccagggagatggtgaccgccagggggaggccctccggcaccgccaccacgacgatggtcacggcaaagatgaagaactccagggggccagaggcgaactgggacagggggaacccgccattctccaccatccagcggatgagcaggacgaagaagcagatgaccgcaaccacgaggcccagcttcccgatggcggtggccagcacgcccagcttctcctgtgtgggtcgggaagaaatggcggaagaaggggagtctttgtaaagggagtggggtgaggttgaatggctcaactttgcatcggtgcagccagcgtgagtttaccagcactcgtctggcagaggggtcacactccataaaggcgtgctgaaagtcaacagtgttcccccccccctctctgctggatgatcttggcattgcctcccccatnnnnnnnnnngtggggaggaatggcggaagaaggggagtctttgtacagggagtggggcgaggttgaaggactcgactttgcattggtgcagccagcgtgagtttaccagcactcgtctggcagagaggtcacactacataaaggcgtgctgcaagtcaacagtgtgctccccccccctctccgctggatgatcttggcattgcctcccccatgcacatgcctgccttgatcgttgttcacccaagggccctcttttcaactccaacatccttctgcgcgcacctggaggggggtgtccggggactccacctgcaccatgctcatcgtccgaccccagtccgactgctccccgactgctagaaccagcatgcggccggagccctcggtgacctgcggtgatgggttgtagaaggggggatggttggagaatggggcagggtttgggctgcgaggagtttaggcaagcctggtgatgcannnnnnnnnnggaaggggggatggttggagaagggggcagggcttgggcagcgaggagtttaggcaagcctggtgatgcacacagctctgcagacacacacgtaggcaagcgcacgtttgtgcaaagcttcctgcttgtattcccttctgacactgaatgcatacaggattgcagactcccccaacctcccccgcccttcagcgccttcccctcctgctctggaacacacatccccttccggagaaaacattaggacaccagccgagaagcccagcccacgcggcccacctgcgtccccgaccgcatccannnnnnnnnnaaacccacatccccttccagagaaaacagtaggacaccagccgagaagccaagaccagcggcccacctgcgtccccgaccgcatccatgggtcgcgctcgcccttcttgatgggctcggcctcccccgtcaggcttgcctcgtccaccaccagcccatgcccgtcgatcatgtagccatccgccacgatcttgtccccggtgtccaggcacagcacgtcgccaacaaccacctcgctgttcaggcaggtggcctgggcgccgccgcgtaggaccttgacctcgatcacgtcacgctgggagttgagcttctggaactggcggtccttttgccagtcgttgccggcccctggtcgaggaaggggggcgcacaggagggaatcaggagataggagctcaatggccttggagctgctgggggaacaacaagcctgagggctggatccaaaattctataaaggaaccatcagggcctgcacgccttgcccacacagcaccccaagagcttgggcagggtgctgtcccaggaaccctccttccaagtcgcatcaacccagtagagtgctctgcccatcgccccacactcaccgaccagggacaccacgagaacagccacccagatggcgatgccctcggtgtatgcctggtcgtctcgctcagccttgacagccnnnnnnnnnnacaatggccctccactcaccaaccagggacaccacaaggacagccacccagatggcaatgccctcggtgtacgcctggtcgtctcgctcagccttgacagccgtgccaatgatggtggatacctggagggttgggtatattggttggcccagttctgagtgcaatgaggtcaaggggtcagaaattggcaggggcagggccagcacactgagggccaatgtgtgtactcagatggcgggcaaagggttcgtgcagggcacggcatcgagattgacccagagcgccgttgtgccattcaggccaggggaataccaggccagcgtgtagacatgtcgcaaactgccactcaccagcgctgcagccatgagcatgatcagcgtcgggtcctgcagccagaagggtgggnnnnnnnnnntgcaggcaaagggtttgcgcaggcaaggcatcaaggttgacccaaagcgtcgttgtgccgctcaggccagggaaataccaggccagcgtgtagacatgtcgcannnnnnnnnngagagttggttcatggttgtacacgcactctgcttctgcgagacctgaagcattccttcctctcagcctcgacaagacttttggccagcacatccatggggnnnnnnnnnnagagttggttcatggttgtacatgcactttgcttctcagagacctgaagcatccctgcctctccgcctcaacaagacttttggccagcacatccatgggggaatgtactcaaacctcgtattgccagccgcccccataagcaccttgaggacggaataccagaggacgaaaaagttcttagcaggaacgggcttaaagacgttgctcccatatgcctcccggcgcgcggccagccccgttggcccctccaggttgcaaccctggtggagttcggtgcgcagggcggaagccaccccggccaggccaccggccctggccatgtccgcgtcagacttgttctgggggagggcagggagcgggagagacttcgggcatcctggcacaaagccacatacagggccccgatcatcggaccccaccagctatcgaaccacgacgcgttgtccacgcacctcattcagggcaaacagggcttcgcaggacatgtcgaaggggccagcgcccgacacatgtgtcgggcgcagggtctccaggtccacatcctcgttgcggccacgcatgactttcaagctattcaggagttttcggagagtatattcgcaacacgtcgctgcgggtcagaagtcacctgtttcagtccccgagcgcgaacatgtggtactccaggggccctgacccaccgcgtaaattcaatgaagatcactgtttggcactattttgtgtacgtgcaaggcagttgcgggctccatcccgccctgcctggccggatcacgggaggagaatccacgcgctttgcgatgggtcctgcgcacaccaaaaaccctgggaagataccgggaagctgcctaagctcagctggtccagcaaggcagaatatgctgcatagattccgagcctcatcagagaatgatggatcaaccattgttatcgagagctccctagacacctattatgtacatgcgagccgtgccacagaaaaggtacagtggcaggccggtgacgggaaaggggtgcattggctgtaatgctcgcaaagttggccattaaaaaggtgatgaaacggttttctttgatgcatgagaggttggcaaacaaggcaggaaatggaccgtgtgccattcacacgatgccggcactgccgccgcgggtgaggcggtgcgtgctgctggcgcggggggagcgcagcgtggaactcccgtgcttcaccagggtgtcgtcgtcgccggcgccgcccttcttgcgcccaggggtcccgctcatcttcttcagttcggacccggcgctgctcttcttcagcgcagagtcgccgctgaccttggccagctccgactcgccacgcttccacagctcgcggatgtgcttgggcgggggtgggcgcagccactgccaccagtgccggcggtacaggtccttggggtcagtgaaggtggcgcgcttcttcatcagctcctcgggcgtgggctccttgatggggaaccagcgcctggggggtgggggtggagaggaggaggagggtgctgggcaatggcatccagcggctatccgcacgacaggctccttacattcgcagagttggatctacatgccacccctcgcatgctgtgcgccaaggctttgcacatggatacccacacgcgcctgctgcctccatccggaaactcgatggacctggctccaccccgcacaattcccccgcaagccatcctctacccccctcacctcgtgacaaacttggcgatgagggccaggggcagaccgcctgcgccgatgaggagggagatgccccattgaaggcctgactgggtttgcagcctgaacactccttggaggaagaacatgatgaggacctgccagggggtggagggggtgatgaaaatcagcttggacggcatgcttggcaggcgatcagcgtgtgaaacattcaccggcggcatgcctctggtgcggcaatggctgcgtgagcagcgagccgcttcttccgttccaccgccccgctgggaactccggttcgcactcgcctgcagcccagctatgaggaacaggatcccgatgaacaggtagcctttgaagagccctgcaaatatgttgtactcgtcccggagcttcctcgcgttgaggaagttgaagagctgcatggaggggtggtggcatgagggtgtcatggtggggtgcagagtattcataacgctcaagccaccctcaaacaccgtccttttccatctggaatgcgcgcnnnnnnnnnnaggcatgagggtgtcatcgtggggtgcagagtatccataacgctcgagccaccctcacacaccgtccttttccatctggaatgcgcgctgaagggaagtctgcgcaaaacccacccaaaccaaaagcactaagctcctttcacttgcctgcatgcagatgaaagtgttgaagaccatgctgctgaccgcctcctgggcgtcgtactccgcctcggcatactcgtcgtctgcgtggagatggggtgagaggctcatgggcaatgctgccgtgccatcagggcggttttgatggaaggttagggtcccacacccagggagcgtctgacaggatgcaaggccatcgctgccagggttcaaaagacaactcaccagcctcaaagtaggtctgctccatgaacctccagcgttcacagccatccgcattgccgtcacagtattcctccggccgaggctcctggatgacgcatccgccatccacagacagctggcacaggggggtctcgcctggaggttggaagaggagatgagggccgtttggactccgcttgcatgatgttagaggtgaggtatgtgcaaggagannnnnnnnnnagttagggtcccacaacctggcagtgtctgacaggatgcaaggccatcgctgccannnnnnnnnntgagaggattatattcagagcatgtggaatacagagcagcaaggaccctcggcccctgcttcccgcagctaaactcccccgccagagggtgtccgctcccgcgatgcacacccattgcctggcgcccacccaccgtgagcgcccctcttttgccccctacatttgtagcgctcacctggctggtagatgnnnnnnnnnnaccgattggactccacttgcaggatgttagaggtgaggtatgtgcaaggagagtgcctctgcacacgttgcacccccttgcactccaataacaggtccactagatccaaacgagaggattatattcagagcatgtggaatgcagagcagcagggatccttgtcccctgcttctcgcagctaaactcccccaccagggggtgtctgctcccgcgatgcacacccatcgcctggcgcccatccactgagagcgcccttcttttgtcccctgcatttgtagcgctcacctggctggtagatgccgccataggtgtccaggcagctctggctgtctgccaggcagcacaggttggtgttggcctggaagtactcgcacttggtgggggtgcggaaggagggcaggtggcgtggcatgccgtagaagatgaggaagagccagaaggactggtacagcgtgtgcacaaggatgttcttggccatggtgcggctgaccagggatgagtcccgcccatgtggttcgtcgtccatcagctctggcccgggcttctccagcgcaaaggctgcattggtgaggggttgagtgaggaggggcgagagtgtggtggagggtaacggatggaacgctcaggatctggaggatgggctggctgacatgaggcctggttttgagcacctcagcttagctcgtaaggtccacccctgcccaagttcctgagtatgacctgcccacccccctccccccaacacnnnnnnnnnnacgcaaacgctgcattggtgggagtggaagtgaggagggggtgagcgtgtggtggagggtagtgtacgttgatgcccaggaactgggggatgggctggctgacgtgaggcctggtttgagcaccccagcttacctcgtaaggtccacccttgcacaagttcctgagcatgacctgcccacccccctccccccaacac

SEQ ID NO: 38240 - DNA, 160 bp, Chlorella protothecoides
gaggcatggccctcgtctcttccagcgccaagccccccaccctcaaccgcaccccccccatattccctcagccctcacctgctgtcgcgctgagacggcccttgatgaccgtcagtcgaggtttgccgctcctggacgcctcctgctgcaccgtctccac

SEQ ID NO: 38241 - DNA, 173 bp, Chlorella protothecoides
ggttgtgaaggagctggcagccatggtgtacgcgagcgggccgccccaggactgatgaacctggaactgaacttggagacagcgctgccaaatacaacagggcaatctggcaaacgatgagtgcgctgcaatactccttcacccgaacttagatgtactggactatgactcta

SEQ ID NO: 38242 - DNA, 61 bp, Chlorella protothecoides
ggtccctgcaatggacacggcgaactctgcgagcccggaacgcataggtgctcgctccacc

SEQ ID NO: 38243 - DNA, 5715 bp, Chlorella protothecoides
  modified_base (92)..(101): a, c, t, g, unknown or other
  modified_base (731)..(740): a, c, t, g, unknown or other
  modified_base (1104)..(1113): a, c, t, g, unknown or other
  modified_base (2185)..(2194): a, c, t, g, unknown or other
  modified_base (2747)..(2756): a, c, t, g, unknown or other
  modified_base (4037)..(4046): a, c, t, g, unknown or other
cgtcgttggtcttccccaggtcctggatgcagacggtgctggtgatgtgctattggggcgacagccagaagcaggagacgggagccagaccnnnnnnnnnngcctcggccatgggggcaaaccccgcgctggcgccgcatgcccacgccgcggcgcgcctggcggccacgctgttcgtccccggcgcggcgctggccacggtcaaggcgcgcgccgccaacttcatcctgcgggcctcccgggcggggcgggtggaggacgtcgttggtcttccccaggtcctggatgcggacggcgctggtgatgtgctgttgctgcggcagccagaagcaggagacgggagccagaccgactctgccatcgcgaccgccctggagggcatcgccagaggcggccaggccctgaagatgggcggcgaggtgggcgacgcgctcgcgctggaggggctgctcactggtctggtgcgccgtcccatctccgccgcccagctggcagcctccggagcgggcaagggcgcgcggcgcctgcagtcccacccctgcacgcgggtggctcaggcggctcgagacctggtcgagcgctggaaggctgggctgatgaagcagggctaggagtgggagttgacggccggcgatgtgcgcctggcaagctcacgatgcatcgggcatcactcgtgtccgcagcccatactctaatcggcccaatttgtactgcacaggtatctagcgagnnnnnnnnnncgcgagtcgacggccggcgatgtgcgcccggcgacctcacgatgcatcgggcatcgctcgtgtccgcagcccgtactctcgtactcggtccaatttgtactgcacaggtatctagcgagtggtatcctacctgcattgcgccttccttcatcccagtggctccctccccttcctgtcaccactcgcgacccttgatcgccaccacgcgctctcgcctacagacagtttgctgcagcagcactctcagcaatgcagggatgggcatgatcatgcagcaaagggttcaatcggtgcaatgcaatccaggatgaatctgcttctttccagcgaggtcagtgggcagggcttggtgatacaggggggnnnnnnnnnngtcatgcagcaaagggttcggtcggtgcaatgcaatccaggatgaacctgcttctttccagcgagggcagtgggcagggcttggtgatacaggggggccgcagtccggcagggggcaaagggtgtggtcgcgtggctgcagcgatgcgcgtgcgggccctggagcagagtacattcccaaggagcgcaagtggcgctcgtggcaagaagccatctcgatggggagtctgcagggaaaggaggtggagcgtgaagcagagggggtggccccgatgttgagacgtggtctctgcgccgacacagctgctgcggaggggcctcttcagtcggtcgtgccaatctctgctcctcagaactccaggcctgcaaacagctcgtcctccagctccggcagcgcgcaaggggggcagcccgaaaggtcccctcctgccgccaggaggtccagctcctccgcaaacagcttcttgtgtccgatgacgggcaggcccagggggctcatcgccggcaggaggccgccggagaaggtcccgccgcagccagcgggggggcccgccccgccgcccgaggtcccgggggtgaacatgagcttgccgggggacaggaacatgttgcacgccgcggcaaacagctcctcggtcccagggctgaggaaggaggtggccaggctggccaggtcgggctcgggcagggccaggcggggcagggcctggggcgcggcgtcgggctggcggggggtgtgcagcgcactcgccccctgcgacgtggcgttggccggggtggcaaaggtgtcggccaggcgcgagcgccccacggcgtgcgcgggccgccggcggctgccgtgggaaggggcgcggcgggggggggcgaccttggtgcgtgcctggtggcccaggcgcaggcagcgctgcaggtagctgaaggtggcccacaggtctcgattctcctcgtccatcacggcgctctgacagtcgtagagagggaggtggaggtgttgggcggagggttgtgaaagtcatgtgcggaggtgacgacttcccggggggaccccgaccccgacagccacccgacgcagnnnnnnnnnntggagggttgtgacagtcatgtgcggagttgacacgactttccggggagaccccgaccccgacagccacccgacgcagcattcaaacggacaccgcggctcgcacctggctctccgcctgcacgatcgcggcctccatctcggcgatgctctgctccagttcccggacctccgcctccatggcacgaatgcggccatactggacgaccgggcgcgtgtatgtgaggtccgggaaaggggtcaggcacagcttctgcgcagggggcaagctgtcggacagcgagccgaagtcggttgcgagcaggccgtcaaacttccgcttcttcttgttgctgcgatacaggggtgagatagtgagttggggtcgaggcgctggccgaggggaccgggacgtgcccgcaccagccgagatcccgcactcacgtcggtcccacggagtccaggttgtcgaaagacaggtggccatctttgaccgcaaagtcttcgaagaggttcgccgccagcggcgaggtcaggctgaagcccttggggctgaacaggctggtgaagggggnnnnnnnnnnaagtgctccccgaagtccgtcttgaggggcagggggctaaacatcctgttccggagtttgtcaggtagtgtcagtcaagagtcaggagtcagtcgggtcaggtcgtgtcgccttcttgctcagtgttaatagggttgtgcgcgcgacagatggggatgccgggtatcattttgaaagcagcagaagccggctgctccggggtcgatcgatcgcaagcccctctgtctctggagcaggggaatttgcgctgcaccgaaagcctaccagcgcccggtgtctcctcagtgctccgatccatagccaatgagtttacagaccaatgaaatgactcaacgtgagtgctacaattgcacagggtgcgtggatgttgttttggtgtgcctccgcagaggcttcgtcactcgcgtcactcccctgctgacccatcggatcagggggtcgaacgatatgccgcgggggcaccagagcagggcaaagaacgccagcatgcgcaggatgaggccctgggcacccagaatcagcagcccctttcgggcctcgccggcgcagtacacattgatgtccagcgacatgttcagcagcgcctctgggacgaggcctgtgggtgatgagggaagggtgagggaggcggcggtcacgaagggaggactggggtgcgcccacgggaacgcacgcatctgcgccgggccgctgttggccgactgctctgacccaggggtcgcagggtcaggcttgcatagaccctgccccacttccgcatccactacacacctgacccggcggtgggctcctcgatgctgtccaggccgcactgtccagaggcaaacatgatggaccgggtgaggggccactgccagggcggctgctccctgaagtcccagatggccgccgcatcagcggcccacctgcgtggggttggggtgatcaaggagggtggcacgggctctgacttgggaagtattgagaaatcttgtacaggcccagcacagaacccactgaggctctgtgctgggccaatcactgcctcctggagcaggaagcatgtccccaccagcctcatcgcacctgttgtagctgaggacggtgatgcctttcagcaatggggagaggcttcggtacaccggattgaccccgttgatgaacctgcggggggtggtggcgcggggagcaggcatgagccggaacagcttcttcagccttggccgtgcattccagggggggaaggccacgccaggcgttgggtctgacctgccatccgcggcagtgcgggaagagtgccannnnnnnnnngggattgaccccgttgatgaacctgcgggcgttggtggagcggggagcaggcatgagccggaacagcttcttgagccttggccgtgcattccaggcggggaaggccacgcaaggcgttgggtctgaccggccatccgcggcagtgcgggaagagtgccactcacgctgatcgccgaccctggacgcctccccaaatccacaaaccccctgccaagcacacacgcacgccgactcaccccccgatgaccatcaggatggcgaccgaggcaaccagggcgctgttgttccccatgatgatggacatgaggcagcccagggatgcgcaccagaacaccaccagcacgccgatgacatacagctacgatggaagagcatgggtgcaggcggagtgagaggaggcgaggtgaggtgcatgccatggacgtgtgggcgcaagcgccgccggcacctgctcgccaccccccccaacacacacacacacacaactccaacgcctcaccagcccaaaactgatgctggggatggtcatgctatagtacacggacaggaagaccaggggctgtatgaacacgtctaccatgttggtggtgctgttggccatgaagtaggagaagaccctgacccccgactcgcgctcgcgccagtgcaccaggcgctccttcccgaacacggccagcgcgcccgaggcggcgatgatgcccagggtcagcatgatcagtgcgatgtgccccttgaagtcccagttggtccaacccgtgccgtgcatggcgcctgtggtgagtgggtgagggagagcgttgcgatgaatggtgttggccggggaggggtggatcgcagcgcaaacagaagctgggcagaagccggccgcacagcggggcactggggcggggttccagcccgacacctgtgagccagccagccggtggacccactcctcctcaccggtgacgatgcccgcgaagacgaggagcaaaaggtccaggaatttggtgccccaggcgcgggacagcttgatcccggcgcggacgagcaggaaggcgtattgcctgccccagcccggcgtgacgcgcagcacggagcgccccggccgccgccagcagcgcatcaggccgccgcacggtgcgcgccgcccgcgcgcctcgtccagcgtggccagcgaccccgcgctgccgccgcgcgcgtccgtccccgaggccgacggcgtgtgggagcgcaccgcgtcgggcgtggcgcgccccgacgcgccgccgttggcgccgcccagctcctcgcagcagctgagcttgaggtcgggggtgaccgacccgctggcgcccttgtcgtcctcgccccggccgcgcaccaccgcctcccaggccgctcgcaggccctgctcctccacgccctcgccgtacccagcgcccgggcggtcgaagcggatggccaccggcgcgtcgtgcgtggcggtggaggagcgcgagtggaccagcgggtcgccgccgccctcctcctccccctcctcggccacggggggcagcgggggcgcgccggcgccgcgccgcgggctgcccgtgctgctctcctccagcgggatgacgcagaagcggggggacatgatgcgcgtcgggctgtgatcctcgtcttcgtgcccgggcgccgcggcaccggtcgcgccgccgcccgcgtcccc

SEQ ID NO: 38244 - DNA, 78 bp, Chlorella protothecoides
cgtcagcgccaaaatgcggcggcccagcaccgacgtccgccctggcgaccctccgccccctgcgccaaaggcgaagcg

SEQ ID NO: 38245 - DNA, 65 bp, Chlorella protothecoides
caagggacggacatccaaacccccccccccccccccccctctccctgtgccctcccagggcgaga

SEQ ID NO: 38246 - DNA, 70 bp, Chlorella protothecoides
accttccccatctctggggtgtagagatgcttcagtttccttagcaccagccggggtccagacctcgaag

SEQ ID NO: 38247 - DNA, 167 bp, Chlorella protothecoides
ccccctttggcaagtgagtgtgaacactccgatcctggcgaggtgatgcccgcaggcggagtgtgcctttgagggctttggaggagggaaaggtcatacccctgcctgagtgtgtgctgccctccaccggtgcagcacccattgcctggcagggacccctgctctgt

SEQ ID NO: 38248 - DNA, 78 bp, Chlorella protothecoides
gcatggggtcgccaaggctaggatagatggtctgctgaaatgcggtgaatgtgcttgggccctctgcagccaagtggg

SEQ ID NO: 38249 - DNA, 63 bp, Chlorella protothecoides
cacgcgcagaacaccacagttttcctctgccaggaaggttggcgcagcatccttccagtgtat

SEQ ID NO: 38250 - DNA, 85 bp, Chlorella protothecoides
tggccagggcctcgtcctgtgaaggtcgaggggggtttttgagaggagaggagtgggagggattcaaggtggtgtggaggcaact

SEQ ID NO: 38251 - DNA, 169 bp, Chlorella protothecoides
cggggtccccttggtgtacgctggcttcctcggtgagtaagggttcgcgacgataacaaagctcttgttgtgggtcaggttcttcggtcctgcccggggccatgtgggtgcaatgtcccgaggaagatgaagccgtgcagtggctgactgccctcaccacagaatcctc

SEQ ID NO: 38252 - DNA, 61 bp, Chlorella protothecoides
tccgcagccgcctgcgtctcgtgcttggtcttcagggcgccctccagcgccctgggaggag

SEQ ID NO: 38253 - DNA, 2649 bp, Chlorella protothecoides
  modified_base (696)..(705): a, c, t, g, unknown or other
gcgagggcgcgacggcggcgcgcgccgcggagctcgccgcgcgccgcgccgtggtggaggccgagaaagccgaggcgctgcagcgccgcgccgcgctggagctggacgtgcgcgagctggagcgcggcatcgccggcaccaaggccgagcaggtcgggagtaggagggagggtaaaggggtgggggtggggtgggcaggctatgagctgtggtggtcgtggggtcggccctgatttccagcctggcaagcacacgaatcatgcgactcgacactgtcaccatgcactccctcctgaaccccacccactcattcacccccctacaggcggaactcaacaagggcctggacctcgtgagcagtgacatccggatcaagcgcgccgagctggcgtccctggacgcgcggctggcgggggccgtggaggaggagggcgcggcggcggccgcgctggcgggcagggaggcgcgccagcaggccctgtttgcgaagcagggccagcgggccaggtatgccaccgccgccgagcgcgacgaggccttgacaaaggagatcaggtgcggccgaggggtgggaggtactgaggttgtctcagcacaggggttttcccatgtgggaggctgcagctgcgtgtgaagttccaggcgccttcacacttgcaacacacccatcctcctcccagggcgctggagggcgcnnnnnnnnnnaatcaggtgcggccgaggggtgggaggtagtgaggttgtctcagcacaagggtttccccatgtgggaggctgcagctgcgtgtggagttccaggcgccttcacacttgcaacacatccatcctcctcccagggcgctggagggcgccctgaagaccaagcacgagacgcaggcggctgcggagcggcaggccgccgcgtgcgccacggaggcagaggcgctggaggaggtgagggcagggttgtgtggtgtcgtttttggagcacagaggtcggcggcaaatagtccggggtggcttatttatctgactctcgggaccttgaagtctttgagcagacccaccgccgtccagatcgatgggcgtcatctgtcacacaagggtcgacttttcttctgttcctggcacatggttcacacccccaattcctcgctgcaaccaaccccaccatgcccgctttgaccccggcaggaggtggaggccgcgcggtccggcctggccgacctggagcgcgacctggcggccaccgcggggcgggtgcacgcgctgtcccagcgccgcgacgcggccgtcaaccgccagaaggagctgtggggtgccgaggccgagctggatgggtgaggcgggggaatcgaggggggcaaaaggtgtgaggaggccttcaagggcgggcagcaccctcctggccacgctgcgctgctgctgcaacactgattgtcagcagacggcgtcgcgctccccggctcccggaacccccccctaccccccttcctcctgcttcaccctcccccctcgctcgtcacagctcgtggcggctgaaggcggaggagctggcgcgggtgagccgcgtgctggaggccgccacgccgcgcgaccttgtgcgcggcttggaggccgtggagcgcctggtgcgagagcacggcatccgaggcgtgcacggcaccctgctggacctgtttgacatcgacgcccacccgggacacgccaccgcggtggaggtcaccgccgggaacaacctcttctacgtcgtggtgcggggcgtgttgtttttcgtgaggtggggtggggtgtttgaggtgggtggtggagggagtttctggtctcgatgaccgcactgggtgcctgccccagcgggctctcgcatggacagggagtctgtgtggggagggaggacagagcggcgacgagagaacagccgccgcccggcaccgctgcacggtgactggccggcagcgcacagcagacgcgatggctctacctggctccctacagtagggtaccaacaattcccagactctccctccacatcccttccaccactccttccaagaccattccccctccctcgacccctttctctcccttccctccctcaacccccttccctcccttccctccccccccctgaaaaccactccactcaggtggacgacgacggcgtggccacgcagctcacgcagctgctcacgagccagcgcgcggggcgcgcgaccttcatgccgctcaaccgcctgcgcgcgaccgaggcgccgcgccccgaccagtacggcgacgcggtggccccgctgctggacttcctgtccttcgatcccgcgctgcgccccgccatgctgcaggtgttcggcaagacgctggtgtgccgcgacctggccgccgccgcgcgcgtcgcgcgcgagaccgacctggcctgcgtcaccatggacggcgacgtggccgaccgccgcggcgcgctccgcggcgggttcaccgacgtgcgacgctcgcgcgtcgccgccgcgcgcgagaagcggcgcctcggcgccgagctgggcgcgctggacgctgagctggcgggcgtgcgcggccgcctggcgcaggcgcagcaggacatcgcgctggccggcgaggcgctgggcagggaacaggcccagcagtcccacatccagtgagcgcagagagggggggggg

SEQ ID NO: 38254 - DNA, 130 bp, Chlorella protothecoides
agcgctggcagagtccttgcggctctaccctcagccgccgattctcatcaggaggtgatgagattggctgctgggctcggggcttgcagagtgcaccctgcgtgtccatacatgttggcacagagagtgc

SEQ ID NO: 38255 - DNA, 73 bp, Chlorella protothecoides
cgagccgcggtggcctggcccggcccggccgagaccgatgccagcatgcaccagcccatggggcctgcagcag

SEQ ID NO: 38256 - DNA, 104 bp, Chlorella protothecoides
gccctgggtctacgcctccctctccctccttcccctctcgcatccgcgcacaccaaccctgtggtggcccccgtgttcacaggggagcgggcggagtccgacgc

SEQ ID NO: 38257 - DNA, 80 bp, Chlorella protothecoides
ctggctgcatatgtgccgttcccttccatgcaagtcaaggggccaatagacacctctgcatgtatccagagtccaaacaa

SEQ ID NO: 38258 - DNA, 73 bp, Chlorella protothecoides
gtcctccccggcaattacccttgaaatgagcccatccctagcagccagccccgagttcccaccctccccggca

SEQ ID NO: 38259 - DNA, 61 bp, Chlorella protothecoides
gcagtcacaggaccgacacggctcggtccaaggtatctctcgacgcaatgctcggtaaggt

SEQ ID NO: 38260 - DNA, 103 bp, Chlorella protothecoides
ccgtggagggcagcctgaccatagacctgagtgtgaccaaggtgtggcatggtgtggtgtgggtcagaggcacagggaaggggaggcggggaggcggtgcgct

SEQ ID NO: 38261 - DNA, 61 bp, Chlorella protothecoides
cctctgtgtgttatcccgcatggtatgcatctctctgccttccgagacgaaagcgctcgcc

SEQ ID NO: 38262 - DNA, 77 bp, Chlorella protothecoides
gtcaggttgcctgacaatgtatggctctatgatggcctcatcggactaatttggacatggggttgttcaacagctga

SEQ ID NO: 38263 - DNA, 72 bp, Chlorella protothecoides
tggtagggaacccagaacgctccatcacactctagtatgcctcattacagtcgcacatgctgtggtcaactg

SEQ ID NO: 38264 - DNA, 101 bp, Chlorella protothecoides
ccgaaggtactggtgtggctggtcgcgcgctcaggggctgctccaggccccatactgccatggaccactctaaggcatcatggatggtggcgctgtggtgc

SEQ ID NO: 38265 - DNA, 61 bp, Chlorella protothecoides
ttcagcactgttgttggaaaggggggggggggcaagaggggatggaggcaaggggcgtgag

SEQ ID NO: 38266 - DNA, 61 bp, Chlorella protothecoides
tcaggcgcggcgtcgcacagacgcccagcgtgtgcgccgcggcgtcgcccaggctccgcga

SEQ ID NO: 38267 - DNA, 61 bp, Chlorella protothecoides
accagccctgctcccacctatcttcttgccaaaccccaggtccagcaggcggtctgcctcg

SEQ ID NO: 38268 - DNA, 80 bp, Chlorella protothecoides
caggaaagcctcccttcacacccagccatgtcagcagggcacgctcacgcacttctctgggaggaaagctggtcggcggt

SEQ ID NO: 38269 - DNA, 76 bp, Chlorella protothecoides
gcctccggcggcttggagtagccgatgcagggcgccttcatgcgacccagcccgtgctcggcgctgatggagccgc

SEQ ID NO: 38270 - DNA, 74 bp, Chlorella protothecoides
acgcaaggccaagtgaacgaaaacggcatgtgcggggaggaggaggaagctcactctggcgtcggccagagagg

SEQ ID NO: 38271 - DNA, 61 bp, Chlorella protothecoides
tggaaaatgcgctgtaacccagtggctgggggggtagtttgcagtacaggaccccaatcct

SEQ ID NO: 38272 - DNA, 105 bp, Chlorella protothecoides
cgagcgctgctcgccgttgaaggcgtacactgtgcgcacgttgctcagcgtctgggtggccagcgtgttggccccggcgtaggcctggttcatgcgcgaggtcag

SEQ ID NO: 38273 - DNA, 186 bp, Chlorella protothecoides
ggactgcagcctgacccagcgagggtgcaccgacacttctgcgctcgtctccaagatgcgggccacgacaggcctctgcgctctgggaccagaagctcagctgcaacggaccaagcgactgcgcatcctcctccctgcgcacagtcacccgcgcctttgcctctgctggaaggctgacggtgcagg

SEQ ID NO: 38274 - DNA, 7502 bp, Chlorella protothecoides
  modified_base (1742)..(1751): a, c, t, g, unknown or other
  modified_base (2935)..(2944): a, c, t, g, unknown or other
  modified_base (3020)..(3029): a, c, t, g, unknown or other
  modified_base (3261)..(3270): a, c, t, g, unknown or other
  modified_base (3330)..(3339): a, c, t, g, unknown or other
  modified_base (3574)..(3686): a, c, t, g, unknown or other
  modified_base (3987)..(3996): a, c, t, g, unknown or other
  modified_base (4354)..(4363): a, c, t, g, unknown or other
  modified_base (4758)..(4767): a, c, t, g, unknown or other
  modified_base (5173)..(5182): a, c, t, g, unknown or other
  modified_base (5863)..(5872): a, c, t, g, unknown or other
  modified_base (6050)..(6059): a, c, t, g, unknown or other
  modified_base (6378)..(6387): a, c, t, g, unknown or other
  modified_base (6573)..(6582): a, c, t, g, unknown or other
gccgcctccatcgccagcagcgctgggttgagcgacgagcccgtcgcgctgcgcgcgctgcgctgggccgtggcgctcggggcggcgacggacggggccgacgagaggcgggcagaggcctgcggcgccgtggcctgctgccccgcaggcctgccgggtggggcgccagggagcgccgggtctccaccacacaggctgctgctgcacctccccctggtcgaggcgaggctggacgacgaggcgctgccctcgcccgtcctgctgctcaccgcgcgctcgctgaccctggcctctgactggggcctgggcaggcagacgtggacggtgcaactctcaaactgtcgggtggaggccagcgccgcacgccgcagcacacgcgtcctcctcgccgacgcggggggcggggggcgggcgtgcctgaccctggacgacagcgggcggggggtgttgctcccgctgctgaccaggctgtgcgacgatgccgccaccgctgagccggggccgggccagccccaacgtgcgcgaggcatgcgcctcgagcctgccgcaccatgcaaacaacccacagatcggccagcgactgtgaacccctgctagcctcatcacaaacttgcatctgggttttgctctctccatacccactccctctgctgaaatcttcctttgcacgaggtctggcaggcagctgacaagggggggctgtaggatggcagcccggacgtgccggaacaatggggccaatgtgttcaatagacgggaggagcgagggaagaccaaaaggcgatggcgtgccaatgcggggagaggcacccaaggggggcgcgggcgcccaaaggaggaggggaggggtgaccagggtatgtctggaatgtgacaccccggcacaggcccctccacgaggaaacatccctcgactaaaggctgggctgcggactcatgctgggcgacttggcaccggtgcgcctctttggagagtagagcccgctctgctgcattgaccctgggggtagggggcgcccggggtgcgggggtgagcgcggagggcaggcgccggggtggcgggggacgggcaggggtgcaggggtgcgaggcagggggcatgggggcgggggaagggcaagcattcgccgctcggcagggcgcagcgaaggccgcgccgacggccccggccgcatgagaaaactggcggtgcgtcctccccagggccagttcatcagcgagggtatgggctgtcgacgccgggaccccccgctggagggctcctccccgtgggaccagcccggtctctcggtggtgggcaccctgggcagtctcacattcagaccttgccggctggctccggcgacgccgacagctgccggcgcttgaccaggtcgaccgaggacaacacccccgcccgctcacccagacggttggtggccagggtggccgtggggagctgcagctttgcgctggcggtcatcttggcctctctcaacttgatgtgggagtacctgggaagggagggggggtgtatatcgttataattttgctgtgggggcaggggtggctgtgtgatggtggggttcaatggagggtgggtggggggtggcgagaacctccccctctcccctcttaaaggtggatgacctcctcatgcctactttccgcacaccccttctggaccttcatcaatttcttcacaacctgtttctcttccccccacttcaaaaccacaaaacacagcacacccacacatgccnnnnnnnnnngaccttcgcacacccctgctggaccttcatcgatttcatcacaacctgtttctctcccccccacttcaataccacaaaacacagcacacccacacatgccacccaccagatgatgccgagcatggcgacgccgatgccggccatcttcttggcgggcatgacgtcgccgaagaaggcgacgccgcccgacaggatgagcacggtcttgacgtggcccaccacattgtaggtcaggctgctggtggcgccgatgaccaggaaggtggagaggttgaccagcagccccaacgcggccgacacggcgatggtggccaggccgcccggcgtgtagtggaagccgagcagcgtgcccggccccggcgccagcagccccacaggctccagcagcagcaccaggccgcccagcatggcggcggccagcggcacatactggtgcagcagctgcatggaccccaggcccagctccttctgcttgaccccggcccagatctggtacatggcggtggcggccacggagccgaagcccgcacccaggccggccgcgttgctggcgatctgagggtcggtgacggtggccaggcccacgcccgcgcagaccagggccaccgcgccgccgacggcggggctggcccgcttgccgtaggctaccgcctcgatggcgaggacggcgggggccaccgcgatcttggtgatctggtagaaccccaccgggttcaggttcaggttcaggttgcacagcacgatgtagccgacgtaggcggccgccagggggagcatcttgcgccgtggcactgtcttccgctcgaatatcccaaactgttgccagtggagtttttattgttgggggggtggggcgcggaaggtcagagaatgaattataccactcagctaggttacagagggctgcaacccctcgcgccgcgacccaggtgcacaggccctgcgccccagacatgttttgcacaggctcatgtggccacagctcagcttgccagctggtcatctttgcactacacccacctcgactaacacccagacacattcctccacgcactgcagccccaccaaagggaaacactcaccctgaggaagacgtgcatgcccgcaagcgtgaagagcgtgtgtatgaaagtcagggcatacgtgaagctgaatttgacgacgctgaacactgtgcaagtggnnnnnnnnnngatgaatcataccactcagccaggttacagagggctgcaaccccccgcgccgcgacccaggtgcacaggccctgcnnnnnnnnnngaggtgggggaaagaaggcttgcttgggcgtcctggggagttggcaggtggggtgcgggaatgcagggaggccctgtgcgtgccgcgactttggcgggccattggtggcagcctctggtcgcgggcatgaagggcggggcccccttccttgcggcgaggggtacaagtcggggggcgcgttggggtgcaggccgcggttccgaacatcatgcggtctatgtacctgctttgnnnnnnnnnnacggcgggtgttgaccgaccgactaccatagcacgctggccttgctccaagatgcgacgnnnnnnnnnnagtagaccataggccaccggtgcaacaagggtggccatcctgtcgtcgggacgggccccgtgtaggaaagtattctgcggtcaagtcatggtctcacgaatgagttgggcagtctgaatggctatttggagaggaccgggatattcagggagattcaagtggaggtacgcctgcgacccccactcgtactctgggatggccccccacatgcccgtcacgaattgaaattaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaatttcacttttcagggcactaccaaaggtttaaaacattcccttgtcttgcactgctcacacacttgggcagcatgtcagttgtgttgggagtgcttttcatgagggttgagcctcagccaggtcacctgactcccaagtatcagttacacatcatcacttgcattatcgacttttctgaaggcttatgtgctgcattctgcccttcaggtcacctcctgcaccttgtacagtgtccccactgcgcgctgcatcccacctgaacatattgacactttccccattctttctagtctcnnnnnnnnnncatcagatacacattatcacttgtattatcgacttttgtgaaggcttatgaggtgcattctgcccttcagggcatctcctgcaccttgtacagtgtcctcactgcgcgctacatcccacctgaacaaattgacactttccccattctttctagtctcagcgctgcttgttggtatggttgtgcttcttgaagcaactctgggtacgttgcctgggacagcagtttcgagggggagcagacttctccagggcgcgcgcgcatgaaactgcttggatacatgagcacaggtctctcgcgtggtgagccattcgacgagaaaaatcacgcattacttgttttacttaccaaactagtggcnnnnnnnnnnttgggacagcagtttcgagggggagcatactactctagggcgcgcgcgcatgaaactgcttggatacatgggcacaggtctctcgtgtgatgagccattcgacgagaaaaatcacgtattacttgttttacttaccaaactagtggcaccagcacctggactggcggcagtacacgcgcacgagcgacgggggtggggatcggcgccctgccccaggcagcatgagcctggccagcacagccgctgtcgacaggctcgtgctccagtacctgaagcggagaaggtgaggatttggggcgatgtctcaggcagtacggcgggtctcgggatcgaacattccgccacacgcacacacccctgcccactccaggctgcacgaggcggggaaggtgctnnnnnnnnnncctcgggatcgaacattccaccacacgcacacacccctgcccgctccaggctgcacgaggcggggaaggtgctatccctggagctgcgcgccagctgcgcgccggaggacgttgagatgcaggcctggtccgaggtgaatgacggcgacgacgacggcgccctgctggaggccttggccctggacggctcggagccggccgcctacgcccgggcctacaccgcctttgccgcctgggtggacgcctccctagacctctacaaggtaccgggaggtggctcggctggggagcgccggggtgcggggccggtgggccggccagatgttggatgccgcccctcaccccatcctctgtgtttacacggaggcgcgaagccacgatgcccccctcccccctctcctccccnnnnnnnnnnctgttggatgccgcccctcacaccccatcctctgtgtttgcacggaggcgcgaaggcacgatgcccccctcccccctctcctcccccgcagcccgagctggcatgcctgctgtaccccgtgctcgtgcacgtgtccctgagcctggtggagcgcggcgcggcgagcgaggcccacgcactcctcgccgagcatggcccgcgcttcgccgcggcggggtccggccccgccgctgagcaccgcgcgcgggagctgcagagcctgcagacgctgacggggcgggagcagctggctgggaacgcagcggccgccgcctggcgcgcgcgccgcgccggcgtgcgcctgtcggcctactcccacggcctgctcctgcgcgcgctgcagaccccggcgctgcagctcatcctgggcgtcgtgaacgggcacgtgcggctggaggttgcggaggggccgcccgccggcgccgccgagctggccgccgcggaggagctgggcgcggggcgggcgggggaggaggacggcgcggcgcacaaccgcgggcccatcgacctccagctcctccaggtgggacacaggtggtgcggttgagggaggaaagagaggaacagcttgggatgaggtggcagggtgcacggtgggcggtggggtggtggtggctctggggccagaccttgtggggcccnnnnnnnnnngggaggcggggtgcacggtgggcggtggggtggtcgtggctctggggccagaccttgtggggcccccttgcccgacccgcgccagccaccccggggtggaccccctgggaccagccacacgatctcacgccatcccggccgagttcgtgtgcaggggagcgtcgaggacgcgtgggcnnnnnnnnnnaggtggaccccatgggaccagccacacgctctcgctccatcccggccgagttcatgtgcaggggagcgtcgaggacgcgtgggcgcaggccaagttcgatcgcttggagcgtgaggcggcggcgggtgagaaacgcggggaatgggggtccttcatcccaagggatgcgctcatgtggtggggggggctgctggagctcgctgcatgagcggctggtttcattgccggtctccagccgcggtctgggagacgcttcacgaccaactacgagctgcgaaacctgcgccttggcggtaccacactgctctggctcccaggnnnnnnnnnnctttcattcccgggctccagccgcggtctgagggacgcttcacgaccaaccacgagctgcgaaacctgcgccctggcggtaccacactgctctggctcccaggcccccgcctcggtgacccacagtctttccatcccatggttcccccccccctccccctcagaggccgacgccggggcgggaagnnnnnnnnnnctccttccatcccatggttcccccccctgcccctcagaggccgacgccggggcgggaagcgcggacggcgcgacgaagaagcagcgcgccgcgctggccaaggctgcggccgacgccaaggcgcagagggagtccgtcgccgcgaaccgcatggcatgcgaggtgcggcggggaaggtggctggggggccgcgggctcggaggccgggccacactgtggggagggcgttatggagtgtggtcgagctggtggattcaggctgcagcagctgcggactacagccccgagaaggcagagtgttggcctggagtcggtgtacaggaagcgtggcgtcaccccacgccctgcaacccaccacccaccacccacgcgcagatcccgctccccccgcggaccgaggaggaaagcgcggccctggcgtcggagctggacgggcgtgtggctgtgtcgccctccgcgctgccctccgcgctgctgtgcacctttgtgaacacgcacgcctcgctggcggcggcggccgtggccctggacgcgcgctgcgtcgcgggcggctttgccgacggcagcgtgcgcctgcacgacctgggccagggcggcgccgccgccgcggtcctgcgcgggcacgaggcgggggtgcacggcgtggccctctcccccgacgccagcctggcgctgtcctgctccgcggacggcagcgtgcggctgtggagccgcgcgctgggtgcggggctggtggcctggcgcggcgcgggccccggcgccagccccgtgtgggacgtggcctggtgccccgcgtcacccgcgggccactactttgccacggggggcgcggaccgcgcgctgcgcgtgtggagcgtggagcgcgcgcgggcgctgcgcctgtgcgccggcgcgggcgccgacgtggacgccgtggcctg

SEQ ID NO: 38275 - DNA, 61 bp, Chlorella protothecoides
agtttgttgtgtcggcagggcacagagaataccgcgccgccggccactgacgagaaggggg

SEQ ID NO: 38276 - DNA, 67 bp, Chlorella protothecoides
ctgggctttgtgtctggttgggcacattgaaggcgacgggagtctcttgccctcaaccctgatgggg

SEQ ID NO: 38277 - DNA, 65 bp, Chlorella protothecoides
gagggtgtccgagcgaggggggcgctaccactgttgtccccgggaccctccgctcaccctctttc

SEQ ID NO: 38278 - DNA, 4417 bp, Chlorella protothecoides
  modified_base (1553)..(1562): a, c, t, g, unknown or other
  modified_base (2080)..(2115): a, c, t, g, unknown or other
  modified_base (2276)..(2285): a, c, t, g, unknown or other
  modified_base (2636)..(2645): a, c, t, g, unknown or other
  modified_base (3030)..(3039): a, c, t, g, unknown or other
  modified_base (3263)..(3272): a, c, t, g, unknown or other
  modified_base (3528)..(3537): a, c, t, g, unknown or other
gcccctcggcgcccgcctcggcgccgtcgtcgtcctcctcgtcgtcggcgtcgcggcgtcctcggccggcccgctgccgccgagggacgaccagcttccgccaccagggcaccgccgggggcggacccagctgctgctgggcggccggggccgagtcgcccggcgccgaagccccctcccccgcctctcccgccccgctcgcaggcagcggctgcaggctgaccgtgccgtgcgtgccgtggccgctcgtccccgcgggccgggtgaccacctggaacccggtctcgtccccggcgtcctgggcgccggggtcaaagcgcgccacgcgctcgcgcagcggcacgtcctcgtccccggccctccaggcggcggcgccggagccgccggcgcgagcgccacgcggcagcagcggcagcttggagggcgtgcccgcgggcccctcccgcggcgtcccaacctctgtgttgtcggaggggcggggcgagggctgggccgccgtggcgcccccgtcggcggagtccgccgcacgcagcgcgtccttgccgcccaccctgaacaaactgcgccaggtggacctcttcagcggccgggccttgaccccgggcaacgtggcggcgggggcggggtgcgagactctggtcaggggagggggcgatgcccctgccccaggctcccccgccggcggcactacagctgcggtcggcgccggctgattccatcgggtcgccgggccgcccgcgtcctggctgaaggggctggccgggagcgagggcgggggagagtgcggggacagggtctccgcgccctcgctgatggcgggcagggtctggcctcccggccgccgcgaatccgggccgcgctccggcgcctgcacctccgagcccgcgccgccatcgtccgggcgcccgggcgccgggcgcccagcgcgccgagccggcgcctgcacctccacccccgactcgcgccagaggaagctggggccggtggagtcgacgccgccggcgacctgctcgtcctcctcctcgccactccttcccgccgaactcccgcgccccaggcgcgcgcggcgcgcgcgctgcgaggccgcgctggccttcttagccacgagggacgctccgctgcggcgcatgcgccgcgccatgccgcgcatgtgcgccaccgcacgttccatgtcgcggcggttgagcgcgagacgcgcgtcgcgggcgaggcgcgtgtgcagcacgttgaggttcagcgccgcctccttgagcttgaccaggtactgcccgacgttgtcctccggcagcaccggcagcggcatctccatgctgaccatgcgcagcgggatgtcgcgcggcagcctgtgcgtgggcgaggagcgggggagcgtgaggaggagggctggaggggtgagccgtgcaggcgagtcgctcgaatctgcgaccgtggacagagcaggaggtcgacgcgcggggcagtcctgccgtgggatctgcgccgcgggatggtcccagcagagtcgaggcccacgtgctccagcctcctgaagcgcccccttccacccctcgcgnnnnnnnnnnaggggagcgtgaggaggagggctgcagggatgagccatgcaggcgggtcgctcgagtctgcgaccgtggacagagcaggaggtcgacacgcggggcagtcctgccgtgggacctgcgccacgggatggtcccagcagagtcgaggcccacatgctccagtctcctgaagcgcccccttccacccctcgcgcacgaaccaacccagcttgcctctgcgtcatggtggcctcgcccggctcgccggctcgcccacccaccacagcgcgctgtgcccaggagcacagcgcccatttcgtgctgcgcatgccgatctcctccaccgcgatgtgcagcagcacggtctggcgcaggtcgacgtacacgccccgcgacccgccggcggggatggcatagcagaagtagcgcccccggctgccgcccccggccatgctcaggcccaggcgcggggtgaaggtgtcggactcgatgcggggccgtctggatcgcgaggcagcaccctaggttgtggtggagggttnnnnnnnnnnnnnnnnnnnnnnnnnnnnnnnnnnnntgaacattcccattgcccccccctcacctcccgcaggtggacggcacaataccctgttcacagccagccacagtcccccgcactcccccacatccccttcaagacaccacacatgaacacttccccctgaatccccccagcctcaccatggcgtccttgcnnnnnnnnnnaccacatccccttcaagacgccacacgtgagcacttccccccgtatccccccagcctcaccatggcgtccttgccgtgcgacaccgtgatctcctgctcacgagtgatggggatttccacgtgcggcgtgcccccggactccccctccacgtcggaccagggcatgccggaggccccatcctgcaggcacggtaccggggtatcaggggggggtggcatgatcacactccttttctcaccaggcaggtggcacaatgaagagcacggctttcagtccagccaggccacagagagccgagggccggagcgcgtggcagccccgacctcctttcactggcaaccgcccatggnnnnnnnnnnaaggcaggtggcacaatgaagagctcggctttcagtccagccacgccacagagagccgtgggccggagcgcgcggcagccacgacctcctttcactggcaaccgcccatgggcccatgctccaatgcacagacacccctctccccctcgcctccgactcaccccctcccctgctgcggcgcgcggggacgcgtagccccgtcccatgctggtggcccccggctgggagttgacctgccacagcaggacgcgcatctcgtagggcagcgcgttgcgcagcaggagcggcggcttgacgcacagcgtgatctccagtggggaggaggcgcgctggatcatgcccggagccgtgcattccatatgcttgaacgcctggaactccgacnnnnnnnnnnttggatcatgcccggtgccgtgcactccatatgcttgaacgcctggaactccgacacgagctgcggttgaggaggacggggttgggggcgcacatgggtgcggggtgttttcatgctgcagtgtatattcggaggggcctccctcagcagggtccagcagcgtggatcgcaactccaacaccgcagcagagttcatttgccatgaccatgcggcactttcctannnnnnnnnntggaggggtctccttcagcagggtccagcaatgtggattgcaactccaacaccgcagagtccatttgccatgaccatgcggcactttcctaagccacgctcccccctgtcgtgttcatcccccctcacccccccaaacaaaaacacaacacacatgcacactcggctcaccctggccggcgtggtctgcaaggccacgtggagcgggaactcctcctcccctgcggggtcggggtcgcaggagatgtagccctgcnnnnnnnnnnatgttcaaaccccctcacccccccaaactaaaacacaacacacatgcacactcggcttaccctggccggcgtggtctgcaaggcaacgtggagcgggaactcctcctcccctgcagggtcggggtcgcaggagatgtagccctgctgcgccagcaccgcgcccagatcggcgctgaggcgcaccacatcgcgtgcggcctcgcagaacccctccggcgcgaggaagagcaggccgcccagcaccgaggtcaggggcaggtagcagccggcgccggggcgcagcgggccaacggcgaggtcggcggaggcggcgtcgcgcgcctcgcgcgcgtcgcgcgcgcccgcgcccggcgggaccagcggcgtggtgggggtgtgcagccgcagcgacagcgggcggtcgatgctgttctccacccagatcgaggagtggagggtgatgaccttggtgcggccgaccaggatgatgtccaccagcacgggcacggtggtgccgtcggcgggggaggccatgcggtagcggtacttgcccaccacgttgaccgccacgtcgcgcagcggcatccagttgccctcgaagtggaggtgcagcgtggcgccgacgcgctcgctgccggcgccgccgccgccgcgcacgttgtgcgcgaagtgcaggcgcttgggcgccgggagaacgcgcaggttctcgctgccgccgttgggcagggagaaaacgggcgagcgcacgccgccgcgtgggccgtcggcccagtagtacacgcgcagcccgctctggttctggatcaggtacttctggggcgccagcgacatgatggccgccgggccgctgccggcgggaggggtggcgcgggcgggggccgccgccgcggccgcgggcggc

SEQ ID NO: 38279 - DNA, 61 bp, Chlorella protothecoides
ggggctggacctgctggtgaccggctgaggggggcggcggggcctcagtgccgggaggtcg

SEQ ID NO: 38280 - DNA, 64 bp, Chlorella protothecoides
caagccccttccaattgtccgcgccctgccagcggccctctcagagctcttcgtatgccaggcc

SEQ ID NO: 38281 - DNA, 93 bp, Chlorella protothecoides
gggggggttgatgcagggaaggcctgcatcgagccatggtgcaagcgtttccttgcgcccagctgggccccccaagcacggtatccaaacccc

SEQ ID NO: 38282 - DNA, 140 bp, Chlorella protothecoides
atggaggagaggtgaagagggtgtcggtgtatgtgactgtatggagggctacacttttgggaaagggggggtgaaggggaggcggggcgatcagcagtgaagtggaacatgcccaaagatgcacggccagaaactggata

SEQ ID NO: 38283 - DNA, 89 bp, Chlorella protothecoides
gtcatgctgcagcagactgctgtgggtcagagactgggaagccctcaccctcaccgggtcagcccatctccagcccatctgcccagaag

SEQ ID NO: 38284 - DNA, 65 bp, Chlorella protothecoides
acgttgcagaatggctcatccggcgctggcatgagggagcagatcaagcaagcctttgccaagaa

SEQ ID NO: 38285 - DNA, 76 bp, Chlorella protothecoides
ttctgatagctttccttaagatcaatctactctgtaggaggagcaagaggtgcaggtagtgccagtcgacaagcca

SEQ ID NO: 38286 - DNA, 61 bp, Chlorella protothecoides
ctctatatactcggtaagggagtggatggtttggaggtgcgactccgctcgtctgtggatc

SEQ ID NO: 38287 - DNA, 75 bp, Chlorella protothecoides
gaggatcatgggcttgggtgtggaggtacagggtacccgcatcgcgcaggagagcgggggagtcggaggctgggg

SEQ ID NO: 38288 - DNA, 78 bp, Chlorella protothecoides
acggaggcgctgcaggcagggaagccctgggacgcgtcccacggagcgggccccaccccctggggctgggaggggccg

SEQ ID NO: 38289 - DNA, 77 bp, Chlorella protothecoides
cccccccccaaaaaaaaaattaaaaaagataagataaaacaaaacaaaacccatgccacccacctgctggaagttgt

SEQ ID NO: 38290 - DNA, 61 bp, Chlorella protothecoides
gacaaagacgctgccggggaagagccgggctttttgggcgtagaggggcgcctggggcagg

SEQ ID NO: 38291 - DNA, 746 bp, Chlorella protothecoides
  modified_base (88)..(267): a, c, t, g, unknown or other
  modified_base (370)..(590): a, c, t, g, unknown or other
tctggtgagggggaaagagggaggggggtgtttgtgtatggggtggaggaggggggtagatggcgaaagatgtatggggggccatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaaagctgcaccttgtactccttgcgaaccatgtgcctgtgtgtcctgcagagtcccgacctttccttcccccccgccaatccgcacaggcaccagctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggcgtgctgcagtaccttgccgtgcacgcatcgatggcatcgtttcatgagtgcttgccgaatgtctcgaggacctcacgccaaagagctccctcgccagaggttgctgagacctatgcgtcggtccctatgccctgtgtcgcagggtcaagg

SEQ ID NO: 38292 - DNA, 61 bp, Chlorella protothecoides
tgaaggttgctggtgcgaatcgtagcatgcactcctgcctcagccggggcagtcaagaaag

SEQ ID NO: 38293 - DNA, 64 bp, Chlorella protothecoides
tggggctggcgaatacatgtgtagctgtgctacgcatctgtcggacccctggccgccccctcga

SEQ ID NO: 38294 - DNA, 6773 bp, Chlorella protothecoides
  modified_base (191)..(200): a, c, t, g, unknown or other
  modified_base (1490)..(1499): a, c, t, g, unknown or other
  modified_base (4833)..(4879): a, c, t, g, unknown or other
  modified_base (4986)..(4995): a, c, t, g, unknown or other
ccccctccccccctcaggccgcccctgccctgccagggagcacttagtctttgaacacatgcattacactcatctgtaccaaagctctgatcctctgcagttgcttgcctgttccccttcgtcatggtttgtacccagacagagttgaaagtataagttctaaccgtgtgtgcgggatcccatgctttccnnnnnnnnnnccatggtttgtacccagacagagttgagagtataaattttaaccgtgtgtgcgggatcccatgctttccattatgcgcaacgggactgcatgaggcagggcacctcacgctcgtgtgcttcgagcgcggcgaccagacgcagattgataccttttcgacgccacgctcctgaacctcatacgtgctcctgggtgtgggcgccagcaccccgttctaccccgccccttgatcgccccagcgcaatgttcctctggaattggtaagctgccgacgcgggctcccaggctcctgcacgctggttcggcaccatcccactcctctctaagcaatctggcattggacgcgcaacctcccggctgtccaccgctacacgcaggttccagtctgtgctaaacagtttggggctgtacaacaaaaacgccaaaatcctcttcctgggcctggacaatgccggcaagactacgctcatgcacatgctgaaggatgagaggctggcacagcaccagcccacacagtacccgacctcggaggtgggtggaaccaggaggaaggtgctgagcggtcgatggccatgcgagctttgccgtgggttggctaccgtggctgcctgtacactccttgaagtcacagctctctcggctgctccaagtggcggactggtgctgcgcctggtggtgccgcaggcactgggcccccatgtcatgccacccgctgtcgccgaggcactggggccacaccacccgcacatgccgggcaccggacgacactgggcgacgaactgactgccggcccctgcctcccacccaaaacaggagctccaaatggggggcatcaacttcaaggccttcgacctgggggggcacgagattgcgcgcaaggtgtggaaggactattatgccaaggtggacgcaatcgttttcctcgtggacaccgccgaccgggaacgcttccacgagtccaagaaggagctgtcctccctcctctccgacgactccctgggtgacgtcccgttcctggtgctggggaacaagatcgatctgccgcaggctggtgcgtcgagccatctggttgggtctgggggaacatgaggaactgcggttcaactgggtttggagaggctgctccaagaaggggaaggtgcagtcgcccgcccccccccgccccttgcacgcgtaagggacctggacgttgtacccggggcttgctttccagtggggaaggggaggcaggaaccagataccctgcgaggaagcggcctcgggaagtttgcgctccaagctcacacccacnnnnnnnnnngactttgtacccgaggcttgctttccagtgaagaaggggaggcaggaaccagatactctgcgaggaagcggcctggggaagtttgcgctccaagctcacacccacacccacatgaccctcctgtacagcctccgaggatgaggtccggtatgccctcggcctggccaacctgaccacaggcaagggcaaggtcgacgtcaagtccctcaccatgcgccctatcgagatcttcatgtgcagtgtggtaggctgggtggatgggtggtcatcacttgggcttgggccccctacaggctggcacatggtcgatgtgcagggctggaagaggtgctgtacgcggtgctcgcaggttgtctggacgcgacatccccagttgataacatcaagcacactgccctctcgccaggtgcggcggatgggctatggcgacggcttccgctgggtatcccaattcatcaagtaaggttttgggggccactctagaaccgccctgtcagaagctgccaggaaccccccgggccctcgttgcgctagacccacacttggcggcggtggtttgtgcctctgccagctgcgctctgctgtgctgccatgctcttgaccctgtgacgactgttccgagggatccaagtggcaaggctgggtcgaggctctcgaaaggcatggagcagcacaggattggtactgaggggcatttcttcagtggacatggtggtcggccccggatcaccagagcatgagcctgggagctggggctgggaagggggtgccacccatgggatgggggtgcacggtttcaagcagccgcaagggagcaagcctgggtctggtggcccccgcaggcagccacggactgagcacaacaggtacgctgtcaacctggcaacaggcagcaccttggctacgccggtggccggcacttggccgccgcgagcagcgtggcctgagcaatcacgccacgcacccgctccaggtcgcccgtggccaggaggaagctgtaccccagcgccccggtggggatgcggctgtcctcgggcgagacctgcgcgttgaagtggtgcacgtagttccacttgtaggggtcctgccaggtccccgcccagggcggcgcggcctcgtccccggcgtagacgtggccccccggcggccagtcaaccgccgccacgccaaaggcgaacgccccgtcccgcgaggcgtacaccatgccctccgccggcgtgcccggccgggcggcgggggcgtcgccggagggcaccggggtccacgccgcgaaggggccccccatcccccgctcagcggccaccttccagcggcaggggagggtgctagggtgcatgtatcctgtcagcgcctcaacctgcgcaaaccagtgcggctcgtcggccggcaggcagaaggccacggtgtagcgcaggaggtccggggctaggaagacgaggtgcttggccagggtgacgcgggacagcacgctggtgttgcggggggggcctcggtccgggccggactccatgggcctgccggggggccagaagtaagccatgagggtctccgtgtaggcctcggtgtggtcggcgttcacgcgacacaccttccactcggaggaggtggcgccggcgttgtcgttcacgttccccgcctccgtggggttctccgcctcgggggaggtgccgggccggacgtcgaaggcgcaggcggactgcaggctgcccccgttccccggctggggcaggatcagctcctggccacggtaggtcattgaccaggtggcaccggctagtcgggagttcagggtgatgcaggtgtccccgcaccgcagcgtgacatcttcccgggggtgggggtcgagcgtggcagggtcccctcgcatgggactgaaagccatggtgggcccctcgaatggcctgcattcgtggcatgtatgacgtattagatcatagacgttgacagctacccccatcatggtgatgtctcaggtctgtagggttgtgtcccatcgtacccgatgcagggaatgggtccttcccccgaacactaccactgcagccctttgggtcacggcgacatgcacatcctggatgacaaacaaaacctcaggaaaacatattgggatccagatctctatacatgggcagcggtgaacctcgcagtattgtttcggcaagtggcagtacgcaccgacagggcgcgcgcgcgcattgggtgcagctgaaaaactcgtcgagcttccggcataaacgaaggcacagcggacgtgatggagacatgtggcaaccagcacatccaatttgatttcagctcctgggattgttatattgtcgaccatcgacaatgcccctagctctatcgccaagggctctctagggacaccctgaaccggtctggtgcagcaaggtcaacacatcagtatacgacctgcccgctcataagacatacaaatcataccatgaagcttacactccgatagccccgtctcttctgggcgggacagtcgctctctagcaatgggtgggctgctggaggatgtccaggaggagctctgcgctatctctgccatctacggcgatgatgccgtggacgtggacctcgactcgggcatctgcacggtacgcctctcctctggcagcgcttccttgactgccggggtgctgctgcccgcggactacccggcagtcagcccccctcaccttgaggtggccagcaccggcatggacgacgcagtgctggacgactgcatcgcaggcctggtcgagagcttttctccgggtgcgacacctggaggccacacagagggcaatgtgggttgctggtgcatgccatctgcgtgccccggatgccccgccagagccctcatgatgatgtcgtgccatgtgcaggcgagcccgtcatttttcaatggctcgaggcgctgcggatgtgcatggaggactgggtggcggagcaaacaccgcccagcccaggggagggcggggacgaggcaacggaggctagtgacgacgctaagcccggggacgagctcccttcccaggcccacccagaggcctcgccaggcccagacctgggcatagtccatggggagccgttcaccgagaggaggtccacattccaagcccaccttgccgtcgtgcattctagagaagaagtgaggattaggaagggtacatgggtaggggcagccctgcttggaagttaaggaggtcggtagctccctatttattcatgattgctgcgcgagcatcaaccccatgcacatttccaggtggaagctgttgtggctcaactcctgtcgatacccaaggtccagaatgccacccacaacatcatggcgagtggctgnnnnnnnnnnnnnnnnnnnnnnnnnnnnnnnnnnnnnnnnnnnnnnngcgaggggctcattccagattgtcgctgcctgtgtagatctgctctgcatttcaagatttctgagtcctcctgtaagggcatccaaaagtatcagcccgttgcccannnnnnnnnntaagatttctgagtcctcctataggggcatccaaaagtatcagcccgttgcccacatgctccaacccttcccacaggcgtacaggttccagatgggcaatggcacatgggcgatggacagcgacgacgatggggaaagcgcggccggcggaaggctgctccacctgctccaggtgcgtctgtttagtccctggggagaaaattaatcctaggatacaccaggacggtgtctgtggcccggtcgatcctaccctgtcaccgcctgtgttggtcccaactccctgatccccacgcaaagtcacctcccattcccctgccccattgccgagcagatcactggtgctcaggacgtgtgcgtggtggtttcccgctggtacggaggcatccagctgggaccagcccgattcacgcacatcaacaatgcggcccgacagctgctggtccagtgcgacatgctggagggcaggaataccaagtccaagggccctcgctcccatgcctgacggggccagcaagcgtgcttgctgcatacatggtgctcatggtattacagcaacgcgtctcaggtgtgctcggagactgcagcaaggagcagaagctcgcgagcaggttgttgggctcaggtcagggtgccctggccctcagacacgccggcgctctccttcctgaaaattgcgcacagtcgagagggcttgaaaatcttggccttgaacatcatggtgggagggatgttgatgatggtgtggtccgggctggcatggtatgcctccagctcggcgggcatgccccgcttggtcgcggggctccatggcaccggctgaaagaggatgcctgtgaaggcgaggctttcctccatcttgcactcgctggaaacctatgggacacggaggtatgtgcattacaagtgtgaaaggctccttgctgctgctgcgatgatcgtgcaggatctggcggcatgtccggaattttgcagcacttgcctgtcgtcggaatccctctgcgttcagcatgctgtagagggtcgctctgctctcctcctgcagctcgaaggacccatcaaagtcgttgatccctttgatcgagactcgagccaggacctgccttcgcggcgcacagtgtcggggccgtcggacagtggcaccgtgcatcggaggcacgactgcatgtcgttgacaggaggttgggcatgtccgcgggagcatcttaatgtgagatttaggtagttggtatccaggtatcggtgctggagaggtaacctttccgtctcctgtgcatggcactcgagatatgccgcgatcttcgcgccctcgagggttccagagcctgatcatcatggtcatgcccaacggcaatgacagggtacatgggaccaacgcagctactcctggaaagttgaagaggaaaatatttggtctatttaagtgcaagcgcaggctcggaacctgcgacggccttggttgccgcatcaaacgcctgctccaagtctgctaagaggtcgtcgatgtcctcaatcccagctgtgcaggaaagtggagcattggattagagcggctcctggtccagaaagggaaccactgcacttcgtgcctgacaccgacctgtttcaaaatccacatgccccccgcatggtccagggctgttctacccactcgacggtacagagaggaagcatcgccacacctggcagcccttcgcacatcactcacagcgatcagccatccctgcctcttgcggcctgattttctaacacaaatccctccgttctccctcacccccccc

SEQ ID NO: 38295 - DNA, 77 bp, Chlorella protothecoides
gccaccgcccccatctaagaagtcgccaccgccctcatctaagacgtcgccaccgccctcatctaagaagtcgccac

SEQ ID NO: 38296 - DNA, 79 bp, Chlorella protothecoides
acgaagtgcaccagcaaaaaagcacttggttagcatcagtatgttggcggctccgttcacgtcgcggttgacaacatgg

SEQ ID NO: 38297 - DNA, 61 bp, Chlorella protothecoides
ggcacagggcctattccgcgcggcgaagcctcctggacacgcaaccgctcaccataccgtg

SEQ ID NO: 38298 - DNA, 61 bp, Chlorella protothecoides
gtgacaggagggttggaggaggggtctggtcgggtctggatgggggggccacgtggccttt

SEQ ID NO: 38299 - DNA, 127 bp, Chlorella protothecoides
cgctcaccgccgcctgcatgcgtggggtggccgtgtgggatgggagtcggacaggaaggaggggcgcggtgtgcgagggatgtggggcgctgaaggcaggggcgccctggcctgggcgcccgcgcac

SEQ ID NO: 38300 - DNA, 61 bp, Chlorella protothecoides
atccctggccctgaactaccagagccgccatcgggccgtagctctggagaagcaggccagc

SEQ ID NO: 38301 - DNA, 61 bp, Chlorella protothecoides
gtgtataaatataaagaatggagaccaggatctggatgagggttacgaaggccgggaaatt

SEQ ID NO: 38302 - DNA, 178 bp, Chlorella protothecoides
gccacgaagccggccaccctgaaggggtggggagaaaggaggaaagggagattggtctgagttctgctgccagacgccaatcgaccatgattggacggccaggcctgagcgctgctgcacagagcatgggcaaccgcacacccctgcctgcgcactccccgcccgcgccccgacagac

SEQ ID NO: 38303 - DNA, 62 bp, Chlorella protothecoides
tggtccagggaccacgggtgcacagcgcagctggtggacccagcggcggaggcgggccgtcc

SEQ ID NO: 38304 - DNA, 77 bp, Chlorella protothecoides
gactgcagtactgttcgcatgtgagtgtccttgtgggtgtctcgtccacggggtgcaggcacagtgcaatgttgggg

SEQ ID NO: 38305 - DNA, 107 bp, Chlorella protothecoides
aggatttagactcaggaatcgccaggcaggtgaagtacaagagaaaataagagggcgaaggaaagagcacactcctttgccccagccagaagtagaggtcaggttac

SEQ ID NO: 38306 - DNA, 120 bp, Chlorella protothecoides
atcttgggctcgagtgaggtggacggcgagccccccaggccctccaaggcggccttgccatccccaggaggagccgggtcgccgccgcgtcgcacacccacgtcacgcgccgtcaccagg

SEQ ID NO: 38307 - DNA, 69 bp, Chlorella protothecoides
tcgtcagaggacaccagcccgagcaggcctgagtgttgggggattgggtgaggcacaatcagtttctga

SEQ ID NO: 38308 - DNA, 140 bp, Chlorella protothecoides
cctgcaggcgcttgcagagcaggacggccgtcccatcgacctgcacatctgctgcggcgacttccaggtctgctgagctttgatgttgtgatctgtttctccactccttccccacaagaacaagcctgccttcatacatg

SEQ ID NO: 38309 - DNA, 61 bp, Chlorella protothecoides
tcgtcgacggcatgcggcaccaggtggggcaccgacgccccgcgcgtgctgggcgccggca

SEQ ID NO: 38310 - DNA, 66 bp, Chlorella protothecoides
cccagggccaggcggctgtgacctgagtccattcctcacccccaccaccccaccaccctccatccc

SEQ ID NO: 38311 - DNA, 9551 bp, Chlorella protothecoides
  modified_base (217)..(226): a, c, t, g, unknown or other
  modified_base (319)..(328): a, c, t, g, unknown or other
  modified_base (718)..(727): a, c, t, g, unknown or other
  modified_base (989)..(998): a, c, t, g, unknown or other
  modified_base (1112)..(1121): a, c, t, g, unknown or other
  modified_base (1250)..(1259): a, c, t, g, unknown or other
  modified_base (1353)..(1362): a, c, t, g, unknown or other
  modified_base (1424)..(1433): a, c, t, g, unknown or other
  modified_base (1731)..(1882): a, c, t, g, unknown or other
  modified_base (2941)..(2950): a, c, t, g, unknown or other
  modified_base (3610)..(3619): a, c, t, g, unknown or other
  modified_base (3901)..(3962): a, c, t, g, unknown or other
  modified_base (4100)..(4109): a, c, t, g, unknown or other
  modified_base (4949)..(4958): a, c, t, g, unknown or other
  modified_base (5143)..(5152): a, c, t, g, unknown or other
  modified_base (5912)..(5921): a, c, t, g, unknown or other
  modified_base (7001)..(7010): a, c, t, g, unknown or other
  modified_base (8012)..(8021): a, c, t, g, unknown or other
  modified_base (8978)..(8987): a, c, t, g, unknown or other
gagatgggctgtagtgatatccggcctgtgccgcggcaaaacgcagctgcaaaccagtcatcagagtaatgaacagcaaagggcaaccctcccaaagcttcccgaggaaggcacccgggcttgaaccgaagaagcgaaagacatttctgtgacacaaaacccctcctcctccacggcatctggcagtgcctcacacctcgggcacggtaaacatccnnnnnnnnnncaggcttgaagtgaagaagtgaacaacatctctgcagcacagaccgccctcctccaccacgacatctggcaatgcctcacacctcgggcacgnnnnnnnnnnggccctcttgcggcggcacgagcagcacaacaagggcggcgtgaagaggctcacggggctgcagctgcccaaagacaaagattggagaatgtttaccgtgcccgaggtgtgaggcattgccagatgccgtggaggagaaggggttttgtgtcacagaaatgtctttcgcttcttcggttcaagcccgggtgcctttctcaggaagctttgggagggttgccattcgctgttcattgctctgatgactggtttgcagcagtgttttgccgtggcacaggccggatatcactacagcccatctctcacattgaatccacccctcacccaccccttgcccgtcccccacccacacccacccccccaatcccaatcccaggtgctcaaaatccnnnnnnnnnnagatcactcctgcccctctttcacatcaaacccactaaaatccctcccaccccaggtgctcaaacttctcaacctcgagacggtttgtgccacggtgggctcaaagctcaccgccaagaagcgcagggcggtcgaggcctgcctccgctgcaaactggaggagttcgaggtggacgtggacagaaacgggcagcagaagaaggggaggaaggcggtgaggacggggaagatgggagagaagaagacggactggttcgtccannnnnnnnnntcaaactcaggtgctcaaacttctcgacctcgagagggtctgtgccaccgagggctcgaagctcaccgcgaagaagcgcagggcggtggaggcctgcctccagagcaagcgggnnnnnnnnnncactctgatgaccggtttgcagcggcgttttgccatgggagagtactcaaccaatcctgcccatcgctcacatcaaacccacccctcacccacccccacccaatcccaatcccaggtgctcaaaatccnnnnnnnnnnacgtggacaaggatgggcagctcaggaaagggaggaaggcggtgaagacggagaagacggaggcgaagaagacagagtggtttgtccacatcgnnnnnnnnnnagaaggcggtgaagacggagaagacggaggagaagaagacagagtggtttgtccacatcggnnnnnnnnnntactaatggctacagcgtcacagtgaccctgcggcggcggaaggtcgccgggccggggaggccctctcgcccgccgcagggtcaccgagacgctgtagccgttggtgcgccagtgccccgcggagtaccacccgcagccctcaaagcgcgggaagttgaagaggagggtgaaaaaggcgcagcccacatggacaaaccagtccgtcttcttctcgcccgtcttccccgtctgcaccgctttcctcccttcttgagctgcccttacttgtccacctccacctcgtactcctcccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggacgtgcgtggatttgatgcgaaggatgggcagaagtggtttcaggactctctcatggcaaaacaccgctgcaaaccggtccacagagtaatgaacagcaaagggcaaccctatcaaagcttcctgaggaaggcaccccaggcttgaagtgaaaaagtgaaccaacatctctgcatcaccaggacccctcctccaccacgacatctggcaatatccctcacctcaacctccgtgtgcattttccactccatcctagtgggcaactgcacccccgtcagcttctccacgccgcccggatggtatttttcgtgccgccgcaagagggcccacagcgtcgtcagggtgccggtgatgtgcaccgcctcgaagccctgcctgcagggcaggaggccgaacagccgcccgatgtgccgctcctgcacgggctgctgaggccccttggcggggccgccggcggcgttcgccgcggcctccttgcgctcggccagtgccgcccgtcgagccttcccaaggccccgccgcctcctgggatgccctcgtccgcgttggacttgtgctgcttcgcacggccttcaaccaggcgctggagcccggcagcgatggtggacgctgcagcggcaccaacctgtgcatgtgggtaagagggggctggtgattacacatgtagccgtgctacctatctgtcggaatcctatccaacccctagagggtgcaaggaagtaaccatgtcaaaccactgccaatctccacatactcgtgcattcccagccgttcatcaacactcacatctggggggttggtgtcgtgttgcaacaactcgcccgcctgccctggtggcgcgttctctggagtctgcgagggagctggcgcggccggcagaggtgtgggtgatgttcccacaggccccacgtcggcctctttggcatgcagcggcgaagttcgacgatccagtccacttgcgcttgcgtgaatggcacatgccaccacgcagccgcccaaacggcccggccattcctgtcgaatggagtgggaaggggtgctgagggtcttcgacgnnnnnnnnnngtgcgaaatgttttcgcaagacgatgggaagagcacacctaatgtgatcgatgcactcggatcccatccatgcagcaaccaccgaatctaggacaacccaagtatgtgagagtccgctatgttgacctcgtagctcacgtcgggactcattcagacataacagtcgggtggcatggcggtggaggtggatggtaggcgaggcaggacacaacgatggtgtggtcgcggggcgtcggtgcagaagagggggagcgccctagacgtgccttatatgacaccccgatcgatacatgagacttctgctcctgtttaccatgatgagaaaatcaggaactgtaatgggcatgcgagaataatgccaccacggccgttggggagaccctatatcctatccgacctcccccacacacgccagggacgagttcccactgcccccgtgtttaccgccatttcacctgacccatctgaaaaatgacaactctctaggcctttgaatgcttgctcgggttgcgaggcctctttctcaggcctggtcgtttctggaagcttcgcgggactctgtcccgtcgggatgtgaacgcgccctccaaggcagattgctgtgttcaaatatcattgtgtggtaaagtatcgagagcaagggagatggagcactgtctnnnnnnnnnnctttctggaagctttgcgggactctgtcctgtcggggtgtgaatgcgccatccgaggcagattgctgtgttcaaatatcattgtatggtaaaggatcgagagcaagggagatggagcactgtctgcgtcaggtggtcgtccccggggcctccgcccgttgaggcagcaagaaccccaaagtgggggtgggtgagaggggagggcggtcttctcctctcccttgcccgtccaaaggcactgctgcccccggtacacgctctccctgcctggttgctaagctcnnnnnnnnnnnnnnnnnnnnnnnnnnnnnnnnnnnnnnnnnnnnnnnnnnnnnnnnnnnnnnatcgaaacagtcggccgcctcttgccaccatccctctcagggtgggagcagatgcggtgtgctctggccttgatttgccgctcgcagggaatggtatcagccggccaagcgggcagcacaggtgtttcagcttccacnnnnnnnnnnctgccaccacccctctcagggtgggagcggattcggtgtgctttggccttgatttgttgctcggaggggatggtatcagccgatcagcgggcagcacaggtgtttcagcttccacaaggtacttgtagagtgcttcatgcttcgcatgcactccctcttccgcaatcagtttgatcctggtcgccagcctctggactgcttccttgagccctggatcgctctcgggtgaaggagccgggttgcctgggaggctcaccggtggtgcaggtgcgctgcttctgtccacaaggtgtgggccggtggcactgtccagtcgctgagtgtcaggctccgcggatgctgaggccaggtcaggaaaggtatcaatcagggggtctgccattggcaccggctccttgccgcgcctcctgctggtgccggccttggatgccacgatgttgcctgtgtcagtgcgtggattgttgattgcctcaatggcatggtgtgggtgaatagcactggagtgaccgtgtgacacagggatgaagactcagacggcactctgctgcaacagcaacgctatgcacatctcgcagcttacttctctttgctgctgccgccttgtcctcccgcacagctgtcaacatgcggtggaggtcaccctcaaaggtacccagtttggattccaagaaacactcaaggtggtggtcggcaaggtctggacaccgcttgcgcctgacattgatgatgtggttgcatggcttatccatgcaggaatcagagcaggagcagccgtccacctcgctggggtccacctgataaggctcggactctgggtgggactgggacggcacttgccannnnnnnnnntgtccacctccctggggttcacctgaaaaggctcattctctgggtgggactgggacggcacttgccacaagggcgagccagggttgccggtggggcgatgacggcagcttcctcaacttggcccgagaggaaagcatcttggagatcctcgcgcgttgtttgtaggcaccgcatcctccaggttnnnnnnnnnngggggcgacgacggcagcttcctcaacgtggcccggagaggaaagcatcttggagatcctcgcgagttgtttgtaggcaccgcatcctccaggttttaccaaattttaaccacaacttgtgagattctcacatcaaacacgtttttcacactcaaacctcggtaaggtatcgtttctcgggtccaagtccggtcggtgcaatgctaacccgcgacgagaggagtccgacctacggacaggagcatgtggagggcaacgtttcggacttcatcgagagtacttttgcttctcgctacgtggtgagcctgcatggtggtccgatgatgggcgagggagcaggagtgcgcgcagtcgtctccatactttaaccacacgaccttgtcccccctctgacaggcggagcccctgccccgttaccagtgagtgtgtgaatgtaaactcatttcaaaccgacattacatgcatatgtcgaaagccgggcgggcgaagggttgtgccatgcaccgtaagcaccccggtacctcgggcagcttggtggaccccatccccctccggcccctccccggcacgccacaggctctccgaatacggggtgccggcccatgtgtgctaccagctgatcaaggatgtgagggccctggatgccacgcccaagtaggttggcaagcggctacgcttgtgggtgtcattcggcagctcctcgtgcccatacgctcccccacctcgcatcctgcgctccaggctgaacttggcgtccttnnnnnnnnnngcgcttctgggtgtcattcggcagcttctcgtgcccatacgctcccccaccttgcaccctgcgctccaggctgaacttggcgtcctttgtgacgacgtggatggagccagaggcccgggatctgatgcaggatgccctggacgtcaactacgtcgacacagacgagtaccccaggtgaggaggggtgggttgtgaacactggttggaaagtattgaggtgagcgtgtctgaccagatgcgcatgatcaacccgcccatttgggtgcctggtgcattcctgggtagatgcagcgatctcttcccatgcaagcctcaacctgtgtttcccctcgcgcaagccatggccttgtacacacccgctcgccctatccagcacggaacagatcaacatcaggcctctccgcgccaacccctcatccttgcagttccacggagatccagaatcgctgcgtctccatcctggccaagctgtaccacgcgccctccgtggccggggaggagggtcgcggcgaccccgtgggcaccgccacggtcgggtcctcggaggccatcatgctgggcgcgctggcactgaagaaagcgtggcagacacgacgcaaggccaagggcctggacacttcccgccccaacctggttatgggtcgcgagacgcatgtctgctgggagaagtaagctgtattcggggggggagggaggggaggtgctccagatgggcagggaaggggaggggaattggggagggggggatattacggggtgggcgcgcgattgtcccacttggatgcactactgccgggctcttgatgccccgaccctttctactcaccccaccctcagattctgccgctactttgatgtggaagagcggtacgtgtacgccgaggaggggcggtactgcgcaactgcggagctgctggagccgctgatcgacgagaacaccattggtgggtgggccctgtggaacttaggtttggggttgggtgtgcggcggctggaaccgccggctgcatcccgtacggactgtgcatgcatgggtgtgcacgccgcgacggcgcctgagactcagcgagaatgccgctnnnnnnnnnngttggggctgggtgtgcgacggctggaaccgtcggctgcatcccgtaccgactgtgcatgcacgggtgtgcacgccgcgccggcgcctgagactcagcgagaatgccgctgcccccttcctttcatccccccaggtgtggcagccgtgctgggcaccaccttcactggcgagtttgaggatgtccaggccatcgacgcgatggttggtgagtggcagggtggggcggggcaggtgctggctgtgctgtgtggagggcagtggtaatcccagtacgcacccctgacacattcaacggctgctcacgctccgcctcactcctgactgtgcgcccccagaccgcgtgaacgccgagaacggctgggggggcaagatccacgtggacgccgccagtggaggcttcatcgcgccgttcatctaccccgacctggagtgggacttcaggctgtccaatgtcgcgtccatcaacgtctcggggcacaagtgcgtgtgccctgcatgctgagcctgcttttggtggggaggacgagggtgcagcagggtgtcgagtgctgcgatctatcgctgagcgggcctgaatcgtgaagatgatatattgagtagaggacgagacctctgtagcagcccttgcatgattttgccgtttctgcccatgggccacatggcagcatgccttacgcctggctgcgcctctgttctccttcacctcctgcaccaaatgcccgcaccaacaggtatggcctggtctatcctggggtgggctgggtactttggcgcgacgcagaccatcttccacctgagctggtgcgtattgtgctgtggccgtcgggattttggggaaaggtgacgttcttggggaatcggaccagaagtgttggtcaaaggttgagagtaatgcatgcaccgaggaccttgagagagtaccgagaggtatactcttagggtgctacacagaagatcgccgcgttgtacctttgactgtttgcaaatctagtatggcacannnnnnnnnnggctgtagccgtcgggatgtaggggaagggtgacgttcttggggaaaattggaccagagatgttggtcaagcgtggagagtaatgtatgcaccgaggaccttgaaagtgtaccgagaggtatactctcagggtgctacacggaagaatgccgcgttgtacgtttgactgtttgcaaatctagtatggcacacctggtcaagcgaggctccttcaatcttggtacctgtggtgcaaggaaccttgccaccctgcatcacgccttctcctctcacccactactttgtctcaggtattcatggagaactacctgggctcaacagagaggtccatcaccctaaacttttccaagggcgcctcccagatcattggccagtactaccaggtttgtagttctaggtggtggtggtgggctcggtctcgctggcaaggggggccaagggggaaggagggctgtcttggtctcccccgtggggctgagtgggccacagggagtcccacatgcttgtattacagcgcaacacacctgccctcctaccactctcaactagcccgtgctcggaccccaatctctcaaagagtgtccccggcactgtccgcagttcctgcgcctgggatttggcgggtaccggaagatcttcctgaacctggaggtggtgaggaagcgcctgcgtcgcgccatccagctgacggagcactttgagatcctctctcccgaggtcggcgtccccgtggtcgccttccggctgtcaactgtcaccggctccgatggcaagccgcaccacaggtgtgcaggacctgcagagtgcaaacctcgcaagactgttgagccagatgacatatttgctggaggggcttcattatgccccttgactccaaaggatgtcgttccatgcagcccaccttcacccctcccaggatgtacgacgagtttgacctggctgatcgtttacgaatgnnnnnnnnnncgcttcattatgcccctggactccaaatgacgtggttccatgcagccctccttcaccccctcccaggatgtacgatgagtttgacctggctgatcgtttacgaatgaggggctgggtgctgcccgcctacaccatgtgcccgaatgcggagaacatcaagctgatgaggatcaccatccgggaggacatgagcgtgcagatggcagaccaggtatgggcagttttggggctcaacacgatcttggcggtgccctccctatgcaagcagtaaaggagttgcccaattgttgcctgtagatgtgggggatgtgtctgcgagtcggaatgctcaaatctgaccggccaacttgaggtaccttcctgactgtttggtagattaatctccaacacttctgatcccattctcgatccccaatcctgcagctcatcattgatctcaagaatgcaatcaggtggcttgatacgcacttcatcttcacggcagagatggtgagtaatcagtggtgaggacccaggttggaatagaaggtcacatattgcagagaccaccgacataaaggggaa

SEQ ID NO: 38312 - DNA, 61 bp, Chlorella protothecoides
cacgcgccccgcctcggcctcgttgatcccacgctccaggtccaggcaggcgccatggtcc

SEQ ID NO: 38313 - DNA, 62 bp, Chlorella protothecoides
ccccccccttgctgcctctcctgatctggcttggacatgcatggagcctgagacccaaggag

SEQ ID NO: 38314 - DNA, 65 bp, Chlorella protothecoides
tagacgggtctcatgggtttttggtcagaagcccttgctcgccaaatgcatcagtgccattcctg

SEQ ID NO: 38315 - DNA, 77 bp, Chlorella protothecoides
cggcacagtggggaagacagggtccaggtgcggaggggccaagagttcatggtcctccaacaaacacacctctgttg

SEQ ID NO: 38316 - DNA, 72 bp, Chlorella protothecoides
atctggaaagaatgctcggcgagccgagccgagccgagccgagccgcccgccccgcggcactcaccgccagg

SEQ ID NO: 38317 - DNA, 61 bp, Chlorella protothecoides
cccgagccccaagtctcccagccccagcccaaagtctcccagcccaagccccaagtctccc

SEQ ID NO: 38318 - DNA, 155 bp, Chlorella protothecoides
ctcagctgcagtaggatgtgacaagggcgttgtgtcttggactcagtggcaatgggtgatggtgtgggaggaatcactctccgtaagacacgtcggctgtcacaactctcactcaagccaaggcactctgtccatcccttcagtcaccgccaccc

SEQ ID NO: 38319 - DNA, 101 bp, Chlorella protothecoides
ggcagcgtcatcagactgtgcacctacgggctaggggccctcactgatgcagttactcacacagtcttgtctacagcaggacggggactgcgaggagacct

SEQ ID NO: 38320 - DNA, 119 bp, Chlorella protothecoides
ggggagggttttagggtttgggaggggtcttgggggtgcgaggggggggtgggcgaggcatcgctgagactgtgacacactggccttgccagcgtgcaggcatcgaggggctgagtggg

SEQ ID NO: 38321 - DNA, 61 bp, Chlorella protothecoides
gtcagcatgcagtccgggagtgcatggctctccctgccactcgacaggcaggcgcggaatg

SEQ ID NO: 38322 - DNA, 85 bp, Chlorella protothecoides
atccagggcaaggtcggggcagtcggcccaggcagcaccctcccctcgctccccaatatgcccatgccgggcacaaccccccagc

SEQ ID NO: 38323 - DNA, 61 bp, Chlorella protothecoides
gttgagggagatgttgtccacgatggcttcgcccacccctgatcccaaatcctgaagcagg

SEQ ID NO: 38324 - DNA, 76 bp, Chlorella protothecoides
aaggggggaagtcggggaaggcgtgggggaagagggggggggttgtttacggccgatgtatccccagcacaatgtg

SEQ ID NO: 38325 - DNA, 97 bp, Chlorella protothecoides
cgaagccggccaccacgccgcgcgcgccgttgaccaggccctcgcgcggcgccagcgagcgcaggagcatgacctgggccccggcgcgcagctccag

SEQ ID NO: 38326 - DNA, 61 bp, Chlorella protothecoides
gccgccccccgccgtgctttccacgcgcctcttcacgcaccgcgccgacgtggacgcggtg

SEQ ID NO: 38327 - DNA, 75 bp, Chlorella protothecoides
tcggcctgcccagcagagtgtgaggtgctttctgtgagtctgtcggcaggagagcagggtgtgccaacgactctc

SEQ ID NO: 38328 - DNA, 101 bp, Chlorella protothecoides
ggccgccggtgggctgatgctctgcatgggccgtgccgcgcatcggccccgccgcagcatcctcactccgaaggtgcccgccggttggcacaggactcggc

SEQ ID NO: 38329 - DNA, 2234 bp, Chlorella protothecoides
  modified_base (374)..(383): a, c, t, g, unknown or other
  modified_base (1424)..(1433): a, c, t, g, unknown or other
  modified_base (1819)..(1828): a, c, t, g, unknown or other
agatatgggggtcctgggggctggggcccatggtttgacctggggatgtagaggatgcgagtgggaggcgggcctggaaaggctggcacggcgcgcgacgcctttgcggctgtcttgcacccggtgtgcacctctccactccacccctttgcctcattgcagcgaggacgcctcgttcgatttcgagacgacggtgctgaacacggaggcccaccccctcaaggtggtgcgccagcccctgagtgcggcagacacagacacgcagcgatgagggtggtgtaccgtgattgctgcacgcagcgtgcgttagcctcgcggagagctcactcaggatctcttttttggatgccgcgcatcgacatgtgagggctgtnnnnnnnnnnccagcctctcggagagctcactcaggatctctgtgtgggatgccgcgcatcgacatgtgagggctgtgtatcggtgcgttctcagtcccagctcagcacagtgtactcctgcacgaccattcatgatcaaggccaggtgtatcggacatgcctgggagcaggacttgctcaagaagagattactgtcgcctgcacatgcacaaattcttgtgggaggatgagtcagcgagatcttgtccaggcgcggaagggatgtgggtttcgttccgggtgtttgaattcaaccgcatggaaggcagcctgctgatggatgcacacgattgacgattcacaaacatttttacgcgaaaacccgacgagttcctcattctcaagccgctggtcgacaccatgggggagctagaagcggtgctggcccctctgcagggccgggctcccttcccggccgacgcggccctgtcctacaccggcccggtcccccgtcgcgccctgcaggctcttgtggcagagctcaccgatcacccacgactgcgctgcctcgccctccagggctgcggcctggacgatgccggggcagacctgctgtcccgggtggtggccttcaaccccaccctcgagcgcctggacctgcgcggcaacgccatcggggcccagggcgcgcagctgctggccaatgcccttcgcacgtacaatgtgggaaccctgcgcgcgctgtgcctggagggtaacccctgcatcacacaggcgccggagctcttccccggcggccagaccgagctgtcggcccaagcaagctccactccccgggccgagaaggggcacgccatgagtgcgccctcccccctgagacccctggacgccaaagtggagcgcaggtgggggctttttgtgttgagaatgaggatggaatcggacatgcaggacatatgccatgtcctgcaccagcactctgagagcttgaaacagtcatggtggaccttgacaacacgattcagtccctgcacatggcttttttgtccaaccccaacaggatgttgagcnnnnnnnnnncgtgtcgggaatgaggatgggatcggacatgcaggacatatgccatgtcctgcaccagcactatgagagcttgaaagagtcatgatggaccttgacaatacaattcagtccctgcacatggctttttgtccaaccccaacaggatgttgagcctggagcacggcattgaggaggctgccgagcagctgtccagcgtgctgacctggcgcgagcgcttcgacgtggcgtcgggccagatggccgcggtacttgagatgctgcagaccgacactgaggccatgcggtgagttttatttgctattctgggggtgttcttcaggtggagcatattgtgtctgcatcactaccaacagagggcgccgaggggatgctccagcacggtgcgnnnnnnnnnnattttgctatcctgggggtgtttttcaggtggagcatgttgtgcctgcatgattaccaacagacggcgccgaggggatgctccagcacggtgcgtgctgacgcactgcctcatcctgccccgacccaccggcaacccacacagcactcggctggagctggtggaaagcgcgtcaccagaggcccagcaggccgtggccgcgctggcgtcccaggtgatgccgcagttgcaggccttgggcgacgcgctgtgcgcactgcgcgatgacctggcgggcagcgtggtcgcgtccctgcaggcgtccgtggacgcgcggctgacggcccacggggagagcacgcgggtggaaactgcggcactggcctccgacctggccggtgcgcgcgccacggcggggcgggcggaga

SEQ ID NO: 38330 - DNA, 61 bp, Chlorella protothecoides
agcagcaggggcggggggtgcggtggaggggcggtgccggggcgcgatgccgctcaggctc

SEQ ID NO: 38331 - DNA, 77 bp, Chlorella protothecoides
tgtaaccggcggcctcgtggaagacacatgtgcagcccccctccctcagccccccatctcaccgactccgagaaaga

SEQ ID NO: 38332 - DNA, 69 bp, Chlorella protothecoides
atctgggcttgaacggtgccctcgagggtgattccacagcactgcagggcgtttgagcccctcggcagg

SEQ ID NO: 38333 - DNA, 12062 bp, Chlorella protothecoides
  modified_base (109)..(208): a, c, t, g, unknown or other
  modified_base (1033)..(1042): a, c, t, g, unknown or other
  modified_base (1848)..(1857): a, c, t, g, unknown or other
  modified_base (2432)..(2441): a, c, t, g, unknown or other
  modified_base (4827)..(4836): a, c, t, g, unknown or other
  modified_base (4927)..(4936): a, c, t, g, unknown or other
  modified_base (5111)..(5120): a, c, t, g, unknown or other
  modified_base (6561)..(6570): a, c, t, g, unknown or other
  modified_base (7889)..(7898): a, c, t, g, unknown or other
  modified_base (8256)..(8265): a, c, t, g, unknown or other
  modified_base (8688)..(8697): a, c, t, g, unknown or other
  modified_base (9207)..(9216): a, c, t, g, unknown or other
  modified_base (9628)..(9690): a, c, t, g, unknown or other
  modified_base (10992)..(11001): a, c, t, g, unknown or other
ccgaagcgagggcgcttgacggccccggcggggggctcgctcgcagcgtcgcgcggcgccttggcgggcgaggctcctgcgcggcgcaggtaccacttcaggccgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtggcggccagcaggacgagctgcacggtgccgccccaggcgcggcgcgcccagtcgcaggcgccccacagcaagcaggcccggaagagccagcggaacatggcggcgctgcctccgccggccggcgcgcgccggccctgccgccgcgcgcggcggcgggaggttcgccgcgactgcagcgcgcgcacgccggcctcggcaaacaaggcgagggtaggcagcgtgcgcagcgtggtcaccgagccgagcctggaggaggaggtacgcggggtgggggtgcgggggctggagggggcctcgccggccggggtcgcggcggccaggcttaggcgccgcagctgggggggaagtgggtgggagaccgatggtggggagcagcggatcacataaatgccccgaggaagggcaggcgagagactgggagaggactgtcttgccaccttccatcttaccccaccggtgtgcacatcggatatgcgcatcagggcatcagcctcacctggcggtgtctttccacggccagctgctgccacctcagcattaagacccggccctccatccatgcctccaccaatgtggtcagggggaggcacgccaggttgaacagggactgaagtatgctcctgccaggtcgcaagtgtttggttgcgggatggggtggcctgccaggccgatgtaggaaggaacaggacccctgaatgcccccgtgaaggcatgcatcagggttcattcccatgcagatccttttggacagatatcatctttacactggcagtatattaaggaatgcccatgcaggaccccacctgtgagccagctcgnnnnnnnnnnacagatccttttggacagacgtcatctttacactggcagtgtattaaggaatgcgcatgcaggaccccacctgtgagccagctcgcgcccaaggtaatccaccagccaagtttttgggcccctaagggccaccgagcagaggagagcgtacactgctgcatcccggtagtcggccagcaccgcatacaggttccataaaagaagccctatgagggctgccagggcattgccggaagcatacagggcaatctgcaggtacgccctctggggcagggcggggcgagcatcctcttccctatccccacgattggagaaggaagactccattccttggggggaagtagaaacaaatatgctccatgtatatcgctgctcgaatgtggcgagtcgctggcacgctcgagcctttaaagtgcaaatcttaggcgggggcgcgcaagatcacttacgggacttccggcgagggggacacccggggcagcgtaccgctgccactgaggtgcatgccgctgccgctagcgttctcacaaatgttgacacgcctccattccatccaatcgcacgtacaccttgcggcgacaccctgggaattgggtcgctgacgcggggtacagccagcaggaacatacgtgtgcaatccaagccattacccaatgcgccgataaccgtgtgccagataccgtgcctcatcccatttagctatctggtactcaatctcattgaaaatggagggctcgggaaggcccgaggtggacgctcctcttcccccgagcgcggcagtccagcggaccctggaggccctccgnnnnnnnnnnattactcaacctcattgaaaatggagggctcgggaaggcctgaggtggacgctcctcctcccccgagcgtggcagtccagcggaccctggaggccctccgacttcgtgtcaaggagtatgacatggcacgcgccaaggatcgtctcaccatcgcggtggtgcgcggtgcatgtgcggggctcgcggttcgaggtggcctgcatgccgtctcgtacctggcgggcaggctcatgaggaggaggcgcagggagcagcccccgtccggccccacccctgtggagagactggtcgagaccctgcgctatggcgccttcctggggacctttggaggggtgtatgtctcggccgacgagctcatcgccatgctcctggggcggtcaaggtatgggtggcagcgggttgtggagttgtagctgggttgcatggcgccaacctctcctcctcgctgggctccaccagagcgttgcttgagtgccgggcaagctgagtgcattgaaatcgtagcaacccgctccacgaccatcgcccgccccatcctctccgcgcaggaccagggggtggcggtccctgctcgnnnnnnnnnncccacaaccatcacccgccccatcctctccgtgcaggaccagggggtggcggtccctgctcgccggcctcctggccggcccctccatcctgctcaccggcccagggtcaaaccacaccagcctggccatgtacgtcttcctgcgtggcctggtgctgctggtgcggtgcggcaacctcccaagggggcccgcctggcgccgcaggctgctggcgcccacccgcgccacccatggcgacgtggcgctgatgtgcctggcagtcacccagctgggctacagctggatggtcacgcccaaggtgggcgctgggaggggcggctcgctgacccgcgtgcctgcaccatggtctgatttgtctggtgtagggacagggatgccaggcacgtcgcatgtatgcactgggtctccggcagggagggcacccgtgcctgttgcgagggtcgcaatggccaatgggcgggcctttttgcatgacaattgaggacacccttctgctgctctgagaggagctgcaagcctcccccgaccctcagcaccaccttcactcgtagaccctccccggcgcctacatccgcttcctgaacaagcatggcggcaagccgacttacatgtgtgcggtggtgttgaggcggtcggcatggcccgagtgagcagaagatgtacccagtgccagctcccctgccctttcctcaagctctcaatcccctcccacctgcaggtacgcagcgatacgggagatgatggccctgcagcggcgcggggaggcccaccccccgcggcccctggcggcgctgcgcggcacgccccatgccgggttcaggggcgtgataccgtgcagcttcctgcacgagggccagacctgcagccaggccacgctggcatttgccccggaggcctacatgcgggcgctgcccgtgtgagtatattagaactggtgggggtgcgggtattttcaggagatggagagtgatggcaatccaagcaggtccacttaagggaggattgcttgttggaaggccacaacaggtgggagagggtcggccccatgctcacccacatctcccttccaccttccccttccctcgtgcacgcaacccaaccccaggtacttccccgtctacctcatccccgcgctcttcgtgcaccgccagcgactgctggaccccagggtcgcgcccgagctctggcgccgcctagtgctgggcatgctgcgctccagcgccttcctcaccctcttctgcgtgctggcgtggcggtccttgtgcctgggtgagtcgctgtgggcaaggctggagggggctgggcaagcacggcacccctgcatgccggccgtggtacactctgtgtgcgccctgacgacatccctccctttccacgacggctccagcatcgcacctgcccacctgcccaaatccaaaccatgctcgctcgcagtgcacaatgtggcgggccgcaccaccggccctctgttcatgctggcgtgtggggccggtggcctctccctgctggcggaaaagaaatcgcgacgcatggacatcgccctctactgcctgtcacgggtgcgcagggcgccacagcctgtttgtggtcttggaaatcggcccggggatggttgtgttggagttgccaatagcgatgtggcgtggcgctgtttgccgcacgtgctccactatgtgtgctgccagatcagggccccgatatgctgactcagaacccatgcgccgcgctttccacatcgcagggcgcagagtccgggctactcaacctgcagctggccgactcagcgctgaccaggcgcctgccgcgccgcctggacgtcatccttttctcggtggccactgccgccatcctgcactgctacagtgaccactggggagagcggcgggatgtcatccgcgggacctacctctcagtattcgacttcatcctggggaacacaggtgaggcttgcttgtgacgggtggtggcatatgtgtgtgtaggtgatcaaagttggcaagtgacactggacagtttcagcggcactgcttggagatgcagagggtagagcaatcacgtaatcaggagtgctgcagccagtccaggtcccatggtgcctgcacttatgaatgcaagttcgccctcgttcccctttgacagccaggcccagtgcttcaccccttccctccctccctccctccaggcttccagagcgcagaggtgaggcactcgccctccaaccgggagatgctgggcaggatcaaccagtcacagccgatgcagatggtgcgatcgctgtcctcccacgcattcaagcggatcaggagcagtcccagggtgaacagcagccagctaagcctggaccccaggggcgagggtgaggatggcgagccagagagccaatcgnnnnnnnnnnaccctcgtttccctttgacagccaggcccagtgcttcactccttccctccctccctcccaccaggcttccagagcgcagaggtgaggcacnnnnnnnnnngacagcagccagctgagcctggacttcaggggcgaaggtgaggatggcgagccagagagccaatcgccagggcacgagccgggagccaccagagtggtcgaggaggaggtggagggttgagcaacttctgctatcccttgcaccagacggtgccctatcgttaaatgactccgcnnnnnnnnnnacgaggaggaggtggagggttgagcaccgtctgctatcccttgcactagacggtgccctatcgttaaatgactccgctgaaatgattcactgctccgtgggttttctcatcttgtgtaattcaatgtgacacagaagtcaatcctcccgatctggagaggcccaacgcccataccagatttgatttttcttagattctgttggcgccgcatcggccatacaactcgcagcttcgcagcagcctcagcatccctgcgggcgcgactgatgcacatggggatcgagggctccgccgcttcatgcagggcaaatcccgacagattgcccagtgaatcggacttcacaacataatttagcccctctgacgcgcccgggcctgcccgccacccgtcctgggaggggtcatggcgtgcagcccttcttgctccagcaagggcaccaacccgagaaccaccaatccgcagaggaacgcgggcaggaaggcaccgcgacgtgcccctgcaccggtaatcagagctccaccgaggcagttggctccctgggcggcacggacgcaggtcttccgacgagccgtgggcgcaccaccctcgcccggccggacctccagcaccacctccctaggcagccacgacctaccggatgccttggccgcgagtgtggcggtgacgccttcagagccttctcagtccgccttctcgcgggcgctgcatgcctacaccactgctttgcgggaccaccccaccgcgaccaaggctgtcaccagtttcctgggctttggcatcggggatgccatcgcccagagcatcggcgcgcccttcgacatcacccgtaacattcgtatgagtctgtatggtctgatccttgatgggcccctgggccacaagtgagtattggaggagaatggggaatggagcagggttgtgaggtgcctgagccatggcctcttcctgggctgacgtcggaaggcgcgctcgccgtcagcgtatgccatggtaccaaagtgcacttttgacattgaccctcacatcgcctccctcttccctcacagatggtaccagatcctggattccaaggtctaccccgaggatcccacttgtacaaaagctgtgttgatcaagactgcagcagatcagctgatctgggcaccgatcatgactgccgtattctttgcgttcttgaagaccatggaaggtagggtgtggtagggaatttgccttgtggattgggtgggagcgtccaaaatcagctgtagctcctatggacttggctcatgtctgccggaatcagttcccctttcctgtctcgcctcacacccacccgattccctccctctgccccaggccaccccgagctcattttgcccaccatccaagacaagctggtgcgggtggtgctggccaactatatgctctggcccatggcacacatcatcaacttcaagnnnnnnnnnnagtgctggccaactatatgctatggcccatggcacacatcatcaacttcaagtttgtccccagccagcaccgagtgctgtttaacaacgtcgtgtcggtgagtgccctggatgatggtgcaggggaaggaggggatgatgctaactgggttcccagcgctgaggccccatcgcagtgcagcagcttgcgtggcttgcctccgctgcctgacctgcgcttattggcaggggttccccacttaaacacacacacacacacacacacctccccccggtctacagatcgtgtggaacaccttcctctccttctcctgcggtgacaccactgacttcaccaccgacgacgccggggtggaccccgtcccgggcctctcccacttctccagtgtggaggggcggctgctgaccaagctgccgtgcgccaagcgcccagatgtgctggactcgctgcatgtgggcgaccttgtgcggcaaacggcagccctggagcggctgctgggggcctggggcatccaggtgtgtgcagggaaggatgcgtggttgctgggttttggggagggaggcaatgaccaggtgttgacgatgggaaatgttcaggacggctatgtccgaggcacaagtatcttttcagcacattggtggatcaagtgccgatggttcaggtacgtcattgctgtgccagcccccatgcattattcatcattagtcactatccaactcacgcagggactgccgagccccgatgtggccagcgacctgcttgggcagtatgtcgacctgaagcagcagctggtccggaaagtgtgtgggctgccattctgagcacttctgcaggacattttctttcgtccctcagggacgcgctggccccacagggccgcaagcagccagaattcttgtcatacccctccctagcttgcagtgaatgaaggtgcacaggcggcatggacacctcccctccctcgctcctttcctctcctcacacacggccttcctcactcttcaggaaacccaattttctttgttaaccctttctctctctgtcatcatgcccatgccagcacccccttcatttgatcgaacacgtaccttggcgggcgccgaagcatgcagccgctgctcaaacctggcgctgcacccccgcctggccttgacggccctgggccttgccccgctcggtctttgcagcagcctgaattcgctgctcacactcctcgctgagcctttgcttaattttgtgctgtaatatgaagcatgaaggtcgttggtgccggccatgcgcaaggtcacgagccagagcagtcaccaccttctcccccnnnnnnnnnnacatgaaggtcgttggtgccggccgtgcgcaagggtcgcgagccagagcagtcaccaccttctccccccccaaacatcatgccatggctgcgagcaggaagttcttgtagtcggccatgaacctcgccacaaaggcctcgatgtggaagatggccttggaaccctcctgcagccggtgctcgaagaaggcggcctgctccgccacgctctgccgcagctcgtcgtccagcttctgcatcagctccagcgccaaccggcgcatgatgatctgccagatgggtgtggggtggcggtcatgggggagtgtttggtgctcagctctgcacgcctggctgcggcttcccctgaaactcccacnnnnnnnnnngtgagtgtggggtggcggtcgtgtgggagtgcttggtgctcagcacagcacacctggctgcggcttcccctgaaactcccaccactgacagtcctttccctccagcagttgtgggtccgcgcctcgatgacctcagcctcatcaggccccaccctgcacgcttgaccctcctcgtcacacaggcactgcacccacctctggggggatgcagttgacgaggagctcgtagaccttgccgcgcactgtgtgaaggcgcctggggctctgctcggccctgatttcggcggcaatctcctgcggcgcagagcaggggggtgctcgtttgtgggcagggcgtacgataagatcctcacagccagggccacggctcatcggcgcggtcccttgctccaactccaccactccctgccatctcatccccgnnnnnnnnnnggagcaggggggtgcttgtgtgtgtgcagggcgtacgttaagatcctcacagcccgggccacggcacgtcggcgcgttcccttgctccgactccaccactccctgccatctcatccccgtcacctggatgtagagctcccagtcggcggccgccacggcctgcccctcctggaaggggaagtgctgggccttgcaggcctccagcgccagcagcgcacggcgcaggttgcggtcgctggcctgcgcgatgcgcgcggccagctgcgcgggcagggcccagccctccgcggccgccaccgcccgcagcctggcctcgatctgggggtgcgtcggcgcatgcacacgcacgcaaaggcagcgcgaccgcaccggctcgatcacctgagcgtggcgtgcgcgcttgtgggggccagcgagggaggccgcgatgcaggcacggcgcagtgagagcgggcgcaccccggcagcaggggcggggtgcgtcggggctggcttcatgcggcgccgcgnnnnnnnnnncgtgggggccagcgagggaggccgcgaggcaggcacggcgcagtgggagcaggcgcaccccggcggcaggggcggggcgcgtcggggctggcttcatgcggcgccgcgcacgcgaggaggtacccggcagccggcccatcgtcacacaatacacgcgctcccaccttggacacgttgctgcagcagagcacgatgcggcaggcggcagaatacttctccatggtgcggcgcagggagtgctgggcctccttgctcatgcgatccacctcattcaggatcagcatctgacggagggggaggcacagcaggtgaggtgtactcccagagctggaattctctgcaggctccgaggcgctgaccctcacaggcttgctggagagtacacacatgctcacatcgaagcgcccccccnnnnnnnnnnnnnnnnnnnnnnnnnnnnnnnnnnnnnnnnnnnnnnnnnnnnnnnnnnnnnnncatgcggccccgcaccttgaacatgcgctcggagctgacgcccacgggccgattcttggccatctcctggatgatctcctggaccacatacctgacgggcacgaagagcgcgagtgggtgggtgggagggataggtaggaaaacactgtggaggtccaatctgtgactatgaaggccaggcgcgagaccaggcgcaacaccccaggagcacccactccccctcggcatccaagcagcatcccccaccgcgctcgcccgcacgctgcaccacctcaccggtcgttgttacccacatcgctggggttcagctccacatggtatgcgctggccagcgtggtgaattccacctccagcgtgcgggtgggcagctcgatcttccagggcttgcactccactttcagctgggttggggtgacgaggggagcagcaggcgcgtgggtgcggcctcagtcactgcaagcacgccaacgcgagcagcgagcttggcacgggctctctggcctcaccttctccacgccggggccatacacctcccgcaggagcgccaggatgagagtcttcttgccagcccccggggggccgtagaacagggcgtgcgggcaatcgttttgcgagatctgcggagcccggggggtctggtcagagtccagtgacctctcaccttccggcatgcatcccccggccacacccccgcaccagctttgcgaggttgcatgatatgtcgctgtgcaggtcaaagtcctccagcgctttgggccggtactgcacgagtgatgtggatgcacgttttgctttgatcagtgctgcccgatgagaagtccatagagagcccgcatggtgactggtaccttgtctgcgtagagcatggcgtcccacacgacaacctctgccgctccctaagcgatcgcgaatcgcgatcaaagcatttctccaaggcaagaattatcactgccgatctgagctctcgatggattgcatcagggtgagtgggtttgatatttctcctttcgacgggaggctctgtaaaattcgaaaggccccttgccagatctgcagatctcgtggtggacctcagccacgcaatacagtcagtgtcttatcggattaattttcaggtccggacagttgaaatgattggaactgcacaaaacgagaactatctgtctgtctgagccatccgttcgcctggttttgagaatggcaacccccccgtgcatcgtggagccaggggtgaaccgagtggctcacgaatgagcctgggaatcaccacaaaatgatggtgtgcggtaattgagagccttnnnnnnnnnnttggcaaccccccgtgcatcgtgcagccaggggtgaaccgagtggctcacgagtgagcctgggaaacaccacgaaatgatggtgtgcggtaattgagagccttcgacgtcgttgaacccgtgaggaatctgaaactgcccgtccatgccaaggcccactcagaagggcaccatcccagacgtggtggcaggccggcatccactgcaatctggatcctgaaccgagctccaatattttgcgacagacagcatttgtaattcgctgtcagttggcagaagtgcggggtgatcaggtccgaatccgcagagattcgggttccctttgccggggtcggaggggggcatttaaaaacagcggggccaggtataatgcggtccgttgaggatggcaccgcggaatggagtattttccccttttgcagtagcaatgcagcgtggcggtgcggtttgtgctcttgctctgccgagcgaggtatggatcgaagtgcttagccgattaaacggtcaggacctggcccgtgctctgtgcacctgcaaagctttctctcgtttgcaacagcccgtttggcaagctgcctgcttcaaaagatggaacaagtggtcatcatacctcgaccccgcctcgcactggcgtcgacaatatgaattgctctgcctgcgggagctggcagagcagaccgtggcggacgtaggtcagatacgcaacgcccagcaattcgtctccgatcggcaccgcgccgtactcgtggagtggatgtgcgaggtgaggggatcggctggacggtcggagggtgccatgccaacgggtgttgacattgcggcgtgtcggtgctccgtacccgaccccccccgaccctgtgccccgtaaattcgcagatcgcaatggactggaacttggagaccgccattgccttcaaagccgttgcctatcttgatcgttacctttcaagaagctctgtctcccgtttggcaaggtgtgtgcgcatcgcgcgggcgggtcggaccacctgttgctggcacacaagcttcagaccccccccccccccccccccccgcccccca

SEQ ID NO: 38334 - DNA, 78 bp, Chlorella protothecoides
gcgggcgccgccctcgccctcctcgccctcccagtccgggtcggcgcgctgcgcgcgctgcagcgcggcggcgtagtg

SEQ ID NO: 38335 - DNA, 61 bp, Chlorella protothecoides
cagtctggcggagcagtgggcggagcactctcggcgcggcggcgccgcgccgccgctggaa

SEQ ID NO: 38336 - DNA, 61 bp, Chlorella protothecoides
cgccgccgaccacctggccccggcctccccacccccccggccatcaccatacctgctttga

SEQ ID NO: 38337 - DNA, 67 bp, Chlorella protothecoides
cacacacacacacacacacacacacaccgggaccattcccccaaaatgtagatgaacgcgtgggcgg

SEQ ID NO: 38338 - DNA, 412 bp, Chlorella protothecoides
  modified_base (114)..(314): a, c, t, g, unknown or other
gccccctcctcccccgccccttccccgaccaccgccgccgcctcctcctcctcttcgtcgccggcggcaccgtcctggcgcccgctggccacggtcagcgcgtccagccgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccgcgctgcgccgcgtcggcctcgggccaggccagcaccgccgccgcggcgcgttccggccaggtcagcgcatggtcgacggcctcatgcgcgac

SEQ ID NO: 38339 - DNA, 61 bp, Chlorella protothecoides
ccgccatccccgagtgaagcagcgcgtcacgtagccgtattagctaccgcaaaccccgcct

SEQ ID NO: 38340 - DNA, 78 bp, Chlorella protothecoides
ccgccagccccttcgcctcgggcgagggggtccgggaggccaggccgcccctgcgcaccccctcgctggtgggggcca

SEQ ID NO: 38341 - DNA, 61 bp, Chlorella protothecoides
gacatgcgcacgccactgctcagatcgaaaactctgagctgccacaggctcctcaaccccc

SEQ ID NO: 38342 - DNA, 27770 bp, Chlorella protothecoides
  modified_base (263)..(272): a, c, t, g, unknown or other
  modified_base (696)..(705): a, c, t, g, unknown or other
  modified_base (1446)..(1455): a, c, t, g, unknown or other
  modified_base (1719)..(1728): a, c, t, g, unknown or other
  modified_base (3186)..(3195): a, c, t, g, unknown or other
  modified_base (3790)..(3799): a, c, t, g, unknown or other
  modified_base (4293)..(4302): a, c, t, g, unknown or other
  modified_base (5567)..(5576): a, c, t, g, unknown or other
  modified_base (8138)..(8147): a, c, t, g, unknown or other
  modified_base (8202)..(8235): a, c, t, g, unknown or other
  modified_base (8719)..(8802): a, c, t, g, unknown or other
  modified_base (10005)..(10014): a, c, t, g, unknown or other
  modified_base (11162)..(11171): a, c, t, g, unknown or other
  modified_base (12047)..(12056): a, c, t, g, unknown or other
  modified_base (12619)..(12628): a, c, t, g, unknown or other
  modified_base (13032)..(13041): a, c, t, g, unknown or other
  modified_base (13452)..(13561): a, c, t, g, unknown or other
  modified_base (13951)..(13960): a, c, t, g, unknown or other
  modified_base (14219)..(14228): a, c, t, g, unknown or other
  modified_base (14680)..(14689): a, c, t, g, unknown or other
  modified_base (15492)..(15501): a, c, t, g, unknown or other
  modified_base (16260)..(16269): a, c, t, g, unknown or other
  modified_base (19063)..(19072): a, c, t, g, unknown or other
  modified_base (21832)..(21841): a, c, t, g, unknown or other
  modified_base (22872)..(22881): a, c, t, g, unknown or other
  modified_base (23371)..(23380): a, c, t, g, unknown or other
  modified_base (24267)..(24276): a, c, t, g, unknown or other
  modified_base (25942)..(25951): a, c, t, g, unknown or other
  modified_base (26496)..(26505): a, c, t, g, unknown or other
  modified_base (27626)..(27635): a, c, t, g, unknown or other
gggttctgcatggcaacatgtacctgaccaccctgctctgactcccaatatacagcctgctactcgaggtccttcccccccacacctcttcagtgcaacgacccacctcctgtcccgtactgtctctccctccttcggtgccaggcgctcggcagcaattgcagcacacgccctgtccaccatcccctccacgaccccacagtatgccaggttggcttcctgcgccaggccctccatgtcggggtccgaccctgcatgctgannnnnnnnnncggtgccaagcgctcggcagcaatcgcagcacacgccctgtccaccaccccctccacaaccccacagtatgccaggatggcttcctgcgccaggccttccatgtcggggtccgaccctgcatgctgactcagcgcgtcctgcacggctcgggttccgtcttcgatgcactcctgtaggcgatcgatgtgccgctgcaggtcctcctgagagcaaggatccctgcccgcggggaggaagcccatgcgtgccagggagccccatgccggctcgccggccccgcgcatggcacgggcggctgaagcggcggcccccagcgcggcagccaggtctgcaacgtccctgagccagaaggcccgctggtgcaccggggacgaccactgcagcgccccctgccctgccagcagtcgccggtccagggccgcnnnnnnnnnnaaaggcccgctggtgcgccggggacgaccaccgcagcgcccccacccctgccagcagtcgccggtccagggccgcggccgcccgtcggcaggcggccgggaatggggcggcctcccgcctggcggcgtgcgcggcgtgcaacgccccccgcaccgccctcaggccctccagcgcccccggcaccgcgacgcggacctctgttattatggcaatcggtgcctcgatgaccaccaggccggctgcctcggctatcagccgtctgctgtcagggcccaggccgggctgcaggacgcctgtggccggcacacgctgcagcacgctaccctgcaggtcctgctggagccccgggagctggcgctccagttgccgtgcccactcgtcgaccaggccggatgccgcgaggcgcagggccgccagcgccgcctccaccgccgcgccggagcgcgcggcggcggccatgccccggggcccgtccagccggcgacgcacgcgccgccaggctcgccagagaacctccaccctggtctgcgcagcgcgcacagcgcacagccggggtcccaggccgggccagcgggctcgagaagagtccggcgagcgggtggcgccgaggagcagggcatgcacctcatcctccagcctggcatgccactgctgcacctcatggtccagggcagacctatcgtgtggaagaaagaatgggagggatggagggggcttgaggtgggacgtggatgggaggcnnnnnnnnnngtcatgtggaagaaagaattggagggatggaggggcttgaggtgggacgtggatgggaggcaggaggtaaagcaggacggggtgggatagggggtgcagagcaggtggtggggagtgagccagcgacctaaacatgcagtcacagaaaggatcgcagcactctgcaatggtcacaacaaggatcgccctgacaccatcgaggagcagcacaagcaccagcgacctcacggacgcaatccatcgcatctgctcaagcacctcctnnnnnnnnnnacatcgaggagcagcacaggcaccagcgacctcccggacccaatccatcgcatctgctcaagcacctcctcatcccccccactgtgcccacatgagaggacagccctgctgagcacgctgggcgcaggccgcgaggaggttgagctgggcggggaggtagcagggcttgggtgccacgccgagggcagccaggcgccggtccagctctcccacggcagcatcaaaggcgcggtacgcctctggccagggccttaccgcggcgccctgcgccggctgcagggcggcagcgaggccggctgcgcgggccagcgcaggggatgtcggcatggcaaggaaggggtgccctgtgggccgcacgtggatccccctggggcattggcccccagcgcccaacatttcccctggccaacagagtaggtgtcccgcctcgtaccttgcgcagccctgaattcacccattatcctcctgagaagctccagcccgcccgctctgccgtgcaggaagggcgccagtgcctcctccaggccctcgtactgggcgacgcaggcggcgacgcgcagccgctggccgcaccgcgtggcatgctcctccaccggctgcaaggaggccgcgagggccagcggcccgccccttgggaagcgcgcggccccctcctgggcccaggcagcgcaggcctcgacctgctccctcaggcccgcctcgccctcgggcgccagtccgacgctggccgcgaccagggcgcgcccgcaggcttgggccaggggaaggaggcggggcgcgaagcggcggccctgtagcctggcgaccacgcccagcctgagccacaccccggggattgtggcgagcaggtccgggggactggcggcagacgacagcgcctgcagggccggcgccaggcaggtcaggagcagggcatgcctctgcagcccaccagccgcctgtcggtcagcatgcatagatgggggggagtatgaagcaggagcaggacagcagggggtggtgcgagcattcgggggtgaaggtacccgtgcctgattcccgagactcatcgtacttgatgcagtggccttgcactttgagccgccgccatcccaccagctgcccacccaagccagtccacccacctccttcagcgcgtgcagcagtgcgtcgaatgcttgcagcagggggctggcggagccacgcaaccgttccagcaccgcacatgcaggaggggaggacagggccgcacagcagcatgccatctgcgacgcgagcgaggcccagagggcgagcagagccgagcactcgcccacctgctcggcttcacgtgccttgtcaatgtccctgtgcacgcgtgacgagggctgcaccttggtgggtgacagggcgggcaactctcaaaccatgctcggagcgccagaagccttcctgcaggctaaggtaatatgcgcagtacacgaggactcaagcgggggnnnnnnnnnncgggtgacagggcgggcgactctcaaaccatgcctggagcgccggaagccttcctgcaggccaaggtaacatgcgcagtacacgaggactcaagcgggggcaacctccgaagccccggttcacagaagcaagggcagcacctgtgaaggagagcgtcaaggccctgtgtccagcctatcaccaaagcttccaggatggggagggtgtgactcgcctcacaaacctcgggagggagttccggtgtgaagaaggggtggtcccgaacccctgccaggaactgctgctgtgtcagatgggcagccagactcattgcgtccaatatggaggcagcatgcagggtgtctgaggacatgaccgcctcgatgatgtcatggggcaacaggaagtctgtcaggaagctggcgaggtgcatggctgatccaaggcgcaatgcgtctggattgctcatggaggggatgctcagctcagctttcattactcctcctcgacgtgacaaaggtaaacttggtatcgattgagaacaggttcatttgttcctctgggaatggttgccatcacattgtggagcagcatacgacttcatgctgtcctccgnnnnnnnnnnctgatgtcatggggcaacaggacttctgtcaggaagctggagaggtgcatggctgatcccaggcgcaatgcgtctgggttgcccatggagggaatgctcatctcagctttgatcactcctcctcaacgtgataaaggtaaacttggtatcgattcagaacaggttcatttgttcctctgggattggttgccatcacattgtagagcagcatacgacttcatgctgtcctccggacctccagatcaacatgaactctcgcgatcccccgcccgctcgcgatttcccttggcgtttagctgactcaggcgtgagatgtcactcaataacggatcctgccgcggctcggcctccggtgtttgggttcggggacgggttcctgcggtcaaagactcatgtagacccgaatgacggtgcgaaagatttagagggcgcgtattacctcgcaccgaccttcagcaatcagtgccgaggacatctgcgtccatgttgatctnnnnnnnnnnggacccgaatgacggtgcgagagatctagagggcgcgtgttacctcgcaccgaccttcagcaatcaatgccgaggacatctgcgtccatgttgatcttttttggttcaatgatcagattcctcgatgggtgagccggacgaggatcactttgaggctgcggccgagcaattgacgctggccatcgccgccggcaacagcattcccgatgacgagctcttggcactgtatggcctgtacaagcaggggagcgtggggccatgcaccacctgtaaacctggatttctcgatataaaggggcgcaaaaaatggggagcctggcatgcgctgagcgagcttgacaccgccacagcgcgagaccggtatgtgatcaaggtccgcgaattgctgggaggccctgcggaaggcgagcaggccgccacgtacatagacgcctcgccgtccgtgagtgtccccaccaacgaggtgcagctgcccgaagacgacgaggtacggcatgcatggctgattcgtttgggaggcaacccgagccaggcttgatcagcccgcagcacatgctctagctctgcatgtcctctccagcaatggacactccggaatacactgcctcacatgcaggaggggggaccgctgcacactgccttgtgcgaggcagactctgtcgtgctgcagcgcctgcttgaggctggcgagcactgcatcaacgcccgtgatggacaagggtgcacaccactccacctagctgctgacgcgggctccctccaggtgctgtgctgggcgtggccatggcagtcgaatgcctgttgcacctgtgcacgcgttggaggcagcctccacgattgcaggtggtaaccccacaaccccacacgggcatgcatcgtcttcacccatatcgcccggtattaccctaccaatcacaggcgctcaagttgctcctggatcatggcgccaatgtgaatgctggagatggcgagggcttgacccccctgcactacgcagcgctggcatctaagcgggaggtgcgtgccgcctgcgcggatcctgggctgctgctcctttcatgccctggccagtctatggccgtcagatcctgatgatgcccctgctggacagggttcatgctctccttgacgcggccatgtgcacgcacggctgactgtgaagaatcccacgctgtcgcaggcttaccaagcactccttgcggcaggcgcagacgaggcggcaaggagtcgggacggcgaaacggcacaggacctcgcgcccaagnnnnnnnnnngagatcctgatgatgcccctgctgggcagggttcatgctctccttgacgctgccatgtgcacgcacggctgactgtgaaggctcccacgctgtcgcaggcctaccaagcactccttgcggcgggcgcagacgaggcggcaaggagtcgggatggcgaaacggcacaggacctcgcgcccaaggcctggagcctgcagccagcctgagacgctgctgcatggtgtttttgcaccacagcaccccagcgtcccctgcaagcgccccccaagagatcagcacggcaacccccctcttgcagctgcgccctggccctctagatgcagctcacttgaactttgcgggatagttacatgacgacgcggctccagcacgcaatgcaaatgcggctgcgatcgcaggagggctgagcacgaggcggctgcctcttctgtggacccagatggcgctttacagtgggcccatggcatgtcaaaaacatagagcgttaacagagaaataaagtagagcaaaagcagtggagggggccttacagatgggtaaaaaaggggtatggtgtggggtcctgatgctcaacagcaagcaagggtgctcagctgcccgcggggatggtcgctttgggtacatgctgctgcatgaatgcgatgtactgctcagatatcgcctcatacgtgcccacgatctggaaatggggcgcggtggagggcggagggatttcggagaagggcctcggatcgtttcgtaagccagactgacccaaccacatgacagccctgcccgcgggcactccccccgctctcacacctgcaatatgttcttgttcagtgtctggatcaggcttgaactccgttccaggtcccccgagctccccgcattctggtgcgcccgtattcggtgcagcagagacctgtgggagggtgcgacgggcccgggctcgcccgacgtccagcatggggcgggatatggcagcgaaatccaccattactgagctcctccccctcccaagggcgctcacccgttctcctcgaagaggcgctggactgtatcatacatggcctggtccgggaaggtcggggccgacttggactgcccgttttccccactagacattcgtgcacggggcctgagccatgggatagctgctcctggaccgcgtttcatgccccccccgctgccgggccgtggcttacatgcgagcccacctcccgggcggaaggcggattcgcggtcacgtgcgcgaatctgggaaggcatagtgcaggtccccccgccgcagcaggccccccaggggctccacctggggcacctcccgtggacccagcagcctgtcccgcgcggaggccacaacgttgtgcagcgtggccgcgatggtcatgggccccacccccccggggacgggggtcatcacgcccgccacccccgccacccccgcctcgtccacgtcgcccaccacgcggccgccctccacgttgatgccgacgtccaccaccgcggcccccggcttgacccaggaggcgcgcaccaggcgcgggtagccgaccgccaccaccagcacatcggcggtgcgcgtaatgcccggcaggcccgccaggtgctccagcgcctcctcccgcacgtcggcagcgcgcgcggcctgggaaggccctggcggcacgcgcggcgcacaggccgccgctgccacgcgcgccgcggccaagcgcggtgacaacgcgtccgcgaacagcgctgagtaggaggtgcggtgcaccacggtgaccgaggccgcgcccgcgtcccgcatgagtgccgccaggggggtgcccaccgtgttgctgtcgcccaccaccaccaccgaagcgccgcgcagctccacgccgcccgcggccagcaggcgcagcgtgcccagcgccgtggcggggacgaagcctgtgctgcgaccccgcataagcatccgactgaagggatgtttgttttgttggggtgagggggatgagaggaagacacttgagaacagccatcatgacggctgaggagttgggaggactttctagtaggcgcatggggaacgaaagctgtgactgaggtgcagggtcacaggatcctgagaatcaaatggggcccgctgcctgcgctccgactcaggctccaatcccactgatctgcctgctctccacccccccaccccccaccacacacacacacacattgctcaccccatattgagcgggtggaagccgtcgatgtccttgctgggatcgaagctctccatgacccgctcctcggagatgtcgggcggcaggggtaactgcaccagcacgccgtcgataccggggtcggcacagagctcgcccaccacgcgctgcacgtcgccgatgctgcagtcatctggaagctgaaccaggcgctccgagatgcccacctgattgcggaagagggggaatgcgggattgggcatgggtggcacgagtggggcagggacttggagggtggcaggagcatgggttcccttgcatgcacaggttcacgatgcatgtgccaagcagcaatcaccatggagatgcccttcaatctcagaaagcacagggnnnnnnnnnngggagggggaacgggggattgggtatgggtggcacgagtggggcagggacttggnnnnnnnnnnnnnnnnnnnnnnnnnnnnnnnnnntgagacaagccagtgtcgctgcagagtgtcaaggcctggcaaactcagagccgatacttgctgcacctccagcctggccccaagatcaccagcccccccacacacagttgcccacccaatcaccttttcacaggcttcccgttttcgggtgacgtacagcttggagtcggggcggtcgcccaccaggaccacgccgaggccggggcgccgccccgccaccttcaggatgtgcgcagactcccgcgccagctccgcgtgccagtcggctgctgccgcccgcccgtccaggaaccgtgccgtgtgagtgggcaggggctcgggggtggctgcagggtgttgaagtggtcgggcgctcagcagctgctctatgtgaagcggagagggaatgcacccacccaggcaaggccctgtccctgcacaccctgcgcacggcctacccgctgcagcattactggatgactgatgtgcagcagatgtactagannnnnnnnnnnnnnnnnnnnnnnnnnnnnnnnnnnnnnnnnnnnnnnnnnnnnnnnnnnnnnnnnnnnnnnnnnnnnnnnnnnnagactccatgctcagctatcatgatcgcgacctactggacaaacacaacatccaaggtcagaactcaccttggagactcgtcagtcgtaggctgcgtcgaaggacttgctgcaggcgcactgccatgcggctcgacgtatctgctggtacctaccaaagcgggacttgatgtaaagtgcagcgcatacagttttggacccaaaatgcgtatcactggattacatgcatgcgacatgggtagttgctggttacattgtgagtcgaggtcacgtcgcgcgctcgcaggggtcccggatctgacctgataaatccaccacaaaactatggcgctgccaaacaacgagcctacaccctcggttctttgaatgcagaacctgctacccttgtgactgtttcacatccttgggtatgcgcttgagtccatctggcttgcagttctccgcagggcataggctcgcggtcacgacgctggtgaaaccgttcagacctcgccgcgccatcaccacgaccaccatgtcgggatcagatgctcctcagaagctggataaatccactccggacagcgtttggaagcaggtcctgtctccgacacaggtgggaaggcgaaacatccacgctggcgacggcctgttccccgagcacgtttggacagtcgatcaacttcaatcatgtaaaatgaacacttgattcccctgtgcagtatcgtatcctaaggcagaagggcacagagccacccggcagcggagagtacaactccataacacctggtggcatcttccactgtgcagcttgcgatgctcctctatactcgtaagtatagtcatagctgggagtgtgtggatgacacttagtgacaccaagagatccgttggaatgtgtaaacttgcatgccagaattgtgtgcagtgagcctgtggtgcaagtggcgtcactgctgaacccctccaactgacaggagtgagaccaagttttcgagtgggtgtggctggccggccttctatgacgagctcccagggactgtggagaggcacgaagatgtctccatgggaatgcggcgagtggagatcacctgcaaaaactgcggtgggcatttaggccacgtcttcgaaaaggaggtgagcattctgttggagccctgttgctggcaatgaccattgagaactgcactttcaacatgtgacattggacgactttaagcccacnnnnnnnnnntgaaaaggaggtgagcattctggtggagccttgttgctgccaatgagcgttgagaactgcactttttacatgtgacattggacgactttaagcccacgagacgtgctcatccccaaaatactcggtatgccagggtttcaaaacgcccacggacgagaggcattgcgtcaactctgtctcactcaagttccggccaagctaaggagcctctggttgctggaggtgtgtggtgttgtatattatgagtctgtagacacactgatgtgtaagtctgctcatgttacttgcatgttgagtattagattgatttattttctgagcaaccccttctcgggttagcaatgagggaagccatcgaaagggagggcgcgagacccagctgattgtatcattctaaattaaagcagtcacgctggttagagtgacgtgccccgaggcatccaaatagtatatactaatttatcgcagaattgttagaaggtcaaggcggtcgcgtgaaaacccccaacagactgtcggttttgtgatcgaagttcgacaggcgtgccttggggcggggcctgctgcgtactcactcgccaccgacgacgcgatacgactcggatggtgaaactcacgctcatagctcgcgtgagggatggccagctgctggctgagggccttgatggagagaaggaggagggcatgtacgcgtacaagacacaagccaaggtgcgatcgatggccagggagcatgatctcgcgctgccgcccgctatgcttcgatgtggatcctgcacgacggtcagggtgtggtccaaccccgcggcgaccaacccccccttgcagagcctcttcaagcagttcagcacgagcaagccgcccccacggcagtcggtcgcctcgggcgacatggttttccacaccctgatcgacgagtatggcgtctgctacctcaccctcacagacaaggcctaccccaagaagctagcgtaccagtacctggaggagctgcagagcgagttttcgcggatgcacggaccgcaggtcgatacggtcaaccgcccgtatgccttcattaagtttggtgaggagccatgcgctggattgcctgcagaaacatcgatggctcttgacgacaagctctgtgtggtgccagggtcgatggnnnnnnnnnntagccatgcgctgtcttgcctgcagaaacatttatggctcttgacaacaagctctgtgtggtgccagggtcgatggacgggaccttgtgtcctgacgcatggcagactcagcatggccattctgcctcgttacacagacacattcatccagaagacaaagaagttgtacttggacaccaggacccaacgaaacatagccaagctgaatcaggacattgccgaggtccaccaaatcatgacgcgaaacatcaatgacgtcctagcgcaaggagagcgcctcgacagtgagttgcgctggggtgtcttgtttgcagctgggctttgttgggcttgggcactttgcttcactttatactctccgaagagtgcacatgcatactgcggattgcttgttggcaggcaggtcgctttcttgtccatattctggtgatgatgtctcggcaaggctgaggggcgcctcactctgacatggaaagccacaacatcccgggtcttcccttgcaccttgagataggaagagcgcccttccccccttcccaccccgcccctcaagccactcaacccacccccatgtcactgcctcacagagatgcaggaaatgtccaccctgctgtccaatgatgcccggcagtttgcggtcaaggcgaaagacctgtaccaccaggccttgctccgaaaatacctgccgtggttcgtgacaggtggcatcgtgctcctcgtcctggtgctcagactctggctgtactgagcagcagctgcttaaagggatagaggtattaagcggttgggaagagggcgcagaggccatctgggcctgaataatcaaggaacatgcacagtagactagccagcggtgccgggcaggaggtgccctgnnnnnnnnnnggggcctgaacaatcaaggaacatgcacagtagaccagccagcggtgccgggcaggaggtgccctgctgtgagcacggcgaggaaggagggcacgggtgaaggcagcccctgggacccctgagcgcattagcccaaggtgcgtagccatgggcttcaccatcattccgcgacaccgtcggacggcgcctcgtgccgcatgatctccagtgcctcccatgtgccatctggggccaggaaaatggggagggtgacatgactccaggtgccagtcagtgcagtggcatggaggggtcggccacagcgcacaatccctccacacataccttctttcttcagcgccagtcccagctcgtcgtcgtcatgcacgcccagctcggccagggtctgggtgtctgtcagggccgtgctccctcggtacagctgctgggtggatggttcctgcgcatcgtacagagcggaagtaagtcgaggatgtgggtgcgcttccagcccctggtgtgcaggtcgcctacctgctgtatgagatcgccgatagcagacttgagggtggccacggtgtcannnnnnnnnntagctgctgggtagattgttcctgcgcatcgtacagagcgggactaagtcgaggatgtgggtgcgcttccagtacctggtgtgcaggggtcgcctacctgctgtatgagatcgccaatagcagacttgagggtggccacggtgtcagtggggttgacctgcaggaacacggtggtcttctggcgcttgacacgcacgtacataatgtcccaatgatgcgaaaggtgggatgtccgatcaatcaaggccccagagcgctaaatgtgaacaaaaacagaagccaaagggtgtcggaggggggtgcagacgggaggtgtcgggccacgcctgggacaagttggagagtacagagcggatgttaaataatgtaatactaaaatatcggttgcacatccaggtgagacnnnnnnnnnnttaaaggtgggatgtccgatcgatcaaggccccagagcgctaaatgtgaacacaaaccgaagccaaggggtgtcggaggggggtgcagacgggaggagtcgggccacgcctgggacaagtgggagagtacagggcggatgttaaacaatttaatagtaaaatatcggttgcacatccaggtgagacgcagatccgcccagagaacaagcctgcgtgggtgtgatcgatgccctggcatgctgtgctgtggtgagatcgccacccactgatttgaaccccgcaaactgtgaatgcgcgctcctgagacttgggattcgcacgatggcatgcacccacagatcgctttggcaattatcgccctgtgcctggcattggtacgatcgggccccgcaccccttcagggagttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatacagatcaagggccatcaacctcgaagtcctcttttgagctaccatgggtgcgtcgagccgtgcatgggcgccaaggtcttggtgatggaccatgcatctgggtgtgggagcctgccgacatagatccacgcataacacccgaaccgtccgcccaatccacacccaccatttggaaggtcgaaaagtatcgccccacccgcgtgcgggacatcgtcgggaatgtggaggcggtctcccgcctgcagatcatcgctgaggagggcaacatgcccaacatcatcctggccgtgagctggtttacttggacgggagagaggttttggtgtacgttttgcagtgtcatacgaggcctcagctctcgaaagtcttccagcagcaatgctgnnnnnnnnnngaagttttgcagtgccatgcgaggcctcggctctcgaaagtcttccagcagcaatgctggccgagaggtggacaggacgatggtcgtcgccgggcctctgtcgtgcgatctcgtcatcctttgctcatcggtctgcgttccaaacacctgccacgccaccccactccgctgcccccccttcctctcaacgccatcgacccctgaacccactcatgccagggtccacctggcaccggcaagaccacgagcatccagtgtnnnnnnnnnncccaatggtcgtcgcctttcctctgtcgtgcgatctcgtcatccttgcctcatcggccagcgttccaaacacctgccacgccaccccacccccccgccccccctccctctcaacgccatcgacccccgaacccactcatgccagggtccaccgggcaccggcaagaccacgagcatccagtgtgtggctcgggagctgctgggcccacactacaaggacgccgtgctggagctcaacgcctcggacgataggtgctgaatggaggaggaattcgggagcacctcacctctgagacggggagcaggcttgcgtggaagtgcttgcctgtctgcctttgagcgcctcggccaatgtcttgaagagggggtgaccccgacgtaatcagtgtgctgcagtttgcatccaccaatgcttccacttccgtcgactccattccagaacaactgcccccnnnnnnnnnnccttgaagagggggtgaccccgacgtaatcattttgctgcagtttgcatccaccaacgcttccgcttccgccgactccattccagaacaactgccccctcccctccccctcacccaaaactaataaaaacaccccgccccgccaccaccaggggcatcgacgtggtgcgcaccaagatcaagaactttgcgcagcagcgcgtgagcctgccccccggccgccacaagatcgtggtgctggacgaggccgactcgatgacgggcggcgcgcagcaggccctgcgccgcaccatggaggtgcacagcgccaccacgcgcttcgcgctggcttgcaacacctcctccaagatcatcgagcccatccagtctcggtgtgcggtggtgcgctacgcgcgcctggccgacgccgaggtcctggcccgcctgctccacgtggctgcggcagagggggtggcccacactcccgacggcctggaggcggtggtgttcgtcgccgacggcgacatgcgcggcgcgctcaacgcgctgcaggccaccgcgcgggggccgggcctggtggaccaggccggcgtcttcagggtgggagggaggagggagggggagggcgggggaggtgaaaggctgctggggcctggcagggctgcgtgcgacgaggccgtgttctgagagggggcgagggagcgccgcggggttgtgggtggagtcatgcgcgggcctgaccgccgctcgcctgcgcccccgttcacccatcaggcccacgcgccgtgcaggtgtgcgaccagccgcacccggtgctggtgaggnnnnnnnnnnctgcgtgggcctgaccgccacgtgtctgcgcccccgttcacccaacaggcccacacgccgtgcaggtttgcgaccagccgcacccggtgctggtgaggagcatgctgcagcactgcctggccgcgcgaatagacgaggcatacgtgggcatgaaggtgcttgggggtgtggaatcgggggggttggaggtgactggggcaggcctttctggtctcctcgaggcagggaggtgagtggctgtgccccggatcctgccatctctgcagggtgtcgctcgaggaacgctgacgccccgcccccatctgaacgcaaagcagcgcgacacagctccaccgcactcatccacaccccacctcaacccaacaaacctgccaggcgctgtgcgacagcgggtacagcgcccaggacatcatcaccatcctgttcagggtggtgcggggctacgcgggcatcaacgagttcctcaagctggagtacatcaagcagatcgggttctgccacatgcgcattgcggatggcgtggggtcacggctgcagctctcgggcctcctggccgagctctgcaaactcagccagaagagcaaagggtgatgaagccctcgtggtcccagttctgcgagggagtgagctgtaaggccaaatgtagcccatggtggcgcttgtggtgcaaatcacgggaggagaattcgctggagatcgcaaaaaaattgaagctgtggtagaggtcttgatgttcaccagcacaccgcgcctgctgannnnnnnnnnttgtaaggccaaatgcagcccatggtgtcgcttgtggtgcaaataacgggaggagaattcgttggagctcgcaaaaagtttgaagctgtggtacaggtcgtgatgttcaccagcacaccgcgcctgctgacgtcggcacgggtgggccactcccccacagcagcaccgcatcccgggagggacacgttacgtgccatgcacgactgcggcgatccagaatgtggcagaattgttttgctgtaatacttgcagcagtatttaaaacaccctagatgctgcatagtgccatggcctgcccttcccgggtgggcaccgcgaccgccacaggtgttggcaatactgttgccctgaagtccatgccccagcgcaaccttcaaactagagcagtgccacggagcaaaaaggaggatagaatcacgacgaggtgcatggaggggttttgaacgtttgcatgttgcggtgaggtccaagggtattgctgtttggggcatcatggtgggcatcgtgccctcatggaccatgccaacacaatccgcaccatcacatccatcagcatggttatctccccatcacattgttgttccacaggcagaacggtactaggaaggccactggtcctgagcaagagcaggggggctccaagctccgggatcagctgtactttaacttcatcgggtttcccttcccactgggcccagtcctccgacggaagaccatacgaagagaggtgtgctaggacgcttgtggcgtctaaaggaaggtgtagagcttgtgccggcgcaggcagtccctcccagatcccacaactcaaaccctgaacacgtccaggtgacaccaggggtcatgtggacttttgagcaggcccagacgtttgcggggttccgcacctccacaaacatcaggatgactgtgatcaagctgctgtctggcgtgctctgggttcatgcgcccattgcacccaccgccgagtgcatccggctgatgagggtgagaggcagggagatccaggcactgtgttgagcccccctgtctggctgccaggcccctcaccctggtgtttctccatcgcatgacaggagttgggcttcccagtgggatacatcgtgctgacgacatacgcctatgagcacaaggtttttgtgggccctttcagcaggaagttccctcgggccaaggtgtacgtcccgcccaggtgagtccagtggagcacagcgcgagctggtcctgttgactgacacctctccttcccgtcgttcagcagcctgtgttgatcatcgcacgcaggacctggagcttccccctgaacctccccctgcaagccttgggcatctttccctctggaatcctcaccaccgatgacccaggcgcgcacggcctgaaggggtttggactgcttgttgggcccttgcaaactgcccacctcaaaggcagaagcaggaatgtctccttgctccaacgtcaccacccctagctctgcccctcacccctcttgcccacccccccaagcctgcagatgtgccgtgggcaggcgagatacagcaaaaggtgctgcaggcgagcctgggggccgcgccgtacgtcgaggtgtcctttttccacaagccaacccggaccctgctggtcaccgacgcagtggtttccatccccgctcagccgccggcggtgggtaatgtgtcggaggatgtgaggagagggtggtggcgactgtgcagcccctgcacctgcggtggccccgggccccgcctgcctgcctgcctggtggcacgtgacgcctcacctctcgcccaactccagaaacttgtcttgcctcctccagcacacacacacacaccctgcccccccacctcccccccagacggtgagcagctccgagctgctgttccaggccagctccaacttctacgtgaggacgctggtgggcccccagcgagcggcggagccgctgcccgacgtgccgctgcggccgcgggagctgacccccgcggcggcgcagctgggctggcgccgcgccgtcctgctggtgctctacttccggccgggggacctgcgcgacccgcgggctagcttcggcgccctggcggagcgcctgatcgtggggccggtgctgcgggtgctggtcttccccgccatctccgccgccgcgcgggactgggtgggcgccatgtgcggcgagtgggacttccggcgcgtcatccccgcgcactttgacgcgccggtgcgcgcaggccccgccgacctgcgcgccgctttccagttcctgtgggatgggccagagggcgccgtggaagctgcggagcggccggcgctggggtgggccggcctgctgcgccgcctgcggtccggaggggtcaacggcccggcgccggtggagtacgatgcgcgcgatatgcaggccctccgctccctccacgccttcctggtcaggctgcgggtgctgcgcccgcccgacggcggcctgggtgtgtgaagccatgggcctctggaggcccatggctcctggccccgggcctgcagacctgcagcggtgcgcagaccctgctccctccactgtactgaagatgtgcacgttgcagcagaagaaggagcaggggagcggggaagggtaaacggtgaacaagctatgcacagacgctgcatggggtcagccttttcgacgggatgcgcccgcactcctgaccggggctgtccgccccgcctcctctgcggcaagatggagtttggggggggatcactgtggggtcccccaggcccaccatcgagcaactccattcatggacagtacacgcgatcatcnnnnnnnnnnggatcactgtggggttccccaggcccaccatcgagcagctccattcatggacagtacacgcgatcatccgtgaaactacaactaccttggggcgcctggccggtggccatgagggcgaagaacagggcgttcagcttgtccaccttcttcagatcagcctgctgatccgtcttatattgcagacactggagtgggtggcagggtgagatcgattagagagggatgctgataccggcaagacgcggtggcctgcccacctgcaacaccacccaccaagccccgcaagaccgcgctcaccgtcgtgttgtcggtgaccttgacggagagctttccatcgcaatgcctatacttgatgctgtatcgagtgagcaggggattggctgtgtacagcgcttccgcttgctgatagaaactctcccagttctctatgtacatggcggacgaagccccgtccaactcctcctcgcccactgaggtctaggaaccgagtctggagaaaaactaccgcgctctttgcattgcgctgtgggatggcagcgcagccatgccgatggcttaaatgttctcgcttgggtgccatccccagctcccgccaggctgttttgcaacacggcacaggagcggggggcagttgcgcgagatcgatccacattctcgcctgctcctccatgccgaaggggtcaagggcataccacacaatgtgcacgccaggttttgtgaatttttgatcggtatacgcaggccctagcctacttcaggcagaacagtgtacggcaggcgttttgatagagtatgcctcggtgagaccctccttggcccttcacttccctcagaatacagaacaaacatctttggttctgaatcaacaagtagtcgtggtcggaccagggtgtcatagccgcaactcatatacaactgggtgaagttggaccgaggccaaagggggcaccgctcccctgtgagcgagcgccatgcgatggctggaagaggcaccagatgccgagagtctggtaacagaacacgttggtctgatgggagtattcttcaacgggtgagcgagggggcgtggagagggttcgcgcttcagtacctgttgactgtggctggctggctgggtggtaggctgcggcaggccatccttgacccgtctgtgccctgttggtctggtgtgtaccctgtcagctcccaatccagataagccaatgggttttccccgtcactgccccctctactggcagagcatttgtggcggcgttcctcggcttcttctttgcccaggccgccaagatgttcacgcactactactctgagcggaagtgggagctggaacggctctggggctcaggcggcatgccctcctcgcacacctcctgtgtacgtgtggagtgttcctggacatggtgcatgcctgtgcggtgcctgcgctttgcccagggcttctgggtaccgcaatgcatgggcctcgaatggctgcctcctggcgttgccgccgccctctgctgggggcaatcacagaaccccatgactcatcccctttcatcgttcggaccccaggtcatgggccttacgtcggccgtgggcgtcctacaaggcacatccagctcgtactttgcgatgtgcgtcgtcttctccctcgtggtgagctgttgctcaggggaagggagtcatgggctggcatcgctgtgtcactgggcgggccagccatggtctggggcccttgcagggcctggcctcgcatgctgtggtggaatgcaagcagccttcctccaccatcgcacaccctgctcaattcactctccccaccccgagtccctcctcttcctcttccctccaggtcatgtacgatgcgacgggggtgcgactgcacgccggcaagcaggccagcgtgctcaacatgatcatcatggagctgccgcctgaccaccccgtggccagcaacgtggagcagctgaaggaccagctgggccacacgccgctgcaggttgcggtgggcgcggtggtcggcgtggtcaccggctacatcacgggcatcctctatcgatgacgcagcgtgggcaggtggtctggaagttgggtgggggggagagacccccccagcggtgcaaacgaatgagacgcggtggaggccggcctctcagatgcatgccgtcctgcgcattgcgaaccgcgtcattgatgcattctctcgtttggtcatggccgaggcaatggctactgtacattgttgtgcacctgcctgaggccccaatatcaaggaggggaccccgggcacgaaattgccgcatggtggccctggactttattttcgcacagcaccattcccagtcgacaatggcgacctctcaatcttagagatagacagcaaattcaagcatggccagcacctctggagaccgctttcgccttcgatctcttcaggccggcgacttccggaagggtggggtccagagagtggcgcactggccaatggtatgatctgcccttcctggaggcgcatgcacggaatgtgcagaatgtatcaacaattacgtgtatgcctgtctgcaggtcatgtcgaggtgctggcgcagctgagccaggttgggaatgtcgacgaggcagcctggcaaggtggggtaacgtgcccgagtcgagcaggcaagggttgtgcatgacttccttggagatgtttcgccctcaattattctcacatacatcccattgcggtagcagagcgcttccaggtcctatccagtcaacaagatgtgtacaagatcatgnnnnnnnnnnctccttggagatgcatcgccctcgagtattctcacatacatcccattgcggtggcagagcgcttccaggtcctgtccagtcaacaagatgtgtacaagatcatggtcattgagggtgagctgagatccagggccctgcatcttgcccgcatcagatcctgtacaaacataaccaacaggacggtgaccaagggtgttgactttgtgtcacatcctctgcccgcatgtgcagacacaaccaccgaaagaatagtggccaccgcaacactcctcatcgagctaaagttcctgcggagcagcggcaagtgcggtcacatcgaggacgtagtggttgacaacagctgccgtggatatgggctgggcctgaggtaggcagagattgcgcctcgtgatggtgtacgccagggtgcagaggtggctgtctggagttggaccaggtttgcatttgagagtgcacaagggtaaccgaggatgctgttggttggaacaattggcaacactgtcaactcagtggactggccttgcacctgctgcaggttgatacagcggctgggagatctggcagaggaggcaggctgctacaaggtcatcctggactgtgcagaaagcaatgctgcgttctatgccaaggctggccttgctcgcaaggaggtgcagatggtgagtgggagggctgggaatgcgctagtgttatgacgcttatgcagtggttgaacttgaaagagctccgaaacgcagagctaataacgttctcatgcccgacgcaggccaagtacttttgatcaaggccacagtgtctcggcagttactatgtgtgacaatattggacagcacaggcttcattgtaacactggggaagcatcgacctgcacaggcaatactatcttgttacaagcatcaccagctgatgttttggtgaactgcaagcttagaggatagcagcacgggtctcgactgtttctccactgagggccgggctgcctcctgactgagcttgagtacccatcctgctccccgagcctccagatgtgnnnnnnnnnnaggtctcgactgttcctccactgagggccgggctgcctcctgcctgagcttgagagcccatcctgctccccgagcctccagatgtgaccgctgattccagtccttgatgcatcccactcagcagcgcaggagtgccctcccatcaccctcccagcttcacggcgtcggcaagcagggcggcggtgagcccggccttaaagaagttggccatccacaggcgcaggggcctggtgggggagcgatagaaggcggcgctgaccgcctcgtagaagagcagcgtgaccaccgccgccaggacatcgttgatggaaagcgcgccaaacgtcagcgtcacgatgttgcccgcgtaatacctgcggcagcggtgggctctgggaggtggtgtgtggcgcaattttgcaagagaaaacgcagcgtcgtgaggtaattcccagcattgcaaactcctgttggctagaaaagagatcccggcacaaacaagcgggacagnnnnnnnnnngtggtgtgtggcgcaattttgcaaaagaaagcgcagcgtcgagaggtaattcccagcattgcaagctcctgttggctagacaagagatcccggcacaaacaagcgggacaggaaagctgcccagtgctcccctctcctgggtgcccaggaagacaacagcgctcccgatctgccccgacacaccccaggccggcactggaaccggtccataggatccgcagaggccagctggacttcagatacagctcagcccgacggggaagggtcaaaatgtatggcaccagccttctgggggggcgctgctggcatataatcctgctgcatgcggatcgagagggtctgtgcctgtccatttgcaagggaggagggataaaatgaggggaatgggcacggttgccatggcaggtattctttaaacgaacacatgcagcctgaagcatacctcagagttctgcttgcaatagccccaactgagggactaagtctgacgcgcacatcgctatgagtaggcgccagtgctgacattaaagatgcaccatgtggtgacggtgttgttggcctctgggcgtcacctgagtgtgcgtccaaacgatctcacatcagggaagtcgaatgtgctggaggaccaagggcagtttgtcctctcagtatcctcatcgtggaggcgatgctgatccacagctcccgccagtcagaggcccgagttgccgtgcatgtttcgagtgccgagatgctgactcgacactccattccgtttttgcaaggagcgaacaaaacccgacttgatacccgttgccactgctcgtgcatgccgtcggggtaagtcgtcgattatttacgattcaacctaatttctactagagtgtaaagcggtcgactgatccagnnnnnnnnnntatcgattatttacaattcaagctaatttcgactagagtgtaaagcggtcgactgatccaggatcccagcagcatggaccgcgtttctcgtctctctgcccactttgtccacgacacgcaggttgggacgagcagaggggtggtatgaattctacctggaaccatggcttcatccgcgctattactcagtcaccatgttgccagctcccgtcctctcctccctcccgtcgccagggtttggccgggagcgtgcaccctgaggccaccagcgccagcggttgcggcaagttcaatgtggccctgctcggcgccgctggcggcatcggccagccccttgccctcctcctcaagcagtgcgtggggccgatgatgagtggcagcgaagatttgtgcttgacctgccgtgtctcagcatgtcgacttggacgtctttgacttcatccccaaatcagtctcccttcgttccacccccctcaaccctccaggtccgcctacatcaaggagctgaggctgtacgacgttgccaacacagccggcgtggccgcggacctgtcccacatcgccaccggcgcccgtgtgaccgcgcactccggcgccgaggcgctgggcacggcgctgttcggcgcggacctggtggtggtccccgccggcgtgccgcgcaagcccggcatgacgcgcgacgacctgttcaacatcaacgccggcatcgtgaggacgctggtggcgggcgtggcgcggtactgccccgccgcctggctggccatcatctccaaccccgtgaactccaccgtgcccatcgcggccgaggtgctgaaggccgccggggtctacgaccccgcccgcctcttcggcgtgaccacgctggacgtcgtccgcgcccaggcctttgtcgccgaggccacgggcgccgcgccggaggccgtcaccgtgcccgtgattggggggcatgccggggtcaccatcctgcccctcctctccgccgccgtgccccagcccaggctgtcggaggccgaagcaaaggcgctgacggcacgcatccaggacgccggcacagaggtcgtcaaggccaaggcatgtctggtgtctgggcacagggttcgctggggtcgctggggtcgggataccgaagggtggtctcatcacagcggcctggtggcaaagattccaatgccatccccctcctcctcctcccgttacaaaatcgcaggctggcgcgggcagcgccacgctctccatggcgtatgctgccgccgagtttgccacgtcgtgcctgcgagccaaggccggggagcggggggtcgtggagtgcgcgtacgtggcctctaacttgacatcctcgcccttcttcgcgtcgccggtggagctggggcccggcggcatcgcccgcatcccccccttgccgcgcctcagccccctggagcaggccggattcgcggccatgcaggaggagctcgcatccagcatcaacaagggcctggagtttgcgcgtaaataatgcccctgtttggctgggctggggctcggtcattataatcttctgtcaaagtgcggatgctgggcgaaacctggctccgtcgcctggctctagctaccattagcgtgacgtgtgtcgcaattagatactgtagacttgagatcagctgagcctgtggcttgcagcaccacnnnnnnnnnnttcactaaagtcttctgtcgaagggcggatgctgggcgacgcctggctccgtcgccttgctttagctaccattagcgtgacgtgtgtcgcaaattcgatactgtagacttgaaatcagctgagcctgtggcttgcagcaccacagcagcaaaaggcgggtcggtcggatcagaacctcccctgctcctgctgcgcgcgctgtgtaccgacagcaacagctttcgttcgaggtcttcaaattcggatgtgcggctgactttggtcatcttcccaaatcgcggtcactcacgcacacccccgacccaacagcctccacaatggcaccatccgcgatcgaggtcaatgccgttctccggccactcctcctcaaggacctccgtaaccagtgccgggctcggggcctcacccctgccggcagccgcgagtccttgatggaccgcctacaggagcacatgttgtccacaggcgacatgtgagtcttgttccagatggtgacccccggatcacctcgctctaagcccacgcccaggattgaggcgacggannnnnnnnnntcagatggtgacgcctggatcacctcgctgtaagcccacgcccaggattgaggcgacggacccgacgagactggggtaccagcagcatgtgtgcgcacgccaggccggctgaaccatccattcctccctctcaatcattaggactatcgtgtcggatttcacgggcgacctcctgccgtctgcggtcggaaatctcgcgccgacccacgcggatggcgctgaagccgaggtgactagatgggagaggccttgattgagggggttgctctgcattctcgtccattcccagccccatgggactctgggctcgaatgtccacactgccacactttcatccatcaccagttgggttacgccgcatgcaccgtccccacccagcctgccgcgtgttgtgcccatgccgaccaaacctaaccccccagggtgaatacaaggagaacgccccgggccactcgcaggccggtttcgggtccgaggatgtctccggccacgtcaagaacaactacgttcggcccgagggccagaacgtgggcaacttcttgaccggtcggtcatcctctagggtgctggccccgcccggcgggcacaccaacatcacctttggctagtggacatcgccagaagccgtcgctctggttgcgactggaagctgctgcttcacagccgtgctcccacactaccgtcctttttcccggagttgcctggtggtggtgcaggggccgcgacagggtcccttgcagttgggggggattgcccccccccattacatcccccaccgggcgcaatgataccacgcccgcgtcgccctttcccctgctgcattccaatgtcaacagcacaatgagactggagagcggggagacatgcttcccctcagtacgggaagcagtagcgggtatcacatgccaagcagaggtcaagaacgcgggcagccgcccctgcaaaatcaaatgtggcgccggtgatgggcttggagtgtcaggtgcaggcatcacaagggggtcccgccagggcgccgcaacacgcgtttctgggctactcctgtgggacccccgtggcgtgcacatcaccgtccaggtgcactccaggtgccacgtcatcgcagcccggcgcgggcgccnnnnnnnnnntccccccgtggcgtgcacatcaccgtccaggtacactccaagcgccacgtcatcgcagcccggcgcgggcgccgggcgaggggccacgcccgccgaccccggcgccgagcgaggcgctgcgtccgacgccgccgc

SEQ ID NO: 38343 - DNA, 73 bp, Chlorella protothecoides
tgtttacttgaacagggaaaactgtatgcagcaagtggggaaaaaaagtggggacctgggggaatcgaacccc

SEQ ID NO: 38344 - DNA, 91 bp, Chlorella protothecoides
ggagccgcacggatggggctgtcgattgtgtgtgtgacgggcccacctgcggctgggagcgggaggggtatgacagatgccggtggggggc

SEQ ID NO: 38345 - DNA, 20218 bp, Chlorella protothecoides
  modified_base (2903)..(2912): a, c, t, g, unknown or other
  modified_base (3059)..(3068): a, c, t, g, unknown or other
  modified_base (3155)..(3164): a, c, t, g, unknown or other
  modified_base (4984)..(4993): a, c, t, g, unknown or other
  modified_base (5201)..(5210): a, c, t, g, unknown or other
  modified_base (6816)..(6825): a, c, t, g, unknown or other
  modified_base (7937)..(7946): a, c, t, g, unknown or other
  modified_base (8507)..(8516): a, c, t, g, unknown or other
  modified_base (8659)..(8668): a, c, t, g, unknown or other
  modified_base (8911)..(8967): a, c, t, g, unknown or other
  modified_base (10407)..(10416): a, c, t, g, unknown or other
  modified_base (12136)..(12145): a, c, t, g, unknown or other
  modified_base (12245)..(12254): a, c, t, g, unknown or other
  modified_base (12363)..(12372): a, c, t, g, unknown or other
  modified_base (12445)..(12454): a, c, t, g, unknown or other
  modified_base (12648)..(12694): a, c, t, g, unknown or other
  modified_base (13589)..(13598): a, c, t, g, unknown or other
  modified_base (13942)..(13985): a, c, t, g, unknown or other
  modified_base (14338)..(14347): a, c, t, g, unknown or other
  modified_base (14738)..(14747): a, c, t, g, unknown or other
  modified_base (16968)..(16977): a, c, t, g, unknown or other
  modified_base (17481)..(17490): a, c, t, g, unknown or other
  modified_base (18960)..(18969): a, c, t, g, unknown or other
  modified_base (19047)..(19056): a, c, t, g, unknown or other
gcaccgctacttggccagcagcgacgcggaggccggcgctgtgcggcatcgcacgacgggcgaggcgcggcgccaggcagcacacgctgcgcacgcttcggctccgggggccagcacgacgggcgggggcgcgccgggcgccacgggcggcagcgtgcaggcctttggcgggcacgagctgcccttcgccgtcccaccgcgccactgcttcacctgcgcggtcgggcgcggggtggtcagccgcgcggccttcacgctgtccagctctgcggaggtggcggcgctgctgcgccagctggcgctgaccaacggtgcgaccatggagcagctcatgcccgtgacctcgctgtcgcccaccagcagcggcggggacgggctcgccgacagcggctggctggaggccagtgcgcggtcctggagcctgaacccccgcgatgaggaggcgatgctgggcaggcagtgaccctgttgtagaacggttcggagggaggggcgaggaaagggaaggtggaggataggggggcgcccttgggttgtgtcaaatgttcacagaagcgggggcaccggcagcccgcgtagatccccccgtcgttgtggtgcgatacccgttcccgccagattcgcgagaatgatcagctcacagggggcaggggttcctgcacacgcgcactccccgtcaatcgcccgtcgggaggcagcgcgggcagcagtgcgaccctttaccgagcttgtgcgccgaccagaggtgccggcacaccggggctgcacacgccgtgaaggaggcagggtctgtgacctcgatggcgcagaccacctgagcccaggagacgtgggtctccccccggccttgcaccagagcccagcctctttccacttacaggccacgccacaatcaggatgggacaggtgagaatgggagcgcagtggcacagggcctattccgcgcggcgaagcctcctggacacgcaaccgctcaccataccgtgcgcacccccttctcccagtacctctcctctcccgtcacggagaaggacacgttggagggcagcacggatgacctcagctacggcatatccgcgcaccaggggtggcggaagaacatggaggacgcacacatcgcgcaccacatcagcaaggacacctacctgtttggaatcttcgacggtcatggtgagaagacagggagggtgctgagagccccagtagggggcctagggcgtgcgttgtcgtaccctgagaggatggttgcattgcactggtgcaactgcccctggtcagtgctgtgtgagatccaccttggacaggcccacctgacgagcgccccactcacccccttcccaatcccctaggtgggcccgaggttgcgaagttctgctccatgtacatccgggaggagctggagcgatctggggagttcaaggcgggggagtacgagggcagcctcgtgcacgtcttccaccgcatggacgacctgatgcgctccgccgagggcttctcccagctggagtccatccgcaagagcctggacaaaggtgaggggcggcgtagcggcgcttgctccctgatctaggccctggcgtgcaccgatggggggcattcgtgcttgggcgatcgcctgggggcgccatgctcccacagtgtgccccacccgcgaaagcgcaaccagctggtcccgtgctcaccagtcctcccttcatgagctggtgtccgctttatttacacccttcatcaaaacccacccccgctcagcctccgcgacagaggacgaggagggcgacgacacgtacagcatgcttcgcaagctggtgtccctgcagcgcatgcagaacagcgcggcggccgcggcggccgcggcggccggcaccgccaacggccgcgctgccccgctcgagtccggctccggcaccaatgttgccgaccccggcgcccccgccccccgtcccctgcccggcgtggaggccacggtgcaggcggggtgcacggcggtggtggcactgctcaagggccggcggctgttcgtggccaacgcgggcgactcgcgcgcggtgttggcgcggcgcggcgtggccgtccccctctcccacgaccacaagccttcggcggcgggcgagcgcgcgcgcatcatggccgccggcggcttcgtgtccgaggtgggcggcatcacgcgcgtgaacggcaacctgaacctctcccgcgccatcggcgacctgcgctacaaggccaaccccgcgctggaggccaaggaccagatcatcaccgcccagcccgacctctgcgtggaggccctggtgccgggggaccgcttcatggtgctggcctgcgacggcatctgggacgtcatgagcaaccagcaggtggtggactttgtcggcgcgcgcctggacgaggggctgaccccgacgcaggctgccagcgagctgctcaacgcctgtgtggcctccgacccgcgcgagacgcgcggcatcggctgcgacaacatgactgcctcggtggtcgtgttcaagggcctcgatgaggagggcgcggagtgagcgtgggggccatcggagcgttggggtggccggggggaggggtcggggccacactctgcgtagacctccgggccggcccctgggccccatccctccaaacaccctcttgcctggagtgcatcgcgcctcccaggcgtggcggcgagggctggcccctctccctcgccattgtattcttgcccaggccccttgggggggggtaacatgcacccatgtgcctgtccctgcacccgtgcacttccttgcacacttcgctcgtctgtaccgatttcatatccaggtgatgcggccagtcccttggtgagagtcacggggcccgagagatctacccctggcatggcatgcgcagcagcggcggaagtgatctctgannnnnnnnnnctcgtctcaaaaagaacccaaggggccgcacctctctgctgtcgcggacccatgacgatgccagcgtccttggccttgagtttccggccagggagcctggcccaagcaccgggattccgcagatctctcagcacgcacccacaatgnnnnnnnnnntgtgggacggggggcgccactccacgacacacgggcaaatgcgctatgaaaccatcctaacgctccctgattctcgacgatatcacnnnnnnnnnncgtgggacggggggcgccactcgacgacacacgggcaaatgcgctatgaacccattctaacgctccctgattctcgacgatatcaccaaccttttggaagcacactgacatcggatcccggggcgcgcacatcgccgccaaaagaacccaaggggctgcacctctgtgctgtctcggacccatgacgatgccagcgtccttggcctcgagtgtccggccagggagcctggcccatgcaccggggtgccgcagatctctcagcacgcacccacaatggcgagcccctgccccgccctgcccctggaggcaggggcatcctgcacgggcgcccggccccaggcgcaccacatgccgatccgaggatgccgatgccgacatgtgcatgcctgcgtgagtgtgctggccttgcaacggtagtacagcctggtccatgtacgcaggccgacctgttgtcctcctggcctgcatcttgcgatgcacctgccgtgcccacctctccccgcagctttgtgacggtggacaatgagcgcgaggagagttccacggtgctggaggtggagatcaaggactaccccggcctcctgcgcatcattgcctgggtgttgaatgggctggacctggtcgcggagaacgccgtggtgagcacagacgccgagggcatagcgcacaacaccttttggctcaccagcctcagcggtgagcgggcgcagggtggttgtggggattcgcatatgggacggcgaggcagtgagccaggatcatgtgcgcgaggccgcataggagcagccgctggggggcagttgagtggtggtgtggcacgcaagatagcaggggaccatggccacaacccgatctcccctgcattctgtcccctcatgcaggcaataaactgaaggacaagactgcggagatgctggctgatcaggtcagggattacctaatgtactgcactcaccagagcgatgtgaaagcggcgacagaattcacatctgggcccatcaccatctccaactcggaggacaaggagcactccgtggtgagtggaacggaaagtcggtctttggtgcacaacttttggatgaggaccagggctttccttggaaagcggcagcgaggggcagggaagcatggtgtgggggtgtctctgcatcgcgccggattgatgcagagcggcaagagaggcattcagagccgtcgagattgccgctccgagagcgcagcaccgccctccatcccagcatgaatcctgtgtgctgtgcttgctgccccaacatgggtatccttgagcttagcatcaccgcccgtatcctcccggagcccatgccagatccatgtcagggaagacaacccgtcccctggcttcctccttgaggtggcgtcggcactgaccggtctcaacacccaaatacagcagggcgtcatccaggtggggggccggggtggcgctgtgcgttaggttcggagtgggcatgcaaggtttttatgatcgacgccaccaacatcctgggattggcctgtcctgccaacccctcaaccctttccacatctggcgcagggcacaggaaactgcgagaacaaggatacgagccttggctgtgatgcccgcctcttcaagttctgggtgaagagcaggtgtgctgtgtctcaggttgcaggcacttgattactctcgggagagatgtgcaccacactggaggggtctggcagcattcgcagtcagcatggccaagggcaagcgcgagtagtagggagcatagtaggcctcgggcccggtctgggccgcggcgtccgggcgtccacagctcctggtccggctgcgnnnnnnnnnncgtagggagaatagtaggcctcgggcccagtctgggccgcggcgtacgggcgtccacagctcctggtccggctgcgtccgaaacgcattgcccttgtgtgtcggccgatgcgctgctttgcatgcagggggtgccaggctgttgttgtccctcgaccaaccctcctctcacccaccgcccgcccgccacagcaccggcgagaagctcnnnnnnnnnnacgagcaggccagcgccctgctcttcacgctcaacgtcgtgctgggcaactacctgaaccccctgacgccgccagacgcagcgctggaggccaccaacaacaccagcaccgcctgaggggtggcgccgcagtgtcaaaggaggggtcctggcgcttcggcgcagttttcctaccatgctcatgtgccgcccatgcttttcatggtgcagcagctgagctcgtctgtaagccctccacagttgagcatcacgccgcgcgcatccgtccaactgccagcggccctcgtgggtcggcgcttccggccgctcatccgccggccgcggcttgagttttgccctccaccgacaggccggggtttgctgggtcccctcgtcccactttcttcttgcgggggcctgggcggtgcggtgccgacctctcctcgccgacaggggagaggccggcccccgtcgctcccgagccctctgtcagtcggccgactcgcttgggctggaaggcctggaagccctcccgcacacgcacaggtttccccccccgggtcgacggggcaggctccgctccaggctttccagctggcgcggctgcgggggcagccgccgcaccaaggtcgggcgcgggctgaggtccctcgccggtcgcgcctgtccccgcccgtttgaggatggctgtgggattcctcctgctagggtctggcgtcctggcggctccaccgctggcgtctcgggacccctgcggctgtgctccagtagcctcgccatttcctgagggcaaggaccctgctcgttgccgcgagggcgccagcggctgcccctgtagctgcgtgaggccgggccctgccttctctgccttaccgccgccgcctggggcaaccctcttgatcatctggatggtcacaggggccttcttctgcttgggcagggaggccgggctagcctcggctgcctgcgcccctcctggagccccagccttcttgccagcgttcttggcgccgggcccagcctccttggggacagcgccgggcttgccatgatccccaggcttggccttggcggactttgctgcgtcctgggccgctgcggcgcccttggcggcctttttcccccgtgcaggcttgctgacctctggcgtggcggtgccctgcttcccagccccacccggctgctgcttgagctgaacctgcggcgccgtcttcgctgcgggcggtcccttgccacccttcttggcggcggccaccgccgccgccttcagcttgtccttggctcgcttctccttcaggaaaagaaccaggggggtcaaggcatcggtctccatgggcggctggggtgctggaagggcagagggtttggtctgggtctcctcatccagcgacttgagaaaggcacgatacccggcatctgtgggaaggaggagggctggggatttcatttgtgccattcacccgtgttcaagggagaatttgcagaaggatgtaagtaaaatgtacagcaacagtacggatggaggaaaccatgcacccactcaaacaatctatgagctgggccttctgtgcagcgcaccgacaccacacctttctcgattgtgccttcgcgtgggtctcggcgattgnnnnnnnnnnatttcatcggtgccactcaccagtgttcaagggagaatttgcagaaggatgcaagtaaaatgtacagccacagtatggatggaggaaacccatacacctactcaaacaatctaagagctgggccttctgtgcagcgcaccaacaccatacctttctcaattgtgccttcgcgtgggtctcggcgattggttgcacggggtacacgctggaagggagcatactcgacccgagccctggatagggaagggtgcgtatgggtgagcctggaaactcatttgctgtgtcatcttggtgcacaggacagcccgcccctgccccctctcggcccatctgccgcctcacctcgtgtgggctcctcggtccgaaacgaagagattgccattgaatgcagcactgaatcggagggcatccgcggggtccttgaaattcaggtacgccctcgaatgcacatgctccttggcgctgcaggttgaggggcagggtgcgcagttggctggtgcgtcccagcgagacagtagagtcatcgctgcagcagtcccgccgcacctgactttgccctggtagtaggcggaccagttggatctgtcgagccactcctgcacggccgacttgaaggcgtcttcggacagggatggagggaggtgacgcaccaccacctttgtcctctcctccgcctgcgtcatgtcactacagtggcatgcatactatggggtaatctcccagatcccagcgctttgaccagtctgagtcgagaatcgaggtaaaaagtcacaaactcatgttacgtaatggcgaatgccatttctcctcttaaaaaagacactcccagcttgttgcagattcagacggctttcgattcattgagatcgagtgtggatgtcgtgtactcacagctcagtgagagcagctccagcaactgaatcttgcaatactttcagcttctctctggagccacagcgaacggtactctgaattttatctgagaccccacccttctgctcccccgatgatttttcctgcggctcaactgtttaatccctgtctcgagaaataaacctccgaaagtctcatcaccgacgcttgctcatcgtcactctcatcggaccgcctcnnnnnnnnnngcctgtttagttcctgtctcgagaaataaacatccgaaagtctcatcaccgacgcgtgctcatcgtcactctcatcggaccgcctcgtcaagtcgagagcccccattcggcacaggtgccggggtggctgtccgatccacagggagcggccgggtacccaatccccaaatcgaatctggcacacgtgagttccaccgcagcaccgattcgataccccgttgcatacgcctgacgacgacccgcagcctcggtcccatgcaggcgtcgtgaagaaccggggcccctcctatgctgcacagcctccgacggggttgcaagctcgtggacatggtcgtgaccgccggattgctgggccctgccggcagagtcagcctccctggcccaagtaacaatgccgtcttcggctcccgactgttccgcaagcccgtcggcccgggcccctctggtagggagagtggaggggtgcagggcatccacaaggggcaacgtagcgcatgtgctgaacaagtttgttcaatgcgcgcctcacaaacttcgcacccaccataacctgcgcattcnnnnnnnnnncagtgggagatcgggagctgcagggctctgggccgcctacaccaccctcctcgccaagaagccggtgggttgaaacagaatggacatgtttatgagcggtctagggaacggctgctgtctggaagtctggcgcgcctgctttnnnnnnnnnnggggagagtggaggagtgcagggcatccacatggggcaacgcagcgcatgtgctgaacaagtttgttccatgcgcgcctcacaacttcgcacccaccataacctgcgcattctttctgcagcaaggttgggacaaaagcccctggcgccacgcaacccaaacaccacctgcttcgattctggcggcgggtctggtgggggcgccggcgccctgcgaggctacagtggcggcagcggcgggggnnnnnnnnnnnnnnnnnnnnnnnnnnnnnnnnnnnnnnnnnnnnnnnnnnnnnnnnngacagaatggacatgtttatgagcgatctcggcaccgggtgctgtctggaagtctggcgcgcctgctttctgcacgctccatccaacccatcgcgtcaacactgctctgccgctcttccactcattccctgctggacctccacacgtccacccccccccccttcccacctgctccctcccttcctcccctgtcccacagctgctgaccaagtcggtcaccgccggcgtgctgaatggcttgggcgacgttctggcgcaggtgacggtggacaaacaccgcgactttgacttcaagcgcctcgccatctttgctttcctcggcgtggcgatgatcggacccatgctccacgcctggtatggcgtgctgggcagggtggtcaccagcaccggccccaagggtgtgtgcgggggtggctgtgtggttggctgggggggcagggatcttgttgagttgtgtaaattctagtgcttgcgccgcgctttccatggcatgctgctcgtgggcctgggaaggctctgcagctgctgacctggcacgtccatgtgtagcctgtccctttccccattggcccactcctcagaagccccttactgaccttcccctcccttccctcccctcctcccagccggcctcatgcgcatggtgctggaccagtttgtcgccgcccccttcttcattggctcggtggtggcggcggtaatggtgctggagggacacggtgagcaggtcgggcccaagttgcgacgagacctcttctccatcgtacgcagcaactgggctctctgggtgcccttccagttcctcaactttggctacatccctgcgcagttccaggtgcgggacggaagggcggattttgggtgggcacaggggacatgtgatgagggtgggactgtgatcgcactggcggcactggtagttgcctgcacaggactagagcataagaagtcgattatgccacaagtttgctgacacgcaggtgctggcggccaactgcgttgctctggtgtggaacgtgtacctatcgtacgcgagtcacaactgaccccacgtttcacatggtgtggaaggaaccttggcaagcccagcatagatccatgctgcgttttgacagatctgggagcccaaatttctaggtgctcggcatgccaatgtggaaccttggcgtcacacatgcatttcccaacatcacacggaaattgcctcatgtcacccatcacatgtaaaacaaatcagtagatggcataccagcttgaggtcgaatcaggtgggttgcagtaaatgcgaatgtaatcattccatgtgggaattcacaagctcatgtgtttcaaaaagagcgaaagagcatgagtagatggcaaggtaagagggtgacgatgttgataactattgacaaaaaactgccctgctctcgggctcgcgtaccaaagacactggannnnnnnnnnagtttcaataagagcgaaagagcgtgaatgaatggcaagataagagggtgacgttgttgataactattgaaaaaaaactgccctcctctcgggctcgcgtaccaaagacactggacatgcagatctaacgcctcaatgggaactggagactcctttcgctgtagacctggcaaaagacaactctgatgccccatggcagacgttgaagtcgttgtaatagcacttattccaccttgaaagcatcgccggtacccgaaagcctcttgtaggaaaagctcataagtctcgtgaggaacattcttcccaattttgcaagtggagtgttgaccagaatgcattggtcacagtctggctgtcctcgccaccctcaaatccgaaagatatcgctctgcttaccgcagccaattacggaagtggactttccatgcactggtcactcagacacgagcgcgtgcagatacaagagcatattcattgtatataacctttttctcgggcgtaccttgtcgaaatttgacagggtcgccatcatgtttgcaaaggggatgagctccatgcagctatcgagatcggtgaggtccatgaccaggagctttatgcgcgtcagagtcctgagctcctcgaatacactgacgttgtacatgcaccatgtgcagatggctgtaatttcagctgagcggggtgcccttccgattgctcgtccggcgcacactgtctccaggtaagtcctgctcgcgagatgcatgcatgaaagaagagaccggcactcaacctccgaattgacaatgctccgatagccgggccacagaacacaaggcatccagctcctttaataaacactgttaactgtttgagtttcctttgtcagtgcagatgcaagcccgccctgagctaccgcaccccaagcgcccagtcgcggtggagcatcatgcgtgctgcctctgccaaggagccgcagactgaggtcgcggaagaggaagatctgtggcagtatgcagagcgggatcagtggtacgcggcacgctttgcggcggacgatcagccggactgggtcgcgggctccttcctgcgctacaagcagctgactcccaccatcaggtgacgcggtggggctggttgagggatgagaccagaagggagtctgcctggactgtggctttggcggagctcccatctccccggccatccatggtgcatgatgaacaaagattaccaattcactcactacccctcctcccagggaggtggtggtcggggtggagatcagccgggagcgcattcccctccgtaacgcatacaagcatgtcggccagcgggcctgtgtcaggatcaacagcggcaccgagcaggaggttccaggtgcgctgcccggcttgtgcagggactggcgcccctctccttatgtgccgcgctgcagattcaccaggaagtccagtgcattcagatcagagccctcccttcacaatccctgcctgcagtgtccagtccgccctttcctcaatccctgctgagggaggtgctgctcacagtgcgaggagatctttacgcggaggagacaaaggtgatttggttgcggccgccatatgaccagggggttgagtgtcttgggaagatgagagccatgggagagcccgccagggctggaggcgatcgaagtgtgtgagcccaggagcctttaatttacctcgtgtctttcctgtaggtctgagtcgattttgannnnnnnnnntgcggaggagacaaaggtgatttggttgcaacctccatatgaccagggggtcgatcgtcttgggaagaagagagccatgggagagcccgccagggctggnnnnnnnnnngcagagtgcaatgcagaaatccatacatgcatgtacctcgagattctccccttgccatattgcagactgccagggagttgacatctgtcacagcagagctgtcactgtnnnnnnnnnnggctgcacgagaggcccaccgcatgccggctgcgcaggtgcttcttcatcggaaggggcatcccactcccttnnnnnnnnnnccagaatgcaatgcagaaatccatacatgcctgtacctcgagattctccccttgccaaattgcagactgccagggagctgacatctgtcacagcagagctgtcactgtttgtcagcagtgaagagtaccctgacatctacaagctgtcagcagaggacaccctcgagataggtcctttcaaggtgaggcagagnnnnnnnnnnnnnnnnnnnnnnnnnnnnnnnnnnnnnnnnnnnnnnnatcatctgcgccaccttatcctttctttcaccccttctcgccacaggggtcgggtctcgacctgcgaggcagcctgctcgggatattccagcaccccacggtggtcatctttgcccagggcagtgggatcgccacagccaaggccctcctcctggcctcctcggacgtgtgcgggctgaacctgcgcatgcgcacgggggagaagcggctctactatcgggtagggaggggtgggtatagactgaggcccatgggtcacctgcaggtagaagcagggagggcagcgcaaggtacttggatgtccaaggcagaacccccagcctcaccctttcctctcacacgccaggcgcggacgcaggcggccctgacgtatgctgaggagtatgaggcgtgggaggaggcaactggggtcaaagtggtcaccgccactcgggacagctttgcagacatgtttgacgacgacgacacgctcgagtgcgctggccgaaaggggaggagtacatggtcaccatgcctggctgccgccttgcatggccctggcatgaagatgccgtcgcgcaagaaaccctcgcactcgcctcacgggcccatcctccctcatcctcccaggtatgagccggcatcgacggcagccatcctgttgaccggtggcgacgaggagagcgaggaggagctcctggagctgtgcaaggaggccgagatcaactgcatcgtgaggcagagcgtggagggcgccctcaccgagtacctcgccaaggggaagggcgcatgagcgccttgtggagtgcattgcccggcccggacctggaatccagccattgtagcgaaaatggtgagtctgtacaaggaacgagtcagagaggaggcgttggcccccaggacaccatgctgggtnnnnnnnnnntatggtgagtctgtacaaggaacgagtcaaacaggagggcgttggcccccaggacaccatgctgggttcatatgacagccacaccctcgtccatgagggtgtcctctagctcgggaagggggaacctcaggatggccgccaggccggtcagcgcctgcagctgctggcctgagccatgcatgtccgagaacagcatgacctggccgccacctgggcaagtgcagggaagggggaatcgggtggaggacagcatttggactggggtttcttgcttggcgtcctacagtcaacgatgcacctttcacatgctagaaacggagccagtggggacgccgccccccccnnnnnnnnnnnnnnnnnnnnnnnnnnnnnnnnnnnnnnnnnnnncctcacctgccgcgacttcgtccaccagcgcgacatactttcttcgtgccgccacgtcgctggtgcggaagaggccctcggagatgagcagcgtggcgatggcacccagctcgtgcgccgcccagacgtggcctggcccgtagaaagcgcgcgcggggtcgctggacatcatggcgtagaagtcggccatggctgccacctccttggcggccttggtgtcctggggtgggagggacacagggggaagtggtgggcgaggggtgcatgggcattgaaaacacgctcctgggtgcccggcaagagcgaacccctggcaccccgagtccccgcgcgccttgatctgggccgcgacnnnnnnnnnngggggaggtggtgggcgaggggtgcatgggtgtgaaaacacgctcctgggtgcctggcaagagtgaacccctggcaccccacgtccccgcgcgccttgatctgggccgcgaccgccggcaccgccaggacctccttcagcgagtgctggaaggcggtggaggccggggccaccacgatcttggagcgggccgccatcagtaccttgtcctccctccgctgcgcctctgcaacagggaggacaggattggattctagttgtgctcctttttgttcacactgcggcagcctcagataacacaaggcaaaagcaggtggctttgatggtcatactctactcggagatcacgcacagggtacaatacctctgcaatgcagctgctccccgacccnnnnnnnnnncagttgtgatcctttttgttcacaccgcggcagcttcagatgacacaaggcaaaagcaggtggctttgatagtcatactctactcggagatcaagcacagggtacattacctctgcaatgcagctgctccccgacccacacctcaagctgctcgataccactgagagcatgccccagatcccccccccccagacccttacagcaccccacctgcaaagaggaactccaggaactggtcctttacaaaaccggggccggccaccaccaggcacttgaccacatcccagtcgacatgctgcagtactgcctggtgaagttgatgcgagaaggaaggtttgttgcaagtaatggagagggaaggccgccgggatataactaatgttgctagcatgcacgcagtcctccgcagccagccagccagcacgcagtaccctgcaacacacatgcatccccagcatgcccaccccagcccctggcatgccagcaacaccctcgcaacccgcggcacctggtacaccctgctctggaaggtgtgcaccgccttgtcccgccccgcggccgccgcccctttcttcctgggcatgctggtctccacccgagcgcgcaggactgtggcgttggcccccaccagggacaggttagccagaccctcccccaccagcagcacggccaggtcggccgaggcggcggggtctgaggcggcggcgatgcggtccaggtccacgccgtcccacacctccttctccagggtgaaggctgcctggcgccgcagctccagcgtgtggtaggcgcccagcttcacgtgctcattctccgtcaggttcctgcccttcagccggatctcctcccctgcgtgtgtgtcggggggtggggagggggggagagggggggcgatgcattgagctgagcagtgtgttcgtagcagaaccaaagcgtgcggggtgagagcggtgtgtctagcaggtggatggactcgctgcatgcaggagcccgtccccctacaaaccaattcaaggcaagcggcacagcgctgctggcgctctgctaccccccggacccccaccctacgccccacaccccacacctacctgctgcatcgtagtcgatgtcctccacctggatcatgagcctgagcttgatgcgttcgctgtctgtgcccatccccgtgtcccgctggaccttgcggtaggttgtggccgccaccttgtcccccgtccgcacaaggttaaagacatgccagaggtcctcgcctgcttggatgggtcgaaatgacatggtgatctgtcatttgagaagttcacaagctccctgcaggtcctcatcttacatgcaccagcatgcaattcctggggccggggctgtgattctccacacaatcactgcccatgcagatccaagcacacccaccatcttcagggatgagcttgacgcttccgggtccatttttcgaaaatttcttggaaataaacttcatcgtatatggaacccaagttccagccggaggccgacgctgttggccgcgacccaggtcactagcagtgctccgcccctgacgctgtcagcctcgggtcccctcggagagacggtcgacggtggctgtgctgagccgcccgaggacatctgcgcatgcagcgtgacagcatttgtacagacagactgatgcatgagttgcaggagctgtgcaccttgatcgcgagcttactaccaccttgcgcgcgcagcttcctaagcacctttgcaccgagatgacagcaggtcagctttgaacaagctgtcgcgatcttccacgcagggcacaaagattgggtaacattacgacatttgcaggctctgattaggtagttcagacttgtgacaagcacatacaagcaacggtgggctcacgaatctcgtaatgaaccacaagggcttccaatttccagagcatgactgcagcaagggcctcagagtgcccaggcatggccaaggggatgttcattatcccttctaaacatgcattcttgtgctggtacttcatggacacctcatcctcagttccactgttgaaactgtggaaagtctgcccaggatgtgtaccccttcttggtgtgtatgaggtatgccatcctgtgtcaggtgcggatgagacacaccatcagatcaggtggaatagaaccaagaggtctgtggcagagcccgattacctcaggtactcgaaactgcactcaccgacagtaatagnnnnnnnnnntaggtggaacagaaccaagagttctgtggcagagcccgattatctcaggcactcgaaactgcactcaccgacagtaataggcgccagggatgaaagccagtgcacccaggcagatgagtgcgatgaatgcgctcgtgccctcggtattcagaagcactatgccggctatgaacatcgcgaggcctgcgtgaaatgcaggcagtggggttggcatggagagctgcaactctcccaggatcctttgcaagacacacgcacccccgacttgctgtgtctttctgtcagccagagatcgggtgcatcagctacctgctacaaagagccctatggaccaggccaggggtcgccagggaacctcatcctcctcgttccgcatagtaggtcgagaccgtatgttgaccgaccgctttcgcttgtcgagacaggaagcctggggatctgtaggtcgatcgctacaccaagctcccgaagacaaattcagtgaagcattctgattgacatcannnnnnnnnnatgtaggtcgatcgctacactaagttcccgaagataaattcagtgaagcattctgattgacatcatgtaacccactatggtgaagcatacatggtgtgatcacacctctggttgaatgtcgaaagacttcgcgccctgggttccaacaccgggcacccgtattcacttatgtgcctgattcgagacacgattcgcctccctatcgccacatgcggttgtagttcataggctgctacttgaaggatatatgcgcttgtgatctgatgcagcaggcgtaaaccggccgagcgttagcctgctacggacttggctatgccgctcacaatgcacagctgagggggtgcgatgcagcgcatctcccttcagccctgcttcacagcatgtggcgagacccccctcgcccacatcctgcgactaggcgacgtgacattgctgctggatgcgggttggaccacggagtacctggaggaggaccttgctgagctgaggtcagccctgcccagcatcgatgctggtcagtcgaaggagtggaagggagcgaaacatttggcgcaacacctatgcgttgctgtgtaacccacccatgaacaccctggcagtctgcaatggattcttaaggtcgcctcttccctacccctgcccaccacactccctgcccgcagtccttgtcagccacgctgatgtggcgcacctgggtgcgctccctgccctgctgggccagggtgaccggaccctgcccgtgtacatcactggggccgcccacaagatggggcagatggagctgtacgaggagtgcctggtccggtccggctgctcggagttcacggcgttctcgctggaccacatcgacgcggcatttgatgggatgacaacgctgaactacctccagcactgctcctttgttggtgagcagtgtgggaagagctgatgtggcgggggagtgagcaggcccggtgggtgctggtgtgagcatggttgttcctcgcatggaatgatggcagggaagcctgcacaaaccttgcacattatgccatattcttcaagggatccatcgcaccatgggcttacaattaaatgcatctgcatcgcagtcagggacactccggtgaggatcgtggcacacccggccggccaccggctgggcggcgccatctggcacatccagtggagcaacgaggacatcgtgtatgcggtgggcttcaaccacaggtgatggcatgcttggtccatgaattatggatcaacaatggttgcagaacctctcccctcgccgtgccgaacaaagcatcgcctgccagtgcttaccgccctctggccccactgctcaatgttcggctggtattcaaactctcaagcgcccactccgacacaatacatcctcctcctgtctcaggaaggaacggcacctggcgggggcgcagctgccgggcattgtctcccgccccgccctgctcatcgtggacggggcannnnnnnnnntagaacctctcccctcgccgtgccgagcaaagcatcgcctgccagtccttaccgccctctggccccactgctcaatgnnnnnnnnnncggaagcgggacatgacaaccagtcccagaagggccaggagcctggagccgaggtagatgcatgccaggatgacgcagttgaccgcgatggacaacccgttctggatctggctggggaccagggtggaagccgccacgggggcgccctccggggtgtacagggtcagatactgggtctcgttctggaccagggcggtgtaggcgtaggtgagatagctcatcttgcccacccacttgaagtagaccgggatgctggacaccaggaagccgctgaagctgagcaggatcagcaggacaaaggtaaggacctggatggcgtgagggggcgagggggggggggggggggggggggctgtggaatgaataaaccggggtgaatccaagggagggcaatcctggcaaagcactcaagctccccagtctggcaggcttagctggctgctcacgcgtagacccacgcttctctgctgcccacccttttccagcgactttttggaagctgtcgtggccacactgcgctcagaaggcaatgtcctcatccccgtggacgccgccggccgagtccttgaactgctcctgctcctggaacaccactggtgagggtgatgcgggggttgcggggggatggtgccggggattttgggatgcggagtcctgggtgcccttgctctggaattccaaactcaaggcaggctttgccacacaccctaatccccggcagccccccccgggcgcgctctcctgcccatcacaaccaatcctcaatacagatccaccgcctcacccctcggcccctgaccccctcactcctgccctccagggcccagcaccacctgccctattcccttgcctggctgagctccatgggcgccagcaccctggaatttgccaagacgcagacggagtggatgagcgagtcgctgtgctggcacggcggccggctgcaggacaatccctacctcctgcgccatgtgcggccctgcgccgacgccgccgcactggcgcgcatgggccccgggcccaaagcggtgctggccagcctgggggacctgggtgcggggggcgcgcgcgagctgctggccgcctggggcgccgccgagcgcagcacggtcgtcctgccctgggtcgcggcgggccggcgctcgctggcgcgcgcgctggc

SEQ ID NO: 38346 - DNA, 61 bp, Chlorella protothecoides
gcccgccgccggctcggcgtgccctgtccatgatttggccgcctggaggaggagggggtta

SEQ ID NO: 38347 - DNA, 162 bp, Chlorella protothecoides
gcctatgagctggggattcagggcaagagatcagcaagaagaagttggtcctcccaaatggcgaaaggaggaggtacatggccagcatctcgacactttcattatagacatcatcccgcttgaccatgcctggcccactctcccttcttccccccaacctcc

SEQ ID NO: 38348 - DNA, 97 bp, Chlorella protothecoides
atggtcactcgtgtgggtccctactccatgcaacctgctttgaaattaattggggcgcggcgcatgcacccgggcacggaaagactgatccgcgccc

SEQ ID NO: 38349 - DNA, 61 bp, Chlorella protothecoides
tttcacagccccatccttcacgggcgtcttacctctgtaaggggtggggacggccgccatg

SEQ ID NO: 38350 - DNA, 73 bp, Chlorella protothecoides
gtcagcgcaagcatgtgacgccgatctccatgcccatctcagcctgagcagggtaagctgccggtcactcccc

SEQ ID NO: 38351 - DNA, 61 bp, Chlorella protothecoides
aactccccttgtcatcgctccttttcctgtgttccatgcagaatcccgggccggcggtacc

SEQ ID NO: 38352 - DNA, 61 bp, Chlorella protothecoides
gttggcggggcatcgcgccagcgatgcggggatcggtccagacctgctcgatcatgcctcg

SEQ ID NO: 38353 - DNA, 3953 bp, Chlorella protothecoides
  modified_base (182)..(309): a, c, t, g, unknown or other
  modified_base (745)..(754): a, c, t, g, unknown or other
  modified_base (1445)..(1454): a, c, t, g, unknown or other
  modified_base (1596)..(1799): a, c, t, g, unknown or other
  modified_base (1988)..(2121): a, c, t, g, unknown or other
  modified_base (2600)..(2609): a, c, t, g, unknown or other
  modified_base (3802)..(3811): a, c, t, g, unknown or other
ccgcgtcgaggcgcgcgcccgcgcgtcgcgcctgcgcggccagccacgccgccagctcggcgtcccagtcgtcgccgcccagcgcggggtcgcccgcggtggccagcacctccaccgcgccgccgccgacctccagtagcgagacgtccagcgtgccgccgcccaggtccaccaccagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgagccgcacgctttccaggcccgcgccgcggccggcggccaccgtggccgcgcgcgcggcctcgtcaaagtatgcgggcacggagatgacggcgcgggtgtggggcgcgccgcccgtcgcgcgcgcggccgccgccagcagcgctcgcagtacctcggatgccacagccggcggcatggtgggcggcgcggagggcagccggaaacccgcccagccgtccacgtcggtcagggcggggtgaggaagtgtcgcgccggcgccggcctcggagtttgccgcctcccaggtcttgcccatcaggcgcttggtggaggaaagcacggaggaggggtgcgacagcgcgtacctgtcgggcacatgggaggggcacataaaatcgaagtggcatggtgcggagggtatgtttggttgcactgcggagagtccgcggcgnnnnnnnnnngttggattgaagtggcatggtgcggagggtacgtttggttgcactgcggagagtccgcggcgcatgaaggtgccagcatctcggcgagaacccaggccccagcccctggcctgcacgtgctgtggcatcaatccaagccccctgctcacctctgagcggctcggcccaccaggatcctgccatctggcttgtatgcgacgacagacggcagggtgagctcgccgccctcgacgggcagcacctgtggcgctccatccactatgatctgcgagaagaggagggcgacactttcaattgacaccgtggcctcatgaaagcatctgtgcgccaagaggggtggaatgccagtggcgactgtgctgtcaggcatgtggcagccgcagggtttgctgcagcacctcctcccccaccatgactcacagcaatggcggagttggtggtccccagatcgatgcccaccgccgagccatgggctgctgggcatctggtaatgcctgcatggggcctcgaaggtcttcggctccacacgcctgtttcgaaggtgcttaccgggtaggctcgacgggtcaccacactggcgtgggcgagtgccatggaactacatggttacttgggcattctacctttaagaataattctcattgtacttcatattgcataagcatgcacggcatatctcgttgtctgtgcnnnnnnnnnntgcctcatgaaagcatctgtgcggcaagaggggtgaaatgccagtggcgactgtgccgtcaggcatgtggcagccgcagggtctgctgcagcacctcctcccccaccatgtctcacagcaatggcggagttggtggtccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaataattctcattgtatttcttattgcatcagcatgcacggcatatctcgttgtctgtgcctctgcactattgtgtgcttcatcccatgcgtgctttcggagaatcctctgcaacaagtaccaccaaacactttcgatcacctcggccaaatgtcccgttatcagagatccgtcaaatgcacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactaggaaacgtaaagtggaggcggcaagtgatctggaagcccagatccctgatgccgccttatctcccaagaagggccctagatcaagcggaaagaaggctgatgtggctgagaccagggcagtagaggacaagccagcgcccagcagcaaaggcaagaaactgaaggagggtgactctctgcccagtttcaagctgctcagggaggatgatgtcaaggtggacgtccaggtaggctcaggatgggggctggatcacaggttttgagggcaggggctgcgtcacaacaactcagcgatactttgaaatccctggcgagtctcgtcacgacaataccaacccccatggaattccccatactttgcaggagcttgccaaggaccagggggtcgtcatcttcctctacccaagagtgaggctggtgtgaggtcgctgggtactttgcacgatttgctgccatggcagtcaccgaggtgnnnnnnnnnnaatgtgaggtcgctgggtactttgcgcgatttgctgccatggcagtcaccgaggtgttctggccctcccatccgctacgcaggcaaataccgggggctgcaccaagcaggcactggggttcaaggagaaccacaagaccctccaggatgcagggtttgaggtttacgggctcagcttcgacaagcccaagtcccagacgacctggaagaccaagtacgacctgccttaccacctcctaacagacgagagcggggaggtgggtgagaccggggcacggctcctgtgccgggcaatggttttggggaagtgcggggggcctgacacagggttggctgtctgtgtctacacccgggatcagctttgcctgaccctgagtggctctccacggcgatcgcccctcacgcccaagcgtctcctcacacgcctgcagttcatcaaggccctgggcgcattcaagcccccgcgcaacgtgattcggtcccacatcgtcgttgccaagggcgggaagatcgtgagctcccacatccagatcagcccgggggacagctttgccaaggccgtcgccacggtggcagacgtggccaagtcggcctgagtgtgagtatccctggaggcgacagggctggtttcaacactgtggaattctcatccatcagcaccgatcgctggggggccgggctcctgagcatcccccttccatcgagacttggtgccgttccggtgagagtttacgcccttcaatgttcagtcagacaggcagcagggagtgggggttgggagtcaggtgcaggggtgtggggtgcacgtcggctggtggtccatcgcaaaagtcaccgcatgcggtgcaccagccgccgctctcgccgatactcaaagtcgccgttgctctgcaggtagagcagccccttgcgcaccagattctcgttgaaccccaccctgtggatgcgtggaggggatggggtcgggggggggcgggagtgcgtgccacccacctgcgacgccctgggcaccgagcatgcttcagcagcgcaccccacagcggggagcggtgcactgcatggctgatttcctggaacccccccctgcgttaccaggccccgcacagcctcccccgggcgtactcgtctgacctccaggcgtccacacactcctccctttcacccacctcctcacaacaagacaccccccccccnnnnnnnnnnccccccgcctgcgttaccaggcctcgcacagtcttccccgggcatactcgtctgacctccaggcgtccacacacccctccctttcacccacctcctcacaacaagccccccccacccccccttaaaaccaagccccccccac

SEQ ID NO: 38354 - DNA, 61 bp, Chlorella protothecoides
gtcgtggcacgcggccatcggagcaggggttgcaggcaactccgatgtccctgtgcctggc

SEQ ID NO: 38355 - DNA, 61 bp, Chlorella protothecoides
ccttccctggagagccaactggagcggcgggcctggagccccgaggctttccgggagcagc

SEQ ID NO: 38356 - DNA, 92 bp, Chlorella protothecoides
gccgtcgccacccaccgagactgggcgaagcgagacggaggggggttcttgttgagatgggatttcagactcttacatagcagagagaaaga

SEQ ID NO: 38357 - DNA, 417 bp, Chlorella protothecoides
  modified_base (89)..(329): a, c, t, g, unknown or other
gccgccgcccttgccgccgatggcgcccagtgccgccttgagccactcgccggcagggaagccgggggccagttccttgggcaccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggcgagggagggtgatgcgcgtgtgtgcgtgtgttcagggaggcagatgcggtacccaggcgagggagcgggatcctgggaaag

SEQ ID NO: 38358 - DNA, 62 bp, Chlorella protothecoides
gtgggtgtgtgtgtgaagaaatggggtggtgtactcgtgaagttagggagggaagagaaggg

SEQ ID NO: 38359 - DNA, 127 bp, Chlorella protothecoides
cctcaaggtcgagcttcatggcaaggtactgacctcatcaggaaccctaagggctttctaggagcatgtttcattcattgggacgcgtctgaagtcaccgggtggaggggcgtgcatgcggaacctg

SEQ ID NO: 38360 - DNA, 108 bp, Chlorella protothecoides
ccggcggagctgtagcgtgacagctgccggtcgcaggcagcactctccgctcagagcactgcaaagaaaaagagcttccagcacccaatgccgcatggtcaggcatcg

SEQ ID NO: 38361 - DNA, 61 bp, Chlorella protothecoides
gcgtgggcgagaagggcgaggtgcgggcgtgctggggtgttgctgtatgctttcctcgagg

SEQ ID NO: 38362 - DNA, 69 bp, Chlorella protothecoides
atggaggagccctgtgcgcgatgtgagggggaaaggggcggggagtgtcagcatgggggagcaagggga

SEQ ID NO: 38363 - DNA, 78 bp, Chlorella protothecoides
catggcctcgcagcttgtgatttctcatcgcttcaaaacctccttttgcccccccccaacacacactcaggtgtacgt

SEQ ID NO: 38364 - DNA, 78 bp, Chlorella protothecoides
gcgcggcggtgaagcaggaagccgatggcggcgcggcggcgcgggtgcagcaggaagccgatggcgcggcggcggcgc

SEQ ID NO: 38365 - DNA, 78 bp, Chlorella protothecoides
cggtggagccttcttggatgggggcggtggtgacttcttggcaggaggcggtggagccttcttggatgggggcggtgg

SEQ ID NO: 38366 - DNA, 62 bp, Chlorella protothecoides
tagggttaggtttaggtttaggtttagggtcaggtcagggtcagggttagggttagggttag

SEQ ID NO: 38367 - DNA, 107 bp, Chlorella protothecoides
ggggggggcagagggcagcacaccaccaggccgtatgctcatgcatatacacggactggggtttgccgagcagctcgcctacctccaacaggctgtcactgaggccc

SEQ ID NO: 38368 - DNA, 79 bp, Chlorella protothecoides
cttgcaaaactagaggaatcccttgttgaatgattacaggcgctggattaggctcctccgtcacatgcataaatattga

SEQ ID NO: 38369 - DNA, 100 bp, Chlorella protothecoides
agggcgtgccggggtcgcagcgctgccccgaaacccacaatcccggaccctgcgcctcgcagccggaggtgctgagtcagccgctggtggagcgcctggc

SEQ ID NO: 38370 - DNA, 71 bp, Chlorella protothecoides
ccagccactgtcccgctgatatcagcgcgccggtcgtactccagctggctggtcagctttgagatctgggg

SEQ ID NO: 38371 - DNA, 65 bp, Chlorella protothecoides
gtggctggtgcctgggagggatcgtcccgagcggaggacggaacaggcgcggctgcaggcgagcc

SEQ ID NO: 38372 - DNA, 34185 bp, Chlorella protothecoides
  modified_base (160)..(314): a, c, t, g, unknown or other
  modified_base (602)..(701): a, c, t, g, unknown or other
  modified_base (854)..(910): a, c, t, g, unknown or other
  modified_base (1360)..(1369): a, c, t, g, unknown or other
  modified_base (1858)..(1971): a, c, t, g, unknown or other
  modified_base (5227)..(5236): a, c, t, g, unknown or other
  modified_base (5454)..(5463): a, c, t, g, unknown or other
  modified_base (7077)..(7086): a, c, t, g, unknown or other
  modified_base (8365)..(8374): a, c, t, g, unknown or other
  modified_base (8551)..(8560): a, c, t, g, unknown or other
  modified_base (9543)..(9552): a, c, t, g, unknown or other
  modified_base (10359)..(10368): a, c, t, g, unknown or other
  modified_base (10907)..(10916): a, c, t, g, unknown or other
  modified_base (12619)..(12680): a, c, t, g, unknown or other
  modified_base (13673)..(13682): a, c, t, g, unknown or other
  modified_base (14659)..(14668): a, c, t, g, unknown or other
  modified_base (15145)..(15154): a, c, t, g, unknown or other
  modified_base (15389)..(15398): a, c, t, g, unknown or other
  modified_base (15596)..(15605): a, c, t, g, unknown or other
  modified_base (15936)..(15945): a, c, t, g, unknown or other
  modified_base (16577)..(16586): a, c, t, g, unknown or other
  modified_base (16951)..(16960): a, c, t, g, unknown or other
  modified_base (17400)..(17409): a, c, t, g, unknown or other
  modified_base (17894)..(17903): a, c, t, g, unknown or other
  modified_base (17964)..(18180): a, c, t, g, unknown or other
  modified_base (18396)..(18405): a, c, t, g, unknown or other
  modified_base (18684)..(18693): a, c, t, g, unknown or other
  modified_base (19005)..(19014): a, c, t, g, unknown or other
  modified_base (19463)..(19472): a, c, t, g, unknown or other
  modified_base (19860)..(19869): a, c, t, g, unknown or other
  modified_base (20195)..(20204): a, c, t, g, unknown or other
  modified_base (21389)..(21398): a, c, t, g, unknown or other
  modified_base (22334)..(22343): a, c, t, g, unknown or other
  modified_base (22676)..(22685): a, c, t, g, unknown or other
  modified_base (24363)..(24372): a, c, t, g, unknown or other
  modified_base (24793)..(24802): a, c, t, g, unknown or other
  modified_base (25074)..(25083): a, c, t, g, unknown or other
  modified_base (25545)..(25554): a, c, t, g, unknown or other
  modified_base (25862)..(25871): a, c, t, g, unknown or other
  modified_base (26945)..(26954): a, c, t, g, unknown or other
  modified_base (27728)..(27737): a, c, t, g, unknown or other
  modified_base (27897)..(27906): a, c, t, g, unknown or other
  modified_base (28327)..(28336): a, c, t, g, unknown or other
  modified_base (29381)..(29390): a, c, t, g, unknown or other
  modified_base (29776)..(29785): a, c, t, g, unknown or other
  modified_base (30348)..(30357): a, c, t, g, unknown or other
  modified_base (31712)..(31721): a, c, t, g, unknown or other
  modified_base (31983)..(31992): a, c, t, g, unknown or other
  modified_base (32473)..(32482): a, c, t, g, unknown or other
  modified_base (32551)..(32639): a, c, t, g, unknown or other
  modified_base (33085)..(33094): a, c, t, g, unknown or other
  modified_base (33329)..(33338): a, c, t, g, unknown or other
  modified_base (34064)..(34073): a, c, t, g, unknown or other
cccgccacgtgccaggagctgcagcgcgccgtcgccgcggtggcctcgttccaggccccggggcggtacgtgctgctggagggcgcggcccggggcgaggcggcggccggcaacgagcggcgctctagtgctgcgatcatcggcgacgagcggcgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccggacacccaggacgcatcggacgacctggcgagcgcggggtcgcaccccgcacactcccaggcgggggccggcggcgagggaggcgacggcaatgtcggcgcgcaggaccgcgccgcgggcgggaccgccgcgccgctcagctcctccagcagcggcgcggcgcggcgccagctctccgcctcctcgcgctgcctggacgacgtggaggacgggtgggtgggcgcggtggccgactccgcgccccgggtcgccccacctgtgacctccagagaggtgggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctgtgaggtctggatgcctgggtggccgggaacccccttgggagtcttggcgaggcgaggctccgagacacccacctcatcaagcaaggtgtccacgggtgcgcttgtgtgatgctttttacggccccccccccccccccccccccccnnnnnnnnnnnnnnnnnnnnnnnnnnnnnnnnnnnnnnnnnnnnnnnnnnnnnnnnngaccaagcccacctcctaggccttgcctctgctccccacctatcaggccaaacctcaaaacccttgcacctgggcctccccccccgcaggagtacatggagctgcaggtggagttcaacaggcggtatgagcagtacttcaggctgcaccaggtactgcaggcgaatcgcaacgactttgcggcctggcgcgaggcactggagtcgccggggctttcggctggcgagagggccaggcgaggctgggattgcggtgttgactctctggtggaggaagcagggaaatcacgtgatggcatgctcccctgcaccttcacgcatgcttgctgtccccttgccaggcattacaggagattgggcatctgtgctgtggcgtcaagtacagcactcccacctgaccgcaggatcgaggccaagattcaggagcgctgggatcggcaggcgcagcgcnnnnnnnnnnttgtgctatggcgtcaagtacagcactcccacccaaccgcaggatcgaggccaagatccaggagcgctgggatcggcaggcgcagcgcgccaagcgctgggacgcggccttccgtgtgctgcatgtggagctggaaagcatgaaggcggcgctgggcgaattcgtgcgcggcatggaggagggggagggtgcccgatctgggggcgccatcgccagcgaggcctgaggcagaggcgggaggcccatgctgcgccccctccaccgctcctcatcgcggcgtgggtgatccacgcacagagctggccttgggagcaccagtggtgccagaggcacagagggcagcgccactttgcagacctttccacggagcgattcgcgccaaccaaacatttataccatgcttttaccctctattccctggcctttgaaatgcactctaggcgtgcaggtggtccagctgtgcgatctctgcctgtgtgtaacaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgcccatggcagcagcgcatgcctctctagcctcaagagccttcccaccttcagctgctccatcttcaaccccatggaccgctgcagcttgccccgctggtcctccgccagagactcgcccagctccgtgtatgccttcagcacttcattcactgcggtccttgcagtctcggcgctctcattgaagtatgtctgtgcgaatgaagagggcgaaatgggcatctttctgtcatttgacgtggaacggtggtgatcctgatcgggtagaccagtcaggggtggggagggacccatggcgcaccgtctctgcatcctcctgggcgtactcgatctcgtcccgtgcctctgcaaacttctcattcagggcatccacctgtggagagaggcggatccgcgagttacaagtgtaaagcaccgctgctggagcgaaatcaatgaagcatggttgaggcttgtctttgggccacacctctttccagccgtggcctccacaatgaaagctacctgagactcgtacgattctttcgatatagaagagaatgggcgcatcgcacgatgtactctgctgaaagcgccccgatggcaccccgtcaggttcagcatgcttcccagccaccgagcgtactgtgttacactcatcccacgacactgagtaggagcgggccctcgggggtgtttgtggggttcatatgcttatattgtatgtataattgcggggactgatcggtatctcgtcgagcattccggaaaatcagcgctgggagaccaactgtgaacgagtgaccagacttacgggacgcacctccctgcctccatttgtgagattttacatccaaacctggatatcttgtgtcaaaaggtacgatcactataatctactcaagtctcaagcagtgccatcaagcagtgcaatgaagagctccagaagccctgcattcaccacttatcatcccaggagtcctcgtctcccttggagttgttgttgccgccgttgccattcgtgaagttcctgatcacggagatggccacgtttgccagcatgaagatgaggaagatgttgaagatgccagagatcccaaagctagggaagacgccgatgccgcctccatagaagggcatgccatagccgccaccaaagaagggcatgcccatgccgatgccgccacccaggggtggtgcgacatacgtgttatagctattgtactgccggctggggccggggctaggcctggtaaaggtataggagggagtgtgtgagagtggcaaaccgctggctggctggggacgtgcctggcgggcaactgggacatatcatgctgatgtcaagttcaagcagccaacttcaataataagttcaaaaactcaactctgcatgagccctccattcaatcgacagcatgctcattcacgcaggacgcatttgacaacgctcatgtacacgccatgctcatgagcctcacacatcagatcatggtcaccccgcaccacacctgctcggagccggggcggcccggcgggacgagaagctgctgcctcccactcttccaccactcctggcagcctccgcggcgtcgggcgtcgccgtgagcagcaaggcagcgccgagcagcgcagcagacgggactgcaagtcggtcgatccacgacttcttctcctctccgctcgcctgagcgcggatggagcgactaggacacctcaagccgcgaggcatctgtgtcgcgggccggaacgcggctgtcttgggcatcatggtggaggagaggctggtggtcagcatgggactcattaccgacatggacattgcgttacacccgaaatttgcctaatgaggtaagcgcgagaaattcgtaaggaatgcgggtctcacacagtttcgttgaacgatttggctcggaagcctctggcaggatttgtgcgcctcataaaaatcttgtttgtagtcacgtgggtagccctcgaccctggatccattctgaacgctaccaaactccggtcagctccctgtttgcccagcctgcgagtcacagtagggtgtgcatggattacacagcagcacaatgctgccgatcagatgcatgccgtaggttgtactcggtcattggcatcactcaggtgcaggtacaccaccagaagtaggccagatgccacgtagatgccagcgtcgtgcagacctcccaacgatttctggaatggaaccagtgttggtgcgtacatagcaaatgcgcaagagtggtccaaacacagtggtcatcaaagagtcagactgtgacagatttgtaaagaaccaaggttgaatgtagcttccgagaactgaaactacacagccatcaacctatacttgagtccacgcctatttttatcttgtggtctgctcgtgagtggcgatcctccacacaaaatcgtacccctatcacactcagctgccgcagcccaatggtcctcaccatcttcaatgctttctcaatggggtagagtcaaccagcaccatgacctgtgtgtgctaggagtgatatgcaggttgatggtgaggggacgacagccctgctctcgacgccacaccttgcgcaggcagcaatgtgggtcaccgccttggccttcgtcgcctgccatggatctggtggccattgttgcatcacgcaatactaagcgaccgtttgatacttcatgacaaggactggaaaggaatgggcgtcatacatgcccatacaggatcaatgcagtgtctagtttctgagggtgattgtgatgggcaggtgcctgtctgctggcttgagcaagggtccccggcaggtcggatgtggtccagcacgcgccctcacgaagacgcccggtaatatatcgaggacacactgcatctcgatgtcactcagcgtacaattcccactttcccaccccacaatcatgtagcatggccccggaacgcatcgccttcgtgctcatagatggcctgggtgacgtcaacgaagcagggctggggggccggacaccattgcaagcagcccacaccccattcctcgatgccatcgccggtgcgttcgattgcagacccatgttttcggtgtgaaggagctatctcccgcgcgtcgatctgggacacgggtctttgtctggccctaccccgtgggaaactcactggcctggtgctgtgatcgcccacctctggccacccccccacacgacatcaccctccacccacccagcatgctagcccctgctcttggacgcctcgccccatcccccggctgcatcccannnnnnnnnngatgggcgtcatacatccccatgcaggatccatgcagtgtctagtttctgagggtgattgtaatgggcaggtgcccgtttgctggcttcagcaagggtcgccggcaggttggatgtggtccagcacgcgccctcacgaagccgcccgataatatatcgaggacgcactgcatctcgatgtcactcatcgtacaattcccactttcccaccccacaatnnnnnnnnnngacaccacaccaccctccacccacccagcatggtggcccctgctcttggccgcctcgccccatcccccggctgcatcccactcccccctccctttccatcaacgcagcggcggggctgaatggcttgatggacccggtggccccgggcctggcatgcggctccgacaccgcccacctttccctgctaggtcatgatccccgcgcctgctaccgcggtcgcggcgcgttcgaaagcctgggggccggcctgctcatggaccccggggacatcgccttcaaggccaattttgcgacgctggacccggccagcggcatcgtgctgcgccgccgcgccgaccgccgcttcgaggccgaggggcctgtcctctgcgccgcgctggacggcttgcccatccccggcttcccggagctcggcctgcgcgtgcgctacgccaccgagcaccgggcgggggtggtcatcgccgggccgggcctgacggacgccatcaccggcaccgacccgcttcgggacggtctgcccctgctggacccggcccctgtggaggaggagcgaggggggtatggcgagcaaggaaacggggcggcagacggctctggagtggaggccggtggcggccagggcaccgatgcagagggcaacatgggggggccgcccggcgatgagccggcaggccctcggaaggagaggccccctcccagcgctcgcagcgccgcgcgctacagcgcggcagccaccagagccgccagcgatgcgatgcgtgcggcgctggcccgccacccggtcaacgcggagcgtgtctcacgcggcctccctcccgccaacgtcgtgctcctgcgcggctgcggggcgcgcctggcgctgccggccttccccgcgcggcacggcctgcgcggcggcgtggcggcgcccacgcgcatcatccgcggcctggccctgaccctgggcatggccgcgctggacgtgccggggggcaccggggactaccacaccgcgctgcacgccaaggcgcaggcggtcgccgccgcgctttccgcccaccgcctggacttgggcttcctgcatgtgaaggcggtggacgacgcggggcacgacggcagcgccgcacacaaagccgcgctgctgggcgccgtggacgccatggtcgggcagctgctggcgcgcctggcgcgcgcccggctggacagcggggaggaaggaggtgtcggcggtgcgtgggcgtgtgtgcgggagggctgcagattagaccagctcaagggggaccgcatgccttactgcttgtctatgtccttccctgccgccgcctccctgccatccgatgttccccccgtccaacggcaccctgcccagcagagtataccatcgtggtgacgggggaccattcgaccccggtggccaccatggatcactcctgcgagccggtgccggtcgccatcgcccaccttcgacacgtggtgagccagcgcaaggggcccgggccattctgcctgttatgtctggagggctcctctggagggaagggtccctggaagctggggagcttcttgtaatttgagggttcaacgaccgtttccagccgctcctgcatcagtcgctcagtgcttctagggcgtgtnnnnnnnnnncctaattttagggttcaacgaccgtttccagctgctcctacatcagtcgctcagtgcttctagggcgtgtgcctggacacatgcaggtgcaaagactgggaggagcagaggcgctgctggacatcccgctggagcccatcaccctgccacccgttccgggagaagagagcggggaggagagcgccggcccgactctcccagcctcccttgaacccaggctgcaagcccagccacaaaaaccgccatcctccccacaccaggagatgggaaagccctcatctgcgcagaccttcggggacagcgtctcctcgtttgatgagtcggccgctggcgctggaggcctgggccgtttccctgggtcacagctcatgcccctcatcaagcactttgctgggtggggcccttccccccaggacacggcgagggcaagacgacgggaggagtgaattgatgcagcgtgggcgtccgcccttgccgtccagtcctccattatccatccattctttgcaggttttcaccttttccttcagtccatcccttacgtaaaattagtaccatgcgcaaagaattactgcgaagtcctatctcgcgacgatatcatacccaatgtgttctgtaaatgaggctgtccgctgggctggtggtgagcagccgcgtctggatcccgagtcaatcaccgtgtccacgcgctcctacgctgtgcctcgactgaggcaggcgctgcacccaccaacatgccacgctccccacgtgtgctttccattcaaagccatgtggtggcagggtgcgtgggcaacaaggcagccgtattccccctgcagctcctgggcttcgaggtggatgccgtgaacaccgtgcagttcagcaaccacacgggctaccccctgtggaaggggaaggtgctgagtggggaggagttgtgggacctcatagatgccatggagaccaatgggctcctgtcccagtacacccacctgctcactggtgggtgccgaggcagtactgatggggcttagggaaggctactctggtgcgcatgcatgcaagactcctgctttgcaagcaccgcagatgttgtgtgctggagtgtatcataggaactcacactcctaccatcctggtggatcctcagaaaccatcttgggcacccgcacaggacggcatgagccatgtaaggaaacatgccgcactgcatcacaggccagccttcccttccttctctgcccccaagcagggttcatagggtctctctcgctccttcacaccatacaccgtgtgnnnnnnnnnncctctgcccccccaagcagggttcatagggtccctctcgctccttcacaccatacaccgtgtgcttctgaagcttcgagaatacaacccggccctcgtgtatggtgggtctgcaaggggggggcgccgagatgcttgaggtctgcttcatgctgccgagattgaggcgtggccgggnnnnnnnnnntccggccctcgtgtatggtgggtctgcgagggggtgcgccgagatgctcgaggtctgcatcatgctgccgagattgaggcgtggccgggtagttgctgtatagagggcattgcacaggtcgttatcattgtcagttgaccgctgagtagcggatggctcgctcaactctccgccttggcatagcaatctcactcccctaacagcacctgccccaagcccccatcgtcctcacccctccccactctctcatgccgtcacgcgcagtgtgcgacccggtgcagggtgacaacggccagctgtacgtgtctccagacctcccacccgcattccggagcgagttgacgcccatcgccaccatcatgacgcccaaccagctggaggcagagctgctgacggagcgcagcatcggcagcgtgcaggaggccctggacgcctgtgcccagctccaccgcctggggccccatacggtcgtgagtgagatcgagaggatcagtgcgggggacaagaatcgtgagattaatttcattgtgaaggggacgtacagcgagggtctcaatctgtcgccagggacctcagagcctctcccaccagctgcaactggggttgccccagcacccggctggcagccagaaccaacccttccacccagcactccccttcccttgcacccacgaccaggtgataaccagcttggacttggaaccagaccacgtgaccgtgctcgcgagcacgacgcagcctcaggcagagggcgcgctttccacctttcgtatcctggtgccgcgggtgcaggcctacgtcaccggcacaggcgagctggggggggatgagtacagggtgaagtgacaatagctcttggtgaggccacgaggacctgggacaaccttgcactccatgagcatcaagccagtggaccaccaccctactgactctgcacatcccggcaggggacctgttcaccgcactcctcctcggctggttgnnnnnnnnnngaccttgcactccatgagcatcgagccagtggaccaccaccctactgactttgcacatcccggcaggggatctgttcaccgcactcctcctcggctggttgcacaaagagcccggccacgtccagttggcggtggagaaggcgctggcggggctgcagatcatcctgcgggactctgtgggcacagaggcagacgggcaggcccctgagaattggcagaggaccaaacgcacagccgaggtgaggattcagggttgcgcgggatggaagtgaggagagggtgggtgtggaaggagtggtgcccctgtgtgccatgcccactggggctggtgtacgtgctcgagtgttaccagcacattctcttggaccctccccaccacatccccttttaactccccacaacattctgcagatatgcagacagcgagaactgcagcttgtgcagcactctgaagccctgctgcaccctcacgtgacctatcgtgccgaggcagtaccttgatgcagcaccgaagcatgccaggcgatcaacatggcaggacatcatgggtctccagggctctaggcccttcaccttcgctgcaagtaaacagctgcaggtcgcataactcccctggcatgcctctgctcatgcacttcaggtcagcaataatgataccgcatatcttgggtatattcctttcttaatactgtacgacatgcagctggaggtggcaacatgagcgatgaactgcacgatggacaagccggccctatggcgggagatgaagattgggttcggaccacatccctctaccctcctggtacnnnnnnnnnnacagcgatgaattgcacgatggacaagccggcctatggcgggagatgaagattgggatcggaccacatccctctaccctcctggtacggaagggggcccaacgtcccttgatacggtcgattgatagctttgagataatgctacttcatgagaacgagatcgccagtggttgccgtgcattctcccacggcgggacccctgcgacactcttctgacctccgagcgatgagcgactggacactatgcgacagtgccaaggaccctcggtatagcagaccatgtatgcatggcatgacttcatggaacagtgccctgtccgagtgtgacctctgggcgataggggatacgacgaagattagggttttcctgatgcgtgacctggttctcgcgccactgtcaatggcagacatcgcaccacgccgtggagctatttatggtaactttgagtccactcgagggctccatgctgcattctgcccttcggtatgtcgggacattcctcagagaatcgcgtttggctcccggagatcaaccacagnnnnnnnnnncctcgggacatttctcagagtctcgcgtttggctcccggagatcaaccacagaaaaggaaagatcgaacacaagatcacggatcccgggtgtcatttgtgttgtcaacctagggtctctgcgccaacctagggtaaaggctgtcacaccctggaagcgctttatttcaccccgggtttcactgtcacatctcaacattattcggtgtcctctcgggcacccggagtcgccggtaacaactcccagcagcatctaatctcccaagccctagacctacagcaccggccgcacaggacgatcgccgttgccccagccctccacaaactcgggcaacatggcaggagccaacagtctcggcgaggttgcccagaacctggcgacgctcaataacacgatccagcaggagctggccgacctgaccatcggggccatccccgggtacacggacatcaacgccggatggacactgcagagtggctacctggtaggcaggggggctcatacccatcgcatgtggccaatttatcgtttcagatgtcatgaagtacccgtgccggcaactttgtggttcgaagtccgggaagctgtgccgggtgcatgcggccctgccagggtttggcgagaccccccttcccacgcccgtcgacgcagccgctcactcccagaccctcccccgcctcccaccccaggtcttcttcatgcaagccggtttcgccatgctctgtgcgggcgcggtgcgtgccaagaacgccaagaacatcatcctgctaaacctgctggacgcctgcctgggctccatgtgttggtacatcaccggcttcgcctttgcctttggcgaccccaccgccgccgatgacggcacctacgcctggtactcgcccttcatcggccaccgcttcttcgccatgaaccagctgccccgcacctcgtacgtcacctggttcttccagttcacctttgccgccacgggggccaccatcgtgtcgggcgcggtggccgagcgctgccgcttcgagagctacctcctgtacgagatgatgctcgtctccctggtctaccccgtggtgcgtgaggcgtggggtggctgggtgggagtgaagggctggcatgggagcggggcatgcggggatgacatcccacccttgacccctctccaccatgtccatgtccctcccgagccaggtcgcccactgggtgtggtctccctttggctggctgtcagccggacgcaacaccgccaccgtctccggaagctacctcctgttctccggctccggcgtctacgactttgccggcgacggccccgtgcacatggtgggcggcttcgccagcctggcgggggcctggatcctgggcccgcgcctcggccgcttcaacgccgcgggcaaccccatcgacatgcccgggcacaacgcctcgctcaacctgctgggcgtctttgtcctctggtttggctggtacggcttcaaccccggctccaccaacgccatcgtgggctccgccgtcggctactccaagatctccgccgccatcgccgtgaacaccaccgtggccgccgccgcggcctgcctgtccaccctcttcctcaccatggccatcaactacttcacctccggcgtcatcgtctgggacctgatcatcgcgggcaacggcgctctgggcggcctggtggccatcaccggcccctgcgcctttgtgcagacnnnnnnnnnnnnnnnnnnnnnnnnnnnnnnnnnnnnnnnnnnnnnnnnnnnnnnnnnnnnnnctcttcgccggcggcgtctacatcatcgcctcacgcgtcaacctgaatctgctcaagatcgacgacccgctggatgccatcgcggtgcacgcgggatgtgcagtgtggggcatgatcgcgggcgccgcctttgccgacctgggcatggtggatgactactacggcgcctcaccctacggcgaggacacgacgcgcgagtacggcttcatcatgggcggtggcggcaagctgctgggcgcgcacctggtctacatcatctgcatcgccgcatgggtgctgggcatcatggggccctacttcttcatcctcaagcgcctgggcatcttcagggtgtccccggaggtcgagaccgccggactggacgcctcctaccacggtgaggggcggcggggaggtggtgcgagaggcgatgggggagggccaggtcgttgcccattgatgttgcctctggtggatttctccaaggtgcacgttcaggcgccttgatcaacattccgctgaccccatgctgtcttccccccaaccaaaccatcccaggcgggcatgcctacccgcatgaggtgacgggcaagggccaggcctacaagaacgaggcctttgacaaggaggagaacggcctcacagctgccaaggtgcagatgcagattgacatggcactgggcaagctcaaggaggagctgacccacccctcagacaagtctgagtaggtgatgtgagtcacgacgcagtgccgagagcttggttgagccgctgggctagggacgcgtgagcgcccaatgcatgtgcccaggggtgggcgactgtccgtgtgttcccctccccaaacccccttcctgttcttattgtacccatccgttgactggtgtggccagttcctgcacccaaaccgctgctccagcgctcgcagccctacaacccactattactattaatatttgacgatattatgggccgatgtttgccggggctgtatggagggtgggaccgaccatnnnnnnnnnnctacaacccattattattattaaattgttttgacgatactatggaggggagttcgtcggggctgtatggagggtgggaccgaccatcgctgctttcctcagctctttatgaagtcgcggatgtatgtgcggtcaggcctgtgatgctcggatcatgtaacgtggaagtaagtcggttggtgcgctgaggtacatggccgaggccattaattggtaaacctgtgcatgatcagcagaaagtggctggatgatgtatcacaatgggggggaatcgtcggggggctgtcgacccccggcatgtcagcagcgacgtggcgaggtgtctagaaatgtcgagcatgtacggacacattctagaacttcccggccccagcgagtatataggagagcgcactcggacattcttgtcaagccaaaaagcgatcgatattcccattgccaagccccccaaccgagcattttcaagagcaatcgcgcacagcaccatgagcctgatcccattcgccctggaccccttcttcggggacgacttcttccaccccctgcgcagcagccgtgctctgactacatctggaccccagctggctcgcggcgtggccatcgatgtctcggaggtgcgttcgtgtgcgggttgatggcctccaggctcttcatgtcatggtgtccggatgcggtttcgtggagctcttcgcaccggatgttcggctaatggcactcaccgctctgcgcacaggacaagagcaagttcttgatcaaggccgacatccctggagtgaacaaggaggatatcaaggtcacaaccgagggcgataccctgtcactgagtgtagagaagacagaggagaagaaggaggaggaccctgagaccaagttccacaggtattgccccctgccagttcaagacgttgggcctacgtatgccatgtgcttgcggatatcaaatactccagtgatgacgtcaagctcacaaggccattnnnnnnnnnngcccctctgccagttcaagacgttgggctgacgtataccatgtgcttgcggatatattaaatactgcagtgatgacgtcaagctcacaaggccattatcttccctcacagattcgagcgctcgacctcctttgtctctcgatctgtacgcctgcccaagaatgcagacctggcagccatcaaggcgaactacaaggatggtgtgctcagccttgaggtccccaagcatgacgagaaggagattgcgccccgccgaattgccatcaactagagtgttcggcttacagcacactggctggcattgcagccatgcgcagttgtccacatgatcaggccttttccacctcttggcggaagttgtgtatccccgtctgtcaacattcctcagcctcttaccttcacatacccctttttgaaacctctggagttatctaattgaacccttttatcggctgtgaatgcatcatgcttgcaatannnnnnnnnngacctctggagttatctaattgaacccttttgaacagcaaaatacatcggctgtgaatgcatcatgcttgcaataccagtgtaagagatgtagcgcatcatgtcgcatacttaagaccatgttaatggggagccctccctggttaaggcgagcaagcctgcgggcgagcctcagggtgcgagcggaggtgacgaaagcatgcatggctcacctgagcagtgcaccgacaaaagannnnnnnnnncagagccctccatggttaagacgagcaagcctgcgggcgaggcccagagcgcgagcggggctgatgaaagcatgcagggctcacctgagcagtgcaccgacaaaagactccagcaagagtcgaaattgttctcaataaactttaattaccctgtgatctccgccatctacaagcgaatagaatcttgatcacctgttnnnnnnnnnngaattgttctcaataaactttacttacccagtgatctccgccatttacaagcgaatagaatcttgatcacctgttcctggtatggccatcttcgaggacccactgacgggcgacttcccctccagggtaaccctcgatgaggacgaaaagctggcggaaccccatgtgtcccgctactttgttgagccagagtaccaggtagggaatgtctagtcgaggagcaggggggtatgtcgtgacgtctgtcaaacgcatgtcacttgctgctttcccgatggagattggagcaatcaccgtgataccactgcacagacctcacatcgtctcttcnnnnnnnnnnaaatggagattggagcaatcaccgtaacaccactgcacagacctcacatcgtctcttcacatctgatgtgcagtggggaggcgagcctgtccaatgtgacgagctggtatgtgggcgatgggtgccttgtgctgctttgatgaagtcaacgatcgcaagctgcatgcagtgtacaccctccatcgccgcctcccaacccaatgttgtccctccacgcccccagatcctactggtaggggactctgctgctgtcctggcctccactctctatgcagatgcccaggtgggaagggtggtggctgagggactctgaaacagaatctgatgggaagatgatctctgggcactcgttgaatttatggtcgaaatgaattgcaagaattgctctgttggtaccttgctcggaatcgcagtactcggacccctcgcattcacttctatgttcccaaaattcaaccgactcccccctccctgcctccactcagcccctcggcagttgcaccgtgcccagctgccagcccatgccgcacaccaccgaggcagctgcccagcaaggtgatggagacgcagggccgcataccctagcagggacagggccagtagccaaggtgatcagagtgttcctgtggtcnnnnnnnnnngggtgatggggaagcagggccgtgtaccccagcagggacagggccaggagccaaggtgatcagagtgttcctgtggtccctcccggaagcaaggaccacgaccctcgcctccgtgccggcccccctcccagaggagcaggccgacaccctggcgcgctccctgctgcgcacgctgtgccgcgcagggtgcagcgtgcacgtcgcgagcacgtgtcccctgcgcgatctgaggggccatgccggggacgccgcggattcgcccctggtgttcgctctgagcacggcggccgaccagggtgtaggggtgcccgcagcatactcacgggcctggcctccgctccccccgggcatgctcctccagggcnnnnnnnnnncaggggtgcccgcagcagactcaccagcctggcccccgctccccccgggcatgctcctccagggcctgtctgccgcggtgctgacgcgcgggtcgttgcaggggctgcacgtctgctgcctggtgggcgtgcagccaggcccagctccggagacccacctctgcaccgaactggcccgggccattggcagccggaccgggcggagcataacgccgggggtgaggactgccatcggcggcgcatgcgatggcatctaccgctcctctgctgccgcttccatgttcagctgagctgctggctgggggctgggagaggagtcgaccagcaaggttccagtgtgaacgagatcctcacccctctgtcctgaaccgtgctataggttgcggattccatgtgctcgaatttcccaaagccaaaggcccggcatgcagacgcgggcnnnnnnnnnnagatcccatgtgcctgaatttccccaagccaaaggcccggcatgcagacgcgggcacaagggaggtgatggtggcaatgcctgagtgatatcaaagcgcagacgacagcgatgcatctggatggggggtcaagcacggtccctggatccattcaggctgtccctgcacgccgcgcagtccaccagggcgctgtgcaggaggccatcggcatcctgaatgcccagataggaggggaagtagttgatgtccacgatgctccacaggcctgcacaggaggaggcgttgctgagcaggaggcggggatgattgagtggcatcagccctgagctcgcccactctctctcccacctgtcgtgctgcagcacacgaggtccgccccaaacagcatccagcccagcgtccgacgaagtgcagacgcggcatttacggcaatggcatccggtccttgtctggcaccagggtgttgagcccgagaagttttgccnnnnnnnnnngcaggaggaggcggcgctgagcaggaggcagggatgattgagtggcatcagccctgagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtcagcaagcagcctccaggaggtggcctcccctgccacatacactttaagcactgcaccgccaccatccacccactcctgggcaacgcggggcaagggcacgtggcaagcctgcagctcagccgtgctcctcacgaccgccatgacgtgcgcggtaggtcccccgcaggccacctgacggcacagaaggaaggggttgcaggttgtgggtttnnnnnnnnnncaccgccatgacgtgcgcggtaggtgtcccgcaggcctcctggcggctcagaaggaaggggttgcaggttgtgggtttgaggctgttatgtgcccctgcaagggtctccatgcagcaagcaggctgagtgacttccagtcagaacagttcagcgccgtgctgcaacaggcaagctttcgaccagctgtcccaggcagatgcgatgacgagcacgctctccctcaccactcagccagtctcacacgtggtttcactacacatgggaagaagcccgggtcnnnnnnnnnngcgtgctgcaacaggcaagcttttgaccagctgtcccaggcagatgcgatgacaagcacgctctccctcaccaatcagccagtctcacacgtgatttcactacacatgggaagaagcccgggtcgccgccgtcatcgtctgctggcccctccaaggacgcccagcgcagcatgcgcagcccgtcagatagagcgctggcacgctcggcagcatgggccatggcctcacggtctagtgccggacccagggtctccactgggtcgacaatcttggtccccggatggcggcgcaggtaggcccgcacccaggcannnnnnnnnnttcggcagcatgggccatggcctcacggtccagtgccggacccagggtctctactgggtcgacaaccttggtccccgggtggcggcgcaggtaggcccgcacccaggcatgaccgggcccctccttcactccgtcaaaatcgctgagcttgtgcagcaagacgtgcacggggggctgcaggcaggggtcctggcaggggtcaaacgccaggcactgcagggtggcagcgcggccgggaacggcggtggccacgcctggcaagatgccccgtgcctggaaggcctgcaggcggctggctcgcatgaggcatcccacgacgacttctgctgcagggtcccctgccggctccatgctgtggccactcctggacgtcgtcgtcacccagggggccaggcctagagccctgtcagtgtgccatttttactagtactgatgagtacagggaagcnnnnnnnnnngcccacgacgactcctgccgcaggctcccctgccggctccatgctgtggccactcctggacgtcatcgtcacccagggggcaaggcctagagaccggtcagtgtgccacttttactagtactgatgagtacagggaagcaaaattctgtccccgggatcagcaatgatgtgctgggtagcgtgctcagatctgcacaggagtgaagggcaaagaaataaaagggattgggatcgcatacccttgctcccgtctggagcaggcgacttcccactcaagaagacccaccagggttccgaagaagcacgatggattttatcccaacgcaagaattagggaattctgaactattaaatcttctcaactcatcccgcatgcggtgatgtgccnnnnnnnnnncgaagcacggtggatactatcccaacgcaagaattagggaattcttaactattaaatctgctcaactcatcccgcatgcggtgatgtgccctcccgtctgtagagtgtactccggttgcacggctttcgtttcggttcaaagtcgagatggggggtccgacagggagatctctcccgtagtgcctgtgactggaatagatggtcgacacggcagagaacccaatcctcaccaaatgcgttactcacgtctttgccctgtccatctttgcctttatcaatcatgcaagggaacttctcctctctcatccaaccaggccggcaccccnnnnnnnnnngtccggttgcacggctttcgtctcggttcaaagtagagatgggggttccgacagggagatctctctcgtagtgcctgtgactggaatagatggtcgacacggcagagaacccaatcctcaccaaatgcgttactcccgtctttcccctgtccatctttgccttcatcaatcatgcacggaacttgtcctctctcatccaaccaggccggcaccccagactctcatgcacagcgcagcctgggcggtttttacaatcacgaatcctgtgcctgggtctaaaccccctcactgccactgcgtgcgcggggccctcatggccggggacgggtcggccctgccccccggcgtcagcgccgcacacggctgggccgccaccctcgcggaagccagcaggaagtcgtccagcccagactgcagcatcgcctcgatccgggcgtcacgtgcgggcttgggcgctggcgagcagcccgcctgcggcagctccagccgcggccgccgagcctgcccgccgggcgcgggtgtgggctgctgcgccggcacggagccgtcggcgtcctgctgtcggcgtgccgcaggagatgcgccgttcacttgaggggcggggcttccgttcagagccccagccctcattgagctcgattggccctcgggctggcgctgctcgggcggcgggcgcgtcagaccctgggccgagctgaagtcccaggacgtcgcccccgccaccccgcccaggcggcccgacttgccgccgctggccagctggtcaaacaggtctggcgccggcgcaggggtgtggcccgggaagggggcggcaaaggcgctgggtggaggcgtggtgccgctgctggtcgtgggtagagcgctgaagtccagctgcctcagggcggccagggggtcggcgctcgacgaatcggcctcgccgctggttgtcgcggcgccgagcggctccggttccacgctaaagtccatcaggtcgacgacggcggcgggcggcggggcggcgggggcgaggtcttgcggaggcacaccctgtcgcggcgccgtgccaggccgcgggctcggcccaggcagggcgccgatcttcgtgggcgcgcgcccgccgggggcggcccccgccgcccgctcgccgccgtccaccccttcccctcccccggctgcactcccaccggcccccgccgcggcggnnnnnnnnnnaggcgggccccgccgcccgctcgccgccgtccaccctttcccctcccccgtctgcactcccaccggcccccgccgcggcgggcggccactccccctccgcccactcctttttggcatacttgcgccgcacaaaggcctccaggtcggtgagcgagtggcagggcggccggtccgccagccgcgcctcccaataggcgttggccacggcgttgcccgtggcggccatgaaggccacctgcggcgccagccatgtgtccagcgtgcaggaccggacctgggagacgtggaccccaaggccgcggtgcacgcctgcgcagcgcatgcacaggaagacgcccgtgttgatggaggcccaggaggggcgcgcgccgccggcgccgcagtcgccgcaccgcgcgttctcgggccgggccagcaacgcgcgcagggcctccaggttggccacgttggcctccatgctcacgcccttggtctcccccgcccgcgcgacactgggcggtggggtggaggaggccggagcggggtatccgggggtggcctcgccggcaccgccttccaccccctcgcgcccgggcgacgccggaccctcccagctcgggggggaaggccggggagtgcccgccccggcgcgcgcctcggccgccgagtagccgcggtacccgccctcccgcgctttcttctcggccgcctggcgctcctgggccaggcgctctgggtcctccagcagggccacgatcacggcagacctggggtgagtgggttgggatgccgctgtgttgtctggtgttcagggactttggtacaaggagaacccctgccccaggctggccagggcaggggggcaggggctgggggcggagtgactggagatctgtcgctcgcgctggtccagtcagaggacacacagcaaccatcggcgacaccacacccgcccannnnnnnnnnggggcaggggggcaggggccggagtgcctggacatctgtcactcgcgcaggtccagtcagatgacacatagcaaccatcggcgacaccacacccgcccacccccccccacgaacctgtgcctgatgttggccccctggtccttgcccgcggcatccacatacatgaagccggtggacaggactttcagcatgggcatgaggtactcgcgcccagacaccacgcagccctgggagccgtgtcgcagcaggtactccagcacggtcagggcctgcgcgggtggcgagagggtccgagatgatgcggcagggacccagcagtccgtgccatgcccnnnnnnnnnnacaggtggcgggagggtccgagatgatgaggcagggacccagcagtccgtgccatgccccacggggtgtcatggggttgaacactctgaaggcatggaaggtcaaacctgtcccccgtccgtccgcatacagaagggtccaccgcaacaggcatctgatggccacgcagagcgatcatccctgggcatgtaccttgtacacattcctccatcgttcggcggggtaccggaggcgcagctccagcactgccaggatgatggcctcgtcggtggcactgttgtgtgagagccgggccagacccgtcatctgggtgcctgtggggccccatggctcattgcgagtagctgctctagccgccctctccgtggcattgaaggggtgccacctgatggaggggtgcgagggagtgagtgagctggtcaggggcccgacgagccaaccccccccgacgcgtagggacaggttgcgcgaggcgggcacccacctcccattcttgatggccgtcacgtagtccctcagccaggcaccagcgtccttggccgcctcggtcaccgtgccggacaatgaggcgccggggccgggagatgtaaccatgctggtccaaccccccggcgagcacaccggaaggcaggccccaggcttcgagtcgagccctgggcgcacgcttgccccctgaattgtttgagtaaagtgtcttgtgtcagtgcttacactcaggaggagggggctggaagattgctgccgggatctcgacgtggttcgtaaggggacagctcccgaaatttcccgcgcctcccacacttcgccatcgcgctccagcgtgcaaggtgcgactccagcccgcctctccctcgttccagactggccagcatgaatttcccagatcagggccagatattgccagcggtgggttggggaggggggggctgtgtcggcagaggggcagctgcagctggggcagcgccccccgcgagcgcctggctctgggccaggaagttggcgagcaccgctgcccccatcgctgggggatccggggttgtgtaaggcaacctgccgtaaatgggaggatggtggggtggagtcacgtgagatcggatcatggggttagttggggggatccccaccctgtgaagtatgctaccattggcatgcttggctgacaccagcacccccaacctggatgcacacgagtgcggctgcccagcagccatgcactggctgcgtgtggccgcctcatgcacttggacatggcactcggccaggcgcggaggccttgccacgctgagagcagcacccctcgctgcccttaccgctcctgtcctgatcccgcaactacccctccccccaaacaaccagcaaactcacgccaggtactccttgggcctcttaatcttgagcacggagcccatgtaggggatgccgtccagctgcacggccgcggtgcagtccgcaatctccgcaaactcgatgaaggcaaagcccttctcctgcgtcagctggcagccaatgatgggcatgcggcccgggggcggagagcagatgcccgaggccaccagcgcctggttcaggaaggcggtgagctggaagtcgtagcagggcgtgggcaggccgcccacgtacagccggcgctggggccgagtggcctggttggtggcggggggcgggggtgccgcgggcnnnnnnnnnnacgctggggccgagtggcctgattggtggcggggggcgggggtgctgcgggcatgcccaggttggggatcagcttgtaggggtcggtggccagcggcatgttgccggccatgggcagggccagggggttgagggcgggcagggccgccagggagggcggcgccacgcgctccacctcgtagatgggcgcgcgcgtgatgaccacggacggtgagcggcggcggcgcgagcgggagtggcgccgcggcgaccggctgtggcgccgggagcgcgaggacgacctgcagtcacgtggctgtggggtgagaggggggcgggggaagaggggcaagggtagggggaagggaaaagggggggggaccaagggaagggatatgagaggcagcttttataggtcgcgcagggttgtggaatcacccagnnnnnnnnnntcgacctgcagtcacgtggctgtgggatgagagggggcgggggaagaggggcaaggggcaagggtagggggaagggaatagggggggggcaagggaagggacatgagaggcagcttttgtaggtcgcgcagggttgtggaatcacccagccggcaggggcactccagcccctcctcggcacatggccccggtcaggcatgacccccaggcaattccttgagagcaggcatcgacctggacaccctacacacacctgcgcctgcgacgatcannnnnnnnnngaccccaggcaattcagtgagagcaggcatcgacctggacgccctacacacacctgcgcctgcgacgatcacgatcccggctctggctccgacgccgggcgtcccggctcctgctcctcctcctcctgtccttgtcacgactgcgggaccgacgacgccgctccctgctcttgtctctgctgctgtggcgacgggacttgtgcctgtcgtgtgatgaggagcggccgcgctccacctgcttcccatcgtccttgggggacaacgggtcgctaggaccggtggagggaagggggggcggcgacgccccatttcctggggagacaccatctacggcatcaccgggagcaggagggtgctcgtcactcggaggtgcctgagcgtcgggcaggggaggagctgcaccaccatcgtgcgcgacctcctcggcatcgctcattgtgcagcggtcaccctttgggtatnnnnnnnnnntaagggaggagctgcaccaccatcgttcgcgacctcctcggcatcactcattgtgcagcggtcaccctttggatattccactcttcttgacgaaatggcagagggtcagacttcatctctcgcatccgtgcatgcagatctgggtgggatggactgcgtccatattcgcggggtactacatcttcaaacttcgactcgcagacggggcgacgtggtgtggttggatcacccttaagcaagcattatctctgaagtcggcctgactggaggcattgagtcatgccatcctgccctctcgatgcctgccnnnnnnnnnncgatcacccttgagcaagcattagctctgaagtcggcctgactggaggcattgaatcatgccatcctgccctctcgatgcctgccaagccttcgcgactgttgcaggccgagttcttgcgcctcgtcggaaaaggtcgcggaaacctggtcctcccagatctcctccgcctccgatgctatgatgccggtctccctatatccctcagccatctgagcgtgctgtgggtacttgacaggttggtcttggggggtgcccagggtctctgtgtgggcactccttcgcggggttggagctgcaggtctggggaaggggggttcacccactcgaggaggagatgcaagacccccctccagtctcatgcaagcaaggcatgatccttcctgccaccccttgccactccgcgtccagcaatcggagcggcaagttcagcttggagaaattggcccgctttgctgccttgtgccgggagaagagctcccaattccaccattatgagctggaggcacagctgctggggtattgctgcctgcgcatgtggatggacctcacgcagtgccctggaggccagaaacgcttcacgcagtggtgagtggaggggggtaccttgggctctgtttctgagcgatcgtgggtccagggctgtgaggcacctggcttcgccaggcagggccaacccatctctcctccacctccaccccacctggcagggtctcaaacctgacgctggaggccagcagcgaaaggaaacgtttctggaggcacggagcggcccagtatgtgagtctgcatgccatcgaggcactgcatggcttgctccagctccaggtgaggaggagatgcattggggggggggaggggttcctcttggccctgcgtgccggtctgccgacgcaaacagcgagccggcgccgcgcctgcaaccacagcaccgcgccgtccctcctcacccgcttcgccccttgaattggcgctgtacatttgtgctgggccaggtccagcactctaaggcctcgcctcgcctcgtcaccccgccctctgctattcaaaccacaagcacaccaaaacccacacnnnnnnnnnnggccccttgaattggcgctgcacatttgtgctgggccagatccagcaatctaaggcctcgcctcgccttgtcaccccaccctctgctgttcaaaccacaagcacaccaaaacccacacaaggacatgcacatcaacatatttacacccaccgcacgctgcagtcgcaccaggagacctcgctgcagtcctttgtggacctgttgcagcgggtgggggaggacaagcggctgatggagctggcggaggcggggcaggacgactggatcccgctggaggtggtcagggactttgcggcgggactgtacaccggcttcgcggagctcatggccgatgtgtgcccgccggaagaaagcgtggccctgacgcatgcattgtgatgcgctgacgcagagggagaatccgcggcacatggtgatgcctcgttgaatgtcgggtgcagccgggtgtgaagtgctgacccattggatctgtacattagactgcatgcaggtgtgccctgcccttgttgcttgcgcagcatccagaagatctctggcaccaaggataacacacacagaagacggcatatatcaaaagggcgacgtcaagacagcagagccgaaacatggtgatcaggccagtcacatatgctggcctcactcatctgcctcccgcgtgtccagaggcttctctgaatctgcggccccgactcctgcactggacgctgcagtagatgtgggtgggaggggtcagggagaatctttgtgctgacccaacatggcaaacgacaatgnnnnnnnnnnaaaatgtgggtgggaggggtcaggcagaatttgtgtgctgacccaacatggcaaacgacaatggaccgaggaagatctgccgggcctctgattgagaggcatagctacaccatttggggctgggtcatgccctaggcaagcacgacccactcgcccgccnnnnnnnnnncgagaggcatagctacaccatatgtggctggatcataccctaggcaagcacgacccactcgcccgcctctcaccctccccctcgtctcacccacagcattaggggtccggccagcctcagcaccggtgtactcgccctccacatcccgcccgtccctccaccagccgtagagcccgcccgccaggtgctgcacccgctgcgagggcaggacgctgtcgttggtcacctgcgaggtggtatcagtcgatgctgcgcttgagtctgggcctgatgggtgggcaagcgccacaggcagggtccaattcttgatctcgagagcctcaggagggagggctccaacctggatcacaaaggcggggactgtgatcgggctttcaccctgcactcttacgcacccctcccccccccccccccccccccnnnnnnnnnncggaccagaaaggcggggactgtgattgggctttcaccctgcactcctacgcaccccccacccccccaccccacccccccacacacacaccttccaaatggccttcagggagcgggagtccttgccgtaggggaaggaggtggaggcctccatcgtcccaccggcctcgcagtacaggatcagggtcgtgtcctcccccgcagcggccttgatgccttgcaggaactcggggttgaacactgtgggctgcacgccattggccttcatggcgatgaatttgaggacggagcccacgccgttgaggttggacagcgtgaggtactcgaacaggggcacgttcttggaccccgggatgtgggcctgctcgtggaacttggcggggcgaacatccacgagaacggccttccctgacttcacggcctgctcagcctcccggggaggcagggagtcgatgccctggtccctcagactctggatcaggccctccctgcatcagtggttgagggcgaaggggcccattgtgtgtcccggtcaagagctgaatgctgcggtccaatgtgcaagctcatgcagcctcgacacccctcccgtcctgctccccgccactcaccactggatgaacatgccgcgcaccacatgacgggatctggctggcatggacctgtggaaggccgggtgaggtctggaggcgacattgagcccggcatgcctcaatcgcggtgtggtcgaaggaccgggcatggcccgtcctgcgtttgtcatcgccaggctcatggcgacgagaatggctgtatcgtcgagaatgtaatgttgaacgtgttaagaatcatacctcgaagcactgctcgtcactcccgtgtgtccgctcggctgggatcttgccaattatctcccccgcgcgcgctgtttcatgtggacgacgtcgggcactctgtgccgcacatctcgcactaaacgcactacctctatcagatattccttgctacatacgcgggatcttcaacccactgccaacaaggctggatctcatgatggcgaccagagnnnnnnnnnntactaaacgcactacctctattagatattccttgctacatacgcgggatgttcaacccactgccagcaaggctggatctcatgatggcgaccagagctgagatttgtggtgtcaagcaagtggtagttgtggcaccgccaccaggcctgaccctgacatgacttgtgcgtagctggaagagacagcattgtggaccatgcagcttagtcgtggaaaacctcagccataatcacctaatatgtgctgaaagtcatgcatgtgacaatcaagaccgttgggtatggtttgatgctcaagcaggatcccggttcaggcatttgattgctccggtagctttctgagccgaacctcacagggcagaggtgtgtggggctgtagttccacgnnnnnnnnnnttgtcaagcaagtggtagttgtggcgccgccaccaggcctgaccctgacatggcttgtgcgttgctggaagagacagcattgcggaccatgcagcttagtcgtggacaacctcagccttaatcacctaatatgtgctgaaagtcatgcatgtgacaatcaagaccgttgggtgtggtttgatgctcaagcacgatcccggttcaggcgtttgattgctttggtaggttttggagccgagcctcacatggcagaggtgtgtggggctgtagttccacgtagagcgtagaggtcctatggggcttattgccgacacttctctcgtagtgcactggtaataccaccttgatacatggcaatggagtttcatcagtcatcccccaatgctgacacctcatacaggctacagtgcacattgaagggctagttatggtcgaagtcctcgacaaactacggctgagactgcttagatatccgatagtatctctgagggtccaggacgaagcactgtagaagattgccttttgtctccaatgaatctacattgttttcagcgaaagtttannnnnnnnnnatatctctgagggttcaggatgaagcacagtagaagattgccttttgtctccagtgaatctacattgttttcagcgaaagtttatcgcgctctccacagccacagcatatttgggtatcggtgtgattgcatggtgagaatgtatggattaatgacgacgtataggcgtagaggaacggcaccccttgaataatcctgggaaatgaatgagccggcgctcggctgatccggcaccaccgatccatgcatgagcgcgacagatccctcaagctaaaggcatcgtctctcgctcgccctggggacgtagactcgtcatgaattccagattcctccatggcaggccaggctgtctcctggtgcaccctggctcccatacaagaaaagaggcgagactgctcaaggccgcacccatcaaccggcgacgtcaggtttcgtgtacggccggcctagcctcccagctccttccttgggccatatttttcagtcctggagcaggcatcttggcgtatgcggccgtgaggggcggggggaatatcaaggacggcttgagccatgtgctcacccaagtcagccaggggtactttcaaccccaggtcgggggcgacaccatcccggcagcgcagggcaacctctcagatcttgcgggagacgagcctctcttcaaagcactgttcaaatggtgtggcatggtgttattgagggttctgggcttgggcgagcatgctcacagtggtgaccataatgcccagcatgcatgaggctgacccgagccttcaacttttccccaggtttcaagagtgtggaggagtcttcaagctggagttcggacccaaagccttcattgtcgtgtcagaccctgtggtcgtacgccacctgctaaaggtacatggacgagtttgaggcactcaaagccagcaacaatgccgtgctgcggctgagcctctgcatgcctgtgctgcctcgctgggaagtgcggattggacatgtatgcactgctgtgattgctgttggaggtgggcaggggttggcgcgggcaagcgcagcagcttaaaacattctatgtacccccatcaaacctcatcaggagaatgcatacaactatgacaagggagtgctggcagacatcctggaaccgttcatgggcaagggcctcataccagctgactgggacacatggaaagtgaggcgcaagaagatcgttccgggtgagccgacgcccggcgaggcttgggagtggttggggtggggtgacttgacatgttcgggcgcaaaacgccgctttatgtggagtttttagagtcttgtaatctgggtctgattcatatgagcacacctgctccccctatctgcccccnnnnnnnnnntgcccggcaaggcttgggagtggtttgggtggggtgactcgacatgttcgggcgcaaagcgcctcttgatgcggagttttggagtcttgtaatccgggtctgattcatctgagcacacctgctccccctatctgcccccacaacccgcaaggctttcacaaggcgtacctcaacgcttccatggccatgtttggacgttgcacggagcgcatgatcggcaagctggatgcccacaccgcttcggtgtgctggcggtgggggnnnnnnnnnncatgtgcatcgcatacgagcacattgcacagggggttcccatgtgtttgacactcttcccacaaacgccctggtttcttcttctataggcaaatagcaacgacacggtggacatggagactgagtttctgaacctgggccttgacatcattgggttgggagtcttcaactacgagttcgggagtatcacccgcgagtcacctgtcatcaaggtgagggagcgtgaatcttggcaggattgatgtgcatgcacaagtcagggaagcatgcggtcttgacttgggaggaagaacagcgcagcaaggttcaaaagaacgcccagttcagatctcattttgcataggaaaagtcccatgacactaagcctgtgcatacatgctccgctgcaggctgtttacagtgtcttgaaggaggcggagcatcgcagcacattttatttgccgtactgggacttgcccctggcgtccctggtcgtgccccgnnnnnnnnnnaaagtcccatgacactgagcctgtgcatacatgctccactgcaggctgtttacagtgtcttgaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccaagagcgatccaagtcgcctccacatccgcaagatgtgccaacgtcgctctggacccccccccccgcagacatccaggtactgaatgagtgtctggatgagctcattgagcaggcccgcaggatcagcgagcccgaagagatcgaagcgctgcagcagcgggactacagcaaggtgttttgttgcgcgtgtcgtgcagggcatggagcgccatcgcctgatttgggaatgctccagtgtcaagcgtgcaagggggccacatgcgcgacagggttgccgaggctcctcgacgttaatccaatgccagtgcagctgcatggcgtcccatcctgcacccaccgcccaggtcaaggatgccagcctgctgcgcttccttgtggatgcgggggatgctgacctgggtgctcgccagctgagggacgacctgatgaccatgctgatnnnnnnnnnnctgacaaagagcccctcacacatggctgagatccaggccgaggtggatgccgcgctgggggacagccacccaggcaagttgacatggaggtcaactgtgcgagtggcgtgaagtcaggcatggggtctttaaacgagcagtgtggttctcctgcccatgctcctggcagcgagctgggagaggagctgcctcactttgtaaccatagaagtacacacctcaccaacccacccatnnnnnnnnnntggctgcctcactttgtgattctagaagtacacacctcaccaacccacccatccatcgtgcagacctggacgacatcgggcgtctccccaaaacacgagcagcgctggcagagtccttgcggctctacccccagccgccgattctcatcaggaggtaatgagattggctgctgggctcgggggctgcagagtgcaccctacgtgtccatacatgttggcacagagagtgcaaggaattcccatctgacagcgtgacgggaagcgaaggagtatgaccccggccccgtcatccctcgcagagccctggcccctgatgtcctgccgggcggcctgtatggcgacgcagccggctaccctatcggcaagggcgccgaccttttcatctccacctggaatctgcaccgctccccccacctctgggacgaccccgaggacttcaagcccgagcgctggagcgccaagcgtgccagccccatcccggagaagtgggcgggctacgccccccttcaggcagcctccgccctgtaccccaacgaggtggcgtccgactttgccttcatcccctttggtgcggttgtttcgggggaaatgcactctggactgggtgtcatggacctggcaaaggggatttgcagcactgacaaagccgttggctgacagctgggacaggggtggcgtggtgctacccagacgttggggtggaagagtgtccctgtctagtttcannnnnnnnnnactggcaaaggggatttgcagcaacgacaaagccgttggctagacagctgggacaggggtggcgtggcgctacccagtcgtcggggtggaagagtgtccctgtctagtttca

SEQ ID NO: 38373 - DNA, 70 bp, Chlorella protothecoides
cgcgcaaagggcgacggggggttggcggcgacgccgggcagggctgtggacgccctggctcctctgtcta

SEQ ID NO: 38374 - DNA, 88 bp, Chlorella protothecoides
ttgctgcttgacacgtgcccttctttgccacccgctctctgcgatcgtcccactcttgctcgcctccttgtcaagctctgggctggaa

SEQ ID NO: 38375 - DNA, 144 bp, Chlorella protothecoides
gtcatgcggcggtgtgtcgtgtgggtggggacatgccaaacatgaaacacctctaaagtattctcttcacaggaatgtggggtttcagcagcagaccaccaccaggtgacgcaggcaatgacctgccagttcccgcaatccacg

SEQ ID NO: 38376 - DNA, 61 bp, Chlorella protothecoides
tgaataccgcgcggatagggtttggtaggggttctcggtgcactctcgaaaccctacaacc

SEQ ID NO: 38377 - DNA, 166 bp, Chlorella protothecoides
tgggtcggcgtagggaggtgcaccagcctgcgcgcctgcgctgtgcccccggccggtctcttcagagtgacccgagggtcaggcatgcgcatcgttcggctgcggtgcgtcaggacacccctgctcagggacgcctggccccgctgtttccagccctccccatcgc

SEQ ID NO: 38378 - DNA, 73 bp, Chlorella protothecoides
gcacgggcgaggacggcccccatgtcctgcacgctccccccgccggcgcacccgccggcctcctgcttcgccg

SEQ ID NO: 38379 - DNA, 89 bp, Chlorella protothecoides
aaagagaggagggtgcaatgttcggcattcaagtgagtgtccgattcccccacccccccttccttccttccacacccctcgcacctgca

SEQ ID NO: 38380 - DNA, 62 bp, Chlorella protothecoides
ccccccccccccccaacacacacaaaaaaatcccaccagagcggagggtactgaggagcgcc

SEQ ID NO: 38381 - DNA, 80 bp, Chlorella protothecoides
cccatcccacactgtgttgcatcattcgtagtctgccagcaaccacggcccatcccgagagcctctccagttgctgctcc

SEQ ID NO: 38382 - DNA, 61 bp, Chlorella protothecoides
catcccgagagcctctccagttgctgctccaccctccccccccatcacaatccctcccacc

SEQ ID NO: 38383 - DNA, 84 bp, Chlorella protothecoides
ccatccgtgcggccacctggcagggtgaggagggaattgaatgggggattgggcttgcgaacgcaaggctagtgatgctggcac

SEQ ID NO: 38384 - DNA, 69 bp, Chlorella protothecoides
aggtggcagcagctgctagtagtcaccttcagattgaccgagtctgaatatcgaatgtgtggttctttt

SEQ ID NO: 38385 - DNA, 61 bp, Chlorella protothecoides
ccggcggccgccaggccggccgcggcgcaggtcgccccaccagcaccgccagcacggccga

SEQ ID NO: 38386 - DNA, 67 bp, Chlorella protothecoides
aaccggatgctgctctcactcccccgtgtacagtctgctgctgcgatcctggccggcagggcgtgcg

SEQ ID NO: 38387 - DNA, 79 bp, Chlorella protothecoides
gaaatgggcgcaccgttgggctctggtttccatggcgcaggggaaggtgggggtgggaatccatgcgactgcatcaggc

SEQ ID NO: 38388 - DNA, 61 bp, Chlorella protothecoides
tgtgcgtgtcagttagcgtgcaggcttcgtctttgagcgagacaccacctccagtgcgccc

SEQ ID NO: 38389 - DNA, 136 bp, Chlorella protothecoides
ttgagtggagacccaccgacgttacgctctgcagccatacattgttcatcttcggatagtgcaccttcccctgatgaaccaccagactctcaaaagtctgatgcatcggagggggtcagctcagctgcaaagtccc

SEQ ID NO: 38390 - DNA, 147 bp, Chlorella protothecoides
gcacctgggggggggggagggcatgtgtgctgaggccacagggcgcgtgtcgatgcgagggtttgtgcgatgcccgtgcaccggggtgtccacaggcccgccggcttgaccctgacgacccagtccagacagacgattccaacgtca

SEQ ID NO: 38391 - DNA, 125 bp, Chlorella protothecoides
gggggggggggggcaatggaactggagaacactatggcatgtgtcgtatacaaggtagagagctgagcgcaggttccgcatccccccctcactcatcccagagcccctaccattgccagacggcc

SEQ ID NO: 38392 - DNA, 61 bp, Chlorella protothecoides
aaattacaaaaaaaagctcaaaaggtaaaaccacggcgcgggccatcaaaaaaatatagca

SEQ ID NO: 38393 - DNA, 61 bp, Chlorella protothecoides
cagggtgctgactcacagaggcacaaacctgtggtgggtggggcaatcgtttgccgtgcct

SEQ ID NO: 38394 - DNA, 61 bp, Chlorella protothecoides
tggggcaatcgtttgccgtgcctgccctccaagactcccaacgtcaccccaacacaaaccg

SEQ ID NO: 38395 - DNA, 61 bp, Chlorella protothecoides
gtcctgccatgtcaggttcaccagggtcccactttccagctggggagtggcaggggggaat

SEQ ID NO: 38396 - DNA, 126 bp, Chlorella protothecoides
atcgcggggcgggcctgggcgccttggaggccgccgccggcatcaaccccgcccaggtggggaggtgtagggtggttgtcagactgcagccgggtagagctgtcctgttccctcctttctgaatcc

SEQ ID NO: 38397 - DNA, 80 bp, Chlorella protothecoides
accgccgaccagctttcctcccagagaagtatgtgaacgtgccctgctggcatggctgggtgtgaagggaggctttcctg

SEQ ID NO: 38398 - DNA, 61 bp, Chlorella protothecoides
tgcagaacgtgttccgggccaggcggaccgcactcattcaccttgtgtgaaattgttgttt

SEQ ID NO: 38399 - DNA, 114 bp, Chlorella protothecoides
ttgcaaattccctcacattgtcccccccccaaaaattaagcgagtgccctgacagccctactggccgagcgcatccgcacctgcaggaagtgccaatgaggggcggccaggaag

SEQ ID NO: 38400 - DNA, 116 bp, Chlorella protothecoides
gccccaggcaaagcggggcttggggtgtgtgttgttgcatgattgctgctgtgcgtgcccagtactccagcatgagggtgggagatcttgagggactggttgcagcaatgcccccc

SEQ ID NO: 38401 - DNA, 71 bp, Chlorella protothecoides
aattctctgcagggacagaagggctcagatctctcgcattcaaacgtgtgtacgaacatttgcattcgttt

SEQ ID NO: 38402 - DNA, 61 bp, Chlorella protothecoides
cccctgcttccccttctcccgccctcccacaccctctggttcgccgatcgaggcaaccaac

SEQ ID NO: 38403 - DNA, 61 bp, Chlorella protothecoides
ttgagtgagggggcggtagaggcggcagaggggatcacaattctctgcccgtctgctgggg

SEQ ID NO: 38404 - DNA, 82 bp, Chlorella protothecoides
ggcgcccgacctgccgcccagcaccacgactggcgcggcgtcggccccgtttcccggccccaccatgggcttgccctgcgtg

SEQ ID NO: 38405 - DNA, 103 bp, Chlorella protothecoides
cattctccatgccctctcacaggtgacaggatgtcagcaccttgccacggcctctgagctgtgttgcgcttttcagaggcaccgctttcacctggccatggcc

SEQ ID NO: 38406 - DNA, 110 bp, Chlorella protothecoides
gcagcggaatgatcagacatcaccctgaattctacccttgcgtcccctccatcaccaccatcgtgcaggaggcgtcgcacgccacggtggtcccggccctgctgggcctg

SEQ ID NO: 38407 - DNA, 61 bp, Chlorella protothecoides
ccaatcagacccactcaaacacacacaaacaccccccttcccacccacaccgccacccccc

SEQ ID NO: 38408 - DNA, 77 bp, Chlorella protothecoides
gcttatcggcgcgcagacgcatcggccaggggtccccgtactaagccacggattccgcaccttgaagcagatgagga

SEQ ID NO: 38409 - DNA, 78 bp, Chlorella protothecoides
tacgggctcgcaaagctttcagtgcagtgagattcccatcgaacatcttccgccgcgcctcctgtcggtagaacacca

SEQ ID NO: 38410 - DNA, 1009 bp, Chlorella protothecoides
  modified_base (326)..(335): a, c, t, g, unknown or other
  modified_base (748)..(888): a, c, t, g, unknown or other
ggcgccggccgccggcgcgtccgcgcccgccgcggcggaccagcccttcctggcgcatgcgcgctgggcgctgccctgcatcctgcgcacgctggcctgcatccaggcggtgtggtcgccggaggggcgcgccgagctggcccccgtcgccgccgcgctggagatggcgccggcggagaaggcgctgtacctgcggaaggggccggcggggcggggcggatttggcggcgccagggtgaggatttgggttgtctgcttctttttggggggagaaaagagggcgtggagaggctcagttgcccaggcggcagccgctgtggatgcgnnnnnnnnnngttgtctgcttcttttcggggggagaaaagagggcgtggagaggctcggttgcccaggcggcagccgctgtggatgcgcggggggggacagggtcctacatggcgcagccagggggagggggactggaccgactccccgcccgcccgctcccgctgtgacatccgcgtcggggccccaacccccctcccatcccctcaccctctcatcccctctcccccgcccgccgcacaggacccggaggccgcggagcagtcgggcgactttgcatcggtgggcggcgcgggcgtgggcgcgctgcgcggctggctgcgtcacgtgcgcgagtacgggtaccaggcgctgggctgcctgcccaccgcctgccccgcggccctggagattgaggagatcggaagagcgtcgtgtagggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaacaacgcgccaggatgcggagacgcagcatgtgcgcatcatgctgcggcacgtgctgtcgcccctggtccgcgcctgccccgcgcccgcgctgcccgcctgggtgctgggcccgctg

SEQ ID NO: 38411 - DNA, 146 bp, Chlorella protothecoides
gggtggggggggggggggggggcgtgcgtgtgctggggagaaaggggaaatggggggaagacagcaaggcttggggaggcgatgcatcgtgcgtcagccggcggagcggccatgaaccccaagcgcggccggtcggccggtgcaag

SEQ ID NO: 38412 - DNA, 423 bp, Chlorella protothecoides
  modified_base (159)..(360): a, c, t, g, unknown or other
cgcacgctgatggcttcctgtcgggcagcccgaacctggccctgcagctccgcagcctcagccctcgcatcgctcagctcgtcgcgggagcgggcagcctcctgctctctcgcgcgcgacgcggccttcgcctccccctgcgcctgcgccagggcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctccatagaaagccttcagtatgatcccccgccggcagcgcaagcagaccccactccagcc

SEQ ID NO: 38413 - DNA, 93 bp, Chlorella protothecoides
gcgtaccgttttagaatcatccacctccaacccccctcgaccttgccggcaagtatccagcttgaacccaatggcaccttgtgggcgcgaggt

SEQ ID NO: 38414 - DNA, 7157 bp, Chlorella protothecoides
  modified_base (290)..(299): a, c, t, g, unknown or other
  modified_base (481)..(490): a, c, t, g, unknown or other
  modified_base (921)..(1089): a, c, t, g, unknown or other
  modified_base (1394)..(1403): a, c, t, g, unknown or other
  modified_base (1654)..(1663): a, c, t, g, unknown or other
  modified_base (1848)..(1903): a, c, t, g, unknown or other
  modified_base (2205)..(2214): a, c, t, g, unknown or other
  modified_base (2747)..(2756): a, c, t, g, unknown or other
  modified_base (3919)..(3928): a, c, t, g, unknown or other
  modified_base (3984)..(3993): a, c, t, g, unknown or other
  modified_base (4201)..(4210): a, c, t, g, unknown or other
  modified_base (4837)..(4846): a, c, t, g, unknown or other
  modified_base (5768)..(5777): a, c, t, g, unknown or other
  modified_base (6685)..(6694): a, c, t, g, unknown or other
gggatggacgcggggtggggtgggggagagcagggcgtgggagagacttggagtggggccggggaggagggggagttggggaagaatgagggaggggcttgacttcaggcagcacggggaaggcagcagccgcgctcgtcgtgaacaagtttggaccgcagcacagcaggaggacgtcatgtgctgtgggctggcaacgcgagagattccccttcaagcctctgaagccagtcataccgcccagggcacgcactgcgttggtgccactgctcctctggcaaggcgccttnnnnnnnnnngaatgcaagagattccccttcaaccctctgaagccagtcatacctcccagggtacgcactgcgtcggtgccactgctcctctggcaaggcgccttataagtcggggttgcggtgtgttgctacgattgcaggcggtgcacacgcaagtgttgaggagcattgcgcttgcaagggaatggatnnnnnnnnnnattgcggtgtgttgctacgattgcaggcagtgcacgcgcacgtgtcgaggagcattgcgcttgcaagggaatggatcagcagcgcagtgtgcgagcaggaactgcacatcgatcaagcagtgccggcagctcggagtgccaggtctcagtccacgcccaggcctgctcggcattgtcaagtgtcctccattcccttattctagccgcgctcgccatcattcatcgccgtgaggccttgacctccgagtcgttcttggagaaccccatcagccgcccagcagaattctgatacgcaaacaggaacccaccgaaggcgccgatggcgacgcctgtggccaggctggggcgcagcaggttgccggagatgctagcgaacgctggcgacttggaggatcctgaggagggagggagcggagggagcgagggtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagttgttgactgagaggggttgggggatcggggtgggagctcggccacgactatgctcccgggaacgaagcgagggcctgtctggacgcagcccgacacacctcgcactcacccactctccagaattgcggggagctgtccactaccgggtatgatggctcgtcgaggatctttcccatcgcgtcacgggaccactcaggactgtgcgacccgagggcaggtctgggcggtcacacctcagagggataccgacgctaactgcagatatggtattgatttctgctcagaagcacgtaagttggnnnnnnnnnntcttgggtgtgaagtgtatctcctcatatatattgtgctgatctgaaaggcttgggggtgatgtggagggtgaagcttaatgggcattcactagtgccgttgtgtgaccatgccctgaggttcacgaaggtgctacaccattcaacagactaaagacatgtatcctgatgtcgcaaggacagtgtgtgagattgccattcaaaaaaggaggcttacgtggtgtgtcgacgctctgttcaatcgtcatgccnnnnnnnnnntggaggacccctactaccaaccaaagtgcttcccaatggccgaccgtggacccacccgctaggagaccgacaggaattccgaggcccgacagcagggcccagctgccgtagtcggacaagctaaagttgttgactgagaggggttgggggatcagggtgggagctcggccacgactatgctcccnnnnnnnnnnnnnnnnnnnnnnnnnnnnnnnnnnnnnnnnnnnnnnnnnnnnnnnnccaccgacacaaactgcagatatggcgttgatttctgctcagaagcacgtaagttgggactgggtgatgtatttgcaccgtttaggggtgggaaggttgcctacctgaacatcgcacagcacgcagagcatgagaactcacactatcaatggggagccgactgcagggatcagagaactgtcaccacaaaagaatattggtgtccatgcagtgttggtggaatatctcgtttgggcaatgaattgatgaaatcagaattgttgttcaggcaagtgctgttggttgaacttggcaccgccctnnnnnnnnnntgcatagcacgcagagcatgagaactcacactgtcactggggagccgactgcagagatcagagagctcgcaccacaaaagaatgttggtgtccatgcagtgttggtgcaatatctcggttggacaatgaattgatgaaatcagaattgctgttaaggcgagtgctgttggttgaacttggcaccgccctgccaaagcaaccgtacctcctgcttgggtgtgaagtgtgtcttttcatatatattgtgctgatctgaaaggcttgggggtgatgtggagggtgatgctcaatgtgcattcacgagtgccgttgtgtgaccaggccctgaggttcacgaaggtgctacaccattcaacagactaaaaacatgaatcctgatgttgcaaggacagtgtgtgagattgccaatttgaaaaggagtcttacgtgatgtgtcgacgctctgttcaatcgtcatgccatactattccctcagaaagtgaatacaaaacgagtttctccatgccctccaattgaccccggaatcgtaaggnnnnnnnnnnctgaatacgaaaggagtttgtccgtgccctccaattgaccccggaatcgtaagggcggggctcgcgccgtggtacccattggccgcccagaagtgcaaaggcacctgggcgacctactgccggccccttcctacgttggtttgacctgttagtgccttcccggcttaatatctttcaggcaaccaacatgagccgctccgagctcgccgtggtgtacgccaccctcatcctgaacgacgacggcgtcgaggtgtctgtgagtatggcccaagcccggagcattgctggcgtcggaaggacatcataagagcgtcttatttgcgttgcgtccaggatccttcatccctcgcctcacctctcccccctcgcaggccgagaacatcaactctctggtgcaggctgccggcatcgaggtggagccctactggccctccctcttcgccaagctggcccagaagaagagcgtggatgatttcatcatgaacgtcggtgccggtgagtgccgttgattgtcgggagcgcggaacgcaccttcgttgtggccagcgaggatgctccaccgggtcctcctcacccaccgtttcaacccgctccactttgacccattctcaggtggcggtgccgccgctgcccccgccgctggtgctggtggcgcggccgctgctgaggcccccaaggaggaggagaagaaggaggagtctgaggaggaggatgcggtgagtggctgcagggccggtgcagcatgggtgttttcatggcctctcgcctgctcatgtcatgccaaggtgttggaaggctcacgtcccttcccccgtgccacccgctgcaggacatgggtttctccctgttcgactgataaccttgctgctgtaccatgtggccggtgttgtaacctcttctttgagagcagtctgtgcttgcggtacacaagggaggcacgcagctggcctttgcgagactgcatcagcgagtctaggtgcaggacagcagccacaaagatgtttatgaggggattggtgagcaacagagaaggtcagcgaggcctcaggtcagccttcacgtggcgactggggatctcttgccagggcgtgttgcagtcgttcacgccaggagcaacttcacctgctccagggtcaagaacatgaccacattccagctgcatnnnnnnnnnnaaggcctcaggtcagccttcaggcacacgtggcgactggggatctcttgccagggnnnnnnnnnncgtggcgtgagggacagtgtgaagcggtaggggaggcggggggggggctcggtgagcggcgatgtgcggctgctgtccctcacccaggccaagggatgctaaggggacactttccagacagatagtcccagcctgcccactcacgttcccagccgggcaaagttgggcccaaagccgttgtagaaggccaggggtccgtcggtcttgnnnnnnnnnntgtggcgtgagggacagtgtgaagcggtaaggaggtggggagaggctcggtgggtggcgatgtgcggctgctgtccctcacccaggccaaggaatgctgaggggacactcttaagacaaatagtcccagcctgcccactcacgttcccaaccgggcaaagttgggcccaaagccattgtagaaggccaggggtccgtcggtcttgaatgtcttcacaaaagtgtccagcacgccagagtacatgccgggtgcggcgccttttatggggatgtaagggaagttgaatgggatgggtggcatggacggcctggcgcggcacctccagccgtgctggcgctagctcccatgcaggcgggcgctcatccaggacctgggtttcctcccccacacaccgccgggccgctgcgagggacacaaacgatgaatgactcacccatcatccgcgacttgacgacgtccaccggagacccgacacacaccgcgaagaagccggcgcccaggccggaggcgatgtggcaatacacgttgtccttgaagagacctggattagcaacaaaggggaagaataggatggagtgaggcgctgccatgttctaaatgcatgacctggggaagtcaacaccaccnnnnnnnnnngtacacgttgtccttgaagagacctgggttagcaacagaggggaagaataggatgggagtgaggcgctgccatgttcataatgcatgacctggggaagtcaacaccaccaggtggccgcctggtcacacccaaacctcgtcgacacagccaaagcccataccccttagctcccactttcccagaccccacccgacgccagcagcttctccttgatctggtcgtagctggccagctcggcagcattcacgatggcgtttcgggccatgtttggccccaggcctgtccacagcgcgcgcacaccctcggtgcgggcgatgatgccataggccgcaaaggcgccggggtagcgcggcttctggccgggggccagcttcttctcggcttgcatgcggacctggcgtgggcgaggcaggggtggttgattttggcatgtgggtgtggaatataaagtgcttgtgggaaggtcttggatgttaaactgcatctccacctgcagccaccatgcccaggttcccttctctcaagtccagagtttcatcatacagcacacttgcccgcagtccaagcaaccagcccaagcctccggcgagaaagggagcgcaccttgacgaggtccgttgggttggcgacggcgatgcccagcgcccccgtggtcatcccagccgcaatcttggtgagcaggcccacctctcccacatggtccttgcccacgaagagggacttgaccgggtcgtacatgccgatgcgcaggcccccaaacaggacctggcgctgcaagcctgcgcttatgtgggaaagggaagatggatggccctggggacactgctgccgagcaccgtgggcgtggaaggctccgaagctaggctttcctgctacctgaaatggcaattcctttccttgtccccctcccagcatgactcnnnnnnnnnnacttatgtggaaaagggaagagggatggccctggggacactgctgccaagcaccgtgggcgtggtaggctctgaagctagactttcctgctacctgaaatggcaatccctttccttgtccccctcccagcatgactcaccaggcccaaggcccttatatagggacttaacaccctgttcccttgccagcgtcagggtcgtgccaatgaggcctctgcagccaggcgggaagaagtggtgaggaggagctgcacagcaggtctggctgctaaagatctgccaccaaacaagcctcagctttactcaacggtgtgacatctcctctcagcatccatacgacatatcatactttcaacccagatcaagtctccgacacccacttgtaatggggggtcgcgctctttggctgcagctgcagcgtcaccttggcggtgtccagggggatggaaatgatctgcggcggatgggacgtttgaagtctgtagggtggtaacagcacaccggggcaggctagatggacgatcactgcgagcgataccctgcataactccatcatctgggagtgcgcacctccgcagtgcacgcggcgactgcactggcgaagaatgtcttgtgcagggggaggttggagttgctgggcggcgacatgatcgatgacttgcgcccttacccaaaagtatttcaccctacaaagacatggatatactgtacatgttaatattccggtggtcaatgatcccctctgtcgactgcagtcccaagtgagcacgtttaggcccgcggtgttgaacgctctttcctcgcgcgcggcctcaacaacaaatgctccggaatccatgctgtgctggggaacacccaccccatttgcgagccaatcgatcctgcgcaaattggaaacaagagagcatnnnnnnnnnngtgctccggaatccatgctgtgctggggaaaacccaccccgtttgcgagccaatcaatcctgcgcaaattggaaacaagagagcatcttgtaaacattcaagggtggccttctgggtggtgggatctgtgtgtgcagccggtgttcatctcgtaacccatggaccccccgatcaagggccctggggccacccaggatctcacacaggagttccggacccagaccagggggatacattccatctctgatgccctggtgaacgcccgcctcgtgttcctcctcgctgaccggaccctgtacgggcgcgccctcacctgcttctacctagtgcacaagcagctggacatcagcctgcatgccgcggcggtctccacgtccaatacaggtacctgggcattggagtgaaatcccctgatctcgatgctcctgggagtcgggccccccacccccccgttcccccacca

SEQ ID NO: 38415 - DNA, 691 bp, Chlorella protothecoides
catgtaattattctccttctagaagttaatctggggaggccccaggcctggagggactgtcgattgtggacttgaaggccgtgccgacggcggacgaggggaatccggaggcacgtctactctgacggcagcgggacaatagccctgagccttttcatgtcttcgaaaggcccaatttacaagggtgctggtgtaaggacagcctgtgggccgccaatgcgtttctgcagcatactcggtcagtgcaaagcggctcccctggtctccggaaacgccttgttttctagttttaagcgcacccgatgcggactacagccgattgacgtgtcttcagtctcaatgaacttgcgccatgaagaaatcagccttgcaagagtcgcacatccgaccggctggcactcagtggtgagacacagcaacaggggatgccacggtcaagtaatcacgggctctcgcgaaattgccagcgcgaatggcactcatagccggctccttcccactagaaacgctactcaaggcactcatgggggcagtggtttctgtggcatgctgctgtgggattcatacccgtgcacagctgctgcaaaagtacgagcaccctcaaagctcccgagcattacacacatccattaaaggaagttctcttcgattatacatcaaatcgatgtcatggattcatcacagcatcacg

SEQ ID NO: 38416 - DNA, 66 bp, Chlorella protothecoides
agcgagcgcagccgcctcctcctcctccagcgtggactcgtcgtcggcgtcgtctgagtccgcgcc

SEQ ID NO: 38417 - DNA, 102 bp, Chlorella protothecoides
ccatcaccaagacaagcaaccccacgccctccacacctgcctcctctccccttcgcgcctccatccctgcgtcctctccgtccccggcggccagccctgcgt

SEQ ID NO: 38418 - DNA, 154 bp, Chlorella protothecoides
cgactccaacggctgcatcgccgacatcctttgcaccaaccagaagaacttcaccctggtgagttattctcggggggaagggggggggttgagggtgtgatattccggtgccaagggagacattgtgtgcgcatcgccgaccgcgcctgggcgt

SEQ ID NO: 38419 - DNA, 98 bp, Chlorella protothecoides
tgtggccctggtcagccttgcagcaatgaatgtatgccacatcctcctgtacccccacccacccccgtatagacggagacagagctgctcaaggagca

SEQ ID NO: 38420 - DNA, 61 bp, Chlorella protothecoides
tcaagttgccgtcatcctcaccaatggcacgctcaccgaggaagttcaaggtcctgagatc

SEQ ID NO: 38421 - DNA, 61 bp, Chlorella protothecoides
gcaacgtcatcccgacaaaatccgctcgagtgctccgacccccctgcccaaggccatccca

SEQ ID NO: 38422 - DNA, 63 bp, Chlorella protothecoides
gatcggagagaccggatcagagcaaaagacgacagacatgtccgtccgtcctgtgacccactc

SEQ ID NO: 38423 - DNA, 120 bp, Chlorella protothecoides
aattcctgcaaaagggttctcagtagctggtgccagctggatgccagcaaaggggttcgcaggggatgctgggactgcagcgcctgcagagccctgggctggtcgtcgtgccttgatgat

SEQ ID NO: 38424 - DNA, 175 bp, Chlorella protothecoides
ctctgggtgccgggcgagcaaagtgtcgcagagctcgcaagtttgtgctctggtcacgcgttgggatcctggaatgcctcgaataatagtacagaaggaattataattctgcagtggaccatagttcccaatactgcaccatgcgtgcctcacagccaatgcttgacggtcgggg

SEQ ID NO: 38425 - DNA, 78 bp, Chlorella protothecoides
ggggtggagaggtgagaccctggttgctgattaggccacaagttccactaactagagctcaggctgctcacggtggca

SEQ ID NO: 38426 - DNA, 62 bp, Chlorella protothecoides
acagtgcacaccgggcgagcaccgcagcggcccgctcgtcaccagggccaagggtactgcca

SEQ ID NO: 38427 - DNA, 70 bp, Chlorella protothecoides
gatgcgtgccacaatatcttgagtagaccagtcccccccactggacgccctcagccccaaaccccaatca

SEQ ID NO: 38428 - DNA, 423 bp, Chlorella protothecoides
  modified_base (116)..(322): a, c, t, g, unknown or other
atctgggcaagggtggggatgcacggagtgaatgcagggatcagggggtgtgatatcgcaagctcccaagaatggacggccaccaccgctggcttccgtggcagtcacggccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggggaaagcggggagcgacgagggccgtggggtgcaggcgatgccgcggagcaggcgcgtgccatccgtgcattccatgccccaaagcgtgcagcctg

SEQ ID NO: 38429 - DNA, 61 bp, Chlorella protothecoides
ggtgcgaatggacccggacttgctgaagccgttgtgcctttaatttgtggagggtggacgt

SEQ ID NO: 38430 - DNA, 65 bp, Chlorella protothecoides
tcaaacctcccgccctcaaacctcccgccctcagccctcccgcccgcatccagcccggcgcagcc

SEQ ID NO: 38431 - DNA, 79 bp, Chlorella protothecoides
ccctgccagcagtcgccggtccagggccgcggccgcccgtcggcaggcggccgggaatggggcggcctcccgcctggcg

SEQ ID NO: 38432 - DNA, 61 bp, Chlorella protothecoides
ttgggcactcgtccacgaagacatcgatgacgatgtctcccttgctggtctccaggatcac

SEQ ID NO: 38433 - DNA, 63 bp, Chlorella protothecoides
cgtgaggggtcacaggatgagcgttgccagagtgggtggagggccgagcagggcagggcgagg

SEQ ID NO: 38434 - DNA, 419 bp, Chlorella protothecoides
ccccccccccaaatacacacattgcagcagggcatgcagggccgcttcagcggccgcctggagacgaaggaggacgagaagcggctgacggacgagtgcgcgcgcatcggcccgctcctgggcgccggcggcgagggcgaggggtcgcacggcacgctggccaagatcgtgcgcggcctagccagcggcgagatccgcgccgcgctggaggcgcgcgagcgccgctaccaggagctggaggagcgggtggcgctgctgtccggcggcacggcgggcgcggtgtcgcgcctgcaggaggactgcaccagactgcgcgccgagctggacgggcgcgacgccgcgctgcaccgcctggagatggagctggccgcgctgcgcgacccgggcgacgccgcgcgggccgcaggggcgacggcggc

SEQ ID NO: 38435 - DNA, 113 bp, Chlorella protothecoides
cccgtgactgctgcccgccagcgctcccccgattgcctgccccatctcaatgccctgacccctgcggcgccacccttgcagggccttggcgccgaggctggcccggcgaggca

SEQ ID NO: 38436 - DNA, 122 bp, Chlorella protothecoides
tccatgagggtctcctcggcccagacctccgcctcccctgcatccgcactggcagccttcgagacaccgcccggcctggcacagctccgcttgcccatcacatgtggcttgaagggctcaca

SEQ ID NO: 38437 - DNA, 64 bp, Chlorella protothecoides
caagacccggctggacagcgaggacgagggagaagagggggaggaggaggctgagctggcgctg

SEQ ID NO: 38438 - DNA, 124 bp, Chlorella protothecoides
cccccccccaccccccaccctctgttccagacgagtctgggccggcgacaccggaaactgcctggtaagcctcctggccacgggaggcccacccgtctcgttcgctgccttcaccccgaacgac

SEQ ID NO: 38439 - DNA, 73 bp, Chlorella protothecoides
cggcgtgtacctgtacgccaaccagcagggctgcgacggcggccgcctctactacgacggctgcgcggcggcg

SEQ ID NO: 38440 - DNA, 114 bp, Chlorella protothecoides
ccatcccccgctcctgggctgctccctgcgcaggtgcggctcatcccccagcgccccggcatcgccttcgtggagtttggcgacgagcggcaggcaggcacggccatggtctcc

SEQ ID NO: 38441 - DNA, 61 bp, Chlorella protothecoides
ccacctggctgcagctggtagcggatggaggggcgtggggaggctgccagctcgtcaaaca

SEQ ID NO: 38442 - DNA, 124 bp, Chlorella protothecoides
acaaggagaacagcatgcggatgctggttgcacaagatggcctcacttgggttttgagtttccatcatgacctctgagtgctgaggatggagatcctgcacctcggcctaagcctcccagatcc

SEQ ID NO: 38443 - DNA, 82 bp, Chlorella protothecoides
gggactgcggtctggctcgccgggcagcggtgagggcgtgagggccctgggtgcggactatgcggagtgggagcaggagctg

SEQ ID NO: 38444 - DNA, 121 bp, Chlorella protothecoides
gacagcctcaccggcttgggcgaggcatctcgactcgtgagcattcagtgttgtgttcccagcccaagctatgtggagcatgctcgtagccaggccaaaggcagtcaaacctcactgcaac

SEQ ID NO: 38445 - DNA, 61 bp, Chlorella protothecoides
tgtggcggctcaaacaggagagttagggggggggggaggccagcgctctggattttattgt

SEQ ID NO: 38446 - DNA, 70 bp, Chlorella protothecoides
tgcagcggtcccactatgatcagactggcaagatcatcaagacggccgaggaggagttcatggacagctt

SEQ ID NO: 38447 - DNA, 65 bp, Chlorella protothecoides
tcctgcatggatgtcgtggtggaggggtcggtgggtcttggagatgtatcctgtcgcccctcctg

SEQ ID NO: 38448 - DNA, 61 bp, Chlorella protothecoides
ctacatgaagttgtcctgtggcaagcggaggggggcagggtgggatgcgggtgagtgcagg

SEQ ID NO: 38449 - DNA, 74 bp, Chlorella protothecoides
ctcctgcattttcactctgaccagtgcatatatacacatgatctggaatgtattattccatcccacatggcagg

SEQ ID NO: 38450 - DNA, 61 bp, Chlorella protothecoides
aggcgtctgccgatggtgttcaagtttgtaatgtcaagctctcagattatcgacaaggttt

SEQ ID NO: 38451 - DNA, 61 bp, Chlorella protothecoides
cgcccacgacgacatcactgctctgctcccacccctgcctgtcctgctgactattcctgtg

SEQ ID NO: 38452 - DNA, 61 bp, Chlorella protothecoides
ctcgcggtgctgcaccagcaggcccgccagcgcggcgtcgcacaggcgcgccagcgtcccc

SEQ ID NO: 38453 - DNA, 77 bp, Chlorella protothecoides
gcctcccagcatcacggcctgcgacatgcattggcagattttgatcaagtcgccgcaccgctgcatgcatgctgggg

SEQ ID NO: 38454 - DNA, 66 bp, Chlorella protothecoides
gggggggggggtattactttacactgggagcctccctttgacctgggactccatctccggccctgc

SEQ ID NO: 38455 - DNA, 21702 bp, Chlorella protothecoides
  modified_base (238)..(247): a, c, t, g, unknown or other
  modified_base (423)..(452): a, c, t, g, unknown or other
  modified_base (788)..(797): a, c, t, g, unknown or other
  modified_base (909)..(918): a, c, t, g, unknown or other
  modified_base (995)..(1004): a, c, t, g, unknown or other
  modified_base (1713)..(1722): a, c, t, g, unknown or other
  modified_base (1947)..(1956): a, c, t, g, unknown or other
  modified_base (2578)..(2833): a, c, t, g, unknown or other
  modified_base (2927)..(2936): a, c, t, g, unknown or other
  modified_base (3320)..(3329): a, c, t, g, unknown or other
  modified_base (4981)..(4990): a, c, t, g, unknown or other
  modified_base (6380)..(6389): a, c, t, g, unknown or other
  modified_base (6581)..(6590): a, c, t, g, unknown or other
  modified_base (7144)..(7199): a, c, t, g, unknown or other
  modified_base (7742)..(7751): a, c, t, g, unknown or other
  modified_base (8199)..(8208): a, c, t, g, unknown or other
  modified_base (8389)..(8398): a, c, t, g, unknown or other
  modified_base (8576)..(8603): a, c, t, g, unknown or other
  modified_base (8746)..(8755): a, c, t, g, unknown or other
  modified_base (8999)..(9008): a, c, t, g, unknown or other
  modified_base (9266)..(9275): a, c, t, g, unknown or other
  modified_base (11240)..(11249): a, c, t, g, unknown or other
  modified_base (11543)..(11552): a, c, t, g, unknown or other
  modified_base (12010)..(12019): a, c, t, g, unknown or other
  modified_base (12554)..(12563): a, c, t, g, unknown or other
  modified_base (13183)..(13192): a, c, t, g, unknown or other
  modified_base (14627)..(14636): a, c, t, g, unknown or other
  modified_base (14788)..(14797): a, c, t, g, unknown or other
  modified_base (14989)..(14998): a, c, t, g, unknown or other
  modified_base (16515)..(16524): a, c, t, g, unknown or other
  modified_base (17036)..(17177): a, c, t, g, unknown or other
  modified_base (18165)..(18174): a, c, t, g, unknown or other
  modified_base (18694)..(18703): a, c, t, g, unknown or other
  modified_base (19424)..(19433): a, c, t, g, unknown or other
  modified_base (20692)..(20701): a, c, t, g, unknown or other
  modified_base (21175)..(21184): a, c, t, g, unknown or other
ccggacctggaggcgctggagggcgcgcggcggcggggggaggaggccgaggagcgcggcaaggcgcgtgcggccctggccgcgggcctagcggactcgctggcgctggcacgggaggagagcgcgctggcctcggcgcgctgcgacgcggcggaggccgcctgccgggcgctgcgggaggagatggtggggctgcacgccgcgctagccgaggcggagagggggctcgaagagggcnnnnnnnnnnaacggagctgcgcgccgcgctggccgaggcggagagggggctcgaagagggcgagcgcacgcgccggcagctgcacaacaccatccaggtgtgttttgatgtgtgttttggtttggtgtgtcttcctttggtgagtatgtgtggtgtggtgtgtgtgtgtgggggggggggggggnnnnnnnnnnnnnnnnnnnnnnnnnnnnnnagttggagagggtttactacaagctgcttgcgcctttaccggccaggggtgctgaggcatgcagccctgatgctggggtggggacgcataagccaccgttatctcgccctcgacgccgctccagccacgccgacaccgtctcatgcaacctgcccatccctcccacaggagctcaaggggaacatccgcgtgttctgcagggtgcggccccccagcggggaggatggggcctccagcatccagatacccgcaggcgaccaaggtgggtgggcccctgcatttgcatgttttccagtgggcctgttggggagatgtgagtcacaggcagcgatgcannnnnnnnnngggggcctccagcatccagatacccgacggcgaccaaggtgggtggccccctgcatttgtatgttttccagtgggcctgggggggagatgtgagtcacaggcagcgatgcannnnnnnnnncctacaatgcacccccttctcacccggggcccgcccccccccaataaaatcatcacccccaggttcggagctccagnnnnnnnnnnggccaccaggcaaggctggggttcaggggtattgctgcccgggggacaccaggctcccggtcttgtatgctcagggctatacagcgcatgtctcataagccccatctcccactctgcaacctgtgccaccctgtgatctacaatgcatccccttctcaccctgggcccccccccaattaaatcatcacccccaggttcggagctccaggtgacgcacgccgccgcctcaggggccgtccccgccacccacaccttctcctacgaccgtgtgtttggcccggcggcccggcaggaggccgtcttccaggagatcagccagctggtgcagagcgcgctggacggctacaacatctgcatcttcgcctacggccagacggggtcgggcaagacgcacaccatgctggggcgggcgggggaggagggcattgttccccgcgccatgcgccagctgtttggcgacggcgaggcgctggcgcgccggggctggcgctttgccatggccgtgtcggtggtggagatctacaacgaggagctgcgggacctgctgggggccaggctgcccccgggcaagaagcacacggtgaggttttggggctgttgttttcatgcatgagggtagggacgaggggcatggggatgagggaggggtgaaagggggaggggtgaaccctggggattgaaggggcgatgcggggcggcagtcacggannnnnnnnnngcgaggggcagggggatggcagaggtgtgaaagggggaggggtggaccctggggatcgaaggggcgatgcggggcggcagtcacggagctggctctcgacctagcaggacatgtgtgaatcggctgctggtgctcaaaccaaatacatgggccacgtgctaccacggttcgttccatcctcctcctcgaccccatgaaacactgcagatcagccatgacgccaannnnnnnnnntaaatacatgggccacgtgctaccacgttttgttccatcctcctcgaccccgtgaaacactgcagatcagccatgacgccaagacgggggccaccagcgtcagtttcctagaggcagtgggggtgggcagcgccgaggccgcccagtccctgcttgagcgcgccacgaagcaggtaggcatgggctggaagatggtgacagcagggcaatgggagggagggggaggtggtgggcatgggcgctcgtggcctgcgcctggtgccgatagttcgacgcgttgatggcaccgccggccctccctactggtgattagcctgctgacataggagttctgggctggaaacccatgatacatcccccacacccacacaaccgcattgcagagggcgatcggctgcaccgcgatgaacgagcactcctcccgctcgcacatggtgttcatgctgagcattacggggacaaacgacgagacggggcagacggtccgaggtgaggccttgcgggcggggtgggatgggcggcgcgcatcgctgtggccctgcagggtgtggtgtgtgcggatgatggatgccgactggtttggaatgtgtaatcacctggcctctttggcaagcctgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgaggacaccacgccgggcgcccccatctgccttgttcaacaccacacaacccccaaaaaactcacaacactccatgccgccggcacaggcnnnnnnnnnnggggatgggcggcgcgcatcgctgtggccttgcagggtgtggtgtgtgcggatgttggatgccgactggtttggaacgtgtgatcacctggcctctttggcaagcctgctccctgctgatacgcccactccaggccagctgaacctggtggacctggcggggagcgagcgcttgtcacgctccggcgtcgagggcaagggcgtcaaggagacgcaggccatcaacaagtcgctcagcgccctaggtgaggcgggaggatggagttggcaggaggaggaggagtggggatccggtgtaccagatgcttcatggcttgggggctccagggagcagggaggcacccctgacccaacgcacaccctccagcctggtgcatgcggctgnnnnnnnnnngtggcttgggggttccagggagcagggaggcacccttgacccattgcacaccctccagcctggtgcatgcggctgtccagcatgcagaagggcgcgaggacaccacaccgggcgcccccgtctgccttgttcaacaccacacacccccaaaaaaacctcacaacactccatgccgccggcacaggcgacgtcatcgcggcgctggtgaacaaggacacccacgtgccgtaccgcaactcccgcctgacccacctgctccagggctgcctgggcggcgcctccggcaaggcactcatgctcgtgcacgtcgcccctgagcccggcagcgcccaggagacactgtgctcgctgcgctttgccgccaaggtcggggcggtggaggtgggcaccgcgcggcgccaggtggcggccgcccccacgtgacccccgccgccgctccgtcacccccgtgaaaccccacccacccgactgactcgcgcggcgctccaccgccccgcccctgaccgccgtgcccgcctttcacctgaccacgcacgccgatgttgacagacatgggaacacatgctacagacgcacggccggcagttcatgggggggagctggatggcacggcgggcaccaggcacgccgccaggtcactcacagctcgtcgcgggcggcgctggcgtctgcttgctcgtcgcgggcggcgctggcgtctgcttgctcgttctggaccgccccgccaccccaaacctcgtcgtcaaggagcggcgcgccggatggcagccctgccgcggcctcgtacgccgcgatgtcgtgacgcagcgggcgcagcgcgggcgccagccagggtgcgaagcggcgccaagcgcccacggcgcgggcgtgcagcggctgtcgcacctgcagcgcgctggccgtggccacgctgcgtccctggctggcgtggaagcccagcacggccgggtcccaggccaggccgcaggcgcgcaggaggccgcgcgacgccacctcgccgtcccgcaccacgtcctcgtaccgcaggcggtacacgcggccgggggggagcacccgctcccatagggccatcaccctctgggtctggatgtgctggtccacgatgcctgcgttgcgcagtggagggaggggggaaggagggagggaggttgaaagagaggaacagagcttgggaccgggaaggcgccaagccaagggaccagcctctctgggcaccagagctggcagtgcagcgccgatggaggctggttgcacagagtctctccaagcaggagccatagactgcacaaccgaaatctcaaagttccagtacacagcctcgcatcctccctctcccgatcaaacacacgcacgggtgaggttattagcccagaggatgccgcgccgttcaaaggactgggcgaagcaggagaggacggtgtcggcggggtggcgctccacgtgcacgatgcaggcgttggggaagagcatggagatgaagcccaggttcctgggggtgcaaggaatcgaatcaagttggagaaggagatattagagaggagagcagtttgaacattacaaggcaatgaggtcccattttgttgttcaagacatgagctcctcgtacaccttcattttcaagccccccaccagctccaactgctggctcaccnnnnnnnnnnaagagagaagagcggcttgaatattccaaggcaatgaggtcccattctggtgttcaagacatgagctcctcgcacaccttcatatccaagcccccccaccagctccaactgctggctcaccatgagttgaacagcatcttgtccacgatgtgggtcacgttcttcctagactgtggtacccttgaccgcatggcatccaggtaccgtcgagcgatcgcctgcaccttctgcaggtacgacggggagagcatggtgagctcaggctcacgcctctgccactggcaccatgcaggcgatcaacgcttgtgctggccgggaacaccctctcctcccatggtccccgacccagacaccaatctcctcccacaaacaaaacaatgcaccgcacccctaccctggatccggggcggagccagtcgcccgactgcaggacggccaggaggtcggggaggagcggggccagcgcgccgtcctcccctgcgccccacacctgagggtgtgcagccaggatggcctctgccaggctgctcccgctgcggggcaggcccacgatgaagatgggggtggcgtcctgcgtgccccgggcaccccggaccagggctcgccatgcagcctgctgcgggcccgagccagtcgcctggcctccaaacaccgcggtgagcgtctgcgaggcgggggcggagggggacgtttgggcgccgagggcatgtagtggaagcgcccttcaccttgccacatggggttaggggacgtctcatttgtggtgagcatgcgctcgagccctgccggctacgcagcgcacaatcaacctgtgtgagagcagcacaattgcacctggaggttggaggccaggttgccgtcgccggcgtcctcggaatcctgcagcgagttggcctgctccaggtgccgccatgcccgctcgtacgccctggcatgcagggattgaacggggagggtggcaggcgatggcgtgggttcccaccagcttggcagcaatgacactcttcaggccaggccatgacccagagagcatcccattgcccacctctcaagttcctgcagtctaaagccccgcccgcagcaagcacccagatgagagcggcgtacccttgctcccgatgggccctgaagagggcgtagtgtatccaggcgcggtcgtaggcttccagcccggccagaggccctcttgtagggctgctgtctcccaacggacccgccacctcctcaaaagccgccgcatccgcggccgtgtaggtcggcagcgccgccgccgcctggcgcatgcattagggtgtgggggttgctgaaaatccagatgccctgtgcacgccactcagcctgcatggggcttcgcaggcgggcggtccaggcacactacccatgcattgannnnnnnnnngtgctgaaaatccagatgccctgtgcacgcccctcagcctgcatggggctccgcagacaggcggtccaggcacactacccatgcattgagccctcgcactgcatgcagaggggctgaggagggcggctggcactgcagggagcaagcagctgcatccccggcggtcaccaggcatcgcctcaaggttcaacnnnnnnnnnnaaggagggcggctggcactgccgggagcaagcagctgcaaccccaacggtcaccaggcatcgcctcaaggttcaacgcaccacccccgaggtcctctttacacaacaagcaggtgacacgcccaccgcccgcccctcaccttggcatacagggccggcgtgcgctcgagggcggcgcgggtgagcaggcgcgagcggaggacggcctctgccccttcagcgtcgcccagtgtctgcagcagcttggccaggttgaactcgttccccgtgcactgctcctccagggtcacgggccgggacgcccccccatcgagcaggccgcggcacagggcctgggactcggtgagcgccgcccgcgccccctcggcgtcctccgcgcccagcagcagcgcgcccaggttgcccagcaccaccgcgcgcccggcgtcgtcgtcggtggcgcgagccacggcgcggtacagctcggcggcgcgcggcacgcggctgcggccgtctggcgccgcgctgtccaactggtgcagggccagtgccagacgcaggctgggcgcccgccgnnnnnnnnnnnnnnnnnnnnnnnnnnnnnnnnnnnnnnnnnnnnnnnnnnnnnnnngagcgcgccagctcccgctccagccgcgccacgctgtcctgcagctctgtcacgctgccgatgcgctgcgattgggcggggggggatgggaggggggcctgaggaatggatgcggcagggagggcgccgagtgcctgcacagcaggcctctgtttgggacttggttccagccgaaaatcgcacctggcaccctgcttgccacagcagggcagccaggatacatgcacagagcatccaggggcgtggccgcatcgtgtgctgagatctacggcatggctaaccaagggcgaggatggcctagaggttgcggagatgaggcgatgtgccggggacgtacttagacacaacagagtacagacagactgatgctagcccttcggaagattgctgtctcgcagggctgatttattctggcagttcggaagctataccgcggggcgcctggccgtcacggaggacactcagacatgcagtctcgcgacaagccagatctcaaacgggactgttcgcacgcgggcaggtttcttcagggaccaatggagnnnnnnnnnnaacatgcggtctcgcgacaagccagatctcaaacgggagtgttcgcatgcgggcaggtttcttcagggaccaatggagagggcgaacgcccttgtccatcgcatgcttgcagtgtcgatttcggattgagtgatctgagtcgaggagggtcacgaatgtgctcaggcggtatcccgtgccgcaattatgcacattgtcggcggcacggcggacaatgtacgatctcacaaagtatcgcgcaagttgtataaattcagcctcaagtacaagttcactaccttctgcgcgacatgtatacgcggacatgtcagaaaacgatgggtcagccgaggcgcctcacagggctctccgacgagattttgctcacttagcaccgtttttggccttaccctggtcattccataatcggcttaataaaattgcgagagtagggcgctgcgatggggcnnnnnnnnnngtttttggccttaccctggtcatttaataatcagcttaatagaattgcgagagtagggcgctgcgatggggcgcagggtgcatttgttttacaccctggccaggggcaggggtgtctcgaccctctctccagtgcgtgggaggacgggtgatcctcagccgaaaaccaataccgagccggnnnnnnnnnncccagtgcgtgggaggatggataatcctcagccgaaaaccaataccgagccggaggcggccacgacgcacatgcggagttgcctaggaagctgggctgcggttcgcgagactgggatggtcgaccctgctgtgcacagagcgcgacgtcccagtgcatgacacgtaagccatccctcnnnnnnnnnnnnnnnnnnnnnnnnnnnntgtcaacccaacagagtgaggttgtgagtgggctgggcctgaacaatcaacaaacggttaagccctgaatgcaaggctcggtgaggtccaccagcccaccagatcaccattggacgtgaggcctgagggttgggccggagtcnnnnnnnnnngatggctaagccccgaatgcaaggctcgttgaggtccaccagcccaccagatcaccattagacgtgaggcctgagggttgggccggagtcagggcattgccgcgttgtcaccgtatcggaatatgtgataccacctctttttaaatggatggactttaggatgtccttgatgcccgcatgaactttctgtggtccaggcatgtcagccccctactcgcccggcagggggcgaccgtgtgctgtnnnnnnnnnngtaaatggatggactttaggatgtccttgacgcccgcatgaactttctgcggtccaggcatgtcagccccctgctcgcccggcagggggcgaccgtgtgctgtagctgtcgggcatctagtaagtgcacatccgacaccgtcaccgccctaaatgactggtcgtgggttctccctccagcatcaaatagggcagaatgcagagatttacaccaacaatgtataagttatagtcggcaagggagtcaagatcggaccgnnnnnnnnnnagtcgtgggttctccctccagcatcaaacagggcagaatgcagagattttcaccaacactgtatgagtcatagtcggcaagggagtcaagatcggaccgtatagtctgtttccttttcgtgcactgattccccctgggcactgacttccggaccaagaggggtcaccttccctggtccacagattcccctcctccaatccgtcccgctctgcccctctgcacacctcctgagtgctgtcacacgttcatcagacacatagcatctggaccgcgcgattccctgatccttcctccgatgcacgcggtgaccaccagcgggatggcagcctccgaaggcctcgcgcgggccactgtggtggtggaggctgcatccgtggctgctgcctgcaccaagtgggccacatcgcatggcacgggagaccgctccaccttctgtgccgtcagcgggcgggcgggggtgctcgtgcaccgtgccggcacctggggcatcctcaccctcttccccctgtttgccgtttacgcgtgagtcccggtgcctccctggccatcagcgtgcttgtttgagcagcttgaccccccctggtccttcgatctggaagggtcgggccagctgggcccgccctggaggctagccaacagtactgcccagcccagtgcggtgcccccccttctcacaggtggtacatcaacgagcactgcgacggctccctcctcggtttcctgggccgtctggaagcggggggctgggccttcctggtggaggcctaccccagccccagctgggcggcggtgcgctacatcctcggctttggcctgctccagggtgtgctccaggtctggctgccaggtccggtgcaccgcggccccaccacaccgcgcggcaatgtgcccacctacaccgccaatggcgtgcccacgctggcgaccaccctgctcatcttccttgccacgtggcgggcaggcctgtttgacccgggcgcggtctacgactgcatgggctccatcgtctccacctccaacatcatgtccctcatcctctgcaccctgctctacctcaaggcaaacgatttttcttttgtggggggcggatggcaggggtgattgcatgggaaggaggggggccaagcatgtgatgggttgcgggggactgacccttccccacgtcgacctcattctcaccaacccttgaccttcaccccctccacaaatggcgctcccatgaaccccttcccccctctttccccgcgccagggccggctggcgccctccagcaccgactccggcaccacaggctccctgctctacgacttttactggggcatggagctgtacccgcgcatcggcgcctttgacatcaaggtctggaccaactgccgcatgggcatgatgggctggagcgtgatcacgctgtgctacgcggtgaagcaggcccagctctacggcgcgcccgctacctccatgctcctgtcggtggccctggtccaggtctacatcttcaagttcttcctgtgggagacagggtactggtccagcatggacatcgcacacgaccgcgccggcttctacctttgctggggctgcctggtctggatccccgccgtctacacctccccggccatgtatcttgtgcgccggcccgtgaacctgccgctgtctttgaccctggtcctggggttcctagggctggccgccatctacatcaactacgactcggaccgccagcgccaggagttccggtgaggggcagggaaggtgtctgagtgttttacctttctgttggggttgggagggtcctggagccacatttggaagaggggcaggagcacaatgtatatgcacgcccgccgcagcgggggacaggggaaagagacgcggtgcaaggtttgtgccgatgtgttggcctgaaccaggagctatgacacctgcactgatgcctatggaggagggcatctggtcagctcatgnnnnnnnnnncaaggtgtctgagtgttttgcttttctgttggggttgggaggctcctggagccacatctgggagaggggcaggagcacaacgtatatgcacgcccgccgcagcgggggacagggggaagaggcgcggtgcaaggtttgtgccgatgtggtggcctgaaccagcagctatgacgcctgcactggtgtctatggaggagggcatctggtcagctcatgctttaaagtcggccttcggctgggtgcctcatgcctccactcattcaagtacttgaacccctgaacagacccccgtcnnnnnnnnnngagtcggcttttggctgggtgccccatgcctccactcattcgagtacttgaacccctgaacagacccccgtccacccccccaccaccccctattccatgctgcagtcagagcgacggtaaggcgctagtgtggggggcgccgccccaggccatacgcgcccagtaccgcaccggcgacgggcgtaccaagacctcgctgctgctggtttcaggctggtggggcctggcccgccacttccactacctgccggagctggttgcggccgccatctggagcatgcccgccttccatgtcgccatcatgccatttgtatacctcgcattcctcaccatcctcctgctggatcgggcatacaggtggggcggggctcacgggagcgcgtggcgctgctccttacccctttcagggtgggaagacgtcctgccgcagcatagtctctcctcggcgtccatgttcnnnnnnnnnncttcgccatcatgccatttgtatacctcgcgttcctcaccatcctcctgctggaccgggcatacaggtggggcggggctcaagggagcgcgtggcgctgctcctcacccctttcagggtgggaagacgtcctgccacagcatagtctctcctcggcgtccatgttctggccacgtgggcaatgcagccatcgtgcccctgccagtaccagctgctgcattgaccccaccgcattggcgcatcacttccacagcgtcaagccagccgatttctactcaatcaacactccctgaccctcacagggatgacgcgagatgctctgccaagtacggcaaatactgggaccaatactgccagcgtgtgagtgggtgggaggaacaggcatggttggtgtcctgcgtgggacaggaggttggtagactgctgacagggcgcctgccgacaggtgctgctcaatgtccaagagcctctcgccaattccattgctcccatcttcctgtacctcgccaggttccataccgagtagtgccataccnnnnnnnnnngtactgccagcgtgtaagtgggtgggaggaacaggcacggttggtgtcctgtacgggacaggagtttgggagactgctgactgggcgcctgccgacaggtgctgctcgatgtccaagagcctctcgcccatcccattgctccatctccctgtaccttgccaggttccataccgagtagtgccatacctcttctagaaatactgtacctcttccctgcaagaagaaggggagggggccaggctgcactccatgtcccctcccccacaacaaccctgctccaagcagctcactcaagaatctactagggccgcgcctccactctctgtgcttgcggctctggcatggcatccataccggggcatactgagaccctcgcccccagctgcttgaaatcttctcctcgcttgccgcctcaggggatcctaacgcctggtttttgctacgatgccatgtccttgtcgctgcgtgttttcactgcttttcttgtggcccgacaactgggccaacccccttccctgccgccgtgcgggactgcaattccgccacgtccaagccgcaggtcacacaagggaagaggggggttcaccactcagagcaagcgacatgcagggttcgcaccnnnnnnnnnngaaggaagagggggggggtcatcattcagagcaagcgacatgcagggttcgcacccggccccgctcggcctcagagaggcacagcgcagcatacgctgcctgcagacgcagcgtggtggggccgggggagcccctgccaatgcgcctcccgtcgaccctcaccaccggcgtcagaccgccaaacgtgccggtcacgaaggcctcgtccgccccgtacaccttccggggagggggtagagatcatcgagtgtgtggggttgctgggcgtgcagctcacctacgcactgcaccctcatcagaaccggaatgaaatcccacctgcgtcacggtgaagtccagctccctgcatgggatgccctcctgctcgcacaggccgagcacactggctcgagtgatgccgggcatctggtagcggggggtaggggcccatacctgggtggggtggtcgggagggaggagtcaggccggcaatgggcccactggggcatgcctggtgtggagtggcaccctctgctccccacggagctgtgcggggagatgagtgcgccaacatgtgtccaggtttggggtagcacttgcgtcacttcaccagccaggcattcatcaccgctagccaatccgtgcaccgcccacctggcactgccgctcgccccggatgtctatgtgcgaccggatgatgaagaagttggtggagttgcaggtggccacaaatccatgagggtccagcatgagcgcctcgtcagcgcccgccgcactggcctgtgcatgagggtgggagcagggatcggtggctgagcctctcaccaggctctgcagagtgtccactaggagctgcaggctcaagccgtacagcgcatccatcctcgcccctccctgctctctgcaggtactcgagctcagactggagcgtgcctggatgcaggccgagatgcagttcagcttggagtgggagttccagcctgggtcctggacgtcgggcgggccccgcctcacgtggcaagtgaaaagggagatgccatcttcctgcgtgcggtgaggtggaggtgcggcatgctgaggattggggcagggtacctccagggtttggttgtaatggtcaggcaccggcagcggtggggttccttcaaaatcaggaggcacagcaggaggaacccgctgctgtgaagcttgggcacgcatgcctgtgggcctggcgcagcctccttgtattctgggatgatgacgatggtgggcagcccgatcgttgtcttgggattttggtatggctacagtggggtggtttatggggggtgttagtgcagcaacaggaggaaatttaagagctggcttctacagagtggcgcatgactgtgcagcactcttgtgcgtgctatgagacacctgttcaccccgcaggatccgcatggctccaagtgcacaccgtgggcttcaggcnnnnnnnnnncggggagtgttagtgcagtaacaggaggaaatttacgagctgggttctacagagtggcgcatgactgtgcagcactcctgtgagtgctatgagacacctgttcaccccgcgggatccgcacggctccaagtgcacaccgtgggcttcaggcnnnnnnnnnngccccgtggccggtgtgaggtttgaatgcgtgttccatgaatggaaggagcgtcaccagtagctggaagggtatcgctctgttcaagtccggcaacctatattcacatgatcatcgaggctcactggtggatgcgacccacatcacaacaccctgcccccggagagcatgcacacacccaagactcaccgannnnnnnnnnatcccgtggccggtgtgagatttgaatgcgtgttcaatgaatggaaggagcgtcaccagtagctgggagggtatcgctctgttcaaatccggcaaactatattcacatgaacaccgaaggctcactggtgaatgcgacccacatcacaacaccctgccccccgagagcatgcacacacccaagactcaccgatggacatgccgatccctgccgctccctcgaacagccgtgccagatgcctgtccgcaaacagcaccaccccgttgagcaggcgcaggccctcccacaccccgtcgcccaggaggaagccagactccagcacggagaccgttgcggccgggcgccacaccaggtcgaagctgcctgcagggtgctgtcggggctgggtcaggggaacagaggtgtgacgctgcgagaggtatgcactcatcaacccacctgctccctccacctgcaaccgcctggttacattcgagcttgccttccccccttccccccacccggaactccacatcacacctgtgaccccatcgcgcatgcccacgagggtgtcgtcgttccggctgtccggcgcatactcgtgcgttccgcctcggtgtaccgggcaggcaccagagtccagcgacagcaggccgcccccgggcctcgcgctgtgaggccgcagggcgcgccggctcagcacggcatacagcgcctggcactcctccagcaggggccgcagcgtcgggtccagcggcgtacgccccttgaccgcgctggcccctggccccccgcccccctttccaaagccggtggaggcgtgggagccggcgtaccaccagggtgcccacggcccgtcctccggcttggggcccacctcccaatcaagcatggccgggtccggggccatacccagcgcgcagcacagcaggctcagggtgccctccgcatcccgcaccaggtcctctgacaggatgatgggcaccccgtgcctgctgcggtgtggggatgcagagaggggaggatggcggggacgcgagtctgatgtgtgctgggatggagcgggaggggacggcgcgagtgcgtgtggagtcggggatgcattccgggacggcaggagggtccacggattctggccctcaccctgagtcgcccacgcatggtctctcgcgcaggcaagcctgctgctggtgcagggaggggcgcgcggtcgatcaccctcaactcctgtgagcatccggtgagttcctcacctactggttcggagctcgctggccaggctcagcaatgcggggtagcacgtctcctccagggtggccggcagaaccttggagaacgagcgtatgacggcgagcggatgtctgtcatggagagggtgagggggccaccggctatggcaagtgggcgcttggcacagcacggctacagggtagaagcagaggatgtctggtcgacagggtcgagattctgcccgcatcatccccaaaccgtgccttgatagacccaggcagaactcacctcacaagcagcatgtgctnnnnnnnnnntcagatcgtgccttgatagccccatgcagaactcacctcacaagcagcatgtgcttagaggcaggcccaaaggcagtgagcggaatatccagcctatgcttagccatgtgctttgcaaatgagaactgtgaggtggcaatgattgaagaatgtgtggtttgggatgtagagttgcatatatgtggtgttgcggagaccctcacccctgccggagcatcagtaccttccctgcatggggctcgttgaggctctggattacctcagccgctgaagtcgattgagcgttcagcacctgtaccagaggatggtcctggcggcagtttgcatgcaaagactaacagacatgatggcaagcagggaccaaagtgttgggtcagacccaccacccacagcagcactcccggcattaccaggtccctgtaggggcgttctgcgccagttctggcgaggtaagacgcataaagcggctcgtcaaccacctgtgtggcggatcgatcgttgctgaggcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaagaatacatgagggcagtactgacacaacgcggccccgaccagcagtgtacagtgattggcggaggtgccggcgtcgagccctcgcagatcggtgtgtccattgtgtacgtccggttgttgtcgggtggtgtgagaagacctttacacagaagtctgacgccaagtgtgctccagaataacctgcaagtgcacgttatattacatctgaccttcggaatgcatggaattatgcgtcgaaagtctagatcgtgaagaggcccgccaggcgctgggcgcgggattggtctattgcagcgtgggcaagccacagggcttccttgcatgccagcgatcactacgctggtgactccccgttaattcattcatagaaaacgatccagattcagatcatttggatctgttccctgagaggctcctcacgcatactgccggcatgggcgaaggtgatggcccctccacatccgaggtggtgccacccaggaaggtcaaatactgccaaataacaggtgaagtatggctggatcatctcttagtcggtatacgagcccgccaatgctcctgtctcacccacggcaccacacgtctcgccactcgcacaaaggtgtgccggaggagttcaacgacttcctgcccaaggactgcgacgagtacaagaagctgaaggcagcacagcagagtgcagccgagagcgggctggaggagctgacgcttcagtccctgccagcgggtccccctgctgccaagcagttaccagggaacaaggggaagaagaagaaggggaaaccagaggtaagattgtgggtgaagggggcgaagacgtggtaatgtgatacaaatgcatacagtggcatgcacatgcatgactgggaagggaggcgcatcaattactcgagtggccagcgtggcccctcaagcgacctgcggcagcatggccgagtaccaacatgcaagtcaaaccctcccggagaatatttgtggccacnnnnnnnnnngtgactgggaagggaggcgcatcaatcaactcgagtgggccagtgtggcccctcaagcgacctgctgcagcatggctgagtaccaacatgcaagccaaaccctcccggagaatatttgtggccacctgttgctcagccagtgccggccatgccaacaatccaccccaggttgtgttggagcgcaacacccgcaacaagaagaagtgtgtgacgacgatctccggtctggatctctttggcgtgaagctggccgaggcctccaagatctttggcaagaaatttgccagcggggcttccatcgtaaaaaacgccgagggcaaggagcagattgacattcaggtgagttgggtgtgtacatgcggggcagagcatgtctatgaggggttgaggattcagatgcaaaccctgctagggaatgccttcacttgtgaggatgaacgctgtcattccccacactgcctgggaatacattgatggccggcctgcgacatgcacagggagatttcgtggaccctgcggnnnnnnnnnngtttgccagcggggcttccatcgtgaaaaacgccgagggcaaggagcagatcgacattcaggtgagttgggagtgtacatgcggggcagagcatgtctatggggttgaggatggagatgcaaaccctgctagggaatgccttcacttgtgaggataaacgctgtcattccccacactgcctgggattacattgatggccggcctgcaaaatgcacagggagatttcgtggaccctgcggtggacctcatcctcaagcagttcaagtccatcaagaagtctgacctggccctggtggagaacaagaagaaggcgccatactttgacgaggaagacagcgaggatgaggacgagctcttcgactagcattcccgtcttgtctctggaagcaaccctcctcgtgcccatgccagccaggcctggacaagacccctcttggtggtcccgctgacatggcttgagctgtgacccgctgcctcccaccttaattctgcaagtttacatctctgagccagctgagcagtgcaccgaagcatggctgagtactgtcagcagtggcggtgttcttcttgagaagtgtgcaggggagacgatgctgaggcaaggctccaggagcgcggcagatgaagaggtctgtgagatcagggtttgactgcctggctcgcctgtcagcagacttgccaggagaaacgggaaatggggacatggcgacgagtcactcannnnnnnnnnatttggactgcctggctcgcccgccagcagacttgccaggagaaacaggaaatggggacatggcgacgagtcactcacggcctcgctcgcccatccttctcctccttgggcgccttggcagcctgcgacttgggcctgcccctcctccgctgctgcgcgggcttggcggctcccgccttggcatctgccaagggcggcgcctgcttcaccggggccgcggcagccgcagccttcaggccctgcgccgtgggggcgggtgcttcccccgccctggccgcggacgcttcaccgctcctggccgcggaagcttcaccgatcctggccgcggccgcttcaccgacccgcgccgccgccgcgccgcccgtcctggacgcccccgcgccaccaccccgggcagtcggtgcggcgcccgccccgggcccggcccccgcgccccgcccgttccggagcaggccctgcggcacgctgcgctgctgcgtggggcggtccggatccggcacctcgtgcgcgatgaccaccacctccgggcagcggttgttgaagttgcgggccgccaccgccagtgcgccgcgcgccgcgcgctccacgtcgcccagcggggcatgggccggcagggcgcacaccgcgcgctccgcagcggcgtgcagcacccgcagcagccgcttgccgtcctgaaagagttgtttgggggaggtgcaaggatatctgcacatcggcacaggaaaaggacgactgcaccgtccctctcgctgcacctttggaaggtgctgccacgctcgtgaatggtccctggcccccccttcctcctctttgcaatgttgccccttccccatcatcaccacccaacaggacgaagactctacacagcccctccctccaaactccgcctcgctcgcctgccacatggcccgggtggtgaggcgcacgcggcccctcagccgcggcgcctcctgctcctgggtcaaatcacgtggatcgcgctgcgcgggccgctgcacgtccaccgccgcgatgatgatgccgtcgttggccagctgctggcgcatggccagccccatctcctcggcgctgcccgtgccctatacgtgtgtgtgtgtgtgtggaggggtggttgacaatgggggaaaatgggtcgagacgcgaggtgaggtggacatgttggaggtgggggaggagtctcagggcgccaaggacctggagaagattagtgtccaaacgagaccaccattcagggtatgctgggcgagaaatccacgccnnnnnnnnnncgcgcgtgtgtgcgtggaggggtggttaaaaatggggggaaatgggtcgaggcgagaggtgaggtggccatggtggaggtgggggaggagtctcagggcgccaaatacctggagaagattagtatccaaacgagaccaccactcagggtatgctgggcgagaaatccacgcctcccaccccgcccaagaccccacccgcctaccttgtcgccgtcgttgtaaaaggtcgtcagcgcggcctgacccacgacggagaggctggtgggcgtaccgtactcggcgcggttgcgccggtcccccacgcccaccatctgcccatttctgaccaccagagtgtgctggatgccgttgtcccgcgccagctgcgaacgcacgtgagggttcggaaggcttggagattggggtgaggatagtgtggtgcggcggtaggaattggcggcagaaacaagccagacatcagcgcggggccctggnnnnnnnnnnatggtggggcggtaggaattagcggcaggaacaagccagacatcagcgcggggccctggccatccaaggatggcatcgcgttttcccctgcagaccaaccatctactccctcgcagcccgtcaggtgcaagctacccgccactctccagctgccatcgcacctgagcgtgggcgcagaggaaggcgtactcgccgtggacgggcaaaaagtgctggggcttgatcagtcgcaaaacctcctccagctcatccctggcggtggcggggcgggtgatgggaaatgggggttgattgaggccactgccatgcacaagggcataggttggctcccttgaacacgcactcctatacaggcatccaagccatgtgcacagcacttcagcgcacctgtaggcgtgccctgacgtgtgcaggttggtgccgctgcccatgatgacctgagtgcccagccctgcgatggcattcatcatggacatcacctacacgtaagggggaccaaggggggtaggcgggggggg

SEQ ID NO: 38456 - DNA, 115 bp, Chlorella protothecoides
gggaggaggggactggggtcgcaagcacttacggtgggacaccgagcgcccttgcaacccgaacgagcagttgcaccgccagtgaagtctacaggcggccgaggccgcagcatgc

SEQ ID NO: 38457 - DNA, 64 bp, Chlorella protothecoides
gagggaggtcaatggtggtgtcacctcccccccccgcatggcctgtgtccacagtaccggtctc

SEQ ID NO: 38458 - DNA, 64 bp, Chlorella protothecoides
ccgtatggcatactgaatatctggtaattcacggctggatccttggctggtactggcctgccca

SEQ ID NO: 38459 - DNA, 74 bp, Chlorella protothecoides
agcaccgcatgatgcgcgaggcgcccccctgcacgccccatccaccaccatacctcacttgatattccagatcc

SEQ ID NO: 38460 - DNA, 96 bp, Chlorella protothecoides
atggatgtcaaagaagctgtaggactcgaagtatgccgcatcgactcgggcagaggccggggggccaccagattgggtcttcccctgagctgccgt

SEQ ID NO: 38461 - DNA, 61 bp, Chlorella protothecoides
tgaatcttgcagatggcatttgcatgagatactctccctgcctctgaacttcaacccggtc

SEQ ID NO: 38462 - DNA, 75 bp, Chlorella protothecoides
tccgattcaccaatgtcagcctggtcctcagggtgcgggcgaggggcagggtgtctttggatgcggaacagcatg

SEQ ID NO: 38463 - DNA, 76 bp, Chlorella protothecoides
gggttgagtgcttgccggatggaggctcagagacagggagaaattcggcgtctggcaggcctcccccatccggctt

SEQ ID NO: 38464 - DNA, 804 bp, Chlorella protothecoides
  modified_base (203)..(261): a, c, t, g, unknown or other
ggccagccgccccgacgcggtcgacgagcccgccgcggccccggccgcccagtcccgccgcaacgcctcgggcctcctacgcgaggccctggagggtaggggcgccgcgccccccgccccagccgacgacaatccgaccggcggcgaggcggacgccggtcaggactgccggccggagcggcgggggcctgggggggggtccnnnnnnnnnnnnnnnnnnnnnnnnnnnnnnnnnnnnnnnnnnnnnnnnnnnnnnnnnnncgcgcgagcccccaccccccactgacgcccccgcccctctgtcgagcacgctcaagtcggcggtgtacatcgacctgctgctgggcgcggcgcgcgcgctggggcccgtggtgcgccagttcacctccctggggctgaaccgcgtgtggctgcacgcaggggacgtggtgtaccgccagggcgacgtggcggagtgcatgtacgtggtgatctcggggcgcgcgcgcctgctgcaccgcgcctcgcgcgggcgcgaggtgggcgtggaggacgacgtcggccgcggcgagtccatgggcgcggtctgggcgctggcgggcgggcgccacgatacctccgccatctgcatccgcgacgcggagctgtgccgcctgacgcgcggctccttcgagctgctctgcgcgctgcacccgcgcgccgcggcgcgcgtgctgcagggcatggccgagcgcctggccgcctcccagagcaaccgcgggcggggcggggtggcgggggtccagcgcgagacgctcgacgcgtgagtttgctgggggtgggggg

SEQ ID NO: 38465 - DNA, 75 bp, Chlorella protothecoides
cgcggtgctgggtgtagggtgcgcagtgatggccttcacccaaccaccgccttgattgaatcgtccctccccagg

SEQ ID NO: 38466 - DNA, 75 bp, Chlorella protothecoides
gcagcgtttggcgcgcaggggagcgatgagccagagagtcgtgcatgggccatgaattcaggccggcaggcctca

SEQ ID NO: 38467 - DNA, 61 bp, Chlorella protothecoides
caggctgccggcaatcgaggcaggggaggggtccggttgggaggcgacattcgcgggggca

SEQ ID NO: 38468 - DNA, 77 bp, Chlorella protothecoides
gctcaatgatgagccgatggccctcctgtctctgcctcccccgtctttgtaccccacctctggcgaccgccgctcaa

SEQ ID NO: 38469 - DNA, 74 bp, Chlorella protothecoides
gctgaggcagtgggcaggcctgcatggcgcttgagatggtatcgaggagggcatgggtgagctgcaccctgtcg

SEQ ID NO: 38470 - DNA, 62 bp, Chlorella protothecoides
cctccgtatacggcatatggcgtcacgaagagatggcgtgaggcgaatgccacgtcaactgc

SEQ ID NO: 38471 - DNA, 102 bp, Chlorella protothecoides
gaaaggcatggcttctgtatagcatgactaactggcttaaattgtacctcagatttcccctccaagatctccggacaggatactgaggtggccgccgccact

SEQ ID NO: 38472 - DNA, 70 bp, Chlorella protothecoides
cacaagcacatgtacacaagggaagcaggggtgtggatgtgcagcatgccggccgggggcctggagtggt

SEQ ID NO: 38473 - DNA, 79 bp, Chlorella protothecoides
cagggactggtccgcgaggagggcacggcaggatgccagctcgcggtccgtgacctccgctcgacgccgccacccatcc

SEQ ID NO: 38474 - DNA, 76 bp, Chlorella protothecoides
tgaatgtcggcgggggtggcctgaagggattatgagtctcgcccaccaggcatgatcgcgaggcgcactgcttgat

SEQ ID NO: 38475 - DNA, 61 bp, Chlorella protothecoides
agaagatggcatggagtgccccatgcagggggcactcgcggtggcgataacgccaggtgca

SEQ ID NO: 38476 - DNA, 61 bp, Chlorella protothecoides
gctcatccaggcgcagtgcctggtgttccggcgctgcactgcggagctagcgccctacaag

SEQ ID NO: 38477 - DNA, 75 bp, Chlorella protothecoides
atcgcctgtacgtttgagagacgatgccaaatgtcgagatgttgtcgccctcctcacccatcgcctgcgtgggat

SEQ ID NO: 38478 - DNA, 211 bp, Chlorella protothecoides
tcatcaccatggccaccattggtgagggggggttggctgtgcctgctgtcttctcaatgtccgcaagggcgcagaaggtggggcttccttacacctcgctgtggcgctctggctgcccggcttagggtgtcgcaggcggggatctggccttggccccagcgcccgccttcctcactcacctgtacccctctcccacttcccctctcatcaa

SEQ ID NO: 38479 - DNA, 141 bp, Chlorella protothecoides
gggaccttgcgcttgtcggccaggtaactcgggccacgcacctagaagggttgatgcgggaaaaaggggggcattgggcgagtgttggagggtgagagagcaaagtgtgtcggcgagaactacacggatggggcgggcggg

SEQ ID NO: 38480 - DNA, 144 bp, Chlorella protothecoides
cctgtgtagtctgtgagtgtgcacgctggtccccctgcaggtagatccattcccttgcactcatccatcgcacacacaggtgcatatcgccgcggtgatccctgacccggccacggaaacgacaacggcagtgggagtggcagg

SEQ ID NO: 38481 - DNA, 68 bp, Chlorella protothecoides
ccctgccgtcccagcgcacgccatctccccttccccccgacaccctccccctcgaccatgcgcactgc

SEQ ID NO: 38482 - DNA, 61 bp, Chlorella protothecoides
tcattcaaagctcacctgcttcccagcaacgtcaggacccctgctggccggctcatcctgc

SEQ ID NO: 38483 - DNA, 61 bp, Chlorella protothecoides
gaactgcgctcgagggctgacctcccaggcaacctccagctcggagcccaagcacctgggc

SEQ ID NO: 38484 - DNA, 61 bp, Chlorella protothecoides
aggcgttactcccagggagaaaggcaggagtttctttgcggagacttctacaataaacctt

SEQ ID NO: 38485 - DNA, 61 bp, Chlorella protothecoides
cccccccgctcggcccgccgctgcgccccttgcctcttgcgcggtgctgtggctctgggca

SEQ ID NO: 38486 - DNA, 1192 bp, Chlorella protothecoides
  modified_base (145)..(277): a, c, t, g, unknown or other
  modified_base (802)..(811): a, c, t, g, unknown or other
gggcaggcgaggtcgcgccgccggggccggcggccgccgcgccgagacgggcggaggccacctccagcgccacgcccagcttggggcaggtgagcgacaggcgcaggtccacaccggcggccgggccggctgtggggggcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgaaataatcgcgaccatcaggctggcacgcagagacactgtgccccgtggatgcggcgcagggttcagtttctgatgcccagagccacagcaccgcgcaagaggccaggggcgcagcggcgggccaagcggggggtgaaacgctgcactggctccaagatggtgcaggccgtgctgctcaacatcccaccagcagaacgctcccatgcatgtcctcccagcctcacctggtccccatgcaggagcagggtctccagccccgggtccagctgcccacggtgcagcactgcgcaccgggagacgggcatcaagatgattgtggggaggggcggcggactcgtactgattcatctggccaggacaacccccttgatctcacgccccccacccacgccggtgctttacgctgcgcggcaggtgactgcactctggcaccactttcactccgtccacccacatcccctcgccggacctatgccgtccactttatccgcgatgaaacggaggagggcggggtcggagnnnnnnnnnnacggcggactcgtactgattcatctggccagtacaaccccttgatctcacccccaaccccccacgccggtggtttacgctgcgcgtcaggtgactgcactccggcgccactttcactccgtccacccaccacccctcgccgcacctatgccgtccactttatctgcgatgaaacggaggagggcggggtcggaggccaggcgcgcgttgtgcgtggcggccagggcgaggcgaaagtgggccacctgctccagcgtcagcgccgcctcgatcgcctccaggcgctcgtacgcctcacgccgcgggccggcggcgagtctggggcgctgcgcttccacgctggccggcgacagatggcccacgccgtggccgcccgcgtcga

SEQ ID NO: 38487 - DNA, 25601 bp, Chlorella protothecoides
  modified_base (540)..(549): a, c, t, g, unknown or other
  modified_base (1002)..(1011): a, c, t, g, unknown or other
  modified_base (1124)..(1133): a, c, t, g, unknown or other
  modified_base (2303)..(2312): a, c, t, g, unknown or other
  modified_base (2365)..(2374): a, c, t, g, unknown or other
  modified_base (2561)..(2581): a, c, t, g, unknown or other
  modified_base (3091)..(3100): a, c, t, g, unknown or other
  modified_base (3394)..(3403): a, c, t, g, unknown or other
  modified_base (3877)..(3886): a, c, t, g, unknown or other
  modified_base (3965)..(3974): a, c, t, g, unknown or other
  modified_base (4384)..(4393): a, c, t, g, unknown or other
  modified_base (4804)..(4813): a, c, t, g, unknown or other
  modified_base (4899)..(5014): a, c, t, g, unknown or other
  modified_base (7011)..(7020): a, c, t, g, unknown or other
  modified_base (7129)..(7138): a, c, t, g, unknown or other
  modified_base (8077)..(8086): a, c, t, g, unknown or other
  modified_base (8501)..(8510): a, c, t, g, unknown or other
  modified_base (10292)..(10301): a, c, t, g, unknown or other
  modified_base (13076)..(13085): a, c, t, g, unknown or other
  modified_base (13784)..(13793): a, c, t, g, unknown or other
  modified_base (14183)..(14192): a, c, t, g, unknown or other
  modified_base (15171)..(15180): a, c, t, g, unknown or other
  modified_base (16248)..(16257): a, c, t, g, unknown or other
  modified_base (16509)..(16518): a, c, t, g, unknown or other
  modified_base (16589)..(16598): a, c, t, g, unknown or other
  modified_base (16669)..(16678): a, c, t, g, unknown or other
  modified_base (16819)..(16860): a, c, t, g, unknown or other
  modified_base (17179)..(17188): a, c, t, g, unknown or other
  modified_base (18284)..(18293): a, c, t, g, unknown or other
  modified_base (19793)..(19802): a, c, t, g, unknown or other
  modified_base (20901)..(20910): a, c, t, g, unknown or other
  modified_base (21508)..(21517): a, c, t, g, unknown or other
  modified_base (22419)..(22428): a, c, t, g, unknown or other
  modified_base (23498)..(23507): a, c, t, g, unknown or other
  modified_base (23839)..(23848): a, c, t, g, unknown or other
  modified_base (24343)..(24352): a, c, t, g, unknown or other
  modified_base (24415)..(24424): a, c, t, g, unknown or other
  modified_base (24639)..(24648): a, c, t, g, unknown or other
tcggcgccgggcgccggcgcggggcacagggcgtccaggtcctggagcaccagcagcgccggcgcgcggcgcagggcctcgctgacgccgcggcgcagcgcgcgctccgcgccctcctccccgcagccgaccaccacagtgtgtgtgagcgtgtcggggcaggccgccagccgagccgccagcgtgcacaccagctcgcgcgagcccgcgccgcccggcgcggaaatcaccacgccgccggggcggggcagcccctgcgcgcagagcgcggcgtgcgcctgtatggagagcacgggcaacagggcgcgcagcgcggcctccgcgcccggccgcagccaggccagggcgtcggggtgagtggccggaacggacggagccgcgcccaggccactgccggtgatgccggaggtcgtggggaccgacgccgggccgccagtctcgcggccggcatctccgctgggccggtcagaagtggccgcggcccccgaggcagcagcggcggcggctgggtctggggccccgagaaaggcgctggccagnnnnnnnnnnagaggtcgtggggaccgacgccggggcgccagtctcgcggccggcatctctgctgggccggtcagaagtggtcgcgacccccgaggcagcagcagcgccggctgtgtctggggccccgagaaaggcgctggccagctcggggttgcccaggctgacgcgcacgtgggagaagcgggggaggcccagccggcgcgaggcctcggcgtccagggtgacgtgcccgcgggacaccccgtccgagcagcgcagggtcacctcgcgcgtccagggactgtggtggcgaggtgtggtgtgtggtgaggatgccgtgtgctcatcaggccttgcaatagtccatcccagcgcagtatgggatcgagtggaagccgagctgtgataccccaagactggggatcaggcatgcaggaaacagggctcaccccaaggaccgctcatgcacaccccaccccaccnnnnnnnnnncggtgtgtggtggggatgccgtgtgctcatcaggccttgcaacagtccatcccagcgcagcatgagatcgagcggaagccaggctgtgataccccaagactggggatcaggcnnnnnnnnnntggtggtgggcacggcgcaggactggaacctggccttcacggagaggtcgtcctcgccgtcaatcccctcggtctgcctcagggccgccaccagcgtggcccgggagacgagggccggggcgtcgagcggatcaccggcgcccgcggcggcggcggcgacgatggcaggcgcattcacgccaccaagcgggcctgggacggcgagagcgtcgccctctggccccctcaccagcacgcgccagacggcggaggtggctggcgcggccggcgcaggcgctccgtcgccgccgcgccgtgccgcgcagggggcctggcggccgtggcgcaggcgcggcgccacgtagatctcgctgccgctctgcagccgcagcacgtggggcccagaggggacggtggccaccactcgaagcttcaccagctgagagtgaatccagaagggcagcggctgatccagcgccaccaccgccacctgggaggaggaaggtgtggcgactgggcgtggatcagtcagtcctggaaacgagcatgggcacggctctgctggatgatcgtgaggcatcagtgcccgttcgtctggagcttgaccagtccatcgattgaaggtcgcagcggcagttcatctgctccacaaaccgcgacagcccaaccccccctcaacaccccacacatctgcccgcctgagacaggacgtggtcctccaggaaggcggcattcagctccaccacctcccagtcgtccgcgttcgcgggctccacgctgacagactctgccacggggaccccggggctggctgtcacctccacctgatcgcccgccttgagtcccagtgcaccggcgaggcccgccggcacccccagcttgccggcctcgcacgcctccccggcccaggccacggcgaggggggtcttgcccgggcggaagagggtgaggggcaggggcagcccggcgcccgatgtgtacagggtggtcaccagggaggctggcaaggccacccatgtgttccgctccctcgtgatgctcaccaccaggccacggcccgagctgtgacatggaggttgtgtttgtttgcttggagtgattctaaagggtcaatcgcatagcaggcaacatggtcgaggttaaaaggatgcacagcgcccacgctccgacactcacccctccccgtccctnnnnnnnnnntcttgcctacggatttggacatggtgtgagatgcgtgattcgggagctggcgnnnnnnnnnnaattaatcgcatagcaggcaacatggtcgaggttgaaaggatgcacagcgccaacgctccgacactcacccctccccgtccctgcccgcaaacatggactcaaagaagtcgtagctcatgatcacggcagaattggatttccccttattacagaatcatgcatgcaggcacgcgcatcgtcaattgnnnnnnnnnnnnnnnnnnnnnaactcagcatcgcggggggtagagaaaggatacagcattcgagagttccacggtactcagggcttgtttcgacgatatcgggcaccctcaactatcagcagattcggtctctgtcgaggtgtcggaggaagtgtgacaggcccggacgaagccgtattgcataggcgaggaatcagcaggtcatgagcttcgagcatgacaaggtaaactgctgggcacactgatgagcactacagcagcaatctctgtgtgcctggcctgctcgatcccaccctcgaacgcttactgcagagggtgatcgtctaccccaactatgtcaacgccgggaggacggtggcagagggtcggcgtgtcccacgggtgccaggtggggcgcttgagtatgctggtgtacagatgtgcgcgctgcatgcatcaagcccgatgccgcagagcacagcttggctgaccgcccaatttgagtgatgtcttgcccgatgcaggagctgaagacccaaccgcccctgagannnnnnnnnncgcgcgctgcatgcatcaagccagatgccgcagagcccagcttggctgaccgccccatttgggtgatgtcttgcccgatccaggagctgaagacccaaccgcccctgagatatacgactgcatagtgaatggactgaagttgccagcagaacttgaggtgaggatggcccctcatagagctgtgagagatgaagaaggtctcatccagaaagccccaacagtgtttaggctcgccctcgaggtacctgtcatctctgccatcacctccctcaaaacaacaacctgcacattgcnnnnnnnnnntgaggtacctgtcgtctctggcatcgcctccctcaaaacaacaacctgcacattgcagaacaaagcctatccgcgagaggcgctgctgaggggcagggtgcgggtggccctgcggggccccgacggcaagccgctcaaccccgctgtcacaagcaggagcaagctcctgcgtgagatagcagccctcctgcctcgccacccagccagggtgaacaggcccaagcagcctgcaggaggggcggccgcagcggcggccgccgcggccgcagcggcggggagcagcgcgtccggcagcaagcagcaggtgtccgcaaagaagggtggcgggaagaagaagcgatgacaccatgctggctgagctccccttactgtcgtgcgaggctagacacttttgcaccaatctgcactgctgttagtgcactggacatctggaggaatggcacctggtatgggaaggtacatttcggggtggtnnnnnnnnnntgccacacgagcaactcactcggcggcgcagcgtcctttcgcgagacactgccccgcatcaggacgtggtgcatacgannnnnnnnnncggctgagctccccttactctgtcctgcgaagctcgacatttttgcaccaatctgcactgctgtcagtgcactggacagttggaggaatggcaactggtatgggaaggtacatttcggggtggtacagggcatgctgtggggctgccaagggaaattgatgaatgggatgggttgccccgggaatgacgccacacgagcaactcactcagcggcgcagcgtccttgcgcgagacgctgccccgcatcaggacgtggtgcatacgatgcctgacgcgtagctgacgctggagtgcgaggggcgtgtgcaggccgaggactggtcgtacttgttgaaagcgatcgtgggcttgaggtctgcgatggccagcgcctgtgacaaagtggaggaccttgttgagattgggtggannnnnnnnnnggcaatcgtgggcttgaggtctgcgattgccagcgcctgtgacaagtggaggaccttgttgagattgggtggacagtggggcgggagggcaagctcgtggaccagcaaggcacttttgtccgtcaccagaccctccacccatcgactaacagctgcacctgcagcaggatggcgatggcatgccgtccgcagatggtgttccccgtttcctgaaggtagtcggcaaagcgttgagcgtccccgctcgcgatggcggccatgcccctggcatccagagccttgatgctctcgtggatggcgccctgcacagcacaaagggccaacggctgccgatgagaagcaggcatgtctgggctgcggcaaagggtcctgttgtctttggcaaagccagcagtctcaagccacgtcatnnnnnnnnnnatggaccagcaaggcacttgtgtccgtcaccagaccctccacccatcaacgaactgctgcacctgcagcaggatggcgatggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccctgcacagcacaaagggccaacggccgccaatgagaagcaggcatgtctgggctgcggcgaagggtcccgctgtcttcggcaaagccagcagtctcaagccacgtcacggagcactgctgtcaacactacttccccccccacctcacatctgttgggtcgtaacgggtgtactgaaagcggctgccccagtggcaaaagtcggacgagatggcaaagaggttgcctgggtcttggaggaagggcgccaggatgcgggcatactgggcctcgctgtagagcatgggaaggggcgagtgaggcagacaccctgggtacaggccgatcgtcacgcgaccactgccgctgcatcgcaatccaccaaacggtcgtaatatcagaggatatgggtacggagtgatcacacctgggcaccgtaacccctcagtcctccattttgcctcacctctgccggctgagggctcccactatgatgggaactagggtgaagctgcgttccctcataacatgctggatgaaggggcagtgcatctcaatgctatgttcctcctgcttgtttgttcgatgaacagcgggtgcgcagtgggtcagagatgatagctgtgcaaaatcctacgagacgctcatgctcagaatactgatcacaatggaaaagtcaaagcctacacaccctcgaagaaagtttcggctgttccgaagagcaggactcaaaagcatgctgcactgcacagcacttgcctcgtcttgggacaaagacgcgatgtcaaaggcaccgcttgccttcagctggtcatacactcccgagtccacaggcacatcccccagtggcgacctgggcaaggggataggcagatgaggtgcttgatagatgtcatactctcaatgggagtggtccagaccagcctcgctacccaggtgatgctttagagccagtgctaaccccagcaagcgcatcttgcccccctgcacttcgagaggcccttgcctgtaagtggtggctggggagaggaggcagcggcgggagaaaaagtgatgggaagggccgatcacaaatacacgcttcctgggtgatcattgggttcagatgggggcgcatgctttgtccggttctgtgttcatcaggtggaagcacgaactcagaatcatccatcctcagccccaccccagtcccctcccaacccccccaggcgcctactcacacgctgccggcatcgatgcctttgtaggcatgggccagcacgtggccacagtatgtgaaaccggcatggggcccgatgagggcccgtatgctgccgacggggtccggatgggaagcatcctccatccatttcctgatgctagcctccagggatctggctcggtcgtcataccaggtgcccgcatggtatgctgcacgcaccgtcgccatcctgcccgcttaagcgatacgaacacaacctattatctggatcgagatctaggggaggtttggaaagatcatgggagcatggaagcagggcgcctggcaaaagtcgcagaattcagtgcagcctgtcgacctctctgcaatccttgccacaatccaggtaagcctctgtatctcctggacaatacagagacctaccattggactggaaagccaggttgctggctatacgtcgcaatggcagcaactgatccagtcgcgccttcgaattgacgatctcgcgggcctggagcatggaatacaaacagtgcaacacatgccttgactcgaagcgagatatttttttgaaataagcaggcttgtaacttttccatctcgccttcggaacgcccgtcagatcggggccgagcagccactgtgacaagttataagaagcacttcaactcctgcaccataggcacttcccggcgatcatggattcgccgagccctcgacatgaggtttagacactcctctctgatcagatagctcttttgaagaggcgtgcaaccccactcgggttggcctgctaccgtgcctcgccccagccnnnnnnnnnnatttttgaaataagcaggcttgtaacttttcgatctcgccttcggaacgcccgtcagatcgaggccgagcagccactctgacaagttataagaagcacttcaactcctnnnnnnnnnntgtttagacactcctctctgatcagatagttcttttgaagaagcgtgcaaccccactcgtgttggcctgctaccgtgcctcgccccagcccaacacaggcgtcctgaccacgcctgccatcccctcaagcccctgctccatgccttccatctccaatgctggtggatctctcaccagcgccctggccctcaccctgctggcatgggcggtgcgatggtggagggaggaggccagcaagagcaaggccgccgctcagagcgccaaggctgggtcgacgcgagtgctgtcgcgctttcactccggcatctcccttgcggccctcaagctgctggtgggtgggctgaaggagcggagccaattcagacactggtcaacctacctgtcttgttgggagcccgaatttgcatgcaaagctcagagcccataacctgatgtatctccagtcccggctccaaatgcaggtcgagaccggggcgtgcccgcacctgatcttcgatgtgaggcaggatccgagccgccccctcccgccggagctgaagggcgccctgtgcatcccaggtgggtcccgccactctgtacgtgcgctgaggcagagggttgcctggcatgacgcacctgccaaactgagtccggcccctgcttgccgcctttgcagccggagaggtggaggaggtcctttcccatcccaaacgctgggccgagacctttggcgcgacacggcggccccccccctccgacatcctggtgttcctcgggtctacggccggcgagcaggaagagggcgcggccggggccaaggccgccgggtatgaccgcacccttgccctggccggcacgctcgcgaagatcgaggaggcggaggcccagccgccgcaagacctctccttcctgcgtgctgacgcgctgggcctgctcctgatgggggagggggcccgtcannnnnnnnnnactcgcgaatatcgaggaggcggaggcccagccgccacacgacctcgccttcctgcgtgctgacgcgctggccctgctcctgatgggggagggggcccgtcaggccttcccatgcccggtcacggtcattgacgtcaggaggtgggaggagcgcctcctcttcggcagcatccggaccagccaggccctgccaggtgggagtctcaggcttcgtggggggtggagtgtggctgaggtgacgcttggaaggcgcaacaggcttccgcggttggcaggctgtggggcagcggaggaccagcactggcgtactaacctgaagtctctgccacgccacgtcattgccctcccctcggtgcgccccgccgactcgcagtggaagagctgccgagcgctctgaacctgtcgccaggagagnnnnnnnnnnggtggggggtggagtgtgactgaggtggcacttggtaggcgcaacaggcttctgcgggtggcaggctgtggggcagcggaggaccagcactggcctactaacctgaagtctctgccacgccacgccattgccctcccctggctgagccccgccgactcgcagtggaggagctcccgagcgctctgaacctgtcgccaggagagtttgaggagctgtacaggttcccgaagccaagtcagcacgacttggtagtggtcgcaagtgcgtcgcaggggatgggagggtgctggactgtgcttgccgtgcctgccgggcgctgcctgcacagttgtgcatcctgtgctgccccaccaggtctgccacccccttgccatggagatgccactctgcgcaacccccggaatcctgacgcctacgtgtcgcaggcaggagccacgcccgagcggcttgggcggccaccctggcagctgacgctggctacacgcagtggctggttctacagtcgggccacaacggctggcgctttgatgcgaacgtaaagccgtaccatagctatgccgcgggggaggcgccgccggagccggaggacgtggccacagagcttccggatcgagacgagggcctggctgagctggcggcgctgggtctgctgtgatcagaaagctttgcgggcttgcctgccacccttcggatattgatcaaatgaaaggcatcccaggcaggcaattgcagagcatggcccctgctgctgctgggattgcttcatcaatagtgtgtacttccttctttactcgcctggttccaatagccacaacaattgtctccccagacagaacgctacaaatttgaatctcgcgcgccctcatggagcggtatgatttgcatccagctttcgacacctgcacacccatcgcacagattacagacgagtccatgggacatttgtctcaatagtcgcccgacatggagttgtagtgagtaccctacagcatggaagctctagaggactcgatcgagcactctgtcgaaggtccggtcgaggtacgcccccaaaagttgtcgaggcttcgaaaagccaaggagagggctaccatccccaacgacgaaaatgtcgcacacaatagcgacagaatccagggctgttgcgaggctactcgcccggaagggcaaaccttcctgcacaaggagccgaagagcccaaccgtgccagaagaagtcggtgtggcgatggaggctccggaccgtgcgcctagcgtgagtgaggtgggtaccaatgtgatgcacgtcaactgcgtggcatggtcgcctgctaagccccataaacattgctgctcttcaggttgaggcccaatccgacgcggaggaggccaccaggggcgagcccacagatgagggatactgggatgaggaggacgagctggaggactacctgaaccagaattttcagtcttctgatgacgaggagggtctgcagatgaaccagataattgaaggttggggcatcgagtcgtggacaaagcaccgtgccaagatagtgtccctatgacagaccggccacccactcctgtgatcaactcattctgcctctcgtgcataccctacaggacccctcttcggtgggaatgatggtttggatatcggagacgaggacactgcagccgagactcagcggatattgaggggtgaggtgtcggggacacttgatgctgcacatgtcgatgggagctcgaatgaggactgcacctgtatgcctgacttgtcgctacttcccatgctgtgctnnnnnnnnnncggtgctgcacatgtcgacggcagcttgtatgaggactgcccctgcatgtctgacttgtcgctacttcccatgctgtgctcaggcttcaccctatcactttgtgcagaaagcgcggcaagggaccgtctgggccgggatgcaggggttgagaggggaaagaaggatcgcagcgtgcccctgcagtctgtgctggagcggatgagggcgagaaaggcggccgctctggccaggtgagcaggagacaaggggtctggatgggatagaggttcctgtggtcctcccccaccagctcgctcaaccacagtctcgactgcggacctggctcggtgactggcagcctgcagggcatcctttcccatccctactcacatccttgcactctcagggccccccagcctcctgctcccttgattccctcatttgacgatgtccttggggccttgcctgcacagcctgcgaggagcaaggccctccctgcagcctcacaaactgtggctgcggataagcgcgcccttgccccagagccggccacgccggcggagagcgccgcgtcctctgacctcgagctggtggatgaggagggcgaggaggcctgcaacatcgtggctctgcccagcacgctcaagcaacggcgaccctccacccaggtgcaggggtcctgggaacgtgccgcaaagtggctgctcctgattaatcctccggtggaccttgcctctgcccttctggctgcactgggagcagagaggccctggccttttggctagcctggcattgcaggctgacgctcatctgccattgggccgcctgaactgtgccactctctgacgagcatccacttcccgacaggaccttgacgactttgaggatgatgtggacagcgaggaggagctggaggatggggatgtgctggtcggcgagggagctggtgcacgcgagggcagcgccgactccgatgccagatcagcagcgtcgatgagcgagagcgaggagtcggactcggatgatgatggtggatccgaaggggcccctaatggaggcgacggcgacagcgaaagcgccttgagtgacggggcaagatccgccccaggtagttccccgcctacggcagaggaccctgcggccagcacggcgggggatgaccctggcagcgcaggtgcccagcaggaaagccccagcctggcagatgtgctggcggcaggggctcgagcggagcaagccagcagccaaggtgtggcgtggggatgtggagtgcttgggaactgaacggccgtgaggtcttgttccggcgccagaagattttcgcaccatgatgtcacgccttccgactgccaagctccgccgccaagcaatcccagttccgaccctccccttcgcagccaaggcagcccgtcgcgccgagaaactgcagcgggtgttcctggacatggaggctgagctcaggttggggggcattgggccgggttcagtcagacatgagggtgctcttgcacgcgtgagatggtcatggcccattgagatgggtaccaggagctgtgcatgcgttctgcgcctgactggtgcgccagctcacccttgcagtcacagtgcctgccaatctccatccgcaccacccgaccgcactttgtcgcagtgacgaggagggggcaggcatccgcgtcagcgacgacgaggacgatggccttgatgatggaggggacctggtgcgcagctggccaggggggtggcagcttgcctgccgcactcggcagcgcatgctgtgccagttggcagcgcatgctgtgccagtcggcgcagggggagcctggcaggacttgcacccgggcagcaggggggcctggcatccagctcgtaggctggaggggcgcctttcggtcgtggtaacaacggcccatcgcctccctcgacccgaaattggcgcaggcggacctgatcggcaaggagcgggagcggaagagggacgcggcagcccgcgagcgcctgcaccaggaatggacggcggcgcaggatgccagggagctccaggacgtgctgaggggcctgcggcgcggtttccggagggcgcgaggggacgggctgtgggacgacgaggtgcgccgagtgttcccaggatgtggggtgggcatcacggcggtgaggggggagtcgatttggcatgcatgctgcgctgcggcaccctgcacaagggtgacgtgcccctgcagcatgctgtggggagcctcagatcctcatcagaccctttcactcacacccactgtgatcctcgaaggacgatggcacgggcaggcgacgggtgcggctggacgaggaaggcgctccctctggaggatcaggtggtctaggtgccgacctggcgtggctggaagcctttgggcaggggcccggcgaggaggaggaggaggaggaagggggtttcccggggctgctcccgggttccaagggaccggcgcctgcattggggcacccagcccccgcctcgcccgaggcgctgcaagccagcgacgagtcgtcgcgcatgctgctggaggcgctggcgcgcagcgctcccagcgcaagcggcgcgccgcccgcgggcgcagccgcgccccgcgcctcctccttcctcggccgccgccccgccgtgcagcggctgcacagcagcggatccatgggcgcctcctcccgctcgtacgtgttcggccgggaacaggacgacggcgccgccgccgcttcgtccgccgatgcgcagggcggggcggttccccgggaggagccggcgccgaccagcttcgtcgcgnnnnnnnnnnctacgttttcggccgggagcaggatgacggcgccggcgccgctgcgtccggggatgcgcagggcggggcggttccccgagaggagccggcgccgaccagcttcgtcgcgctcagcaggatggtggggcgtgcccccgccggccctcccacaacctccgcagcgggcctggtcagcagactgggcgccggggggcgggccgggaccgcgccagctgccacgacggtggtggatgctgcggtggcggtgtgcctgcaattcggttcccgggctggggcctgaccggcggcccggagggaagccgatgcctcccctgtgaccctgccccttgggcggcgcaagacctgtgaggtgggaacccgaggcaacaaccattattacaaggggtcagcaacgcagtgccacgggagagcaaagggcaagggcagagcaagtggaaaagccttcgggcttcggcatcagtaggagtagaaaccgccctcgtcgacctccgacatgtagtcccaggcaaagagtgtggcggccagcacccccacagccaccagctgcatgaccagggctcctcccacgattttctgggacaggtggcatcgtcgaaggaaggaaattgagggggggcgaaggtgcggtctgcaatggatgagcgactgatcctggggctgaaccctcgcgcaactgcacaccccattcatactcacccnnnnnnnnnntaggtggcatcgtcgaaggaatgaaattgagggggcgcaaaggtgcggtctgcaatggatgagcgattgatcctggggctggaccctcacgcaactgcacaccccattcatactcaccccggcatggtacaggatggcagggatagccacggacccgacggccgagaagccggtcaggaacttgcccgcgtcgacccatgagctggccaggtttgacccgggggcgccgccgaagaagagggcgggcatgggcaccagcacatacatgaaggctgctcagcatgaagatttggaagggtgagtgaaactcccctcacacggggagggcttttagctgataaccccttcaaacaccgacgcacctgtgagcatgggccaccagttgtgccnnnnnnnnnnccggcatgaaaatttggaagggtgagtgaaagtcccctcacatggggagggctttgagctgataaccccttcaaacaacgactcacctgtgagcatgggccaccagttgtgccacaacaagcatccctgcggaggcgcacagggttaaaacatgagcctgtggccgctgacaccgcaagccctatgaccagggaagaggggcccagggtgtacttcccaagcttgggagcagggaggcatactatgcatcctcgaatcccacttacgaggaactgcagcgtgattccaagagctatgccgcccacgaccgccgcagccacgcgagcgtcggtgatggccatgtggtacctgggactgggcccggagcacctacagaacacagcacgccatgctagcacgcgttggtaagagatgtgtcggagaacaattggatattcggctgcaggtggatgcgcagcccaagggacgaattgttcgaacacacactcctagtatatcgcgcgcaggtgcggggcgcaggctttgacttatgcaaagctgctacagcaagatggcacatgtcagcgtaagaccgcgttcttatcattcatgcgcagcacaaagaggttgcccttgtctcccctggagatacgaaggtcttcatcgaggtaggtggtgtcgagcctccctctggcgctggctggcgcagggacggggatgaagccagccagccagaagcgcttgaactgcacagccacctcactgtctgagatgggctccagctcggcttcgacagcattgaaaagaggtgtcgtctctctgttcttgccacgcaggctctcgttgtctgcatgcggcggggtggacaaggttgcgtgtcgcaggatgcggtaatcttacattaacacaagacaccatgtcgcccccatttgacacaaagactaccaagatatccccttggcctccccgtgcgcacccagggtctggtatatagggcccnnnnnnnnnncaacacaagacaccatgtcgcctccatttgacacaaagactagcaagatatccactccgcctccccatgcgcacccagggtctggtatatagggcccttgggtcgcaagaaggacgggcgactccttccaaggatggagtctgaggtggtgtacaggagctcccactgtccattcagcagggggctggtgacgggagctgccgtggggtttcgtccctccaactcgaccaccaggccctcgatgcgctctacatcgctcggcgtagccgtcagtccgcgttggaggggctcaatagcctccaagagctgcgtttggaggtgtgcatggattgggtggggtcgccgtgaaggtggctggaccgtgcgcctcccatgggctacgtggacccattgcagccagcagcaaaacgcttcacaaactcacagactgttttgaatccatgatattaacacccttgttgcctttgaacagtgtccttaggtttgggaaggcttgcatgatgggatgcgggcgccggttttggggcgagagcttcggagcacccggccatgccagcgtacggtttccaacagcatgctgcatcttctatgacagaacggcttgtacctttgagagggttgtggatatcaaacgtaaagaaagccgtgcaccgagaaatgaagcgcgagaacttggtatgcggaagaagggatcggtggtccccttgacgatatgagatcttttgcctttcaaagactcgagtccaaaagcgtggaattgacaaacttacagaaatatctttccttcgcatgcaaaactctgttcaaagcgtcttcaggctgtcagggagctagcaatattttattcatagaagtttctcacatcattttacccaattctgtcgttcatctgggcatacaaaggagtttctgtactcaacctgccaaaactcccgggtaagcatcccatattctggcctgctccagtctctactgagcatcattggccaacccagccatatggtgagaggacaagccagggcttaggggagcactcgggaggctggcgaccagaattcccctgatttnnnnnnnnnnccacacaaaggagttcatgtacttaacctgccaaactctcgggttagcatcccaccttctggcctgctccagtctctactgagcatcatgggccaacccagccatataatgagaggacaagccagggcttagggcagcactcaggaggctggcgaccagaattcccctgatttcggagaatggaggacgaggggagcgcgccccaccctccaggccctgaggaaggctatcctggctttgctgccagcttgnnnnnnnnnnatggcaatgatgcggcacactctttcagcaggggaatacaggccaagttgacctcatacctgctgtgaatnnnnnnnnnngtggcaatgatgcgccacactgtttcagcagggggacacgggccaagttgacctcatacctgctgtgaatnnnnnnnnnntacgaggggagcgcgccccaccctccaaagccctgacgaaggctatcctggctttgctgccagcttggtcgactgagacattaccactgagtggcacgccaagggtagagcacaaaacataggcaaccatgaggagggggnnnnnnnnnnnnnnnnnnnnnnnnnnnnnnnnnnnnnnnnnncccatgtttgtagataatcagaccagaacccaggcaggcgattttgggggagggtacaactgaggtctagggaggtcgacctctatgaggagttctccatggccacctggggcccactggaagacaccgggcaacaccaaggcatgcctacgtcgttttaattgcccgtacaatcgacaatctgcgtttgtatgatgttgacataaaacattctggctcctatgatgtgtccgcatcctggctggccactgcaaggccccgcaaggtgacgagtacgcattctgcctggcagggggaatcgtcggggcccattcgagannnnnnnnnnttgttaaaatagaaacattcaggctcctatgatgtgtccgcatcttggctggccactgcaaggcctcgcaaggtgacgagtatgcattctgcctagcagggggaatcgtcggggcccattcgagatatatcgtacgtttcgttctttgctttagaagggttggctcggctggcgttggactgcgcttttggtattgtctggagatggtgaggctgaatgaattctaccaaaggcaagtgatcgagaaagcgaggacatggcgcgccctgtttcaaggctgatggggtggatcgtgcacgcagtcctatcgtatcacgtagattaacagcgttatagccaagaatgcgtgttgcatgagagcgtggatcgaccagccgaatgtcacagttggtcgggccggcgcaggctctgcacgaggcctttctgcagaccttggcccccaatcctgtgagactgtcggggattcgagcaccgatctggactctaggatctctttgacgcaagtagagcattgctagactacgatccaaccttccccccgtggcaccgtaggaactgatcaagcaggcggaggcgtacctgaagaccgctgcgcagcagcccggctatggaatcgccgtcctgcaggtgcatcgcccacgagtccatggctcagtctggaaattcatctagcagtcggaaggttgcgccatttaatgcatcccagcttgccaaatcccctcccctcctcaccacccctcattgcagctcatctctgccgagtcagtggccgtggaggtccgccaagcagccgcagtagggttcaaaaactatgtcaagtacagctggtcgccgcgggccgccgacggtctgtcaggcagcacccccctcgccattccggagggtgaaaaggtgagggctgaagtgggtggcggagggtggggagcgatttagcagtacagcagacgagtgttgagcagcctggatgctaaggaagtatatgcgactccaaggcgcagcatcactgtgccgttgcatcactgcagacatgcctgccaagctaccgccccgcctgctcaagctcctgaagtgattcctgctgtcagtttgcacgtgnnnnnnnnnncactccaaggcgcagcatcattgtgccgttgcatcactgctggcatgcctgccgagctaccgccccgcctgctcaagctctcgaagtgattcctgctgtcagtttgcacgtgccggcatcctctgtgaccatgatacttttgcagccacccccccctgagacgtacccccttccccacccaacccctcctcccccggaccccaggatcaaatcaaggcctacatcaccgacctgatgctggccgcgccggtgcgggtgcggtcccagatcagcgaagcgttgtccatcatctccagccacgacttccccgcgcgctggccggcgctgctgcccgggctcctggagcgactggaaagcgcggacgaggtccgcctggcgggtgtgctggccaccgccgactccatctaccagcgctaccgcgcccagttcatgactgacgccctgtccgccgagctggattacagccagcaggtggtggcgcccctgctggccacgctgcgccgcctgaccccgcgcatcgccgagagagcggcggacccacccgcgcaggccctcctcctctccaacatccagctggtggtgtccatcttctactccctcaactccccgggcctcacagaggtgggggtgttggtgtttggggggccggggtggcgtgtgttcgagggttacattctttctttggagtgtgaggggtagggtggggaatgcctgaaggcgcctgccggtgcgcacctcctggctgggtcgctgggtcagacgaatgccatctctgagctcgtgattggattctccatccccaccatcccctcccctcccttcctcccctgcaggcctttgaagagacgctggacgggtggatgtcggagttccatgggctgctggtactggaggctccgggcgtggcggagaaggatccagagaaacagagcgtgctggacgtcgttaaggccacggtggggccaaggcctggcatgttttgcaggggttgtggggtttgcatgctggcatcaagcaaggactcgcaggctacgctgtccacccgtgctcagcgacgtgtgctcgttggaagtcacacgaacccctctgtccctcgcattcccccccaccgcagatctgtgaggccctgatcctgttcctggagcggaacgaggaggagtttgccaagttcctgcagacctttgtgcaggacgtgtggaccctgctcttctccgtttcccagaaccccggacaggcaggtttccttggtggttggtgggcggggtgattgcatgcatgctctgtgggctggagggtggagggcgttgcactgttcatccggcagtgcgcgcgtgcacgtgtgcttgcctccccttcacaaccgaagagtagttgagctctgccaatagtagttggctggcccatgccaacatctttcccttcccagctccacgactgagccttgttcccccccgtcctcccatctccctgtaggacaacctggccctacatgccatcaannnnnnnnnnagtgtgcttgcctcctcttcacaaccgaagtgtagccgagctctgccaacagtagttggctggcccatgccaacacctttcccttcccagctccacgactgagcattgttcccccccttcctcccatctccccgtaggacaacctggccctacatgccatcaacttcctgacggccgtggccgggtctgtgcaccactcccttttccaggacccagccgtgctacgacaggtctgcgaatccattgtcatccccaacctccgcatccgggaagacatggtgggttggggtgtggggatggaaaaatcgggtggggaggctgctatgtggctgtgcgtggcggctggggtttcagacacctgggatagggagagtggcgcctggggggattggaccgtagagaacggtatacatgaagatggactgtgtgaatggagccatgggaacctgagtgggcctgctagcaccttcagccaggcgccgctcgcctccacagtgactggacgcctttcaaccccatgtgaaaagttgcaaagctgtccctacgctcacacaccaaaaccccaattactaccctaggaggagctgttcgagatgaactgggtggagtacgtccgccgcgacacggagggcagcgacagcgacacccggcgccgcgcggcctcggagctggtcaaggcgctgacggcgcgttacccggcccagaccaccgagctcttctccggctacgttgcatccatgctggcggaggccggcggcacagggcgggcggcccgctggaaggccaaggactgcgccatctacctcgtggcggcgctgacgctgcgcggcaagacggccagcgcaggcgcgacctccaccaacgacctggtcaacctccaggacttttatgcacaggtttttgggggaagcagggggcagagggggtgttggagtttttttttttggggggggtgggaggccagaggggtgattgtctagctttttgtagaggtgggccagagtaggagtctgcctcccagcgtcatccatctccttcccacccccgccccacccacccggcagcatatcgccccggagctggccgcggctgatgtgannnnnnnnnnggggggaagcagggggcagaggggttgttggagttttttgggggtttgggggtgggaggccagaggggtgattgtctagctttgtgcagaggtgggccagagtaggagtctgccccccagcctcatccatctccttcccacccccgccccatccggcagcatgtcgccccggagctggccgcggctgatgtgaatgacctccccgtgctcaaggcggatgctctcaagtttgcaaccaccttccggtcacagctgcccaaggccaccgccctggccaccttcccacacctcgtcaagtgcgcggggggggtggggggctgcagcgactgagttccatcgtctgggggagtaagtatgtatttatatcttgaatgctggatgatctggtggagggaaaatgttgaggaacgcaaatggctctcggcatgctgccatgcactgcagactcccccttgtactgcgttagccgcgatctatccaggatgaggaggcattctatcctgaccccccccatccctgcccatccctcccgccctccaaatcccaatcccaccttcccgccaccttcccgtcccagcctcttggcaagcgagtccannnnnnnnnncagccgtgatctgtccaggatgaggaagcgttctaccctggaaccccccatccctgcccatccctcccgcccttcgaatcccaatcccaccttcccgccacctccccgtcccagcctcttggcaagcgagtccaatgtggtgcactcctacgccgccatcgccgtggacaagctgctgagtcagcgcgagggcggcgccctgcgcttccagccccaggagctggcggggtgcctgcagggcctgctggagcgcctcttcgcctgcttcgccctccctgattcctcggagaacgagtatgtcatgaaggccgtcatgcgcgtcatcgcgtttgtgggtgagcgggggcatggaggggcgagggaggggggggcgagagggggaggaggggcggagagtggagattcccctgttgcccccgaaggggaaggaagaatgcggtgaaggagcagcaatcatctcaaatgctgctgcggacacccctcatgctgtgcgggaagccaggtagttttgcatctcggctcagtcgttttcccatccctcatcggcatccccactccgaccaccctccccctcccaccaccaggcccgaccatcgcgcccgtggcacccgtctgcctgcagcagctgtcccagctcctgctggcggtgtgcaagaaccccacccagcccggattcaaccactacctcttcgagtcggtggccgccctcgtccgcttctgctgcccccgggaccccgcctccgtggccaaattcgaggagatgctgttcccccctttccaaatagtcctgcaggaggatgtccaggtggggatcggggtttcatcggtgttgggtttggaagtatcaatgtggtgacagggtggggagcaaagcaccggcttggcatgcctcaggggacgcnnnnnnnnnnccggggtctcgtcggtgttgggtttggaagtattgatgtggtgacagggtggggagcagagcaccggcttggcatgcctcaggggacgcagccgtgttgtgaaggatacatggattccatgcctgctgatgcttcttgagaaggggcatggaccctcctgtagccctttggggcttctttgaagagctggcatggaccccatccacaggcctaccagcctgacaaggcggcctccgctcctacttgcaatcagaatccctctccactgacccacatacaacacaggagttccacccctacatcttccaagtctttgcccagctgctggagacgcgggagcccggcacgccgcttcccccctcctacgtggccctcttcccgccgctcctctctgccaccttctgggagcggtccgggaacacccctgcactggtccgcctggtgcgggcctacctcgcagcctcccccgcccaggtcgtcgccggcggccacctccccgccgtcctgggcatcttccagaagctggtcgcctcgcgcgcgctggaccacgagggcttcctcctgctggatgcgctgtactgcggcggcgtgccgctgaccgcgctggcaccctacacgccccacgtctggaccctgctcttccagcgcctgcaggccgcgcgcaccgccaagtttgtgcgtggcttcgtcgtcttcaccgccgcctttgctgcgctgcatgggccgggggagctgatgcaggcgctggaggcggtgcaggcggggattggcctcatgatcctggacaccgtgggttgggtgatgtactggggaggagagtggggagggcaggggcgatggagtgtcatcaggaaggcttgcacctctcgatgcacgtgtgtgggggcaaagggtgaagggttaggggctctgggccagaggttggggaggagggtgtgccagggaaaggtgtgcagctcacctcggacccccttgtcctgcacgacagcccagccttcccttgcacagcgcaccctgtcgcaatctgagacccctcaacccctcctcaaccgaccaggtcatcgccccannnnnnnnnngccctgtcgcaatctgagacttctcaatccctcctcaaccgaccaggtcatcgccccaaatctagcgaatgtgagcgggcagtgggaggagaagctggtggtggtggggatcaccaagctgatcgtggaggcgccgcagctgcaggcccaggagaaccagggcgtcgcgggcaagctcctggacgccctcctccggctcctggatggcaccagcagcagcgccggcgcctccggtacagctgggagagtggaggagggggggaatgaggacgggtggagacagtgtgggaggcaggcagcaatcgccacctgtatgccccggcgtggtccannnnnnnnnnggggcgtcgcgggcaagctcctggacgccctgctccggctcctggatggcaccagcagcagtgccggcgcctccggtacagctgggaaagtggaggaaggggggaatgaggacgggtggagacggtgtgggaggcaggcagcgatcgccacctgtatgccccggcgtggtccagctcatggtgaatgagagtgatcgagttcagcctgtcgacgtcgccaccgcaggcgacgaggccggcgacgaggaggcgggcgtgggcgccggcggctactcggccgcctttgcaaagctgcacaatgcgcagaggtgggaagggcatgtggtcttggtcgccgcaggtcatcctgcgattgcgggagtcccgtcgtcgtgccatgctggtgcaatgagatcctgcatccctcaacccattccaaacccaacctctcgccgcactgcagagtcgaacccgacccactcccgggcatcaaggacgctggcgtcttcctggccnnnnnnnnnnaggccggcgtccagctgacgtgacgggagcacgggggggggggggggggggggggggcccggnnnnnnnnnngtcctgcatcccccaccctcaatccattccaaacccaacctctcatcgctctgcagagtcgaacccgacccactccccggcatcaaggacgctggcgtcttcctggccgccagcctggcaaagcgtggcgcagcagcgccggggaccgtgtccgcgctcgtggcggcgcacgtctccgcggaccaccaggccaagctcgcgtccctggcctccannnnnnnnnntgcgtgcgtcgccggggcatcgggcgaggctcgaggtcgctcagggaggcacgcagcacaacctcacagagcactgcgtgacacaccggcacgatggttgccccgcctgccgccctccatcacagacgagcgctgaacctgccgtgcagcatccgcaccttgattgcttgtacggcgctctgggcacccttcattctcagccgtgccccagcatgggcctccagcctcagcgtgcacatgcttgtcatgcatgatgtaagcaacaatgcagtaccatgcacacaccacacgtcaggacagctcctgcaggtcgtccagggcatccctgaagcgggccgccagggactgcagctcgcggttcctggctatggccggcaggagggcggagcgcaacaggtcccgcttgtccagccccagcacccgcggctcccagccctgggatgatgccgggtcggcgacaccgtccatggcaccggtgggcggtgcgccccgacttgcaggccccggcgggcccaggaggtcggagcagagctcgcgcagccgcgtctcgtcccgtgcttctgcttgtggaaagggaggatgtgtggaaagggaggatgtgtggaaacggaggatgtgaggggagggagcatgtgaggggaggggagtgctcggtgtgcaggatgtgcatgcaccatccagcgtggcaccagaccccaagatgccgccctgccacggatgccacggagggagcattcccggtgcgcaacgctacatcgaggagatgcgcctgagccatgggacttccacccctccccccccttcccccctcgcacctgccaggaagctggcgtacttgaggagccagctgcggtactcctccgccgagcgcagggccagggccgccgcgagggaggcctccaggtgcgcgcgcgtggcggcggcgtcgccacggtgcgcggccagggcgcgcg

SEQ ID NO: 38488 - DNA, 25472 bp, Chlorella protothecoides
  modified_base (585)..(594): a, c, t, g, unknown or other
  modified_base (1160)..(1169): a, c, t, g, unknown or other
  modified_base (1252)..(1261): a, c, t, g, unknown or other
  modified_base (1397)..(1406): a, c, t, g, unknown or other
  modified_base (1707)..(1716): a, c, t, g, unknown or other
  modified_base (2388)..(2397): a, c, t, g, unknown or other
  modified_base (2560)..(2569): a, c, t, g, unknown or other
  modified_base (3563)..(3572): a, c, t, g, unknown or other
  modified_base (3626)..(3635): a, c, t, g, unknown or other
  modified_base (3710)..(3719): a, c, t, g, unknown or other
  modified_base (6074)..(6083): a, c, t, g, unknown or other
  modified_base (6668)..(6677): a, c, t, g, unknown or other
  modified_base (7212)..(7221): a, c, t, g, unknown or other
  modified_base (8090)..(8099): a, c, t, g, unknown or other
  modified_base (9158)..(9167): a, c, t, g, unknown or other
  modified_base (10050)..(10059): a, c, t, g, unknown or other
  modified_base (10942)..(10951): a, c, t, g, unknown or other
  modified_base (12026)..(12035): a, c, t, g, unknown or other
  modified_base (12776)..(12785): a, c, t, g, unknown or other
  modified_base (13278)..(13287): a, c, t, g, unknown or other
  modified_base (14050)..(14059): a, c, t, g, unknown or other
  modified_base (14129)..(14138): a, c, t, g, unknown or other
  modified_base (14777)..(14786): a, c, t, g, unknown or other
  modified_base (15569)..(15578): a, c, t, g, unknown or other
  modified_base (16438)..(16447): a, c, t, g, unknown or other
  modified_base (16526)..(16535): a, c, t, g, unknown or other
  modified_base (18305)..(18314): a, c, t, g, unknown or other
  modified_base (18501)..(18510): a, c, t, g, unknown or other
  modified_base (18669)..(18678): a, c, t, g, unknown or other
  modified_base (18734)..(18743): a, c, t, g, unknown or other
  modified_base (18802)..(18811): a, c, t, g, unknown or other
  modified_base (18908)..(18917): a, c, t, g, unknown or other
  modified_base (19032)..(19041): a, c, t, g, unknown or other
  modified_base (19452)..(19461): a, c, t, g, unknown or other
  modified_base (19526)..(19680): a, c, t, g, unknown or other
  modified_base (19765)..(19774): a, c, t, g, unknown or other
  modified_base (19859)..(19868): a, c, t, g, unknown or other
  modified_base (20083)..(20161): a, c, t, g, unknown or other
  modified_base (20607)..(20616): a, c, t, g, unknown or other
  modified_base (21062)..(21071): a, c, t, g, unknown or other
  modified_base (21229)..(21238): a, c, t, g, unknown or other
  modified_base (21384)..(21393): a, c, t, g, unknown or other
  modified_base (21598)..(21607): a, c, t, g, unknown or other
  modified_base (22157)..(22166): a, c, t, g, unknown or other
  modified_base (22455)..(22464): a, c, t, g, unknown or other
  modified_base (22637)..(22646): a, c, t, g, unknown or other
  modified_base (23338)..(23347): a, c, t, g, unknown or other
  modified_base (23715)..(23724): a, c, t, g, unknown or other
  modified_base (23986)..(23995): a, c, t, g, unknown or other
  modified_base (25071)..(25080): a, c, t, g, unknown or other
  modified_base (25400)..(25409): a, c, t, g, unknown or other
cttctcgatctggtgaaagtcaggagaggacggagggcttagctcactgcaggtgtactcatgcagtcgggcaaaaatccaggacagagtcttctgctgagtgcaatccatgtccttacagtcctgagtgtacaagaatgcgcctgctctacctgggcgatctccacagtctcccctgcgcgccatgttcgctccgtcgtattcccggtcaggtaattcttgagcttggatcgcacgaatgccgcgcctttcccaggcttgacgtgcaagaactctgcacgtaggaaattcggggcagatgagagttgctctggcagcatggcatgtcatgcttgcatggattttgcggccatgatcatgcccctcacacctgccatcctcgtcatgccgagtcactcacccatgactcgatagggagagccatcgaactcgatggtcataccggtcttgaagtcgttggaggaaacctgagctgccagggcggtgcccccgccctggccaaggtgccgggatggggacggccaccccagtggcatggggtttggcggctgggaatgaagactcctcgccacagacctgcttctnnnnnnnnnngtgtgtactcaggactgttaggacgtggattgcactcagcaaaagactctgttctggatttttgcccgactgcatgagtacatctgcagtgagctcagccctccatcctctcctgactttcaccagatcgagaagaaggacacacagttcacctacaccgatggcacggatgtgaggctttgcagagtggctgggtgctttgcaagtgtgcactcagagctagcaagggttgtggtggctgtgcacatacattgcacgggcttttcgattgcttcaccaccacttgtcctgcaagtgaccacacccactcaagaccctcactcgaccatctccacacttcctctgaaatttgaatctagtttgtcttcatggacatgtccagctacgaggagattcgtgtgcaaaaggaccccacgtgggcaaagtacctcactgaaggggccagtgtgtcgctcgtgctctggaatggcacggtgagtactttgtgaagtggcgatatgcctgccgaatttatacatgcttcagaagggtgtcagcaatgccagttgtacgttgctgcaggatgnnnnnnnnnncgtgaagtggagatatgcctgccgaatttttgcaagcttaagaagggtgtctgcaatgccagttgtacgttgctgcaggatgnnnnnnnnnngtgctcttcacgggcttttcgattacttcaccaccacttgtcctgcaagggatcacaccccctcaagacccgcactccaccatctccacacttcctctgaaactcgaatctagtttgtcttcatggacatgtccannnnnnnnnntcgatgctgcacctctcatctgctcctgcctgcatggcattggtgcaggtgatctccgtggacccacctgcgacggtggagctgcagattgtggagaccgaccctggggtcaaggggaacaccgcccaaggtccgcggttgtggtcttgacagacgccacatgatgcaatggttgatgcaatgagtgatgctatgcttgggctcgactccctaggcatgcacgggttagcttgtgatgcaccctcaagcatgcctctctttttacaacaccacaggaggcagcaagccagcgaccctggannnnnnnnnnctgatgcaatgactgatgctatgcttgggctcgactgccggggcatgcacgggctagctcgtgatgcgccctcaagcatgcctctccttccacaacatcacaggaggcagcaagccagcgaccctggagacaggggctgtcatctctgtgcccctctttgtgcagtcgggggagcgcatcaatgtcgacacccagagcggcacgtatgttggccgcgccagcagttagggtggtgctggtgcatgacagcgaggagcgtggaaggggccaggacagctcgtctgcacgggtgcttgctggggcgatggcacatatcgaggcctttgagccccttgtgaccattcttccgcacacggccccacctctacgtggctcggccggggccatacttgtagaactcgagtacgttcacatgctgagcagcaaggcagacaaggaaacagggtcaggcgctcacaggtcaacatccctcgggtagctgcccaggatccttaggaagggtgaaatctcctggatgtgcatgggcaagggagggacatgaaaactgtgcactgagggattggggtataaggtcatcctcatcatccagagaaatcaaggatggagcaagcaggcatccaaggacggcctgtccatgctcaaagatgcaacgcatccccagagtttttcagnnnnnnnnnnaacgggtgcttgctggggcgatgtcgcatatcgaggcctttgagcctcttgtgacccattcttccgcacacggccccacctctacgtggcttggccgaggtcatactttcagaactcgagtacgttcacatactgagcagcaaggcagacaaggaaacagggnnnnnnnnnntatggagcaagcagacatccaaggacagcctgtccatgctcgaagatgcaacgcatccccagagtttttcagaaagtacgcctctggcccccgacgccgctccatgagtcatcgccgcgccagggccccaccaacaaaagcgacaagagccaggcccttcaggcactccccgccacccacctccatgtgcctgagggcattctggaccttgggctccgccagggaccccacgaagtcgatgtagaacatgtagttgaaggtgcgcatggaggagtcgtcgtagtccatggacaggaccagcgggttctcgcgcatcggccgggactcgatcttggtcaggtcgatgtcgcgcagggcaaacaccgacagcgccttgaacagcatgcccgggccctgtggtgcaccaagggggggtgggacaaggcatcgagtcaggaattgcatgggcaacccccctgggcgcagtgggtgtcgatgagcaaggcacgccagcccctttggaaggtcctcatccctgccatgcactccgcaattgaggcgtgtggaagggatgcaaggtcatactcggcccccgactggacaccgccacatatcccacccccttcccgttcctcactgtccgactccctcagaaactcaccgcatggagcgtgaacactatgctggtcttgtaggggcgtgtgtcgttgggctgggccgccacctgcgggtcccggctcagcacaatgaagcgggtgacattgtcgcactggtcctggatgccgtcctccagcacactcaggccatacagctccccggcacgacgggaagccaccgccgccacgtccctgtgtggacgcgcggggggatcgggttgacagccgggtgccgtgcttcaggaggcagcggaaatatgtggggccgggggcgatgagtggactggaggcacgccagatgcgccggcacatgcaaactatctctcacaccgacgcccaccgctgtcacctccatctcnnnnnnnnnnagcacatgcaggctatctctcagaccgacgcccaccgctgtcacctccatctcnnnnnnnnnncctccccctccccctggagcaagcaccctctcaggagcccagtcttctccgcgtgaccccttaaatcacctccannnnnnnnnngctccccctccccatggaacaagcaccctctcaggagcccagtgttctccgcgtgaccccttaaatcacctccatcccttctctgagatgagcttggcggcccctgctgtgtcgtccacagcctcacgtaccactccaagctttctggtgtagccatcggtttgcgccagggcctggggatgactcatcacacgtttgatgtcggtcttggagacgccgggcagcgccaggagacagtggttgacctgttgaccagaacgggggcagatgctggatgaggcacggctcgacagggttgactgtcttggaggttggccataggtgggaccaacccagccgatagaccgtctggcttcttcttgaatatataggtaccaagcaaacagtgccttgaggaactgcatgaaccagcaagaaaaccacatcatccttgcgacagggccgtgctgatgagtgtgcagcctgaccctgggcacagcacgcactctgaagaggtgccccaccagagctcaccacaatggatacttcccccacaatgtgaaggcggtatcgtagaaggaggtcatagacgtcgtgaatggaaccgccaagggagttttccaccggaagcacggctctctcagccagccactgggatgatattggagaatgctcgggttgaggcacagctgcaaattgctcagcccaagcctgaatcgcaggccgaccagagcttgcacaccaaagcacccaatcccctcatgccgacaggctggacgctggaatcacaacccgcctgtgcaagcatccctcccgtcccctggcattcaaggtgcatctcagttttgcgctcagcaacccttcatctccacagtaaccttcgcagtacaatcacctgagacagcgcttggaaagcgacttcgaactgttcacatggcatgggctcccagttcggcagggccttcagggctgccatctccgagtatgcaccaggtgccccctggtaggcaaccctggagagtgggcgaaagcccgtcgccaactgctgcacggaggaggggcccgcctcctcgcccttgctcggcattgcgaagcgcagctgagtggccagactgggagaccgccccgcttggagggtggaggaactcactcccgtagaaggcttcgggggtgtagacgccgtagcccagactgcccctggccccagcttggaggctcgctgcatccggccatcactccgtgggcgcacaaaaccagctgtgtgactgtgagacaccatgccgagggccattgtctgcaacactctggccgacgaggtactagtgggcttgctgcacccacctaaccgagtgcttcgacacgctcaacaacaatgacgtcctaaatagtggacatgtgtaatgtgatccgaaaccaataatatgaatatggtagtctgtcactgcggcaatcgcttcgagtgatatctcggggcgtcatccgcctcgcgtgctgacgtaaagtaggagggaatgcaaggggtgaattgaaaggaaaccagtgggttgacgagacaccaacggcccacttcaatcatttgcgcagcaagatggctactgaccagcaacatattgcagcgagagtctatggcgctgcccaaatccaggattgcctcttcagcatgactttcaggggaaggcaagaaggggaagtcgagtggagtggctgctctcactgaaactagcaggacaaaggcatgcagctgtccaggcacaccttgaagggttatgtgaccacatgagaggcttccgaataggtcttagagttggaggtacagatctggtcatggcacattaggttttctttgagcacgtgatcgttctgaagagagcccccggtgcaccgcgaggctggagcacagctgcccatccacgctcaccaccgagtggatattcgatgaaatattgaattgtcatggtgctttgaacacattcacagcggcatcacatcgccgacatgcaagcttgtacacggagcctcgcaggggctccggtccacttccctaccacacgaccctgtctccatgcagcgcgagccgctcccggccacttgagcttcctaaaacggcatccttgggcggcaggaatgcccgtgagacctgcccttgtcgctgctaggcggcgcgtccacctcgtgaggtgagcgtgtgcaaccaacccgttacacctcgacccaggcccatgccctcccctgattaaatctacgcacctctccacgctacccacaggtcccaagagagagattctgctccagcacggccccaggttcccgagcaggtgggagcatttgtggggggggggcatactctgtgggtcgctcatgagccctcgttgctgnnnnnnnnnncccccaggttcccgagcaggtgggagcatctgtgtgtggggggggggggcataccctgtgggtcgctcatgagccctcgttgctgcatgcgcattgcgagggctgagctgctggcttgggccgcagtgtcgagggggagcactcaatccatgcaagcagcacctgacagcgcacgcaccctttttagttacaggacgccgctgtcacggccctcctggccgagtgcggccaggacctggaggagtgcgacgtggaggacagcccagagctggcgccgctcaaagaggccctcctgcgcgcccggcggcgcagggacgaggccctggggcagcgggaggccctggaggctgaggcgcaggaggtggcgcagctggcggtgaacgccgagactggcctggcggccgccaggaagctgctggaggccgccaaggccaacctggcctcggcggaggcagctgcgcctattgccaccggggcaccagaggcggagcccggctccaccaccggcgaagccggtcccgctgcggccgccgccgaggaccagggcaaggcccctggccccgccggcgaggacccgctgctggnnnnnnnnnncgcgcctgttgccgccggggcgccagaggcggagcccggctccaccaccggcgaagccgcccccgccgcggccgccgccgaggaccagggcgaggcatctggccccgccggcgaggacccgctgctggaggacctgcgcagcaaggtgagggagctggagcaccaggcggcggccgccgccgtggcctacgagtccgcggaccgcatcgcggcggcggccatggaggccgcggaggaggcagtgcgtgacgagatggagtgcattgccgtgttcaacgaggtggagagcgcgctggccaagaccatcgagggcctgcgccagctggacagcacctccgaccgccaggaggaggagtgggaccgggcctcgcactcctctcgtgcctctggcggctcgctctcggtgtcggaggccaccgaggcggcgctggccgccgtggccgtcagcaccagccccgacgcggtgggttggaagggacattgggggctccttcggtgggtattatcggcggaaaggaaggcaatggtgctcaannnnnnnnnnggggggctccttctgtggatatcatcggcggaaaggaaggcaatggtgctcaaggcatgggaggggcagaagcgtacgtcaggcacatgttcttgtgcccacctgtgtgaaggaggcagacgatgcttgcatgcccggtgcttgcagcaaaaccgtccagactcaccctctcctgaccagcgaccccttttgcggacatattctctccacttccaaaaaccaaacccaccctccgcagctggccaaggtcgcggcagccgacgcaaagctggaagatggggtgacccccgtgaccagcctgcccaccggcgccagcgccggcagcgccgcggtcgccgcggcggccgcggcgaagaagaagcggcaggcggccaagaggccgctgtccgtctacgtcatggccgcggtgtttgtcgcggcggctgcggcggcggctcagcacttgggcatgtttgcagcgctggcggcgggcgtgcagctggccgcggagcgcgcgggcgccgcgctggcggtgggccggggcctggtggcgggcctgccctggccccacatccacatccacgactccgagaaggggctgctggagaccatctggctcctcctctcctccgtcatcaccgtccccctcatctgcaagctccccggcggttctgcagtcctgggcttccttgccggcggggctatcatcgggccctacgccctcggcatcatccaggtgggtggactttgttgtagagggagggtccaggaagtgcccgcaaagggtatgcctccccagcagcgaaagccaacccccacccccccacacacacatataaaatcccctcacccctcgccaacaattacaatcacaatccccccctccttcnnnnnnnnnntataaaatcccctcacctcgcgccgacaattacaatcacaatccccccctccttccaaaacaacaataattcaacacagaacgtgtcttccgtgcgccacattgcggagctgggcgtagtcttcctcctcttcaacatcgggctggagctgtccttcgaccgcttggcgtccatgggcaaaatggtgttcggaatgggctccgcccaggtctgtctcaccctggcggccgtggcgggtgcctccctgctgctctccggtggcgcgctgggcggcgcgggcgccatcatcgtgggcggcgggctggccctgtccaccaccgcggtgggcatgcaggtgctggcggaccggggcgaaactggatcccgccacggccgcgctgccttctctgtcctcctcttccaggacctggcggtggtggtgctgctcatgcttatcccattgctcacaccctcgcccgagaatgccgcagcggggggaggtgagcggcgagggttttgtggggggaggggggggaggaggagctcctcggcttgaaggggcttgaggtggtgcctgatgcagcatcgcatggaacaaagtcaggtgtgttccatctgaacatgcaatatgtctgtcccaggagccctcgacaagcagctgcctgtcatacttacagcccccctcttccctttttctccttctcaacccccagtggaatccctcatccgcatctctaaggccatcggggtggcggctgtcaaggccgtgacgtgcatggccaccatcacggtggtggggcggtgggtcctgcagccactgtaccgccgggttgcaggtacagcaaggcatcgacgggtgtgcttgtgtctgcaggcaagggcgttggggcgacaatggggtggacacgttgttgagcatgctttctatatcggtgcggtgtgtctgtggcgggaatggagggcccaatcgaacgccgctctcccttcccctgcatgagcccaaccacacaaccctccccgaaccccacccaccccccaaccccacctaccgacccacctctcaacagagacgcgcaaccnnnnnnnnnntgacgggtgtggtgttgtgtgcaggcaagggcattggggcgacaatggggtgacacgtagttgagcatgctttctatgtcggtgcggtgtgtctgtggcgggaattgagggcccgatcaaacgccgctctcccttcccctgcataagcccaaccacacagccctcccctaccccacccacccaccaaccccacctatcgacccacctctcaacagagacgcgcaaccccgacatcttcgccgctatgacgctcctcgtcgtgctcgggacgtcgctaatcacccagctggcggggctgagcctcgccctgggcgcatttctggtgggtcggcccggcaagcacggcggctggttttgagcggttctggctgtgtttgggggttgtcctcgagtctggaggggagatgtgcatgtggccttgctctgagacacactgcccctggacgcggtggggctggaatgctgggaccgcgacgtgcttgttgccgaccctgtgcgctggctccccgagcaaccaccctccttgtcgcccccctccccaggcgggcctcctgctggcagagacccccttccacctccagatcgaggcggacattgcgccgtacaagggcctgctcatgggcctcttcttcatgacggtgggcatggagatcagcatgggcctgctcgttgccaagctgcgcactgtgctcgccgccatggtcctgctgatcggcggcaaggtggccgtcatggccggcgtgggccaggtgtttggcctcagcctcgtccagagcctgcgcgccggcctgctcctctcccctggcggcgagtttgcctttgtcctctttggcgaagcagtgcgtggggtcggattggtggtgggaaaggaagggggggttcnnnnnnnnnntgccggcctgctcctctcccccggcggcgagttcgcctttgtcctctttggcgaagcggtgcgtggggtctgattggtggtgggaaaggaagggggggttctatcggacgggagggcctggcatgagggtttccgcgtgacaatgcacagggaagggggcggacgtgcaggggccgactgcagggtgctctggtgatgctgggagccactcgcacatggcgatgttgactcgaggtattgctccagatctacagcgcaagggcctggcccgagggtatcccgtccctcaatcgaggtctcccctgagcaacatcgtcgaacagctctacaagcccttgccaccagcagtttgtgatcctgcgctttccccttcctccctctccacaggtgaccaagggcatcctgaacgccgcgatggtacaggagctgtacctcgtggtggcgctgtccatggcgctgacccccttcctggcggagtggggtgcgcgcctgggcaagatcctggataagaaggacatgaagactatgcagccgcaggagaaggaggtggaggggctgtccgaccacgtcatcattgcaggatttgggcgggtaggccgactgatcgccgagatgctcagcgagcagttgatcccttttgtcgcgctagatgtggacgccaatcgagtggcggtgagaaggctgggtggaggaggaaaggggttgatgtgtaagaaagggaggggcccctcatttccgctgagttgtgtgaggaagtgactgatagaaatccgctgggtcagtggttttgtgcagctggtttgagtcagggttggatggtgatcaaaagccaaggatcctcttggattgatttccataccctgacctccatccctggactgcnnnnnnnnnnattgatgtgtaagagagggaggggcccctcttttccgctgacttgtgtgaggaagtgactgataaaaatccgctgggtcagtgattttgtgcagctggtttgagtcagggttcgatggtcatcaaaagccaaggatcctcttggattgatgtccataccctgacctccatccctggactgccatcatatgtgcggtcttcccaccaactctctcgaaacttgtctccacaggagggccgtgcgctggacctgcccgtctactttggggatgccgggtcgcctgccgtgctgcacgctctgcgcgctgagaaggctgcctgcgccgtcatcacactggacacccccggtgcgtgctttggctggcggtatggggaaggtccatgcaggaggtgtgatgtcctgcactggagtcacacgacggccgtcatacctgccatcttgcttctcttgctgccgtcccgttcccacatctccttgattccttttcctacccaaatcaacccctacccacatgccacagccgccaactaccggagcgtctgggccctgcacaagcacttcccgctcgtcaagacattcgtgcgcgcgcacgacgtggaaaacggtgcgttgcactggatacgtgcagcgggggtgggagctgtgtcccgggtacccccccctagggatcaggtcaaaggcaaggctcgagactggccacagtcgattgaacatggcgaggcatggagctgccctcatgccctcgccggcgcgggtggcttgcgttctcctgcaggcacgcataaggctgctgatcctggcatgcatcccgtggccctcctcccacctgtcctgtgcaggtctgcaacttgagaaggcaggggccaccgccgtcgtgcccgagaccctggagccgagcctgcagctggcggccgccgtcctgacagagctggacatccccgagggcgatgtggccgaagccatccgggacctgaggcggacgcacctgtcggagctgcaggtggggggggcgtggagtgggatgcccgagcgtacacgcatggaattgctgggaggaaggtgtgcgggcgtacgnnnnnnnnnngcgtggagtgagatgcccgagggtacacgcatgggattgctgggaggaaggtgtgcgggcgtacgcatctatcgaatgccaggagtttctccccagcaggccgtgcgtctgaggtatgcgtcgtcccatgcacatgctcccctcccaccacaccaatcccaggatgtggcgcggaggagcaggacgagcctggggtacgaagtggtgggagagcagctgcgggccgtcacgggccctgaactcaacggcgcaggtcccctggagcccagcctggcagccccctgaacctcctgcattccacatctcaacttgccccttgagacaccttctccccaccccacacccaagttgggaaacccgatgactgtgcaatgcccacatgcatttccgatcatacccactcacgacattcccttgtgtaactttgaagcatacatgcgagggcatgctgaggagcagggaaagctcgcaagaagtgagagcaagggagcggagggggtgaggcatgagaaggggtgtgacgccaagcaaaggcgcgagaggcaggattgcaaagaccttgggagtgctccagattgtcgaggagaccagaacagctgcgggtccctccatcagtggacctcacggccatttgtactggaagctggagaggtaaactgggcttcattgtctggtgtgacgagggcagtcaccaggacagatcttcaggtctcatacctacgatcaacaccttgccagcgnnnnnnnnnntttgaagctggagaggtaagctgggcttcattgtctggtgtgacgaggacaatcaccaggacagagcttcaggcctcatacctacgatcaacaccttgccagcgtctcaacagttatcttctacccctcatgacgccttgatcagcccggcattgagccagtccaggctgacatcctccatgtgatcctcaaaatccgcgagctgtctgtgctttccctccgcactcagctgctccagggctgatggaatcccagctgtgtgtaccttcagcctgcctccatactccacccaattccggccatccttgatgtggagggtgaacaagggccgtgcgtcgctgggtgactcgcctccactggattgcaacagctgcctcaggccctcagggtccagctgcaagagcagggagcgggcggagaggcgaagaggtgagatcaactcctgatgcatgcaagagctatcatttgactgcagcagattctggggaagtcnnnnnnnnnnggggtccagctgcaagagcagggagcaggcggagaggcgaagaggtgagatcgactcctgatgcatgcaagagctaacatttgactgcagcagattctggggaagtctcgccgagccaggcaaaccaatgaaaaggcccagaacccctcgtaccacaacggcgatggcggagggccacagcgtcgcgacttttgtggcgagcagcttgccggcaccggaaagctgtgtgtccttgttgtgctcgttggcctggtagtagcccaccacctggactccgctctgtgttttcgtgtggttgtccacctgtacaagtgggacgagttgccagttgatttgccaggatggcccctgggaaggatgacgaaggaaaagcacctgtgcaggcagcctgcttgccgcgctcgtgaaaaacaggtatcccgtacttcagccctgcttctctcgagaaacaagtggccagctcaatgatgcccagcgtggctcggacctggcacagtgccgtctcaaaggccggaagaagtgttgtgaagttgtgtacaaagggcacagcatccgtggctgtaacggtgccattggctatgctgcccagcaaaaccccgttgacaccgaatgcggggtacttgatcgcgtgaaggaggatcttgagcagagcggtacgctcgagcgtatgatccccgcccattgcggtagggaagaggattacttggatcggcaaaagtctatcgatctgtacgaagcccaagcttgtatctatattgttaannnnnnnnnntcaccacaccaccttctgcatgcgattttgttgttaccgtttggaatggctggattcgttagtcatatgnnnnnnnnnncgaggaggattactggggatcggcaaaagtctatcgatctatgcgaagcccaagcttgtatctatattgttaaggattttgttttgttgctgatggcttcccaagtgggcctcacgagaccaaggtttggggcttcggtggtcgcgcgcgcccaccacatcctggcttacgccgttgcgccttgtgagaggtctttcaatgatctaccgctgatctcatccctcaagccccttccatgcatgccgaacaccacaccaccttctccacgcggttttgttgttaccatttggaatggctggattcgttagtcatatgtgctggattctgggcgcacttgcagcatgttgtgcgttccatttgaggacatcaaacccttgcatattctggttgagcagatcccgcggtaaaactaaacataaggtaagagagcacgaacacattgagcgattgctgggttccagtgggatgtcttaaatcgatagaatgagaatcagaagggcctatctagatgctctcgcacagctgtgtctcagcctgtggctggtaagcatacgcacttcgtgttccacaacctttggttccccttattttcgaagcaactgtacaagtgatgtttcagattgtaacaagcggatccannnnnnnnnntggttccccttgttttcgaagcaaatgtacaaatgatgtttcagattgtaacaagcggatccacagaacaagcagggatcccgaatactccctaatggaaggccccacggctttcctcctgtactgcttgtggtttaaactttttggttctgcgtagtggtgagcggtttcgagccgattattgcaaatgcacatgaagtcgcgccaattgtcatgggtccaagcaccgatctacatccggccaggcgatcggtccgtgccggtccattaaccactccccccgttcgtcactccggaccgttacgactttgcagcctctcccagccgataagaaagaagccatcatcctcacgttctagaccagacatttcaggagctgctggaatggggtacgacgagggggattcggtgacctccttcccatccgagagcgtcctcagctgggcggaatcgcaacggcgccaatgtcgccaagcgcctgcgacggtgagagagcagggagtgcatggaaacgagtgggtaatctcagtatagagcaaccgcggtctggatatgcaatctactccaggtgactcgcgatgcatggttgtcccagcgagaggagctggtccatgccaggaggaaggcgcacgaatgggagtgcaaggccagagagtacgcgagcggagacggagcacacgctgcaatgggttctattttcactgctgaaggccagatcctctccgtgcatggcatactgcatttgcaaggattgctggggccacacactctgatagagccacnnnnnnnnnntccagatcctctccatgcatggcatgctgcattttcaaggaatgctggggccacacactctgatagagccacacttgaagtgccttccgtccctctctccccagtctgtctgcccagctggcgcgggtggaggaggcagccaagcgggcgctcgtgggcaatgatcgttccctccggggtggcctggcgcagaggctgctcgacgcagagtcagcgctggcccgacagcggagcgagcatgcggatgctgcacagctggcgcacaagtaggcagtggtgtttggttgtataccttgaaagctcagcacagtcatattgtgtccattcaggctctccaggcgacattgccgcgtggacatgctttgctgtgtcccaatcgaagaattgcagatgcagctgcacagactctgacctgacaaacggacaggtatcgccgaagcgccgcggaggcagcaaagcagaatgcggagctcaagtccagactcgccgctgcaaaggccgaccaaagagcactcgccctgcaggcgagtcggcatgatggtggtctttgggacgagtctgatcgagctgggttttgcagttgtggtgcatcgtcaggccaggcattgggtgcatgatctggcagacattgctcagtgttgaggatggttcatcattcaatgcggcctgttgtcgctcatcttgtgtcgtgggcgccatgcatcctcaggtggggaagctgcaagccaaaacactcggacaaaagcagctgaggggccgggttggacaggcaggacgatcgcaggtaccccaggccgaaccccaaagcttgaaggggttgagtcttgtgaagcgtctggtggagcaacaggagcagctgnnnnnnnnnnctatttggtgcatgatgcaggctatgcacgattcattctgtgagtggatggatgtcacttggcaacagatagctctggnnnnnnnnnngcagcccagcgtgaggagatcctgtcgctgctccatgccgctagacgggcccctttgagaggtacgggaccgggggagagtaggttgcaaatgtgatttacttggtgcatggtgcgggctatgcacgattctttctgtgagtgggtggatgtcacttggcaacagatagctctgggtgatggagcagcccacttcctacactcctatcagcactgcacgggtcccaacaatgctcaagtggtgctgcccaagcacgcagcgcattcaatgtgtctgatcaccctccttcccatcctccttgcaaaacctggcctcagcatggcaccagcaccagtctttggtcacgtcactggaagcctgcatcctgtatgcatacacacccaggcggcttggagctgctgcggagctgcagaggcagcatggtggggtggcagagcgattcgtctgcaattgatctgcgtgacatcggagtccgggcactgaccagcatgggttagctgctcctcgcgttccaagttcatggcatcagagcttctcctcacatgcgtgctctccctccccacttcacgcccaggatgcatctgggttctgcaggagtggcaggagggcagtgctgtgtacctcagggacccggtcacaaactttgtatactccttggaggactggccgcagcccgtcgggcggctcacaggcggggtcccagccctgcaagcctgcccaccacgtgccgccctggcagcagtcattgccgcgcttggggacatgagtgggagcagcagcccaagcaccaacgggtcgcatgatgccgacgatccccatgccgggcggggcagccccatgaggatgctggagcgagggtgagtgtgcagggatgagagtagctgagtcggtctggtccatggtctgcatggatctcgatcactgaagtctttgccgttggtcctcgccatgtgcccacggttgcaggtgtctcgtgcgaggcattccaaccctgtgcaacctcaactttcttcgattccacacagggactctgagctgctggacttgctgcttcacccctatcccagggccctaggcttacctaccaggcagatcttggcccaggcggcaaaacttgccacctctcagccagggttccatggggttgcgcagttgaggcgcgccattgagaccgtggtttcagccgggagacgtcgaggcaaggccctcgtagcgcctgtcctgcgggtgggatccaactatcgcgatctcctggcctggatgagggacatggcgccttccctcgacaggtagatggaggcggactgcgcttttcctgctccatctcctagaccagtgcgcgacgagccatcactgcacagcagtctgggaagtaataatgcacgttgctgtccagaataactcataatatttctccaatcactcaaataggactgagctatgctacctcttgctggctgcaaagtgctgggacatggacagcagcgggcacttgagctcagcagccatgctatgcgcgctgcagtgcggggccacatggcgcatcaaggcccaggcagctggctcagtagctcacacgtccagcctgcaatctctcaccagcgctgcgctcttggaagccaagctggagactgacgctggcggtcaaaccccgaggggcgggacaacctgctcattgtctgggcacgatttggtcagtaaccaaggaggcccccctaggacgtcgcaacccgaaacgcccaccgaatgcatccgccgggaagagggtgnnnnnnnnnncgtctggccacgatttggtcagtgaccaaggaggccctgggacgtcgcaacccgaaattgccaccgaatgcatccgccgggaagagggtgtggagggagacgcgagatcacccctccagcccctcgaaggtctgcagacggagcctagacctcaacagaggccagcctctgggtcaagcactcacgnnnnnnnnnntgaattgaattgacgaccaattccggttccgtccccgccggccggatgccgatcttgcggagaagttcgaccaccgatcgggcacaagggttgttttcggagcacaacagcaagccggtactgcatgaccctcgaaggtcaagatgctcgcttcgatcnnnnnnnnnnaattcgcgactccccccacagcaatcctcttgaagcgataatcatcttttaatgcnnnnnnnnnnccgaatttgcgactccccccacagcaaacctcttgaagcgataatcatcttttaatgcnnnnnnnnnncagttcgcccaccgatcgggcacgagggttgttttcgaaccacaacagcaagccggtactgcatgcccctcgaaggtcaagatgctcgcttcgatcnnnnnnnnnnccgcgaattcatctaaagcatacatggtgttcaagcctccattgatcgcgataatcatggcattgctaagtaggcataaattctgcgcgagatccgaggatgcgcgcagctggcnnnnnnnnnnaggctacgaattcattacagagacttttaagaccgccatgagcaggtcatctgctccctcgcatggttcgaggttccggcatcccgccgatccgaaggtcgcctgcaaggttgcgtactgcccacgacctcgaggtcttgcccgttggtcgcgaattcatctgaagcatacatggtattcaagcctccattgattacgatacttatcgtattgctaaataggcataaattccgcgcgagatccgaggatgcgcgcagctggcagcaaaaccctggtatattcgcaaagatgctttattcgcatgctccgatgccccatggtgggggccatgccgccacccatctttgaagttctctccacgtccacagctcatgttgtatacttctctcatctaaaccaccgggcccttcnnnnnnnnnnatagttctctcctcgtccacagctcatgttgaacacttctctcatctaaaccaccgggcccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgctcagagatattggtgcacacgtgatcggcatgggctcactctccttaaccccgctgctcactgcagggtggacagccgcnnnnnnnnnncccgctcagagattttgatacacacgtgatcggcatgggctcactctccacaatcccgctgctcactgcagggtggacagccgcnnnnnnnnnnctcaagtccgatataaacttcccggccttgcctgagaggtgaggctggctgtgggcgcaattgggggttgcaccgattggtgactggcttgcgcagtttgcgtacccgacgtccgtccatgttctggagcgcatgccctgttcaccatcgtgtctggaacaggagacagtgtttccagccgagcgcagcggcataccgcacattcttggtcgctnnnnnnnnnnnnnnnnnnnnnnnnnnnnnnnnnnnnnnnnnnnnnnnnnnnnnnnnnnnnnnnnnnnnnnnnnnnnnnnctcgcaccatggccgccctcccggagttcacatgggcaagttcggttggcattccacgggtcgcgaagacttctggtttattgatgtcatgtatgtcgaagcatatccccgattttgtataacctggtcgaaagaccaggaagataaagctatgaccttgaaggtggcgctgaggcccccaccatcctcatccccatcccccccccaatcctccagatctttgccctgtcagtcgtgttcgggttcctgacggcagtcggcattggcgccaatgacatggtgaggggctggactgcgagagtggccctcgtccctggtgctcctcagtggagttctttcccggccggctccctcctcatatccttctccctttttaaccgtttccttgcaggccaacagttttgccactacggtagccagccgtgccctgaccctgggccaggttnnnnnnnnnngcgaaagaccaggatgataaagctgtgaccttgaaggtggcgctgagggtccccccatttccatcccccccccaaccctccagatctttgccctgtcggtcgtgttcgggttcctgacggcagtcggcatcggcgccaatgacatggtgaggggctagactgagagtggcctttgtcggtggtgctcctcagtggagttctctcccagccggctccctcctcatatttttctcccttttgggccgtttccctgcaggccaacagctttgccactacggtggccagccgtgccctgaccctgggccaggttgtcatcgtggcgggtatctgtgagtttgccggcgcggtgctgctgggcgccggcgtcaccaatactatcaagtctggggtggcggatctggacgctttcacctctacccccacggtcctcatgtacggcttcctgnnnnnnnnnncacgatcaagtctggggtggcggacctggacgcattcaccgccacccccacggtcctcatgtacggcttcctggccgtgtccatgaccaccgccttctgggacaatacggcttcgtacctggccctccccgtctccatgacccatactaccggtgagnnnnnnnnnncacggcctcatacctggccctgcccgtctccatgacccatactaccggtgaggggcgttggaagggcttacactggagggtaatattgctcccattgcaaggataactgacgggtaaacttgcctttgccaacgtcgaatgcattnnnnnnnnnnagtttggaagggctgacactggagggtaatgttgctcccattgcaaggataagtgaagggaaaacttgcctttgccaacgtcgaatgcattcccagggatgcagcatatgctggccggaggagcatgctcctcttcctgatgctcccttgtccgatcggtaccaagcctttcccagtgaccagctgtttcctgctctgcgcttgnnnnnnnnnntgggatgcaaaatatgctggtcggagcagcatgctcctcgtcctgatgctcccttgtttgatcggtaccaagcctttccaagtgaccagctgtttcctgctctgcgcttgcgcaacccccgtgcaactccaaaacgcccccacaacacgcacagtcggcgctaccgtgggtatggcactggcgctgcgcggcggcagcgccgtaatttggagcgagaacaaggaggagttcccctatgtggggggcatggtgcccatcttcctgtcctggatcgtctcgcccatcatgtgtgggattatcaccgtcatcctctttgccagcatcaggcagtgggtcctgcgctcccagcattccttcaagcgcgccttctacgtaagttttggaatggagaggggcccaaggggctgtgggctcacatgttcgagtgtgtgacgacgagatgtggtctcctggtgctcgcatgtgcgacaatgcgaccttaccaacttccacacccctcatggtcgagtgcaggtgctgcccttcctggtcttcggcatggtctggctcnnnnnnnnnnctccttcaagcgcgccttctacgtgagttttggaatggagagggggccaaggggccgtgggctcacatgtttgagtgtgtgacgacgagatgttgtctcctggtgctcgcatgtgctacaatgcgacctaccaacttcgacacccctcactgtcgtgtgcaggtgcttcccttcctggtcttcggcatggtctggctcatcgtctccttcatcattcaaaccggctccaagaacgggacctgggcaaactactccgacggctttgcggcctgggtgggcgcggtctgtnnnnnnnnnnccagacgggctccaagaacgggacctgggcagactactccgatggctttgcggcctgggtgggcgcggtctgtggcgtgggctgcggcgccatcacactcgtcttcatcatgccttacctgcgccgccgcatcctgtcgcgtgaggcggagggcgacccctccatgatggagnnnnnnnnnntgtgggctgcggcgccatcaccctcttcttcatcatgcccttcctgcgccgccgcatcctgtcgcgcgaggcggagggcgacccctccatgatggaggcaggggcaatcgcctctggtccttctctgggccccgacggtctgaagaaggatgcagaggaggggagccaggacgtggagcaccgcaacctgaccctgtcggagcagcacgcgcttcgctttgcggccaaggacaaggcctggaaagacaagaccttctgggagaaggtcgagtacaacccggtgaccaacatcctcctgcacaatgttcgccaggatatccacggtgtagcagagaccgacgagggcgtcaaggccgtgcacgacaacgctgagctgttcgacctcaagaccgaggccatgttccgctacctccaggtgaggggggtgggggggtgactgtggggtagcttgggaggaagagggtgaccttgtgggtggtggcacagctgggtgagtactcgttgcagatcgatcatccatgttctgatcggacatgtcgggctctgacaggggctcactttgctgtcatcatgggtgatgtttgagcaggggtgatgggctgcctattgcagcaggcaccgacctggcacaagatccttgatctgggtaatcatagaacagtgtggagatggcagctcttgccttttgccannnnnnnnnnagtggcagagaccgatgagggcgtcaaggccgtgcacgacaatgccgagctgtttgacctcaagaccgaggctttgttccgctacctccaggtgagggggggtggggcgggactgtggggtagcatgggaggaagacggtgagcttgtggatggtggcacaggtgggtgagtactcgctgcagatcgatcatgcattttctgatcgggcatgttgggctctgacaggggctcactttgctgtcatcatgggtgacgtttgagcaggggtgatggactgcctattgcagcaggcaccgacttggcacaagatccttggtctgggtgatcatagaacaatgtggagatggcagctcttgccttttgccannnnnnnnnnacagatcctgggggtgaggagggttggaaggaagggtgtctctacactgctgtagtatggtggatgttgaggtgtgcaggcatgaagacggaaagtttggaccggcgatcctgtagcagcatcggcatgcgggacgggggagtatggtccacaatggcatgctgcactgcttgagcgttgaggttgttgtgaaatgtacctcaatatccccatcaacatgggcctgtgctacgcatggaccaaccacccaacacatgccctnnnnnnnnnncttcacgcacggcgcgaacgacgtgagcaatgccatgggcccctttgccgcggtgtacgacatctggaacacgggtgaggtgaaccccaaggtccccacccagacctggatcctcgtcattggaggcgcgggtatctccatcggtctggccctcttcggctggcgcatcatccaggtcctcggggtaaggagggttgaaaggagagaggggaggggatgaggggggaggggggtttgtatctggctgtaaaatgggtcaatgtcagggtatgtgggagtggagatggtacggctgcccagagatcatgtagcagcagagacatgtaggacagggaggatgctccatgttggcatgctgcactgcttgagcgctgatttctctgtgaaatgtaccccaatactcccaagaccaggggtctgtgcctgcgcatggaccaaccacccaacacatgccctcatcaacaggtgaagaccgtcaaggtcaccaatgctcgcggtttctgtgctgagattgccactgccatcaccgtggccgtcgcctcacgctatggtgggtgtgctgatgttgtcgagggggtgagcacggcaaggtttccagcttgtgcagatgtaaatgctttgggcggaccaaatcttccttatgataacacaacagccgagagcggcacacattgcagcctggagatcgggaggggcattgagctcggtgcttggtatcaccatgaacctcaacccaccaaccacccttccgcaggcctccccgtctccaccaccatgaccatcactggtggcctcattggcattggctgcctggagggcttcaagggcatcaactggaaagtgctgctcagggtgcgtcctgcaataagccgtgatgggcggggaatggccagggacagggcagaaccacctgtgatccccgtgtatggaggagggaagccactgcaacatgccccgggctgtagtaaggatcaacaagtacacacccaccacaagttcgaatttgcttcactgccgtttccctccatcttccccagatctttgcggggtgggtggccacgctcttcattgcctgnnnnnnnnnntacaggtcaagactgtcaaggtcaccaatgcccgcggtttctgtgccgagattgccactgccatcactgtggccgttgcctcacgctatggtgggtgtgctgatcttgtggagagggtgagcacggcaagggttctacctcgtgaaatttactgttttggacagaccgagcctcccttacacaccggccaagagcagcgcacgttgcagcctggatgttgggagcggcatagacataagagctcggtatcaccctgtacctctccaccgtctcacacttcccaggcttgcccgtctccaccaccatgaccatcactggtnnnnnnnnnngggcataagctaaccagcatttcagaccagaaccgtgcatatgaccctcctcctctcctcccc

SEQ ID NO: 38489 - DNA, 61 bp, Chlorella protothecoides
ggccacgccctcaccaagcgccactccctccccatcggccacgccctcaccaagcgccact

SEQ ID NO: 38490 - DNA, 61 bp, Chlorella protothecoides
tcgagaacgccggcacggatcggtccgaaagtacctccgagaacggcatcttcggaccgct

SEQ ID NO: 38491 - DNA, 61 bp, Chlorella protothecoides
gctcggctgtacacaagcaaccagcctgagcgccttgcccacacccatgcagtggccggca

SEQ ID NO: 38492 - DNA, 74 bp, Chlorella protothecoides
cgaggatcatgagacgcccatgcaggtgggggtgcacgggcggcggtccatacctcgtttgcgaggcaatgggt

SEQ ID NO: 38493 - DNA, 61 bp, Chlorella protothecoides
gtgccaagggacaggcttgcaaacactgggggatgaggagctggtgcacagcattgaaggg

SEQ ID NO: 38494 - DNA, 61 bp, Chlorella protothecoides
cgcatcctcgtcttcgggtggaaagggcggcggcgcggcagcatccggcgtgcggtccccg

SEQ ID NO: 38495 - DNA, 91 bp, Chlorella protothecoides
tcggcatgttgccaggccgactagtcggcgtggcagccttcggaatcggtgatgagggcgttcaccccattgtcatggtcgctgcagccat

SEQ ID NO: 38496 - DNA, 80 bp, Chlorella protothecoides
ccggccaaggagaggcggctggtcagggagcactttgaggcggtggagggtgacggcgatgcccagtcggcatcggacac

SEQ ID NO: 38497 - DNA, 61 bp, Chlorella protothecoides
cggggagctgggcggaggcgagccaggcccaccctcaccccatgctgtgacatgcagagtc

SEQ ID NO: 38498 - DNA, 70 bp, Chlorella protothecoides
tggtccaaacggatgccgtcgtcgaacctgcgtgggtgaagaggggtgcacatggtggttgacggggagc

SEQ ID NO: 38499 - DNA, 126 bp, Chlorella protothecoides
cctggcatgagcatgggatttcctgcaatggcatgcaacctcccccctaccccttaggcaaggctctcactcttttctgcgcgggtgccctgcaccccccgcggcaccctccccacacgtgcggtc

SEQ ID NO: 38500 - DNA, 68 bp, Chlorella protothecoides
gcacgcgggcgcgcaaggtgtgagccgtgtcgctgacagcaggcatgcctgcccttgcttggcctttt

SEQ ID NO: 38501 - DNA, 63 bp, Chlorella protothecoides
gggagggacagggcccatgcacggcttcccacagcagcatgcgcagcatgcgcagcaggtcat

SEQ ID NO: 38502 - DNA, 72 bp, Chlorella protothecoides
ggagaaggggtgcatggttgcagtcggcgacgcgtcgttggggaggtggactcggggaggagatggtgggcg

SEQ ID NO: 38503 - DNA, 61 bp, Chlorella protothecoides
agcggagcctttgtaggtctgcagttggacattcacaacgaacctgagcatgggcagccct

SEQ ID NO: 38504 - DNA, 74 bp, Chlorella protothecoides
acccgcaccaggtgcagcggggtgtggagcacaggaacatgaccgcgcagggtcaggaggcccgatgccatggg

SEQ ID NO: 38505 - DNA, 72 bp, Chlorella protothecoides
ggatgccgcggcagagcccagcgccaagctctaggggtatgggagcacgcctttggcccctggggcagcccc

SEQ ID NO: 38506 - DNA, 61 bp, Chlorella protothecoides
ctcgcacgtgaagcgggtgctggcgcggtatccgccgcccgcgcccaccgaggcggcggtg

SEQ ID NO: 38507 - DNA, 61 bp, Chlorella protothecoides
aggtgggaaggcatgtcagggctgttttgctggagctgcaggtggcgataccactgtgcat

SEQ ID NO: 38508 - DNA, 63 bp, Chlorella protothecoides
tggggggggtgcaggcagggcagggaggggggtgatgcctaggcagcaagctgttctggctgg

SEQ ID NO: 38509 - DNA, 61 bp, Chlorella protothecoides
gccactgacgaggaccttgcccagcgccacataggcgcggccgtcagtggggtccatggcc

SEQ ID NO: 38510 - DNA, 143 bp, Chlorella protothecoides
gccagaatctcacattatgtggagctggcacaaatagagtacccaccgagcaggcacgcagcgtgacactgagttcatacgtaaccaacccagctgcaaccacgcacgaggctcttgggccctctgagccgatgcttcacatg

SEQ ID NO: 38511 - DNA, 61 bp, Chlorella protothecoides
ctgcctgatcacgcccattcctcccacaactggactcgtatgggacgcggcaaaggcatcc

SEQ ID NO: 38512 - DNA, 91 bp, Chlorella protothecoides
ggcggcgtgcgaggggctgccttgtgggagccaggcggggcgcctgcaggcagatcgggccgcccaccgcacaagaacacacatctcgagg

SEQ ID NO: 38513 - DNA, 61 bp, Chlorella protothecoides
tgctctgcagtcggtattatggctgtcgaggcgactcttcagtatcatcgtctgttctgca

SEQ ID NO: 38514 - DNA, 109 bp, Chlorella protothecoides
ggggggcagccggcacgcttgtcaacactgagcctagtgaggggagcatggggcacagtagcatgaccgccggcacacgccccattcaccccggctgcatgcacacctg

SEQ ID NO: 38515 - DNA, 190 bp, Chlorella protothecoides
agtcacgctgaggtgtgtgtgcgctgagggatcggggagggaggcaaggggaggaaggacaggggggttgaatacacagtctgaacgctgagccatgatgcctttggctggaggctcccttacatgtgcgaagagtgacacctctgacctcatcctccccctctgtgcgcagcctgccgcgcagtcgagc

SEQ ID NO: 38516 - DNA, 132 bp, Chlorella protothecoides
gattgtaaatgagcctagtgttgagccatgaagttgctgccagcatggggcgcgagaggagtccgaatcgatcgcaacagctctccggcgcgacctgctgtgcatgacgggaaacatctcgttgccaacagt

SEQ ID NO: 38517 - DNA, 63 bp, Chlorella protothecoides
tccggcatccaaggccaccactccccacgacgagcttccatcagggactgaaaccccttgttc

SEQ ID NO: 38518 - DNA, 79 bp, Chlorella protothecoides
caccacaccctcccccggctaagcgtgccggctgcgaaacccctgggcgaatgccttgctcggtgcagaccatgcgcgc

SEQ ID NO: 38519 - DNA, 61 bp, Chlorella protothecoides
cgagcttgaatctgtgtgtcggggggagggggttgggagaatgagccgggcagcttcagct

SEQ ID NO: 38520 - DNA, 136 bp, Chlorella protothecoides
gcaagctcgggtcgtcagtgacacaagctttccaagagggccgcttgcaacacaagctgcagctcttgcggccattcctacaagcgctgcagcaatgcaggcagcgacagcctttgccccatcttctgcaagcgtt

SEQ ID NO: 38521 - DNA, 836 bp, Chlorella protothecoides
  modified_base (437)..(446): a, c, t, g, unknown or other
  modified_base (498)..(673): a, c, t, g, unknown or other
ggcggcggcgccgacattgcgactcgcgaaggcccggcgctcgccaggcgcgcggcggaagcggcggaagcggcgcggagcgtggacgcgggccgggcggcgcgtgccgtgctggaaggagccatcggagcgatcgcgcggcgcgagttcctgccgctcgtcgcgcgtgcgctgctgagcaccggcgccagcctggaggcgagcctggccggaaagggcgccgcgagcgcagtgcagtgggggcctgcggcgagtggaaggcgcggtgatgtccctggcggcggcgctcctcgaggagcggcatggggcgaaggcgttcgcgacacccccccgcccctgcccgagttcttcggcggccaggacgacgcctgcgcgcgcgagctcgtgcccttcatggactttgatgatggcatggcgggcatcggtgaggggcaaannnnnnnnnnacctcgaggagcagcactggacgaaggcgttcgcgacacccccccgcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacctggggggtgccctggaggacagcgacgaggagcagcccctgacggcggcgcacgagtggctggaggagacgggcctcgagcgcgacgcgccggagccgccggcgggcacgcgccacgacgggccggtcgcgccggcgcccggcctgtccccggaccct

SEQ ID NO: 38522 - DNA, 150 bp, Chlorella protothecoides
gcgcctgctgcaggtacggggtgcagttctgaggcagaaactcactgtacagagcacggcatgtaccacttcttccgaaccgtgctggattggtaaatgttcacactcatcccatgcatccgcgttctcatcatcggccccatctcgtca

SEQ ID NO: 38523 - DNA, 13915 bp, Chlorella protothecoides
  modified_base (470)..(479): a, c, t, g, unknown or other
  modified_base (1629)..(1638): a, c, t, g, unknown or other
  modified_base (2187)..(2196): a, c, t, g, unknown or other
  modified_base (2894)..(2903): a, c, t, g, unknown or other
  modified_base (3086)..(3095): a, c, t, g, unknown or other
  modified_base (3166)..(3175): a, c, t, g, unknown or other
  modified_base (4742)..(4751): a, c, t, g, unknown or other
  modified_base (5582)..(5647): a, c, t, g, unknown or other
  modified_base (6483)..(6492): a, c, t, g, unknown or other
  modified_base (6745)..(6754): a, c, t, g, unknown or other
  modified_base (7058)..(7067): a, c, t, g, unknown or other
  modified_base (7958)..(7967): a, c, t, g, unknown or other
  modified_base (8753)..(8762): a, c, t, g, unknown or other
  modified_base (10142)..(10151): a, c, t, g, unknown or other
  modified_base (10663)..(10672): a, c, t, g, unknown or other
ctgcgcggctgtgcgcgtgcgagtgcctgacgagcccgaggtgtgcgtcgcggcgcccccgccgccgcactgggaggagctggcgcgggcgcggggctggcggctgcgcggcgagggcgcctgggcgtaacgcctgcgcggtgcgcgcagcggccggcgcccggcctccagaccctcctccctgctgagcccccgctcccccgccgagttccacgctctgcgacgtgtttattccaatgacggctggagtgcgcagggggtggggcagcacattgcgagcagggtccgttggggggggggttcaaaaaggggcaggaaatggagtagtgtacatggggggtgggagaccgggttccaggccccccgatccccaggaggctcccgcacgtgcgggcgcatgcacacgcgcgcagacgcccccagcacgcgcgcagacgcccccagcactcgtcccctccacgcgcgcgctnnnnnnnnnnctccccgatccccaggaggctcccgcaagtgcagacgcatgcacacacgcgcagacgctcccagcactcgtcccctccacgcgcgcgctcagatggggatgctccaggggtgcgacacgcgcccgtactggatgtcgcagagggcggcatgcatgcgcgcgacaaaggcgccgtcgccggccgcgcgcatcagctggccgccggcgcggacgaaggagctgatgggctgcacgatgcaggcggtgccgcagccaaaggcctccagcaggcggccggccgcagccgcgcgctccacctcgccgatggagatggtgcgctccgacacctccaccccgggcatggcgcgggccagggccaggatggagtcgcgcgtgaccccgggcaggatggtgccgtgcagggggggggtcaccagctcacggtggccggagccctgccagggattggtcaggatggatgggtgagagaggggggcggttcggagggatgccactggacccttggcatcctctaggggcctcccaagccctcccccccccaaaacaatcaaccccctaccttgtccagcaggaacatgacgttcatggagccgcactcctcaaacacggcctcctccggggcctgccccggctgcgcaaaggtgtagaccacctggggcgtgccgtgccgctccgccgcctcgacctggggcaggatggtgggcgcgtagttgccacccaccttggaatcgcccacgccgccgggccaggcacggcgatgcacctcgtccacgaagatggggatgggggtgaggccggacgggaaataggggcccacagggctcatgatgatgcccagcgtcgtccgcgtcgacctgctaacacccagggtgtgcgctgcacgtgagagggtggcgggtgaaagggggtttggggaagaaagtgaggcgcatgcgctcatcagcggttgcgacgagggcgacgggggcgaggaatgcgagcaggcgcccagagcatggacgaggccacatggccgggaatggtatggccaggttcgagagcatgctcagggtagctcacaagaccctggctttctgaagactgctgtagaagtcccggccacctgcccattcctgagccacccactttcttctcatccggctcacaggtgnnnnnnnnnntcgacgagagcgacgggggcgaggaatgcgagcgggcgcacggagcatgggcgaggccacatggccgggaatggtatggccaggttccagagcatgctcagggtagctcacaagactctggccttctgaagactgctttggaagttcccggccacctgcccattcctgagccccccactttcttctcatccggctcacaggtggagaaggcatatggccggatgtacatggagtatccgtcctgtgttggaagccaggcggaatctgtgcgcaccagctccttgagacactccagcagctcctgtgagcggaagtggacataagacccctcggcaggtaaggaggcaatgccctcatcttcctggctctctcaagtgggctgcactcccctgtgcccttgagtactacgatccaacatgataggagccctcgggccatcaatgtgaagaaaaaagcaccgagggagagggcgccaggcctgttccacagagttcatatcaggccagcaatcgacatcaatgatcactttccacaatctcctctttttannnnnnnnnnttctccctggctctctgaagtgggctgcactcccctgtgccctcgagtactacgatccaacatggtaggagccctcgggccatcaatgtgaagggaacagcaccgagggagagggcgccagccctgttccacagagttcatattaggccagcaatcgacatccatgatcactttccacaatctcctctttttaccaagatttccccccttccctcccgtactaggagtctcacctgggtgtcaaagggtgccagctggaggcgggccgcggagcgagccaaacgcctcatgttcatgtctggccggaagaggcgagcgcgaccgtccgcgccggcgtacgccttcatgccctcgaagcagcagaggccgtagtgcaggacaggggccgctgggtggacagcaatggtctgaaaagggccgatcgtgggcgtcgaccagccccggcctgccacatgctcggtcaagaacatgtgatccgtgaacacagccccaaacttgaggtcctgtgggcggggacgggcccaggatcggtggtagatacggagggccgaaggccaggggtggtctgttggagaactggggaccttctgggccggattttcccttcacaacaaccctagtgtggcaggcagttcacgcgagggggtacccgtcgtcgttcggaagcccaaagcacccctcggaacacagtcccgacnnnnnnnnnnatggtagatacggagggccgaaagccaggggtggtctgttggagaactggagaccttctgggccggatattcctttcacaacaaccctagtgtggaaggcagttcacgcgaggggggaccccccgtcgttcgtaagcccaaagcacccctcagaacacagtcccgacaccgccacttccgcannnnnnnnnntggcagctctacgcgtaccgatgccagggtgatacggaacgacgagtctcactcacgagactgggggaagnnnnnnnnnntaggttgagcttggcatttggagcggacagctcgtagcgaatgtccgccgcgcggaaactggcagtgtcgtcctgcaggggaagacggacaggcgtgaggcgctggcccctcagcagctctacgcgtaccgatgccagggttatacggaaggacgagtctcactcacgagactgggggaagccgcaggcacaggctcaggcgccgctgtgccgcgccgggtcgctgtggagatttgacggaggccccccggcaacagtcgcactccacgacatgctgccaagacactcatcgccacgacagttggcttgctgaacttttagcccaaagtgggttcgtttggagagatgcagcccgggatattccgtcaaaatgagccgcggccgcggcccctggtgtttgccgaacgcagaacaaaaatctgaggtgcaatcaccatatgccgatccgaacttccaactgcgagatcgaagaggtaaagtgtgtgtactctcgactcccgacccagaaaatgccgtcagcttgtgaagggccccgaaaccaaaagaccagtctcgcccagcacagcacgcgtggcacgggggtgtccccggctctgatcgccgaaacgggagccgatgttggaacagtgcaggcaagacccgagcagggcactttcaagcctgcaaattaatcgcttctcttccataatgggtgtggtagcgccgatacggaggtgaaggagctccctccttgacacagcttctcgtccctttccaacgccccccccaccggtccaccgaatcgtgctggagcgttgtgcatcatggcgatgtctgcctacatcatgaagcggcaggcaaatgcactaagttgggctcggctggtccagccagcagcagtggaggctgctagctgtgcatggcacccggcatgccctggccctgattccacctcggaacagaggcagccccctggagggcccgggccctggacggtggactctgggtcctttttgaggcgagcctacagcaagggcaggccacatgcacagcatggcagggcgcaggagcgcaggcagaagggcggcaccccgcatggggccgtgtcggtgcacatacgagactttgatcggcccacgcctgtggccccaagcaagcctgtgcaggctgcggagcccgccaagccatccctggtgcaggtgagaggcgtcttgggtcgaggtgggcgagggagggtggcgacatgctattgccagaactcacagtaacaggagattgcatgaaggatgaacccccccccccacccacccacctcttcaacccctgaactgtgtgtgcaggccctcaaggcggctggctggtcgcgacaggaggtcctgaacgtccccaacgccctctccatggccaggatggtctccggccccgccatcggctggtggatcgtgcagggtcaggtatggtgtggtgcgcattcgttactcagtccttggtgccgggacaattgccagccatcgcctgctcctttgcaggcccatgtgttctctatcctggtggttgcgggggccgaagggccctggctggatccctnnnnnnnnnnggttactcagtccctggtgctgggacaattgccagccatggcctgctcctttgcaggcccatgtgttcgctatcctggtggttccgggggccgaagggccctggctggatccctggccccaggcagggtctcttggcaggtctttccgccgtccccagaccccccatcggacatccccctcccgtccccctttccaatagtgggaccttgcggcgcctgccctggcggtgtccgcggcctccgactggctggacggcctggcagcccgcaagctggaccaacagtcggttctggggtcctacctggatcccatcgcggacaaggtcctcatcggctccgtcaccatcgccctcacgaaagcggtgagcggtgtgaggggctgtggggggaccatgatggtgttcgattgaggcgacccagtccctgtgacgaggacatcgccgtctcctttgaacgtcctgggcctcggcctgcctcctcaaaaccaaacaggggtcgctccctgtcgcgctggcctttgtgatcgtgggccgagacgtggggctggtggcggggggcgccctcatgcgggcgcggcagctgggctggcgctggcccggggcggccgagttcttcaggctgggcgggggcacggccgcggcccccgtctccccgctcctcatctccaagatcaacaccgtgctgcagctggggctggttggggggtgcgccctgcaagggctactaggctggccgtcgggggaggcgctcctgtccctgggcatgctcacggctgggactacgatctggtctgcggcggcctatgcccgcgccttcttggcggcggggggnnnnnnnnnnnnnnnnnnnnnnnnnnnnnnnnnnnnnnnnnnnnnnnnnnnnnnnnnnnnnnnnnntcaagcagtgaggggctctggccccagtgaatgcacacggatgctgcgatgaaagcaatgagacgaaagtgtgtcgttcatggattggcgatctgtgcacacccgggagtgctcgcacccccctttcccctgctccgtgcctatgcaaccgcgacacacccttggcgccatagcccgggcagtttcgttacatctccgacacccccccgaacccgtgatacactgcagtagttggttgtgttgtacagggatcattgcaaaccgaggacgggagtgctgctttcccccaggcgtcgggtccatcaaccctcgcttcctagccccactcgcttgcgggacaggtcgttgccaggcccctaccccaccctgacaccggacccccggccactccacctcccccaccccgggtcatggggtgtggttccagcacacctgcgacccacgacgggtccaggggcaccagcgggggcagcaggtccaagtcctccaaagacgacttttacgtgggggacaactacaagcggctgaaacacctaggtgcgggccgggcatgtggtagcagacctcctcccccatccacccccgctgctcgaactttgggttccccctggcgcaggcaagggcggcacgggcgacacatggctgttcaaggactccaataccgggagcgaggtggccatcaaattcatccggagacccctcccgaaggtcttgctcaccaacatagtccgtgaattccaggtgtggcatgtacttgttgggatctggccgggtgcccgggcgtggagtggctggtccggtggaagggggtgaggggctccctggcccagacggannnnnnnnnngacttgttgggatctggacgggtgccagggcgtggaatggctggtccggtggaaggggggtgaggggctccctggcccagacggacttgcagtgccagcaactccttgcgctgcggacggcaagcggtgcacccggtgaagatcgcgttgttgcctccctgcgttgccaacgcacgcctgcgtggtcgagtgctggaggatgtccaggccggccctgcctgtttggcttgggcgctcctcctgcacaccggcnnnnnnnnnngactccttgcgctgcgtacggcaagcggtgcacccggtgatgatcgcgttgttgcctccctgcgtcgccaacgcacgcctgcgtggccgagtgctggaggatctccaggccggccccgcctgcttggcttgggcgctcctcctgcacaccggcgtggcatgcctgcatggcgccccatccccatgtcccccccccccccctgacatgcaccctctccccccttggccccagatccaagcggagctggggttcgggcacgccaacgtgataaaagcgtacgaggccatcctgaccccctcccacnnnnnnnnnngtggggggcccatcctcaggcccatcctcccccctgacatgcaccctcccccccctggccccagatccaagcggagctgggattcgggcatgccaatgtgatcaaggcgtacgaggccatcctgaccccctcccacctctgcctggtgatggagtgcgcggagggcgggtccctgacctcctacgtggccgacaagtggcagaaggcccaggccctgggcctgttcctgtccgaggacgaggcgcggtacttcttcaagcagttcctgtctgcggtgagctactgccacgcccacaacgtggcccaccgcgacctcaagctggacaacacgctcctggactcctccgacccgcccatcatcaagatctgcgactttgggttcgccaagtcctggagcgaggaggccaacatgttcacccagatcggcacgcccgtgtacatgagccccgagctgatcaactccaagaatgggaagctggggtacgatggccgcagcgtggacgtgtgggcctcgggcattctcctcctggtcatgctcctcggctccttcccctttgatcacaccgagcaccccgaccccaacacctccgaggcccacctggaggtctggctgcagcaggtgagcaagcggtggagcgaggtgccgcacatggcggaggccatcaagaagctgtcgccggagtgcaaggacctgctcaaccgcatcttcaccatcgacgccaagaagcgcatcaccatcgagcagatcaagcagcacccctggtgcggcgcgcggggggtggggggggtgggagtgacctcgggcggaggcgtgcaggctaccccctgcttcactgcttgagaagggagcccacgtggcgccctggcccgtgcctggcgcagccaccggcnnnnnnnnnnggcggaggcatgcaggctaacccctgcttcactgcttgagaacggagcccacgtggcaccctggcccgtgcctggcgcagccaccggcgccaggcacccacatggctgcccccccccacatcgcaggtacaacatgaaggtgccggagaagtatgcgcgcgtgctggaggacctgaacgtcagccagggcgccatcgaggagaagatgaagctgcggcaggagaacgaggaggcggtgaccaaccgcgccaagaacctgctggccatggtgaccgaggccacgacgctgccggcgccaggcaaggagtgcccgctgcagcacatcaacctgcgggacgaggcggtgctcgaccgcgacattgccgtcaaggagggcaacctggcggcctgacgtgcgcgaggcggcgcccgcgatcgagactcggacctttccctcccctcacgagctgggcgcggggggtctgcgccggcgtcgcacgtatgactgacccggccgacttgattttccctgcgcacgatggacgggccaggcagctgcgcgactcggccgggtttcccacccctgaccgacacccccgcgcctgagctccatgacctggcctgagggtttcccccctttcagttgtcgtggcgagagtcggccgtttgaggaggctacaaccccctttttcataatgcacacctgtcatacacacccctctggacaatcgaaaggacacttgaacgggctggagtgtagggggggggggagggaggggaaaattgacgacagttgccacaggaaannnnnnnnnnggaacgggctggagtgtagggggggggagggacgggaaaattgacgacagttgccacaggaaaagtccgtgcattggagaggggatggggggttggagggcccggcgacagctctcggccaccgccggcgaggaagaccgcctgcatccctgacgcctccctctgcaaggtgcgcctggcgaggtcctcgccagaactttagcgcggagaagtgccgcgctaggtgcgcctctgcagaagactcgcggggctgccccagtccccgcccgtgccgcagtttcctcgtcgcatcgccctcttagctgccagggtcgcgctgcgccgctgccagaaggacacgcgcctggcccacagcggggatgagagcgtgacctgcccgtgctgcagcagcagcacacctgcggccagggccacggccgccagggcgccggcagctgcccagttccaggcgcgaggggtgggcgaggggagtggatcatcccgaggagcgtgtcgctccctctcaaagacgagtacttccttgggcctggccgcctgcacatatttgctgggcgctggattctctggtggggactggttggatgctggcccgccccgggccgggtctccaggcaccggctcgatcggcttcacctcgccgtcctccccgcttgagcctggcaggcacggggcctgctcaggctggggcggcggcgccccgagcaacatcccgcccttgggcatccccgccgcactggccgtgtgcatcatctcccccagcagtcgcgagtggcccggcttctcaggggacaggatggcggcgagcagggtctcccctcccgccgacgggctgagacgaggtggtgaggccggggggtaggggaggccagccgccaaagccattggcccctgcccacccgctgatcctggcactcgcccgcctgtctctgacttgcctcctgatctgatcgcaccctcggctccgaccggctgggtagcccgtgctccaccgtcgccaacaaaggcctcgtcgcagcgtcgcagcgaggcgctggcaaggcggcccgagtccagcccggcggccgcctgcagccaggcaaggccctgctggctgctgggactgggactgctgcagctgctgcgcgcgctgagctggccgccggcccggcttccgccgccggcggggctgacgtgctcggcgttggggctggggctggcgctggggcagctctcccggcagccacccgggacctgcagccgcggcgggcgaccggcagggcgcttgagcggggagtccaccgtctcgaagcgggcctgtggttgcagtgtgccaaagggccgcatgattggttgatcgggcttgagggtacgtcacgagtgggtggtcagagggaggggcannnnnnnnnngtgcagtgtgccagagggccgcatgattggttgatcgggattgagggtaggtcacgagtgggtggtcagagggaggggcatggaggagcactccctccaaaggtcaggcagtggcccgagcaggcgtgtcaactcctgctgctgtgaacccacaggcagtcggaaggtgccatgtgcgacccggcacactcctcccctctcccaccgccgacgatcagcgcgcaccttcctcgcctttgccagccgccgcatgctggtcctgatggcgcgcctgtcctccgcgctcgcaaactcaggcacctgccgcatgggccgcgggagggttggcgagtcgtccagcagggttcagggcatgactgggcatcgaggaggagcctcttgccataccaggctggtgagcatccgtggtcccctccctgtctctgccgcatgtgtgccgctgcatcctcgagctccatgtccttgtgagcaccgccaggatcctgtgcacgcagtgctctgctgggtctacnnnnnnnnnngggagcctcttgccacaccaggctggtgagcagccgtggtcccctccctgtctctgccgcacgtgtgccgctgcagcctcgggctccctgtccttgggagcaccgccaggaacctgtgcacgcagtgctctgctgggtctacgcagcacccctctcacccaaactctcacacacctcagcgtgcccgccgcgcctcaggatggaggccaggtcccacaggcaactggcgatgcggtggcaggccctgcccttctgcagatcggccagggagacgaggtcgccagggcccacacccagctctcggcacatgtcctggaagcgcgtcatgtcgtccaggacgtggcggtgggggcgctcgccaaaccccagcttgtcggggagggcggggggcggcagtcccgcctggacggcgtggagatgccgtgcagccagccctctgatgggtagcatacgagaggggacagggggttggattgcttcaagattaactgccaatgaactcgagaaacaatcacaggcgaggagatcgtcgtcactatcaacggccagatcctgccgggttgctggcagatattccactccccgtgtcctccccacccagagtggcccctcacaggagaaggcagttgctgatgaggacgtcgaagggggtttcttggggaagatcgcatccaagcagcttggagagccagagtgtggcatggcatgtgaggaagtgctccacattgcggcgcaggctgtcgcgaggactagggacgggacactcaggcgcgacgcctgggctcgccatcgccttcgaggtcgaggtgcggctaatacctgttgcgatccgccgagacaataagactgcacttgatttattcggtgtacagtcggagatccgagaggtcgaggatttttcaccaactgttgttgctaccttttgaaagggaccccatgctgggcgcggtgtgcggcacaagatctcacgagccgctgtagtttggactgcatgcggtgcgagcacgggacatgtaaaaaactacaatatactcatacaatgtcgtttgctcggtcggatgtgcgccgtgcccattccccagcgttgtaattgccgaggccagagcctcgcagcctcctccgtgcttgcgttgcacccagtccagcatcgataggaggcggccacacaactcgacatggttcgatttaagaatcgatacatggtatttgagctcgagtggaagcatgacagtggcagcgctggcctgagtaagcaaggctggggggggtgaggggggtctttgaaggctggagaagcagatgtgtccagaacaatagccttcgttcacccatttcccttgcagacgagctcaagctgctccaggtgtttcgacaagcagtgcaggatctgcatggggaggcactccttggcctcgtgctggcatccctgcaaggtgaggcggctagttagctctctggaacccagatagcatactctgaattgaattggtgccaatatcacctggctgagaccctgtgcatcccatcctcacaacgcaccctactgcagtcaagtactacaatccattgcaacacctgtgtgtcgtccgctgcggtcgtgatgaccatacaaaggtgtgggtgagtggctgggcctcgagttgtcaggcactgctggcgagcgcgctcaggcgcaggcatgcctgcgctgcaggatgccttctataagaactcaaccctgcacacccaggtgtgggctgccctcacctgcctgacggccatcaagaatgagccagtggctattcgactggtgcatctgacaggagacgtgaatgcttgcaaggctctgatgctgaagacattgccggaagatgatggagtcgggcccaatgctaagatattcgcacaggcccgactcagcatagaggcaatggaggtgtaaagcctgtgccgttgcttctcccctttgcttctacattgcagcatcgcacttgataactctgacagctccaaacttggtcttgacaagacgttgtttgcactgtgttattttactgtaaccgcttagattttttgacttgccaacctggctgcctgaagatttccggtacatactatcattgacccaggggccatcccgggaggtttgaacaatccccgccatacggtgtttgaccggatgggggcctgtgcatctgcgagctctcgcaaaaggcgggcgacggagaacccacttgcaggatatgcacgtgaggggtgtgaagcacgaagccggggtccatggcgggggagggactcccctcggatctgcagggcggcgtggtgctgttccgcaagctcatgacagtcctggtgcgatcagatggcacggacatcggagcacgctcactggatgtccgtgtcatgtctgggtcccgacgatgcatcggcatgcagaaggtgagaccagctctcggctacggtagtgttgttgggttcgagagtgggacacccggcaccgtacctcgagacccatctggatcctgggcaagatttcgccgcttgcacccaaacatcctcatcaaaaagcaatatcacgcaatgaggcggctcatcccgagacacacgctaccctatccaggttctgcgcctgtacgtctccagccctaccgacccgctcttcctctataccatggactgtggggaggaggatttccgggtcctgaaggcctcccaaggcctcctggtggaccacgctaactttggggccaagctggtgggcctcctcgatcgctgtgtgacgtgcggcgccgacctggagccgaggtgaggtgctcatgcgtggatcattgtggcccggaatgtctcggcagcaaaggccacggggtgtcttgaatggcatgcgaggtgctctctcgactagtgagatgaggcgcggtattgtgagggtctctcctcacaccagaggaatccaacacacgcacctctcctctggttgagcaaaaccttgcacagtccctccccgctgtctctccagattccaggcggtgctggacgagggccccgcccccggccccaccctccacattacggagcagaacgacctgtcgcgcaggccccacctctcgctcggcctgctgagtggctcagagggcacggtgaagacctatatagcgctgcgcctcgccgaggagcaggcgcggtccgccgagctgtcggccgagctcggccgagccctggccgcatccaaggcggccgcctcggaggcggcaagtgcctccgagg

SEQ ID NO: 38524 - DNA, 71 bp, Chlorella protothecoides
tcaggatcccaggcccgcatttgcacagcccaagggcgccgcgccttggttctgacagtttcgcgggacga

SEQ ID NO: 38525 - DNA, 73 bp, Chlorella protothecoides
ctgccattcctcatcctgcccacctgcagcctctgtcacgcagagattcactgtcagcattccggcatcatca

SEQ ID NO: 38526 - DNA, 109 bp, Chlorella protothecoides
cttaacaggcccgcctagctcgcaatttccgaaccaatggcactgtcctccaccagcatgcgtctgccacatcacccgcgcacagatgaagatccaggtgtcggcctcc

SEQ ID NO: 38527 - DNA, 118 bp, Chlorella protothecoides
cattggttcgaacgatccgacttttgtgttactttcatgaactgcacgcgacacagtcgcgtgcagcgcgtgctttgcctttcctcgtccatagataccaggcatcgcttgcgatgaa

SEQ ID NO: 38528 - DNA, 94 bp, Chlorella protothecoides
gctcctggtggccaacctggtggctgctcgtggcaacaccctacccgagccggcgcggggcctctttggagccctgtatggcttcatgctgggc

SEQ ID NO: 38529 - DNA, 162 bp, Chlorella protothecoides
ctaccccacatcccctttcaccctcttcataccaataatgagctccaaccccccttttcccccccaaaaccaaggccggcgcggctgtggacctgggctgcgctgcgcacgctgcgcgagcccctggtccagttcatggcggacagcaccaacttcacgcgc

SEQ ID NO: 38530 - DNA, 133 bp, Chlorella protothecoides
ggaggaggccttgtatgggggagggaagggggggggcatgacactgggaacccctggcttctgcgcgcacacctgcctcccaacagcaaacgacagtgatgccgggcagatgtgaggatttgactcctgccca

SEQ ID NO: 38531 - DNA, 76 bp, Chlorella protothecoides
ccctgccatgccggtgacggtggcctacctgagcaagaggtgcggtggaagggagaggggaggtggcgcaggtggc

SEQ ID NO: 38532 - DNA, 78 bp, Chlorella protothecoides
ttcgtcttcggggccgcctcggcggcggcaccctcggaggccgtgacatcagcgccggccacctccgcagcgctcttt

SEQ ID NO: 38533 - DNA, 62 bp, Chlorella protothecoides
tggcagtacccttggccctggtgacgagcgtaccgctgcggtgctcgcccggtgtgcactgt

SEQ ID NO: 38534 - DNA, 42820 bp, Chlorella protothecoides
  modified_base (796)..(805): a, c, t, g, unknown or other
  modified_base (879)..(888): a, c, t, g, unknown or other
  modified_base (1467)..(1476): a, c, t, g, unknown or other
  modified_base (2524)..(2533): a, c, t, g, unknown or other
  modified_base (6437)..(6446): a, c, t, g, unknown or other
  modified_base (7594)..(7603): a, c, t, g, unknown or other
  modified_base (7683)..(7692): a, c, t, g, unknown or other
  modified_base (8062)..(8071): a, c, t, g, unknown or other
  modified_base (10136)..(10145): a, c, t, g, unknown or other
  modified_base (10651)..(10660): a, c, t, g, unknown or other
  modified_base (11523)..(11532): a, c, t, g, unknown or other
  modified_base (11819)..(11828): a, c, t, g, unknown or other
  modified_base (12417)..(12426): a, c, t, g, unknown or other
  modified_base (12806)..(12876): a, c, t, g, unknown or other
  modified_base (13041)..(13050): a, c, t, g, unknown or other
  modified_base (13155)..(13164): a, c, t, g, unknown or other
  modified_base (13268)..(13407): a, c, t, g, unknown or other
  modified_base (17639)..(17648): a, c, t, g, unknown or other
  modified_base (18505)..(18514): a, c, t, g, unknown or other
  modified_base (19388)..(19397): a, c, t, g, unknown or other
  modified_base (19761)..(19770): a, c, t, g, unknown or other
  modified_base (20823)..(20832): a, c, t, g, unknown or other
  modified_base (21230)..(21239): a, c, t, g, unknown or other
  modified_base (21579)..(21588): a, c, t, g, unknown or other
  modified_base (22045)..(22054): a, c, t, g, unknown or other
  modified_base (22117)..(22126): a, c, t, g, unknown or other
  modified_base (22789)..(22798): a, c, t, g, unknown or other
  modified_base (27013)..(27022): a, c, t, g, unknown or other
  modified_base (27250)..(27259): a, c, t, g, unknown or other
  modified_base (28701)..(28710): a, c, t, g, unknown or other
  modified_base (29188)..(29197): a, c, t, g, unknown or other
  modified_base (29441)..(29560): a, c, t, g, unknown or other
  modified_base (32229)..(32238): a, c, t, g, unknown or other
  modified_base (32820)..(32829): a, c, t, g, unknown or other
  modified_base (33920)..(33929): a, c, t, g, unknown or other
  modified_base (34490)..(34499): a, c, t, g, unknown or other
  modified_base (35571)..(35580): a, c, t, g, unknown or other
  modified_base (36055)..(36064): a, c, t, g, unknown or other
  modified_base (36954)..(36963): a, c, t, g, unknown or other
  modified_base (38956)..(38965): a, c, t, g, unknown or other
  modified_base (39893)..(39902): a, c, t, g, unknown or other
  modified_base (40677)..(40686): a, c, t, g, unknown or other
  modified_base (41035)..(41044): a, c, t, g, unknown or other
  modified_base (41397)..(41406): a, c, t, g, unknown or other
  modified_base (41675)..(41684): a, c, t, g, unknown or other
  modified_base (41773)..(41782): a, c, t, g, unknown or other
cggcgcggcgtccgcgccgccgcgttcgccggggacctccagcggcgcgggcagacgcgccagcagcgcggcgcacagctcgcccaggcactcctctgcccggccgcccggcgcgtcgtgcgcctcgccagcgccgggctgggccgtggccgactggcccagggcgcggtgcagctggatctgggccagcacggcgaggtcggcgtgcacctgtgcggagttgttcgttttggggggaggggtggcggggtgcgagggagaaataaacagtgtgggtgcagccctgtgagtggccgcctgtctctcctgccgctcggcatggacgcacttgaatccccgcgcgacctccatccccccacacccttcgtgaaccaatcaccacagccctggcagcaagcagacctggacagtgcagaaggccagctcggcgctggagttcaggccgtacacctccggggcctcagcctccgggatggcctggatgagggcctggtgcgcctccaggcctggcgcgtcggggacggcgtagggccccggcgccccgcccccggtgtgcaggctggccccccgcgccagcatggcgggcgcgtaaaagtgctccgccagcgtctgcagcaggcgccggtccgcgtcctcgctcacgcgcccaccgtactgcaccatggccaccatgtactgcagcgtgccccagttggggccctggccgcgctttgtgtccacctctgccatgtggttctgtgggtcaggggagggattttttttttttcggggggggggggggggggggggggggggnnnnnnnnnncgtgtccacctccgtcatgtggttctgtgggtcaggggagggttttgggggggggcgtgtggggcggggggggnnnnnnnnnncgaagtggagggaagatcgcaaggccagggcggcccgctgagcgaggtgcagcccgcgcagcccacctgcaggaagtgcagtgcggcggcgaggtccgcctggtcaaaggcgtaggggatggtccagccgatggggccaaacctgcgccgcccctgaagcacggcgtgcatgaaacaggtgatgtagaccagctggcgccagtcggggcggttgaccgcgtccagggtgtcctgggacacccaggcgtaggaggtcttgagccctgccctgaggcccgtgggcgcctcgttggtgctgcgcaggccggcgtgcaacaggccgatggggaaatcggggtgtgggctggtggtcagccacagccggaagtcggggtggaggtgggctcgatcggccgcaagctgccgctccaactgggaaccaaggggaggggagggtgggtgggccaagagtagggacttagggtgtgttgcggtgggaggtgtgatcagcgcatgcccatgtaaagcagtatgcgttgtaaagggcaatcacatgcttcacatccggtgcgaccaagattcttgaaagtaggtgagtgnnnnnnnnnngacgcatgcccatgtgaagcagtatgcgttgtaaagggcgatcacatgcttcacatccaacgcgaccaagattcttgaaagtaggtgagtgtgaacagggcatcccatcaaggccacatgcttgagccatggaccccacagaaggagcccttcccaccccttccccccaccacccaagccacacctcggccaggtactgggtgttgaggtgcgtgttctggaggagcacccagcggccctccaaggcagcggtgctgacgagccggcgggcagccacctcctggccctgccccatggacaggatgctgagcttggccttggccagcttggcccgcgtctcgatctgctcggtggggtcggcgcctgcgcagcgcggggtgataacaggaggccgtgtgttgttgggtgtggcgatgtggggcaagagtttggccctgacatccagtcaggcacaagatttcagagctttccacgatccctggtggaccgctagcgcagcaggctcaggccagggcccatgcaacttcctggtacccactccctgcccgctggcattgcctggtgagaggaggcagatgatgggggtggaggggccgctctccttgagcacctcctccaagccagctggcgggggttcggtgtagcgctcccccagcgtggctctcacgcagcgtgccgcggccatcatggctctgtcctccctcagggcccagacgacgaggacacgctgcagcggggacacccgggcgtccagctcgggcagggggaggctctccggcgtctccgcgcccgcccaggcgtgccaggcggcatcgcccctggccaggaccgccaggatgtctgacaggccccggaggccctggagagactgcagacggtgccacacgggcttggacagccattcctggtgcaggagtgcagatggtgcatgtgcagtgattgtggagtggggctcagatggggagctcaggctcattggtgagggcttcagagggctcaatcacaaggtcgactccatacccttggccttggcgggacgtcgttcttnnnnnnnnnnacttcagagggctcaatcacagggtcggttccgtacccttggccttggcgggacgtcgttcttgacagggagcacatccaggagcactgcaacctcttccgacgaggcctggccagctgccacctaaacagagcgacaggggatgtgtacaaaagtgatctgacatgtgatcgtggaggtgcatcccaattccccatccaaagacagccattccgtcggtccccgcattcagtacgaggtgccccccccgccctcccaccgcctgtaccatgagggtgcagctcagagcaaaggcaaagacagcacgatggcgctcaaagagtccacggcacacgtacaggaaggccgcataggtaaagtgatctgtgagttggatgggagggacagtggagggaatgtgatacctgcacagagtcttccagccaggcccccacatgtgcgtacagactccaccccccccccccaggctgcaacccagcgcgccagttatgtgcagcacgcgttttgctgggactacggagcgatcagcctggtcgatggagcgctcgtagagcgcagtgaattgtgccagggatgtctgcacgacgatgtcatggacgggggagggagtgtgacggggggtgacacactgtattgtggtggaggggcaggactggtttgtgccgaccccacagcccatcccccagcacttgcctgatacatgcagttgacgaccgagaagtcggtgatgaggaagtagagcagcatggcacggcgcgccgcgggacggtactcctcgcacgctacctgtatcttcttccgtgtgtccgatgcggtggccagccgctcatccacgtcctgccgccggatgaacatagggtccgtgagtagggcaatgccggctcacgtggcatgccggcagcaccacgcccctgcgccacacccctgcgcccacctgcaccgtctgtttggtcctggcgaggatgttgagaaggtcgccgtcctccagcaggttttcgcagttggacaggcgctggagcagctcctcctccagctctgagatcttggcgtggtagttttggacctgggacacgggaagtagggggccactcagccctggcggggccttgcgcaggactccctggtactctggaccagcacaccctgcatcctgggagctgcagccgggagcctacctccgccaccagcttgcgacgctggtgctccagctcgtgcttctccttcagtatgagccggctgagcagctggtcctccagccccacgcgggccacggtgcagtccacgagcgtcaccctggccgccagctccggcgtgaagttggggttgggcagccgggtggtgatgtacaggcggaaacccgtggccacttccacctcagtctcgcccagcgtcacaagcatcgtgcctcctggatgagtgcattggagccgagggatagggctttgtaggacagggatcatgcaccgccatgacctggcgcccgtcaggctggagccattgaggcacccagggttcgctccccaccaccgacctctcgtgatgaagcgccgctccagtatgggatccaggatggggtccacctcctcatcaatgttctcaatcagcaagggcctgtgtgggggggcagaggggtaatcgtggtgccaaagaggcggcgtgatgctctggcggcacggtctggtgtctcaacagctcacgactggcagccaggcaacccaacccacctgccctcctgcaggcacgactccagggtcgcccggaaccctgcatctgcggcctggacggtgcagatggatttggcctcctctttctttaggagccacgcccgggcctgtcgggtgtgttccaggagggcggggggatcggttatcggcaagcttaggtaagcacctgcatgcacgctcctccctgccacgtaaggtactgaacttgcatcaagctgggcccctgtgcccgcacctgcccctgcggatcaatgaggaggggccactgggatgccctcgatactatcactccattctgttgggagagttcgtcagcggggaggcaatctgcgacccactgcgccttctcctgctcgtccacgaggaagtccaggacctgcacatgatgggtgaagcgggcactctcaagacactggtctgcgattccgcgcacccatcttcggcatgccaaccatctccaaaggtctcattgcaccgctcatcccatagagtttatatgcccacctgaagatggggcgtcgtggcgacccccagggaggtgcaggctgcggccagttccttctgcagctgggtgtcccggaacgccttgttgaagggcccgaggtaagaaaggaaactgtaggagggagggaatggggagcttgacacaaggcagacggtagctgccaacaacttttcctgggtgcacactggggtgaacagccaagatggtgatgcccaacgcgctcttccacagctccccgccatgcgctaccgaccttgcagcaacgatgcagtctcccagcagagcatttgcgctgctccggtatgcctccagctgcatcgtccaccgcccctcctcgcccttcagagctgtcagcagggagctggcggtggtcatcctggactgggcagtgctgaggtcatgctccagtgcctgtggtgaagtcagggtgagattatggcctttcttgagactgaaaggtggcgttactttttgcaatgctctaccacgagggactcatgttgcccgtatggcgtcacctgtttctgggcaatggctgcatccagctgctgctgcatttggtcgaggttgccctgcacaaccgccagatcttcctcggcctacacgggcagagggaaaggcagagctgagctgagctgctcaattgtgctttgcgtgcaatcagtgaaagagaccagattgcaaatttgggcccacctcccggtgccactcaccagcatccgctccctggctgcaagcttgagttcagcttctgcgtctcgcagcgctgagatcttgggctcgaccacctatgccaattcatatgggggccatttgtgaaggcaggctttttctaatacgcatagcacatcaggcattgcgatcttccagctcccagaaataaactgccctgccttcaccttggcaacggcatggaacttgcacatggcctctgcccagttgcagagtcctgccacattcccactggcctttttggcgctagcaaagttgaagtctggggcagagaagtatggctgcagtgattgggagtgccgggaggagggggatggagagaatcccaccaatggacggcacacatgctgttcttcaagaggtcaagcactcttgcaacgatgcaggctgccctccagcagcctcccctggcatcaggcctctcaacctggagtagctccacggtctcatcacaaatggcctctttggggaagtggatcaacgactgcaagaagttcaggtcgcccatcatcttgacggcgtcctcatagctcccagcaatgaccatggtgcccttgagctcttgccaggcgacattgttgactggaaagtgcctgcgacaggacgaagggaccttgagtgaaggcattgatgcatcgagtagtggtatcctcaccccaagccctgcccttcaggccatgctaggaccccccacctgaggagcagcacgcagtcaaaaatgcgcttcacgatgtttggcgggttcttcagcgccttcagcgacgtgatatccgtgggagtgatggagttgagcgctgccagcgcggcttggagtgctggttgggcctcctccaggtctcgctccgcatcgtgcttgacagccgctatgtcgtgcgcctgtagaggacatggatattggagggtggattctatgcccctggtgctgggcagggggcatcaatcnnnnnnnnnncagatattggagcgtggattctacgcccctggtgctgggcagggggcatcaatcagcaggggtgccttttgtcaatcgtatatgttgatactcctttgcacaccctacacatggctgaggtccagcgctcgaccagccacccctgccgcccaccttggccgtcacagtctccacgattgcggcaaccttctgacggtccttctcagcctgactggtggagacagagatctggtgcagcagggccttggcctcgctggcagcggcctccagcttctctgtcttgctggcgagctgggtctgcatgctcgcgacatcctcacgcgtctgcgccatgcgctgcaagccatttgttagggttgttatctgcgtcgtggtctgctgcagcttcctgttagacatcagtgtggggtaagtgtatgttgagtgtacggctggacgggccaggtgagtgcatgcacaggcgccgctggatgcgcatgcaggttcttgagcgcatgttatattggaggaggaacccatgccccggactcacatctggtagatgctcttgaagttgttcacgaacgacaggaacgactttggtgtcacatgcacagcccgcttagtctgtcgcaagtacacctgagtcagtataatgtgggagggtgtactccttgacctttttgcatcctttttgtcctcgacagagcgaggcctcagttcattcaggctatgtggccttgctccagacttgtcaggacctcgttgggatgtccagcacgccctcttcctccctacaaactatccttcagatctgccccagtcccaatctcgaagcccggtacctggcaggtctctgcaatgtgctggtggacgcgggccatcaggcgctgcagctggctggtatgggtgacaggcaggcgcgcagagtgcaggagctggccggcaacccccaccatggcatcctcgggccagggcaagaaccagtccacttggcatgcggacagcagggacggaaactgcacagagaggtggcaattctacatggctggagcgtctcaatggctggctggatgaggagagctggggagcctttctaagtcgctccggccccccaaaaacaagctgcacctgctgaatccaccgcctgaactgtggccccgcggggnnnnnnnnnnattttccgcagtatctggtacatctgttgggcaaggcagcgggtgtggttgcttcagtggcatgcctggctgcagtcccnnnnnnnnnngggggagcctttctaaatcgctcccaccccccctaaaacaagctgcacctgctggatccaccgcctgaactgtggccccgcgggggaacagcacaggaccaggtgtagccgcgtctggatgcactcggccatgtgggcacgcaggttctccgcagtatctggtacatctgttgggcgaggcagcgggggtgggtgcttcagtggcatgcctggctgcagtcccctgggcgcaaagtgatgccccatgacagaggctctacaggccccggtcgcccctccctccctccacccacccgatcaccatcaagaaacacaaagtacactcccataccgggcaacgccagcttcatggctgggcgcaggtcgctcnnnnnnnnnngctctacaggccctggtcgcccctccctccctctgcccacccgatcaccaccaagaaacacaaagtacactctcataccgggcgatgccagcttcatggctgggcgcaggtcgctcagcagggcgtccatctcctcccgcgtgaagagctctggtatgtcgcctgtgaccagcagctggttgaggtgctgcaggaaggcatcctccctcatctcagcatcggtcgcaatgaagcagatgggctgattctttgccagcagcgctttgcagagcacctggggcgggcgagaggcatgcagggtccgcctcagtttcaaaatgagagtataggggcagcagggccaagcatgcatcgtgctcctggtatgctgctgtcccaccactgtgctcctccaccttgagatcctccaggaagtggggaacgccatactgtttcgtcatggtgatctggaagacgctcgcccccaccagtgtcgctgccagcctggccagcgactgcttgcctgacccgcctacacccaccagtacggcagaccccctctccatgccaagcaggcgagcaattccgacggtgtgacccagagcatctggtgcccagggaatgcgaggattatgtgaggccggtgcggaagcttgatggtgtggtgctaactcagtgcaaccgcctgcacagctcaagccatggacccaacaccaagtaacatcacccaccgtcaaacatgaccagctccgcattctgtgagcgagagctggagccggcacccgccagtgcaccctcaatgtatgttttcagagacgccgcggcctgcgggatgcccatgtacgccggcagcaccagggctcctccatgcctcccctccagacgctcctgggtgaagcctgcgtactggaccagctccccaagaccgccatgaccagcctgcaccacagtaatgcactgaggacctcacgatctgaatagattgcgctgtatccaaagaccaagagtcgcatgtcggtacaatgtctaactaccaatgggccccactcaagccatgaccaccttgtctagctgcgatgcaatgacggtggcaaggaaggccttgtcttccgcacacaccagcttgtctccaaacactcgcaacacctcgttccgccacagcccagcgatgtaggtgggtggcgatgagcctgggtgcttgccaaggacgtggtcgctgctggcatgcagcattccctgaaccacctgcatggttatagagaccaaggtgagagagggctgtagatgcagcgcatgcaagtggtacataatcgccacgagcaggcgagtcgcatgtggaggtggacaaggtttgggccggcgcaaatgtaaaggggccccagcatgcctggcgcaggcatgtgctgggccccatgcgcgccccaccttggcaacgtcgtgcagggagaactggtagtgcagccgcgacagggcgggctgcaagtttgcctgggcctcctccagcactgccagggtggcggcgaccaggctcgaggcggcgtccgcgaccgcgcgcccaacggcagcggtgtggaaccggccctccaggactgcgccaaacatgctgctcacgctctccacggaaggcgagggcagcccaaagatggcaaactggcgcttgagccgggaggggatgtcctgcgacccgactcctggagctcgcatgcacgccacatacctgcacatgtgttgtggggaggggtggtgagcaccgtatcccgtgcctggtttggctggccggtagggtgacccaagcacctccctcccactcccatcgctcactgcacgtcgacgacaaagttcaggtccccgatgggtttctccagggagtagtagctgctctgagaaaggagctggcgcgtcagctcattggtaggctgtgtgagtagggacgagcgaaggccttcatgccagtggggaatctgccttttgaggatggcacattgtatggcggcacatgtatgctggagctccatcccagctcagccgacgttggaccaggagcccttagcaacaccccagcagtccgtgtgtgtgtatgcatccnnnnnnnnnngggctgtgtgagtagggaagagcgaaggccttcatgctattggggaatctgccttcgaggatggcacattgtatggcggcacatctatgctggagctccatcccccagcagtccgtgtgtgtgtatgcatcccaacctctgccccacctggtcaccccattcattgatagcgggcatgttgatgtcatcgaagaacatggtcatcctcctgcctgtggggggcccatagctcctcccctgccgcttctccaaggatctctctacagagtactgcagagccccaggacttgtcagcgatgacaggaccagcgtcttggacgccagaccgccctcgcctgcccgactcaggtactgccgaacgagagtggacttgccggtgccaggctgcccaacaatctgagggtcaggcagggagggctgtgaaaactaccaaaggtggcacgagaacacgaggttccagcttgtgtggtactcactcggccccccagccctggactcaccagaannnnnnnnnngattaccaaaggtggcacgagaacacgaggtttcagcttgtgtgatactcgctcggccccccagccctggactcaccagaacaggcttccctgcagcatgcaccagcttcatgaggtagccgtagcgtgtggagtccagggtcggcaccaccgtcttgctcagggccacccgcgccccaggggtggggtagctccacctcggcaccagctggacccagggtgtccagcgggctcccgccacatcatagacatagtcgtaaatggtggacaggccactcccatcctgaaggattatgtgtgcagcagctggcccagaatcagcggagggaagtgcaacttctgttacccctgtcgctccacactgagtcgggtaagtctgtgggggagcggtgcagactccaacagaaccctgcctgcatattcagcaatcaacacagctcaccaggggaggagcggcctggctcaggttgcggagcttggcatcaaagcctgtccggtcggcattttcgagcaggcctccaagggaccatgccagacagaagagcacgacggactccagctgcggcgcctgggtgggggtcattgctgcgccgccgtctggggcggacgaggccacaccgtccagcatccccgtcagcagtgtgagcagggtccccaccagaccgcaggcctccaccggcatgatgggcgtgcacgccgacctgcaggagtgagagtggacgagacgcttctgggccgcagagcggtttggacatgtgaatgccgctcctgctcctttctgacaccgcgtcgccgcgtcctgccaaccacactgccctgacctgacgtgattcagcagaggggcgacaaggcggtcaaacaannnnnnnnnntgtcgccacgtcctgccaaccgcactgccctgacctgacgtgatccagcagaggggcgacaaggcggtcaaacaagggtcgcaggaccattgcctccggggttcgtcgctgcgcaagccaggaatccagcatgggctgccagcccaggtcggccggggagacgtacacgattcccgcgcgagagactgcgcaaggaaggacaaaggaagtggggcgtgggggggcatgtctgggtgaaacatgctgttggatggtattgttgctggtgatgcctccctgtgcataannnnnnnnnngaggaagggcaaaggaagtgggacgtgggggggcatgtctgggcgaaacatgctgttggatgatgttgttgctggtgatgcctccctgtgcataaaccagctgaacctccctccaataaatgtaggaacacccaggcacacgcaaggccatacaacagtgccctctgcaacctgtggcaggcgacgcattgttcagattttcggcctcaaacatggcccgcatcttttgtgtcatttgaatacggtccccatttgacagcgtgagcaccttgttgtcgtccaggacctgtgagacgagcaggtgaggtgcttgttgtgcaagcgaataaggctggtggcgcactcaacatcaggcgctttgggtacatggtgctagtgcgtggtggaaacacagcccaatatatgcatagggtagtgaactgtgtgcagaggcttggtcgctccacgccagacccatcccctggtccagcaaacacctttcaacccccgtctcccctggaataacctcaacctccactcaccgagttcaggttctcgatccagatggcgtcgatgggcccgtccatcacaatccaggtgtgctggtgcnnnnnnnnnntccccgtctcccctgaataacctcaacctccactcactgaattcaggttctcgatccagatggcgtcaatgggtccgtccatcacaatccaggtgtgctggtgctgggcccgcgccgcgcggcgccacaacactgcgaacacgccgtccgtccactcgcccgtggcagggtccacctgcccgaacatctgctcgacacgcatggacttggggttcatgcgccacagcaccgtcttggcacccaggcgagtgtgcgcagctgccaggctctccatgacgctggtcttgccagccccggcaggcccaatgaccatgatgccgtgccgaacctggggagaggagaaggggaggagggggatggagatgaaagaaagggggggnnnnnnnnnnnnnnnnnnnnnnnnnnnnnnnnnnnnnnnnnnnnnnnnnnnnnnnnnnnnnnnnnnnnnnngagctgcatgcacttgttgagccaggggccgtgggtctgcagtccagcctctttggccacctggcagggcgaaattcgcagggaggagtatgagcagctgggcaaggaccttttcatttgcccccaccatgcttgtgcctgtcccagctgggtatatggtgaccnnnnnnnnnnagggcggactttccagcttggtgcattggcctcgcccatgcccatgcagccagggatccttggacctccctccaagccccatcctccacctgattcgtctcatgnnnnnnnnnnggctgggcttcccagcttggtgcaatggcctcgcccatggacatgcagccaaggatccttggacctccctcctagccccatcctccacctgattcgtctcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttttcatttgccccccccccgcccgtgcctgtcccagctgggtatatggtgaccatgcccttcacttctaacactccatttcccttcaagcacccgccacagccgcccgcaccgtctttagcatggcctgaacgtcccccagctgcatgcgctccagcttctgcccggggaagacgtcttccaccaggctcaggaagaggggcaggtcatcgcccaccagcttgctgacattcatgtcgcgcagggcgcgcatgagcagctgcatctcggacctggggatgatggatggatcggtgtgttcatgtgggccccgttggcgctgtgtgggagcagcaccgccttccctccagtcagcagcatggctatgcttaattcccttcatactcttcccccatccctaccactctcattctcccccaagcctcactgttgggggttttggcgcttcagagatccacaggagcgcagcactgccaggatgttgcggaggccaaagtcgtagtggggctggcgtgagagctgctgctcgcacaggccatacagcgtgtggaagcgccgggagaggacgtcattctcttggtatccgcatgccgccagcttcacctgcaaagcacaaggtggattgggcatcaagcatgcatgttatcgcaagacacaaggaaagcatgcaagatcggcctcagctggtctcagcttggcatgcagcaccatcccttgcagcaggaactccctgcacccaccttcatgatgatctggcggttgggaaccatcatggtaaccccgcggaactggacctgcaatatgtggtgaaggggtgagacttggcagcggaagacaggaaacagggcaccaccctcaatgacccatggatgggatgttgccccaagcttgtcgtgcataagctgacaccagtggcctcaccttcagattctctgggagctcctgtcgcccggcatacccagggttcatggtgatgaaaatcccgacacgtgggtccaggggaatggttgtcccatcagtgaagaggaacgaggtcttctgctcacggagtgccgagaagattgagtgtatctgtgatgacatggtggggaagaggatgttgtgacttcagaaccttaaactcatccactgcctgcatatccacccgcgtgcagacctacttgctgggcacagactgaaaggacgtcgacattgatcctgttgaactcatcgaagcaaccccacagcccagactgcagcatggagagagaagggagggattggaaagtgcatggaggaggtctgctgcggccaggtttccctcagtacttgcgatgtacggatgcctgcccacgttcgatgacctttgtgccacccacctgggcgagacccttgaagatcttgcccatgcctttgatgtccatctggtcagagcagttgaacaccacaacatatctgtgggcagggagttgggcagtgggtgccatccaagtcttcttctatcaagataaagggttgcttctcctgtcatccttattccaaaggtgccggcacctgctaccaccaaggcattcctcagccccaactcacttccccagagtgttcccaagatcctttgtggtctctgtctttccagttccggcgggtcctgcaggggcccctcctgcagtagagatgggattggaggctcgatgcatgtcccaaagatgggggtgcagcatggagcagggcatatgcgagtgcaccgtgtagctcacccatgaacatgcccagcgcttgggagagggtgatgtagcagacgtcggtgaggggtgttatgaccagccgttccttcactcctgagcagggatgtgggcgagcgctcaagggagtgctgaagtgccgtgtccctgccattgcgtgccggtcccagcgctaccgtccgaaggcggcacacagagcaccaccacccctggctcacccaggtattcgaagctgtactcgaaatccacatcacaaatggagatctgggccagggtcctctcctccagccagtaaaacctggcctgcttctgccactcaaagtcggatgggtctttgatcttcttcctcaccagatcatccagtgcctgcaaggatgttgtgacactgaccggtgtcgtgacgagcgcgcaggtgcccatgtgcaaggttcccgcgctcttgggcagtcattgttgcccagtcattgttgccagggcgacgatgccataggataaccaaacatggctcctccctacgcatgacacagggaatatccatcctccgattatccgccaaacacacatcgcctcctacctctttctggtgcatgtacacggtgatgcaggtctccagggaggtgcgctggatggaggttagatcgttgcgcagagtgagggacaccaacgtctgcaggatgccgtccgccttgcgctgcacctttatcacagccgacttgtccttgccggctgcggcgagtgccaactgcaccatgccatgtagggagtcgagtggtgggcgcgccgccatgctaccaaggacgtacttccacccttccagcatgcttggataagcagtgcgtgtgggaagcaggtctggaccccccaccgtcactcttacagatccccgtctgaggcccacatgtgccattccttccttccacgcacatgggtgtccagggtccactggaattgtaggcccaggagtgcgatttgagccgggtgagagaagaggaaggtctccagatcctgctcatacacgtccctgagtgcctggcgcgccaggacgcgcaaggtttcctgcagctcgagcataaaggatgcaaggatgatcacaggacagtgtagctgggtgtctgattgcagagagctgtggcatttggaaagcggtctaaaggtgtccatcctgcctccagtcctcacctgcattccagccacaagctgctgcagccagacttcgacgttcccacgtgcttggatgggacgcgatagcctcacggcctccccgtcaaagctgttcatgcccagcatgcaatttttatcattctgcaggagcaaagacgtgggacccattgacacatggattggggaaggtctcagccctgcattggcacgtgctctttgcatacaaagattggtggagcgctctcagtatttgcctatataccaggcaaccccagccaccttgtcaaaggttatgctgtgcagggcatcgaagaggcctgattggaagtgcggcacaacctgtgtggattgtcatgggaccaagcttgagcagatgtgtgatggagatggtcaagagttggcaaagacatccagccaccctgtcaaactcacagccgcaggctccgacccaagggagagaatctccagcagggtggcatcggccacaaagtagaagcgcgaaaactcagacctcttgctctctgcacacaaggagtggggtggagtgcacgagtaacttcacgcaaagatgcctgcacaaggttgagtgacaagtcacagatgcagtagccccacgccggcagtgcatcagcgtcctgtaaggccctaaacttctcacacataaccaaccccaccgaggtaggccgacaggctcttctgcacgacctccagctgctgtaccaggctgggaagcatgtgctgcatgacatcggagttgcagcaggctgccaggcaggtctggctctcgcgggcgtggcgcaacagctgcgaacaggggaagcagggtgggggtggtggctggcaccaaagatgggctgtgcctcccagcatgccaagtatgcatgcagtgctgcgtggcacacaagcatccacagcctcggcctccaccctcccagtgtacgttttcatagctcttgtcgatcgcagcaaagcgacgcgcctcctgggggagctgcctcacgatgtctccgccgctgcaggaggggcagatgatgctgggttgagaaccccgcttcactccctagttgatggtatgcagtccctaacaaccacaactttcagcctctgtcttggggccctacctgaagacggcctccatgtacatccacatgttctgcaccacaagccactgctccataacgtcgctgatggtggacagcttggaggtccaggcctggatgtctgcagtgagttcccgagcctcaatgccttagccccttttcccaagcccgatgtattgtaagatgcagggcctgggagcccccctgcgtccctgccacattggctcacctggcctgaagcaggcagnnnnnnnnnnactcgatggcttagcccctttcccaagcccgatggattgtaagatgcagggcctgggagcttgcctgcgtccctgctacattggctcacctggcctgaagcaggcagagtagcgattgctcatcaaggaagtgaggcccagcagcgcatcttccagccgctccatgagctcagatgtgtcagaagcctgtcaaaatagcacggcgtgagctggggcaggacagaattagaggagcgccctcggcatgcgggatgaacctcactggatgcacgcgcaccgccgccccaccaccttcaggatgctggcgggtcgaagcttgtggtcgacccagacaaagcattctgtggtccattgtgcctctatgttccccagcttctgctcaatctgttcctccctcttggcacaggagaacagctcctccagctcctccctgcaacatgcccgggagtagaaggccatccttgagggctggctgggtcctcaggcattggtgcttctctgaaaagccaagcctagtcacgtcggcatgcgtgtatgtgtccggcgccaatcccgataccgaacactccatttcccaacacaaagctaggattattaaacataccagtgggcagagagctgtgcattcaagaggtccccaaggatgagacccgtatcatctgatggaaggggagtgccacacagctcctgcaagcgctgccagtgcctgcagtcaagcacactcaatggagatcaaaaggcatgatgtagcaagccttgcaaatctgttctgcgatgcaggctgtcgctcacgaagcacacccttcatcattctcaggcccaccttggcctgatggagctgtttgccaggccttggnnnnnnnnnntttcaatgcaggctgttgctcacgaagcacacccttcaacattctcaggcccacctcggcctgatggagctgtttgccaggccttggaccagagacagtgtgtctgacaggttcttgagctgatccttgaactccagctgcgccggaaggcttgccagatcctgacacagtcaaggatgaaggtctgaggcatgtgcggtgcaataatgggaggattccagacacctggaaggctgggtatctcttcaaggaggtcaaccgtgcaccctgcctggctgaaggcccggaaccttgcctcggagagggtttcgctccggctctggaaggaggcaacttgttgtagcatagaggtaatctggctggcagcctctctccagggcatggcactgagctggtccacagccgtgacgaggtccacaaacaaactgcagaagccagtacggggcagggatcaaccttggtggttgcaaggccctcatggggttcaggcattagaaaagcagctaggaactccttgcaatcaagccgtcacatcatgctggcagggccctgccagccacccctcaccctcatcacctgtagaactggtggagattggccaactcacgctccaagctggcaaggcccgggaccttggtcacctgcatcccaaacagggcctccccggagatgcaggcctcccagcgcgctttgcgcgcctgcacgccagaccagggcggtgtcgggcagatgcataaagccaatcccggcagcagggcagcagctccagatctgcatggggatgatgtctgaacaccatgctcacagcctccgtaagccactctccacctccccgcccaccttaaacatctgctggaactgattggttcttgcnnnnnnnnnnccccagcagcagggcagcagctccagctctgcatggggacgatgtctaaacaccatgctcacagcctccgcaagccactctccacctccccgcccacctcaaacatctgctggaactgattggttcttgccagagcctcagagggcgggaggcccgggccgaggggtcctgcaagcagcagtggttcagtggtgcggactctgggggcacacaacagcggcatggggcttgcggcaccctgcctgggcctgccccttgcagtggcctcttcaacatctgcaggtccccagatgtgtggcgctcgttgtagatcatgcagctccatgggccttcgtgacaccaaggtgcacgacagcaaccaacnnnnnnnnnnatccccagatgtgtgacgcacgttgtagatcatgcagctccatgggccattgtgacaccaaggtgcacgacagcaaccaaccacctctctcaccatcctgttcccagtctgaaaggaaagcttcggtatcctcacgcagtgcctgcacatccaccaccagctgacgttgcaggccgacctgttgtgagggaggatgagtcgaccactgaaccgaccaccacgtctttcagcttagccagcacaggctccaatgctcaacatgcccgcattcacatggccctgtccccacaggcggctcaccctctcttgcaggagcacctcccccatccctgcggcggcgtgcagaaccttctgccagctgtacctcaggtctgctaccgcgtccagctcctgcttggggatctgggcctccaccctgcggcagggctcttgtcaaaggtgactgtagccgtgggttgttgccagaccagtgtgttctccttacgtgagcatgctcggatgacagttggtatggtacaccaactacatctgactgccccacccccgcccaaccttccaagaagagcgtaggtatactcgataggctccacatcatccccgaaggagaactccatgtcatgtacgatgctgagacaggcgctgaggtggcggtagtcctccaggtcctccaccggccgctccaggtcgagtaagagcccagccagcctcttgctcaaagcctgggccggggagccagtgggaattggtagagtccaggtcagcttcaagccctggagcacaaagactccatccccccagatcagcccgccccgcacctgcagggcatctgacccctggactcgcaggcgctcggtgaagagggccttccatgaggccaactcatctatcattcctgccagcagaggctgggcatcaaactgcaggaacgcatgagctgcatgcgcagcgtgtgtgcgcattgcctgtggaaacggtggccgctctggagctgcccaatgatgactattggaaggaagcatggtactccttgtgctcttcatgccctcgatcagnnnnnnnnnngtcggtggccggtctggagctgcccaatgatgacttttggaaggaagcatgggactccttgtgctcttcatgccctcgatcaggcctcaacccatgaagggagcggaaaagaatcccaagcctggcactgttagatgtgacgtcttgcacttcaccagctcacaccagccacccccccctcacctgctcaagcctgtcgaagagcgccaggcggtcctcataatcctccaggctcggtgtcgtggcgatgaaagcctccagctccgtgcctgcatccatctcccacaggaaggcacactcgtccacgctccctgcaaacttgggccaggggcaggtgtggagggtggctgcaacgccagcagacccatgcaggggatgccagcgtgcatgcgggatcnnnnnnnnnntttggtccaggggcaggtgtggagggtgcctgcaacgccagcagacccctgcaggggatgccagcgtgcatgcgggatcccatgccacgtcgcaccgatgagtcgcatgagcaggctcctgtccacactggagaccacctgcaccagcatgccatgaaggctgtccgcgaccccaacccagcccggcctggcatcgatggcaggcgattggtcggcgaggtggagggacaggaccttggtctggacctgcgacgccggatccagcaagggctgaggccaatgcgattactgggtgcagcttgctttgcatgggccggcatgcttccatctgagctgtccnnnnnnnnnnaaatgcgactactggacgcagcttgctttgcgtgggccggcatgcttccatctgagctgtccggccctgggtcccccgccaactcccactcccactcccactgcagcagctcagagggcatgggacctcagccccgacccacctcaagcaccagcccttggagctccttctggacagtggcaacgctgggcacgagggccacagacgcgtgcaggaggtgaacctcgagcctgatcacaggcccgccggccccggacagggtgctgcttcgtccagagagcgtggggcccgggcccagcagctgcagcaggccggccagcgtctgatgcaatgcagcctgagcggcctgcaccccaggcgcaatggacgggagggcaagaggtcgtggggcgggtgtcgagctcgtgagatggcgcccgggggaggagtgtgccacatgtgggcgtccacatccccnnnnnnnnnnaaggttgcccatggcgcctgcacctggttcatgtcccaggtgagtctgcgcccagcccgccannnnnnnnnnccatcagcccccgacaacaactcacctcgtccaccagacgctgggccgcagcagcgaggttggccatggcacctgcacctggttcacgtcccaggtgagtctgcgcccagcccgccagctggcctcttatttgaagcagtgtgtgctgcatgcgctgcagggtgaccgctcccacgcacagctgctgctccaaggtgcggcgctggcggtccacgaagagctcaaggtcctctacaggggcctgatgcccggggaggggagtagcaaagaataatatgcgggcggtggcgcaagcttggcacagaatctcgaatccaccgagcccgccccgatggccatcacaacagcacctgccaactcacagcagaaacgtccaggaagaagagggatcgcagggtggcctgtccacctactatctggcgttcccagatgttcataagctcccggatgagacttccagcctggagtactgcctgaaagtgtgtggaggacagggcattcgacgcaggagcccctgaggactcacagagggggcagtgggccaacagctgtcggggggccttcatgagtgaggcgtccacaaacgcggcatgccggccgggcatgggcaacccaccggagggcatcccccaactcgcctgttccaaacggtgcaggtacccnnnnnnnnnnaccggccatgggcaacccaccggaaggcatcccccgactcgcctgttccaaacggtgcaggtacccctccacaagcgtcgaagcccaggtgatggtcaggccctgcagaagcttgtccttgatgaagtccaggcagggctccagcacaggtctcaggacgggctgaacagcctgctcgatatcctcccattcctgtgagttggaaatgaatcacatccactgggtgaggtgtgcggggaatgaaacattcagcgccccagcgcagtgcacttggagatggcatgtcctccaccagctcgtgcacagctgagtggcattggaggcccctcacctggcccctgtatgtaggactctcttacccacctccccagcgcacacacacagaagcaatttttgatgacagcctggctcacctgcagtgccagtgcgattctcttgtagctgcgctggagtcggtcctgctgcagcaggatggccggcatggggttgggcacctccagccccagccgccgcatgtgcctggcctcacgcacgacctcgagcacgctgcgatcgaggttcactgccaccctggccccatcccggagcaggagtggggccgccaaggcaccatccaacgcggggatggccgcctgccacctggcatgccacacggcttctgcatggagcagggtctcggcgaggcggttgtatcgccgcacgacccgccggttctccttggccgccatgaggacaggatcctggctgaatctgtgcagaggtcggggtgggcagaatcgtgcgggcatggcccgggcaggatgtgcagggctattgccaagccagcggccaagagcctatggagttcccaaccattcgacatgacggctacatgccaagctgcccactggcacacacacatcttcatgggcccttctatctggtccaggaggtgtcgcgtccatgcgatgtcgcccgacaggggcagcgcgttccggcttcgaccgaggcccatcttgcgacgctcgtagtggcgctccaggccctcgaggtcatctgggtgaagcgggaggagacatagcggggatgtagactggcttttctccctgaacccttgctgcccctcggttctaaatggtgagcaccgttctctgagcatgccaagttcatccctccctccaacaggtacttgcctgcatatatctgaaagatggccgcccgtttcgcgctgtagtactcgctgttgtgcaaggcattattggacaggcgctgcaggagctccagggcagccgtggtggagtgcgagcacgaaaaggctgcctcggtgatggtctgtgtgaggagtggtgcatgggtgctggcttgccccagtacgggaggctgtgtttcgtcttgcctgacgtttgaggcgatcagcctgtgtcccgcaccaaagcatgcaatgcatcccaccccctccagcatcgggcaccccaacaccccgagcggcgcaagcccccgtcacctcgaactgggcttccaggcgcgccatgtgcgccgcaaagccctccacctccacgccaaactgctgcttggacgtgtcgaggacgttgtatggctgccgacgcacccggtccagggcgctctgtccctcccgcaccagctccggcacgccctccagatccgtgaatccggccaggagctcgatccaggcggcccgctgcgagatcagctccacgccggcgcagcgggcgcggaaggcatggagtggggagggcgcggcggcggcgggcggggcgctgcccttgccggcgtaccggttcagcctctcctccatcagcgcagcctgtggggagggcgatggggtgtactgctcgcgctggtggggctgaacacaacgccaggtaacccccacgtgagcagctgtgcaggctcccctgacttgtcttatgagaccagccgccgggtgactccttccctcagcaactccccatccccaacacacctgccactgcgcttccaggcgctggcatgcctggcacgccatcagtaggtcgcagggcttccggtcccagagccgcccgccagcttccagggaggactggcagaaggcaaccagctcctcctccaccatctgtgattgtggccgggggaaggcaggcagctgagcaccatggcactgcagtgggaacaggcgaggcgagcattgtggccatgccctctctcctcaggtgtgcctccacctggaggaccgttgcaaaggatgctggctggctgaagtggcggctgatgtgttgggctgtggccagggcagagacaaggtttggcagcccctcaattgcctcctccagcgttcctgcacacagagagggcccggacaaggctggtctccaagctgtggaggacacacgtctgcatgaccctaaacacaggtattcattgccacagcctcgcaatgtggtgtgctggcactttgaagcggacctatcctgcacaaggctggccccttatccccaggattcagtcattccactgtcggcacgctcaccactccgtaggccctgcataagctcctgcaccacctccaggtactggaggcagtcttcagcatctgacagcgcctctcccaggccctgctgctgcgaacgccactccagcgcggcggcgccctttgaggccatgcccacgacgcaccggcaggcgtcgctctgcatgcagggcggccgaggccagcagtgggcaggcaaagggtgggcttgcggctggaagaggagcctcaacgcatgaagccacccgccctgctcatcacttggccacctggcagtaagtctgccgtcttttccctgacccttgctacccacgcacggacctgggcatgctcgacggccgcagccagcgccgccctcctctcgcggcatgctctgacttcctgtgccaagccgccggtgccggtcgagcggcggctggcaggcgacccctcatcaatgatcgcggagctcagcacggagcaccattgctgcagcagcagagcacatcggctggcgagctcgggctcggctgccgcaagacgagcaaaggacctgtgatcccaggaccggaggaccgcggcgtcgcgctcgtccagcggcgtaaagtcgatgcctgcgccgggggcgggggcggctgtggcgaccctggaggacacgtcactggtcctgggatccaaagcaccaaagagctgttgcagcaggggaaggatctgggagggtgtgtggggaggttgggaatgccataaaggagacgttgatgctgtgtgccggccagggcccgagtggggccctcattggagggtctggccctccccatccggacatccgatctcatccatgtcacgagccagggaggctcacctccggaacgacttccaccatggacacgtcggcagtcgtgccgccacatcctgtcctcgagagaattaggcctttaaagttcactgtatcagtctgtgtgcattgcgaacgggttggtgaaagacacaacgaccatgattgagatgggtgagtatcggagattgctctgcatcccgtggtcctttcatcttacccccggatccgccacgtaagtccttggcagggcgtggggcttctcgccatcctctggatggacctgaacatattggacgccatgattgagctctgattacgaatttcccctacatagtttttcaagaggcccgatcgatcagtcgatcgccaatgtatccacagccgcacctgatgcacccacacgacagcatcccgcgaactaatgccttgagcaaggtcatgtatcagttccttttcattcctgcaggattgtagtttaaaggggctgctaaaatattggaagcccacgcacggccggatctggccccgcaaggaccccctgcgcctactcactctaacgcttcctccgcctccctcaatggtattccaagagcgcacgacaactgataagtgagtaggttcgaatcgactgagatgtagtttggagcgagaacccaccgagctggcgcacacgattcacgcacccctgccatgccaaaacaccttgttcgcggtgcgcgcaagaagggcttccatactcgatcaggaccgcatctataagaatttcaccgatatttgcttggattttattctcttcattcgttctcggggctcgagtcagaacctacagcacttgcgtgaagacatcggtgcatggagcaccccctccccggcccgtcggtcaaccgatggnnnnnnnnnngttcaccaatatttgcttggatttgcttctcttcattcgttctcggggctcgcgtcagaacctacagcacttgcgtgaaaacatcggtgcatggagcaacccctccccggcccgtcggtcaaccgatggattctgctcggcggcgtcacccgaagacggtgctaacttgggtcactggaacgcgctgcttggtacaatttcaatgttggattgatgttggccgaacannnnnnnnnnggaccgtactaacttgggtcactggaacgctctgcttggtacagtttcaatgttggattgatgttggccgaacattcgagctttggggagcacgaggcccgcaatcgagccgtgggagcagacctgccgccgccaatcgagctattgatgaggggcagacctccgactgagagctcggttgacggctacaggcttgcagggagagcagactccaacaccgatacggaaagagggcatcataaggggtcgtaaaagggctcaagggagagcaaagtcttcagatgcacatggctcgaagaaggtaatgactacagcccagggcctctggcccaggcttggggcgatgctgctgccgccctccatgtggcaagccatcccctcggctcctcgccctctgcagttcttgaatgtcacctcccacgtgcctctacctggagcttggacacgtgcaccagattgcgtgcctccaacgtcccggccgcaaactcctgcagactggccttcacctcggcctcgctgccgacagggactgtctcgtagcccccggccaggtcgtgccaggtgtcagggcacacaaacctgcggacaggaataaggggaggggaaggaggttgatgaggggcctggctgtcccagaccctgtcccctgcatggcacgctggtcggctcctgcgtggacccattcatgcgacggcagtgcacctccacgtttcctcacttgacggcgcgctcctcgaactgcccaaaataggtgtagtggccgtacagctcgcttgagctggtcatgccagcggccctcaggtccggattgtgccggaggtagtagttgtggtcgaagcaggagccaccacgcgcccggaggtatgcaatccggtatgtggtgcccatctgtaccgggcaggagaatcggtgggtgcggccctggaactgacccaggagcagccagtgctcccacagctccaggggcgaccctgccttccccgccaggtccgggttgttctggagacgcggtggtgatggggtgtgggacaggagattaaggagacgttgccgagagactggcagggtggggtcagccagtggcacaggggaaggaggaggggcggacgctgctaccaagaggcatcacagaccaaagtggggttgcggcacactggctggggaaatccagcacggaatcgcagcatgcgcaatatccccggcccctcagcttcagggtgttgccctctcaaccctccttgtcccacctcggtgtagaatctgaagtcgaagcagcccggccctcgggcattcatggccaccaggtcctcggcacgcgaggtccaggggtcggccgacagcgcgttggtgttcacatccatcgccttgtttgcctgggggcagacggtggggtgactgttaggctcttgcgggcctcgctcgaccagggttgcagagaaggnnnnnnnnnnagcagacagtgggttgactgttaggctcttgcaggcctcgctcgaccagggttgcagagaaggcggcagatagccctgcctagacctgacactgcctgcatctttataaagcgtctctccctgttggacacgagatgccaggtgtgctcattcttcccacgcacgccaccccccgtcaagaagcctgggctccctacctgtgcctgcatccactcctggtacttgagtgccgtccggatataggtccacttggcctccaccttgccagcgtccatgggcacaaacatggtctcatacggcgtgatggacgccccgtcgtactgcatctccccgtctggtcggaccctgcagtggagtggtgcagcaggagcctgggagggaagcatgtgcatgagccaggagagggagaaacagataagcctcccggctgtcgccccttggaggccagagacatcaactagaggccaagcctgtgatnnnnnnnnnnttgggagggaagcatgtgcctgagccaggagagggagaaacagacaagcctccctactgtggccccttggaggcctgagacatcaactagaggccaagcctgtgataatcgtaataaaaacagcaccccaaaggtccaggcagcagttcagtgtagggtagcctcatcatgaggctgcggttgcccagcggccagagacacatgacacatggcccagccagacagggtgtacaggtggtaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattcagcgcccaccagtccacaccctggtatcgcatcagcagcgagtccaggttgtaccctgcgcggagcatggccagaccggccccgacatcagagtagtaccgcgcgtcccaggggctctgaaagcaccggaagacgttggggtcggccgccagcacagcccacccatcctatgggcgcagtgacttgggcagggttgatgcggttgaagagagacaggccacacggttgccaatcaggaatgtcagcacggtgcatactcacacatatggtggcagcatgcccattctaaaccctgcaccctcccaacaggttcggaaaggcaaacacccaaaacaagcaggtcacgaacgcgcaccgcgtctgccgcccaggcgtatggcagcacataggggttgcggcgccactccagtgccgcatgcccggcgcgcggcgccccctcgcagctgatggccgagcccaccatcttcacgctcttcgtgaggcgggaggtgaaggcctccgtccagtgcatgacgccggcggcatagggcgggaggaatgggccgcgcacgctggagtcgaccaccaccacgaatgggaacttggtggcatccacctgctcctcgattgcgccgagggctccccaggtgccggtgcatgccgtggtgctgatgtacttggcgttggggggtagctctggcatggccagggggggcttcaccgcacccccactcgtgatgatgatgcggtacgtgacggtgtcattggcggacaggccgaacttgaggaagaagtcaaagttgcccatctgctcctcatccacggcgttgtacacatagaaaaccagggtggacgcagccctggccgggggtaatgtgccagcagtagccgcttctgggcacttgcgtgccagcacgccatccacggtcacgaaggtatccaccgggggccttttgaagtaggtagcacccgcctgggactgagacatcgaatgtgctcccagatcaccctggttgttctcagccacgaggattctggccagctccgcatcagcggcccccatgctctccacgttggacaccatgcggctgagcctggcctgcacgaccatttcgctggcccagagcactgtcgcaatgacgactaggctgatcagaattgacaacagtctggggctcaggcagcagccctgcgagcctcccctggcccccatcaggttccccctccgcagggtcatcatcaaattttatcaatgaagaagtcagggcatgttgaaatgcgcggtgcgggatcactttgcgaacctgcgttgtgatcttcttcaatgtcagtttgcgttcccgcctcggagatcgcctggaggacggcagatgctggttcggtcgccttctagacagaactcccaaatcattattgcagtcattttccagcatctctcaggctgaaaaggacctttcacaatggcactcacgtcgcgcagcctcatcatcctcgcactgatcggggttgcgctcgcagcaaagggcagcagcgtcaggcatctgaccagcacagactttgatgaagtgacatcggatgggaaggtgtacttcgtcaagtgagtgaatgccagcatcgagatgtcacacgctccaggctgctacttgaacgcggtgtcggacagaagatttgtcactgttatctccgaaaggctcttcataatccgttccctcatggctccgcaggttctacgctccctggtaaggtattgcctgtatgtggatgtgtgtgtcgctcgtggcaactgctggggtatacttctgcccgaaatgagacttgctcccgaggcttctcatatggttgcccctctgcaggtgtggacactgcaagaagctggcgcccacctgggagaagctcgccaaggcctatgaaggcagtgaagaggcagctgtggtctctgtggactgcaccaaggacaaggctgtctgcaacaaggccaaggcaagttgatcactggtgatgtgcgcagcagatttgcggtgttcatgtcgtgggagcgtgcgctggagtctccttcccgatgccgatacacactggactcgcccctcaggtacctggcttcccaagcttgaagatctacttcaatggcgagcagaaggagagcttcaggagtgagtagggggcggtgccgcccttgaccctgcatgtgcagggctgctgcccgcttggcgccagcacacgcatccacatgttctcgcacactaccgtccaggtgctcgggactacgacaccctgaagaccttcttcgatgagaacattgctgtgttgcagggagaaaccgttgcctgaagcatgaggcctggagggacgtggcggcaatggcctttgcatggcagcactggcacgccagacattccatccaaatctgaatgtataagtaaggtcactgtaaatgtagggcagagggtgaagaatgtactcggaataaatagatgatcaactttgcgtcatgctgcccagtggaaaccaggctgggcgcctgtcctccagtgcggctgtgccgctgggagtctcttcatttcaggaggtgcgtttaccctctaccgaccatgcctgccacagcccgcggaagaccacctccagcccctggacgaaggccgggccgtcacacaacgcggacccgagcacgcggccgcgcagcccnnnnnnnnnngagcccgcggaagacctcctccagcccctggacaaaggccgggccgtcacacagcgcggacccgagcacgcggccgcgcagcccagagcgcagctcgcacagcccgggcacgtcgccggcggcccgcacggccgctgcaacataggcgtccaggtcgtgcgccacccattcctcctggaggccgacggcggtgagcaggctgacgcccacgttgtgcgcgtggcacctgccggccagggtcaggcagggcacgcctgggtggggtggaggggttggggaggaggaagcggtgaagggaaggggtgctgcaggatcctcagacccagtgtttcattgtcgcaagccagtgctggaccgggatccccaaccgcctcacccatgacgagggcctcggcggtggtggtggtcccagcatagggccaggggtccaggccgatgtccacgaggccgtactgcgccatgtgatcccggttgctgatggccaggggaaggaggtccacctgcacacgcagaacgcggcagagggtgatgaggggagggagtctgactgcccagttcctgaagggcactccaagcccgtgnnnnnnnnnngaggaggtccacctgcacacgcagaacgtgggagggggtgatgaggggagggagtctgactgaccagttcctgaagggcactccaagcccgtgcgcgttcaagtgtcccccccccctgcctccacgacaacccgcgcaccctgtggcgcttgacacccagcccctcgaacagctgccagtatcgttggcgcacggggtcgcaggcaaagggcttgttcttcaggacaagacgcgccgagggcacggcgcgcaggatgcgggcccaggtctgcagcacccccggcatctgcttggccagggcgttgaaggagccaaaggtgacgtaaccccgggaggccgcggggcatggcgccacgtccggcaggtcctgggccggtgtgtaacacaggaagcagccaggcaggcggaccagttgctctgcagtgggagccatggggtggggggcctgcctcgatgggtgctcaccgcattctggcaagggacactgacgtgtgtgcgtcgccggagcggcagggttcagggctcgcggttcttggtgggtcagcacccagccaacgatagcatcaggctgggacaagggcgaggacactgcagtgtgtgcatgccagacaggtgtgcaaggtccatgactggcaagtgcacgagtcttcagaggcccttctttcgaggtcacgagcaacacactgtccagccactgtaagcacactccacccagaaagcaccaaaaccaacctgtgaaacgctgggttgtgtctagggggtcgcagatgctgtcagtgatcctatactgcactgcctccagcccagtgctgttggggtaaccaatccatgtcacttgcacgggggacggacaggcagccatggtccccagacggttgtttgcagtgtggcccgtcagctccaccagcacgtcaatctgtaggtttgtgacgatggggggatggccgagtttgattagcattttgctcttcaaactccgcaggttcgcggcatcgtcctacagatcacggttctatcggcaacatcagaacccacctctcctcccaacacacacaaacacagggggtggctaccttgtcttcacgtatttnnnnnnnnnntgatgggggcatggccgagtttgatgagcattttgtccttcaaactccccaggtttggggcatcgtcctacagatcacggttctactggcaacatcagaactcacctctcctcccaacacacacaaacatagggggtggctaccttgtcttcacgtatttgtttagccaaggctgcctcactgagggtcgcgacgtccctccaaatccctggcttcgacgtcaccacccctttgagacgctccgtcttggcgtcaccctgggaggggagtggaaggacacggttgtaggaggtcagacccaggacatggcagtgcatgaaaaccctgccgccatgccgtcatgagcaagggactctcaggtggctggagcgctcggtggcctttcacagcaggcactgcaccttaaggcagcagttgtacacaaagagctccacagtggcggtgtcgtggtgtgtgagcggggcctcggcaaagtaggagacgctgtgcgtaaagaggtctggtgagatgtagccgacctgcgctccaatggaggaaggaggggggggattcttgaacagnnnnnnnnnngatgcatgaaaaccctgccgccatgctgtcatgagcaagggaatctcaggtggctggagcgctcggcggcctttcacagcaggcactgcaccttaaggcagcagttgtatacaaagagctccacagtggcggtgttgtggtgtgtgagcggagcctcggcaaagtaggagacgctgtgtgtgaagaggtccggtgagatgtagccgacctgcgctccaacggaggaaggaggggggggattcttgaacaggaggagaccatggtggaaatgctcagggatattctactgtatcctaccctgactcccagcttgagcacagggaggggacttgtacagagccatgcgtccccccccagggcttatcagtcttcaaggcagccagagacattccagtgcatccctgcatcccctcaaagcagcacacaaggcgacagacgcagtggcactgcctgctcacccgaagtttgcgtccggaagcttcatcggccttgtccctcacccgaggcggcaggcgtgggtgcagcctctggaagctctgaccccaatctcggtgggcatcgcagatgaggtccgtctcaccgtgatggacatagttgagcgacagcagccgattttggcctgcagtggtgcacgtgggggttggaggaggggtcactgtgacagagttctggtgccatcacgacagctccagcatgtctgatgcagttctgtctcatccctgggaagagacctgcaggcttgattgcccagctgcagattgggggtatcacctgcccattcccactgcccctcctccactcccagcccccttcacccgcattccggttgtcaggatccagggccaggcatttctcgtatgatgaaatggcctccacagatgcgcccacgtccctctacatggaggagagtgtgagagtggggtatgtggcactctgactgccatgggccagactcaggtagacgtcacttcctgatgaccctccagcaatgccccaaacagcagcttgggactcgagtaatacccccttccccagcacccagcactatgaggccacctgcagcactcctatnnnnnnnnnntcttaggactcgagtaatacccccttcctcagcacccggcactatgaggccacctgcagcactcctatgttgttccaggcctctgcatactccggcgccaggctcagggcggagagcaggagctgcagggcctcctcagattgtccccgggccgtgtacaccaccgcaaggttgttcaaaccctgagggaagttgggccgggcattcagggccgccaggtagcaggtcaccgcccggtcgatgttgcccatctccctgcacgcaagggagtgatttgaaggtatggcctacaatgatcaagttgcccaccccatgtggactgagtattgtaggacaccaggcccccaggagactcctggccctgtagggtaaatgcgcggccttgacctctcctgacagagcatcctttccccactctctccgctgtgcaaccctcctcacccgtcgcccacctgtacaccactcccaggttatnnnnnnnnnnagatttaaaggtacggcctgcaatgatcaagttgcctaccccatgtggactgagtatcgtaggacaccaggcccccaggacactcctggccctgtagggtaactgcgcggccttgatttctcctgacagagcatcctttcccctctctctccgcagggcaatcctcctcacccatcgcccacctgtacaccactcccaggttattgtgtgcctcggcacaggcagggagcacccgcaccgccgactcgtacatgaagatggcgcggtgcatctgcccggcctccatggccgccacacccaggttgtacatcgactcgccatgcagcggatacaggcccaacgcgcgctcgtacagggccacggcctcctcctgcttgcctgggggggaggaaaggggggagcgggaacgtggggtttgtggcgccaatgtcggcgccaaatagccaaggtatggtggcgcgtgctcagcgagctggcaccaacccaccccgcccacagctaaccaggcaggccccagccgccatccagggtgggctccgcccggcctcacagaacctgcctgcacccagccgagcagatctccccgctcaccctgcagcttcacgacggagccgcgctcggacagcgccaccgccaggttgacgcgcacgatgtcgtgattgggcgcaacggccagggcgtgctcgtaggcggccaccgcctcctccagcttgccctgtgaagtaggtttggtgtgggataccctcagcagtactgcaggcagcacgcggggccctgcgtcgcatgcgtcgtccctgtctggccccgggacgaggagtgcacccgcacctcagcaggagaacaaggattaaaccccacatataaagaccgataacaacacagaccacagnnnnnnnnnngccgcacctcagcaggggaacaaggattgaaccccaacctataaagaccgataacaacacagaccacagcagctcgcctggctgcgcagcacgacgcccaggttgcaccaggcctcggcgcaggcgggcgcggcgcggacggcgtcgcggtagtgcgcggccgcctcctccgcccgcccctcctcccctgccgctacacccaggttgtagtgggcctgggcgtgggaggggcaggcctccagcgcggcctcgtaccggcccctccagccgggcaccctggtcagcttctcggcggtgcccaggtccgtcagcacattggcaagggcctgtaccacatcggcgcgggtgggggccagccccctggcacgctccaggcacttgagcgcctccagggggagggccgaggctgtgtacaccgaggcgcagccgaggagggcgtcgatatttgtggggtgggacagcaaggcctccaggtacgctgcgagcgcctgggcagggccgggtggggggtggggggtgtgaggggtgctggtgggcgacagctgcagagcctggcatgacgagtgtccctgtggcccggcctttccccagagcaatatagaagaggaccagagtggctctggatcagccagtgatcaatgtaaggacgcaccagaggtttgttgcccaacgccaggagggcccggcccctgaggcagatgaggtccggtctggctgccacagcctggcccggcaggttggacaggagggcgaggacatccggtgctcgattacattgatccagaaggatcaggacttgagatttgacgatttcaaggtcctgagcatcggcaggtggcacgcatggggtggctgatgtttcatggccagcaggtgacgcctcatgaggtagctgcgaagagggccccgatggcatcgggctggtctgtggtacgtcctctttcaatcgctctttcgactccatactatacatgtccttgaggattgtggcctcgcggtggatgtagtagccttgcacctgctcgcctgatggacgcctacaccatagcgcgcgctcgatggtgtttctgcgcgcgcgcgcgggagcccgcatgcactgtccaacttcagccttgtcgacgaactcgcctgcgcatgcattccataggcatatcttataacgtagcgggatacgcccaattgcatactgcacgtcccgagggcactgtgtttgtacttgagagtgtttggtcggctgaactcctctacggagcactggacaggcatcagcagggtgattagcggggatagattcctccaagcgaccgataaccatggcctctgggcgtaggagcctggccgaagacatcgctgacctgttggagcctgtcgcagtgcagggtatgtcgagagttacaaggataccgtcgccgaggagcttctggtcacgctgcgccagccttcgacagctctgtcacgccggaagtgctaaagtcagaaaaccctccgcaccatgttgctgcaatgcagaggctgagcccgatgcgcatgtcgtcctggatggtgtacccaccctggaagagagcgatgaggacttggctggggtggtgggcatgggccgtgcccgcatcttgccagacatcgccctggatgacccggcgtatgccggcgtacgctcctcccgggccacagcttttgaaagcgaagacttcacacacgacgccgctgaagagccagcagaatctcccaggggatccgatgccagcacctcccagagtgaggacgaaaggcccggacaccacactgaaccccaaggtgagcagtaaggcatggagttgtgcaaggttgcaggggtgatattgggtatgccgggtttccaacaattgtatgtgtgaggtgggcttcaactgcaggggaaatatatatgctgggttatgcacacctatggattttgatggtttggggagttgcatgacccaacatccccccgactgctcgtgctgcagatgatgannnnnnnnnnagaatatgtgctgggttatgaaaacctatggatttggatggttttgggaattgcatgacccaacacccccccgactgctcgtgctgcagatgatgacgaggtggcagccctcgaacgggcggtggaggacctgcaggcaggcgacggcgacaccgccgcataccttgccgagcgagcaaaccgcgagaagcgcaaggcgctggcggtgcagtcccagcgacggctgtgggaggctggactggagatccggatcctcctgcagcgcctcctcaagtccgcagtgcggtttccccaggtgaggatcgggaggattgctgagcagggcaggcgcaagaagatagagttgcagatggggggttccagccgagccacatggactccagttggaaaggtatgcggctcgtttgccatccacatcacgatgtcccaattgctcccacatcccctgctggcgcatccatttcgcagggcgtcctggcaaagaccatccaggccagcgatcaaggtgtggcagctgccgtcgaagacatccgggcggagtctgctggggcgatcagcgacttgctggaggtcatcaagggcctgcacgaaacgaaccctgccatagccgccaccccgcccaagtggcagcggaaggaacggcgggacagcacggcactctggcgctgcgcagatgcatggtatgaggccaccaagcccttccaggacgcctccatcgaccgctggcagaggaagacgctggtggcaggaggtgcgcagggctttgcatggcatcgcttgctggctcttgagcagatcgcgagaccaatacagtgtcgctcggaggacatccaagctggggactgctgtgctgactacgtctcgatgttctgcactatgactctatctctggatataccaaccctcgcagggaacttgaaggccctgnnnnnnnnnntatagggtcgtctgctggctcttgagcagatcgctacaccaatatagggtcgctcggaggacgcccaagctggggactgctgtgctgactacatcccgatattctgcactatgactctatctctggatacgccaaccctcgcagggaacttgaaggccctgaatcagcctgtgtcgcaccaggtggcacagctcatgcaggcatcagatgcggtgatcgagcgaacgcaactggagcgtgaccaaactggcgtcataggccaaccgatccagcctcaggtgatttgtcagaatgtcatgggtgtggctgtggaggttatggtttgtcgaggtggggagtggcagcgtggtggagggtggtggggggtgcagggtctttcacctgccgataagaaatttggaaaatatatgatgtgtggggccagctgtcgcagacttgtagatcgcgggcgtacggggtgcgattcgacgcttatgggtcgctccatgttcgcctcggacgccttagacgcggttcatgcaatctacgccgtcaccggaatttaatctcggtttcaagatcaactcaatacagcaggcagctgggagtaagcccggagatcgcgatcccgagaccttcgacgacactgacttctactccacgctcctcaaggagttcctggagagcaccgaggcccccgcactgacctcccagaaatacgcggtgcgctgatgttgtgttgcatggtccattccttgcctcattatcagctttcgagcatgcccgttgcagcttnnnnnnnnnngtgttgttatgttgcatggtccattcctggcctcatcatcagctttcgagcatgcccgttgcagcttgtgcagttgctcataataccttccctggatccacccatcatgcagggcaccaagaagcgcaagatcgtggaccgacgggcctccaagggtcgcaagattcggtacaatgtgcaggagaagctggtcaacttcatggcccctcgagaaagtgggtccctggtcctggcctcccagctctttggcaacctcttcggttcgggggcgtgacgctgcacaagctcggccaacccctgcggctagtgatccgccctctttgcagctggtctcccctgcctgcccggnnnnnnnnnngcaagctcggccaaaccctgcggccagtgatccacccactttgcagctggtctcccctgcctgcccggcccaaacatgcaatcccttgcagtgcgctgtgaacagaaaggcactcaaatgggcgcgtcggcccgtggacgcaagagcaagggagctgagtcgtattggggatgggccacgccgggcgtttactgtgctagcgccgcctgcagcgtggcctgtgccttgggtttctgcgccgccaccagcccctggaaggcctcggctcctatcgccgcctgtgttgtgagggatcggggtgggggttgcatgagcaaagggcctgggttttggagagtggagcgcattcagcnnnnnnnnnnccgtgagggatcggagtgggggttgcatgagccaagggtctgggttttggagagtggagcgcattcagccacgcagtcccctcgcacagcacgtcgagccgcagcaggatgctgggatcaacgaagtacggacctgcaagtcacttgcctgctgttgggttcacacgcaaaccctccccccagcagggaccgccgtgctgccctccatgatctgccctctcccctctttgagttcaatctcccccccccccccaaaaaaaaaccccccnnnnnnnnnnctcacacgcaaccccaccccccagcagggaccaccgtgctgtcctccctgatctgccctctcccctctttgagttccaacccccccccnnnnnnnnnnaatacccgcagtgcaccaacctgcatctgcttgagcatggccacggcgttggggatctggtctgcggccagcagcttctcgcccttgcccagcacgtgcaccagcaccttggcggcctggggcaggttggcgttgccctcgcccagcacgcgcgcgtcgcccgcggcgatgaagcgcagcagctgcgcgtgcacttccttggcctccgcgcggtcctccaccaggggcagcgctgcgagccaggcgccgcccagccccggctcggcaaggtccggtgcgtgctccagcaccttgcccagcgcgctcagcgcgttctctgccgcgctggcgttgccgtcggcgcgcgcgtccggcgcggccacgatggcgcgcagcgcggccagcgcggcgggggccacggggcggaaggcctcgggccggcgcgcggccgccacgcccaggccgtaggcggagcactgccggatgtcggcgtcgcggtcgccggcgccggcgaggagcaggggcatgatggagggcgcgtgccgcgctgcgcccgccggcgagtgctccagcacgtcgtccatcatgcagatggcgatgcgccgctcctcggggaagcggcccttgcccagcagcgcgccgatggcaggcatgaggccctccaccccgggcagcgccgcgtcgccgtacaggcgcagcaccgtgctcagcgccgccgccagaccgtccagcagctccgactcgcgctcgtgctcctcctccagcgcctccgcctcctccgcgtcaaagtcctcggtggaggcgcgggccagccgctccccgcgccgtgcttcgtaccccgccagcaccgacgcgaagcgctcaaacaccacgcccaggacctcggggcccagaagctttggcccctctgcgatctccagcaggtcgtccagcgactccagcatgcacaccatcagctcctgctccggctcctggtcagtgacaagggaggggggggcaggttgggggggaggcggagggaaggaatgggagattggataccacagtggatgggggagg

SEQ ID NO: 38535 - DNA, 76 bp, Chlorella protothecoides
ccctccttgagctccacgtgagcctggatttgagggggagggggggggagggggactgagtgttttggatttggag

SEQ ID NO: 38536 - DNA, 114 bp, Chlorella protothecoides
ccgccgccacccccgcccactgcaccctccccgccaccagcaccctccccgccaccgggaggaggcgggatgacgtcttttccaccaccgtcgccgcgccagagtccaacgctg

SEQ ID NO: 38537 - DNA, 61 bp, Chlorella protothecoides
ggatctggactgggtggggcctggcgaggggtgcgaggtgctatgggcatctgcgcgcaca

SEQ ID NO: 38538 - DNA, 61 bp, Chlorella protothecoides
ttgtcttcatgcaaccccgcatccccccccacacacacaccagggtacgacgaggaggcgc

SEQ ID NO: 38539 - DNA, 65 bp, Chlorella protothecoides
gtctcgagccttcatgcatggtgctggagaagaggagatgtgcgcctgttatgtccaacggctgg

SEQ ID NO: 38540 - DNA, 66 bp, Chlorella protothecoides
gaagctcatggtgcctccccctcctccacctcccaaccccccagatcagcagccgttacggtactg

SEQ ID NO: 38541 - DNA, 61 bp, Chlorella protothecoides
ttgcccgtattgtcgcgggaggtgggtggacggcctcttcccagctacatctcaggcagac

SEQ ID NO: 38542 - DNA, 152 bp, Chlorella protothecoides
agctcaccccgaaccttcttcccgctttcataatggaggtgcggaccatatgcgtcgggatggtctaacttggggtgcatctgccttgtccaaaaagtggagcatagcctgcatgcccgaggccacagcgacacccccgtccctcgaccatt

SEQ ID NO: 38543 - DNA, 66 bp, Chlorella protothecoides
cccggctcctgctcccgcggttacggtgcccctcctcccggctcctgctcccgcggttgccgtgcc

SEQ ID NO: 38544 - DNA, 76 bp, Chlorella protothecoides
cccggctcctgctcccgcggttgccgtgcctcccctcccgactcctgctgcgcgtgtgccgcctggaaggcccacg

SEQ ID NO: 38545 - DNA, 470 bp, Chlorella protothecoides
  modified_base (138)..(268): a, c, t, g, unknown or other
gactgggttccctccctggactagatgaggagccacccacgctctcctgaacttgcttctgctgcatatagtctgttcccctgaagtcagaagcatcacctttctgggtgggcgttaaacatggacgggcccagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacgagccgtgcaggggtgaggggcacagaacaatagtgtgaataattgcaagagtgcagtttcatgctatcatcctttgcaggctttcgaatccacgtcaggtctggtgggtcgcatgcagcagatcatcatgtgaccccagcacaggaatgaggcacccctgcgcccggcagtggtcgatgaatgccgcccaaggttcc

SEQ ID NO: 38546 - DNA, 400 bp, Chlorella protothecoides
  modified_base (170)..(299): a, c, t, g, unknown or other
cgccgcgccgccaggcgccggtccagcgcggccagcgtgctcagcacggcgccccagccagggcccagcacgcgggacaggcggtgcgcggtggctagcagggcgcgcgtggccgccaggcccagcgcggtgaagccgccggggtcggccgaggcggggcccgcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggggacacactgcagcaggcccgccgcgatggcaaaggactggtgcgcctgtggggaggttgcggtgtgggaagatgcacacttgagagaaaggggggg

SEQ ID NO: 38547 - DNA, 8551 bp, Chlorella protothecoides
  modified_base (259)..(268): a, c, t, g, unknown or other
  modified_base (2249)..(2258): a, c, t, g, unknown or other
  modified_base (3979)..(3988): a, c, t, g, unknown or other
  modified_base (4561)..(4570): a, c, t, g, unknown or other
  modified_base (5114)..(5123): a, c, t, g, unknown or other
  modified_base (5206)..(5215): a, c, t, g, unknown or other
  modified_base (5426)..(5435): a, c, t, g, unknown or other
  modified_base (6293)..(6302): a, c, t, g, unknown or other
  modified_base (7146)..(7155): a, c, t, g, unknown or other
gggagggggtgggtgggaggggggggtggatgagaaccatgggttggatgtatggggagttggcaggggggtttaggcggcccgcatggcagatgagaaggtagtacaggggaccatgcgcagcaaggtgtttccaggagcggctgccagtgcggctcagcagcttcaagcaccgccctgtattccctccccgccccccctcaaccaccaccacagacacacacaaagtacaaacctgacgttccagccgaccaggagnnnnnnnnnnccttcgagcatcgccctgtattccctcctaaccctccctcaaccacgaccacacacacacacaaactacaaacctgacgttccagccgaccaggagctccatgcggcggggggtgtcgaccgcggggccgcgaccgctggacatgcccagctgcgcgcagtcgttcaggccccaggtgtacacctcgccctgcaggaagggatttgggttgtgtggcaggggaaggtgacaggctggccagtgaggggcctaggcagacggggggaggggacaggggcgccgtggcatgggctcagaacccccctctctgacccaggccgccagaagcgaccatgcgtcacccagaagcaaccgtgcgtcatccagaggcgaccgtgcgctggccagaagcgaccgtgcgccagccggaagcgaccgtgcgccagccaggtcactcgatgaccattggtaccctccgtccctccgttcaaccaatgagagcatgcccgcacctggccagtcaccgcggcggtgtgagatgcgcccatggccaggcaggcccagcgccgcgccaccttgaggggctggggctcgtgaacctcctgcgcgccggggccaacgcccagctgcccacagctattgtcacctgggccggaagggggggggagggggagaggggggaagggggaggtggagggatgaggcaggatgggcagggcacctcctgtcccacacggcaggaaggaacttcccatcgatccttggaagatctgcgtgtaggcaagcccctctcccctcaattctcacaaccaaaaccccacacctccctctgctcaccacaaacccagccattctcgtcgagctctgtgctcacgagggggctgtgggggctgatctggcagtccacgtctccctgcaccccagggatggcgagcatggatgaatattcgagctctagccttcattgcatggtcagatccgggcagagaccggggcggtgggggcccgactggtctccgaggtctgggtgtcgggtcctcggtggttggggcctcgccggaacccccgcccctcgccctcgcggcatgtatcccaggccccacatccccaaatccaaccagcagaccccggcaggcattgccggctcagatcaccttgagtgcggctatgcgggggtgggtgcggaccttcaggttgacgtccctagggtggggtgggcccctgcctcccaccgtcgcgtccacattgatatccattccctacttgcttgtggggcgactggggcgagcaggccctcatgtgctggctgggatcccagttcggacggtggttgggcgagggaacgggcggtaccatgtgactcgcgaaagtactcttgcttgctcgcgcccgtgggaatcgcccacgtgcgtcccggccccccagcccctccccgaccccctcgctgccccaaactctcccctcctcactgccttacagcacacgcgatcagtgcacggccgcggtcttgccaaagatcttggcctgctcctgcaggatggactgccggatgcccttgcccttgggcaggctgaccagcggcttgtcgcccttgccgatgacgaacacgttggtggcacgggtggcgaaggagtggcccacggcgtcgcggatgtacacgatgtcgaaggagcccttgtgcttctccttgcgggtgatggtgcccacgcgcccgttgttgtgcccgccggtcaccatgaccagggagccgacgtcaaagtgcacgaactcgcggatcttgccggtctccagatccagcaggacggtgtcgttttcctggagattgacgaaagaatgagtgatgaagatcggcgcaaccgagcaggtgggggtatgggtggcaggaatggcataccgggtgcgaaaacaggtccccagtggcgaggtcccccaggccccacgctgggcacctcggtgcagagttctttgcaccccacgagccatccccactcagttcccaaannnnnnnnnngggcgaggtccccccaggccccacgatgggcacctcggtgcagagttctttgcagcccacgagccatccccactcagttcccaagcaaacaacacaccaagcgagcactcaccctgatgtcggggtcggggtagcggatggtgcggccgtcgtgggtggcgatgtaggggatggcgcccttgccgaactgcatcctcttcaccttgcacagcttgtaggtggcctcctccttggagatgcggtgcaccacaaagcgccccttggcatcgtacaccaagcggaagtgctcgtctgtgaggggaacaggaaggggtgggaggactcaggggaggggctgtggcgcaggcccaggggcctgcaacctacgagtcacagtcgccacatcagcccgctcaggcgccccactgctgctcccacaccccatttggcgacacgaggtcaggagggcacacgcccgtagcgtgcaacaggatgcgagccccagcgtgcctgggtagccaaccaaggccgacgtacactccaggatgaccaaaatccctgccgtggcttcctctgggccgacggtattcccatgatcccgcaagaccctagccatgccaacgcaccggtcttggggatggtgatggtatccatgaagcccacggggtaggtcttgtcggtcctcaccttgccgtccacctgcaccaggcggttcttcaggatggccacgacctcacgaccggtcagggcatacctgcaggggaggagagagggggagagggcaccggttgcagccatgggacagatgggagatactacggagggacactcagttctcccgcccaggggtcgagaggtggtcggcactcacttcagacggttgcgcagcagcaggatgagtggcaggcactcccggggcttgtgtgggccggcgctgggcttgggagcctgcatgggagggccaggggaacggtgacggagagtggcgggagccatcgcagggcatgccggaccacactggtggggccccggcgcaggcctagccccggagcgccgaccgcgggccagcatcctgccattgattggggacagaccatcaccgtccatccaccatccgcgggactcacgaaaattccgccaagcttgtccagcatccagtgcttgggcgcattcagccgcttcaggtgcttcttaggtccgcgaaccatggttgtaggagccccttggcggtcctaccgggctctcgatcaaactctaaaaggacagcacctggctcgctggtgcccaatgtgcggagagccgcccccaacccagggtcgcaatatgggcgccctttctaccacaccgcatgaaccacggttcgacagatcgggtaactcccacagagtcctcctcccgaaccgccagaccctcagatggtggatttgcagggttgaagtgaatctgacaactcttaacaaacatattcagagcttggcgctggtgccagccgcggattcgagccgtggactccccctcgaccgcctacggtgaccacgtggcggtcgggatactccactccctcgacaccgatcggccccatccaagatccaatggaccgccatgtcctctgacatggaaacccaattcagaatatgacatcaatctgaaccagggtggattctaacctccagcagcgggccgggagggtgcctgcaccacacccctgccatccaccaggagcccagagaggtggacgtcannnnnnnnnncttcagaatatgacatcaatctgaactagggtggattctcatctccagcagcgggccgagagggtgcctgcaccacacccctaccgtccaccaggagcccagagaggtggacgtcacctcccggtcaagatcctatggtacgctgcacatccatgtcaaggcggatcatgaaaccggctattgaactctccaagccatgaacgtgtataaagtgtctccgcagagtgggcatgcaaggtcagaccatgcccagcctcgaaatactgcttccctgggtccaagcgtccctgtccttcccaccggcggcatcttcaagtcggcagctgtggaggtgctgcgtcgagaaagacgtctcatgccaactggcgagatatgcaggcatgctggggtgtggacaaggaacgggtgcttgggcggtgtgggtttacttcagcacagattgcaacacacaatgccattggatcctggcaaaacagagactccaccatacatgccgcgcttcagcgcatcctcactgcatctgggttcaagtcgcttcatacatctgctcgcaggctggccttggagtggggnnnnnnnnnngatgccattggatcccggcaaaacagagactccaccatgtatgctgcgcttcagcgcatcctcactgtatctgggttcaagtcgcttcatatatctgctcgcaggctggccttggagtggggcctgctgacatgctcgggcaggactcccgaggcaacaatggcctcttccctctatggcgacatcaagcgtcgagaccacaaatccgtcttcatacggccgcaggagggactcttcggactgaaggagtggatcgaccagggctacttgccccccatgccagacaactcagtgatcatggcgcaaaccaagcgtggttgcaggccgacccaggtgctttgtagagatggagttgtgggtttaggggggcggggacatcaggggatgcaagccctacgaggcgagaatggtgggaaaatgggcatacctgcatcccgagtgtagggctcctgggatagcctatgggccagagacaggttgtgcaccgtggctgagacgcgagaagcacaaggccgccgtgcttttgcctctgacccaccattgnnnnnnnnnngtgggccagagacaggttgcgccccgtggctgagacgcgagaagcacaagggcgccgtgcttttgcctctgacccaccattgnnnnnnnnnncccccacgaggcccctgggcatgccccttgccccaccccatgccttctcctgctcggtctcggaactggagatgggctcatcctccccatcctcctcctctgaagtctcttgaggactgtccacgcgcatcttgcgagcataccgctgcttcaccaggcggccctggagagggaggtggacaatggtgggtcagaggcaaaagcacggcgnnnnnnnnnncgaggggagcatggggcatgcccaggggccgcgcgggggcaagtgcattgggagcgtgcggggcactcccacgggtaacagacgcacgcctggtccttgtcccaccgacggatgccccccctcctccagagtgcgccccctgcaaggctgataccaggccgcccaggggcatcccagaggaagggcatcacccaggcggcgcctctccaccccgcccgctccacctccctgccatcctcctcagccagggcagcatgcggtgcagatcctggctgcgccactggacaagtgcacagcgcagggctcgaacctggagggactcccttggagacaacacgcatgtcaggacccctggaaggaggttgccggaccgccttcagccccgctgtgggcctggcccaggcaagtgatgatgtcgaggcggcctgccatgctgcgggggcatgaaaatctcgcgccctggtgcaggcggtgccatacccctccctcacggtctccatgctgtcgggacatgcaggcgcagcctgaagccgcgtgccccacccctctggccatccagctggggtgcagccccgcctttcccctgccgctgctgggcctgctcagccctgaccctcccttcccaccgctggaaagccccacgcccctcttccgtgcctcgccgattccagtgagcgtggcattgcctgccttgaggcatgagaccatgcgcgcttcctgacgaggttgttcattcgcagccactcttggcacatgcacaaaagtcctacggatcagtgccagctccatggcacactgtcctagaccccaagccggcacccaccatacccgtcccacagggaggaactgcgaggcccnnnnnnnnnncttcattcgcatccacttgtggcacatgcacaaaagtcctgcggatcgctgcctgctccatggcacgctgtcctaggccccaagccggcacccaccatgccccgtcccacagggaggaactgcgaggcccgccacagcccccggggaagcgaagcccggccctgctgccgaaccctgtgcggagcctgagacacaagccgcttcccatgtcctcgtcgatgcatccctctttgcaacatgcacggggcaggacgcacggggggcagccgtgaccctggcacactacttcaccgacgccaggtgggtgagggtgcagggagggaggcgcgtgcttgtttcgcgctgctgctatggccgggaggaagtccccactgcgccccttggcaacttgtcgccacgcatgtgagctgttcgtggatatcaccccatgatcgagccagtgcctgtggtccattcatccgggatacccagccccccaatctacccacggccccaagatttttggactcgtgccagtcggggctgctgcgccacctcgtggtgttggaggaaaaggtggacagcgtcgccgcgcggtgtgcaggagatcccctccgcaacgccaaggccaatgcgctcctacaccatgcctactcttggctgaagacatcttactactttcaagacagggctgctgtggcatcgctgagatggccggcgggcctcggcgacgacaggagcagacaaccgaaataacctcaggtgctccctgtgtctatacctcatcatcagaagaatcgtgacaactgcagcaaggaaaatatgggtgaaggatatggggtctttgttagccgacggtgatgcnnnnnnnnnncgtggcatcgctgagatggccggcgggctttggcgacgacaggagcagacaaccgaaataactccaggtgctccctgtgcctatccctcattatcagaacactcatgacaactgcagcaaggaaaatacgggcgaagggtatggggtctttgttagccgacggtgatgccccgctcgcacctagggggtgggtggacacccggcacctgcctcctcgcggcagcacgggtgctgctctcgatgcgacgtgccataaacctcatccgtgcatgtatatgtgttgcatgactggtagtatgatgtggggcacctgcgggtcccttccagctgacgtagaaattcttgaagtaacatcctaggcccggggaatcgatggcaagcgcccccatccaggctgcgccgtcccgacccgatcggtccccagcacagcacatatgccctcccactacgcatgcacattgaccgcgacagacacaggcaaaagcctcgtgtaaggaagggcgaattatcagtatcaggcaccctgtgcagtgcgcacccctgtccgacgcacaccggtttctacacgccgtacccaccgccttcctgggacacccccctagtcttggtgctgtcctcgccaaagaacatccagtggctggagtagagccactgggtccctccccttcccgccagtgtctgagaggccatttgccgagcaggcgcagcgatgtccacggaggcaggggtgagcgaggcgcgcagtccccgggcctcggactccgatacaatacatgaggcacccatcgcgcaggtacgatgcggaatgggcggccctgcgctgttcccggcaccctcgcccgcctggcatgcaggtcgtcgtgtcccaagtgtcccgcccatggcgtcatctccgacgctgcatctcgcacccacgcaggcggaatcgactgccaagcccatgcccggcagccccccggcccccaagcccctgactaagccctggagcgccgtggtggccaagaccccgacagatactccggagcagcccgctccttctcccccgcagccccccctcgcccgtgccagcccggagagcgcggcccccagccaggggtccgagcccgccacgtccaaggaggagtcccaggagctggcgaaggaggggcagcccacctccgagccggcacccgagggcggcgagcccgccgcccctcccaaggaggaggagccctcccgccccaccaagcccgcctggaacgtgcccgccagggtcggcgacggcggcgcagagggcgcggttttggaggcctccgcccccgctcccctggcgagcgcctggccctccctgggcgacgccaaggaaccgatgacgcgcaaggagcggcgcgcggccgcggccgacgccgccgccagc

SEQ ID NO: 38548 - DNA, 171 bp, Chlorella protothecoides
atcacccgcctctggtccatcataggtgggcggcgacgggggtccagcgccggatagccacgccacccgtgccctgcttgcagctgctagcgcgtcgcgcttgccgacgggcagggtcccgccgcgatccagccctccaatccctcctccatgtgccaccttcgtgcaggg

SEQ ID NO: 38549 - DNA, 122 bp, Chlorella protothecoides
tttggtgagggtttgggacgtggggggatgcccaggaagtggctgtggcccacgaggcaggtattctttgtcctggacctccgctccccgccgatggcactgcaactctcacatctgcacat

SEQ ID NO: 38550 - DNA, 138 bp, Chlorella protothecoides
accaccccagccctggccagccaccaggatgcgtacccagaccatgcaacccagtcgaccacccacacactacgaccattgctgatgacgctttgcccgtcagtcctgacccatctacttccaaaacttgcacaagga

SEQ ID NO: 38551 - DNA, 18926 bp, Chlorella protothecoides
  modified_base (211)..(220): a, c, t, g, unknown or other
  modified_base (578)..(587): a, c, t, g, unknown or other
  modified_base (1390)..(1399): a, c, t, g, unknown or other
  modified_base (2286)..(2295): a, c, t, g, unknown or other
  modified_base (3067)..(3076): a, c, t, g, unknown or other
  modified_base (4727)..(4736): a, c, t, g, unknown or other
  modified_base (5418)..(5427): a, c, t, g, unknown or other
  modified_base (5939)..(5948): a, c, t, g, unknown or other
  modified_base (6848)..(6857): a, c, t, g, unknown or other
  modified_base (7517)..(7526): a, c, t, g, unknown or other
  modified_base (7759)..(7768): a, c, t, g, unknown or other
  modified_base (8604)..(8613): a, c, t, g, unknown or other
  modified_base (8691)..(8771): a, c, t, g, unknown or other
  modified_base (8880)..(8889): a, c, t, g, unknown or other
  modified_base (9410)..(9419): a, c, t, g, unknown or other
  modified_base (10479)..(10488): a, c, t, g, unknown or other
  modified_base (11171)..(11180): a, c, t, g, unknown or other
  modified_base (11467)..(11476): a, c, t, g, unknown or other
  modified_base (11655)..(11664): a, c, t, g, unknown or other
  modified_base (11777)..(11786): a, c, t, g, unknown or other
  modified_base (12030)..(12039): a, c, t, g, unknown or other
  modified_base (12242)..(12251): a, c, t, g, unknown or other
  modified_base (12390)..(12399): a, c, t, g, unknown or other
  modified_base (12458)..(12467): a, c, t, g, unknown or other
  modified_base (12526)..(12535): a, c, t, g, unknown or other
  modified_base (12986)..(12995): a, c, t, g, unknown or other
  modified_base (13255)..(13264): a, c, t, g, unknown or other
  modified_base (13589)..(13598): a, c, t, g, unknown or other
  modified_base (13996)..(14005): a, c, t, g, unknown or other
  modified_base (14525)..(14534): a, c, t, g, unknown or other
  modified_base (15097)..(15106): a, c, t, g, unknown or other
  modified_base (15186)..(15195): a, c, t, g, unknown or other
  modified_base (15911)..(15920): a, c, t, g, unknown or other
  modified_base (16298)..(16307): a, c, t, g, unknown or other
  modified_base (16369)..(16378): a, c, t, g, unknown or other
  modified_base (16826)..(16835): a, c, t, g, unknown or other
  modified_base (18001)..(18010): a, c, t, g, unknown or other
caccgcgacgccgcgctgcgtgcgagctacgccggcctcgcccggccgccctccacggggcaccgcggcggctggggctcggccgcggccacgcccgcggccacgccgctgcggcacgaggtggccgaggcgaacagggcggggggtgacagggctgccgcggggcgcacaggcagcgaggcctcaccggcgccggggtcgcatgtgaccnnnnnnnnnntacgccgttgcggcacgaggtgcccgaggcgaatagggcggggggtgacagggctgctgcgggccgcacaggcaacgaagcctcaccggcgccggggtcgcatgtgaccgacggcctgctccacatctgacatgcttgaccgagcaagtgtgatgcccctgagaccctgcttcctggactggctgaggcagaacagtcgtggtcgctgctccctgtgacagtcgcgccatgcattgtgttccgaggaggcgagtgcaggcagggacagcctgatgtagcttgtgtaaagacttcactctcctcatactcgaatcaccgctgactgcgtgagcgccatgcgtgtcgcaggccgcagcannnnnnnnnntccctgagaccctgcctcctggactggctgaggcagaacagtcatggtcgctactccctgtgacagtcgcgccgtgcattgtgttccaaggaggcgagtgcaggcagggacagcctgatgtagcttctgtaaagacttcactctccacatgctctaatcgccgctgactgcatgagcgccatgcgtgtcgcaggccgcagcacactgcctggcatggcccgtgcccaggatggcccacacctctcaggggagcagctgggccagcttggcgtgggcggccctcaggcgccgcgtctcggcccccagctggttggacagcttggagagctccagccgggactcgcggaggcgctgctgcaggctcgcctccacctcctccgcctgcacggggactgggaggacactggggcgggcctcgcgacgagcatgctccacggccagaaggggtggcaggtgcgagggctgccaccgcgatgcatggtcctgcgcacccgcagagggacctgctccgtgacgcgctgcaagccctgctgaaccgcatggggatgccacaggacgccagcctgatggctggaccgctgcatgctcctgcgcaccatggaagagggcggagcagtagggcatgccgtccttagtaacgtcgacatcaggctgtcgacccagcccatgccccctgttggcacatcctttttgggatggactcatatacttgcatgcccagccagatccaggacccccacccagacataacaacaatcctgcacacctcgaggtcgacaggccgtgcagctgctcgtgcaggnnnnnnnnnntagtagggcatgctgtctttagtaacatcggcatcaggctgtcgacccagtccatgccccctgttggcacatccttgttgggatgggctcgtatccttgcatgcccatccagatcctggaccaccacccagacataacaacaatcctgcacgcctcgatgtcgacaggccgtgcagctgctcgtgcaggctggccaggagagcacgctcggcctggacggctcgctgcagtcggtgcaccccctgctccaagacttggaccttgcttgcccgtgcagccctccgtgctctgcggaccacagcggcgtccctgctcctcctggtccactgctcccggaaggcccgcagcatgtacgaggaggaaattcgcatttctgtcgcatgttcatcgtccgtccgcgccacctcctggtcctctgggggtggagaaaggccagggtaggtccggctccactgctccgcccagatcacttcggagcgccaggtcacatcgcgaagacgtcgcgacacctttgacacccgacagatgtccatgacagagcatcgagacaggacatgctccaggagctcatcggtgagcgtctgcaggttgtggaagtgctcggcagcgcccccccggttgcctggggtgccgtgcatccaggtacatagtgtagattatactactccgagagtgaatagctgcatgtgaagctgatcggcattcgcgcgcgttgcccatgacagccgcgaggtcgaatagaatgctactttcccactgacgcgccagggctatctggcatatatgatggatcctccacgaggtgctccccaaaaccaatactcatgacattcgccgttgcaataatccaaaatcgatatctgctatggtgcatcggtccagggtcnnnnnnnnnncagattatactactccgagagtgaacagctgcatgtgaagctaattggcattcgcgcgcgttgcccatgacagccgcgaggtcggatagaatgctccttccccactgacgcgccagagctacctggcatgtatgatggatcctccacgaggtggtccccaaaccaatacttatgacattcgcttttgcaataatccaaaatcaatatctgctatggtgcatcggtccagggtcatcgtcgggcagaatctgcgccgggaataccggcggccacgagcacgatagtatgacgccgggtcgtgccttgtgatttatgccgggcaccgacgatgaggcttgaatggagttccgatggcgatctatagcgtcggtttgcaatgctggctccaatggcttccgctcagcaccccattgacagggatcgctgtcggcatggtcggcctcctgatgctctggcacttccttgctccccctggagcagccccgccacctccccggccattttggattgatgctgccattcctgcgctcatacatggtaaccttcctgactcgaccaggcgctcacatcttcatggcggccctgtgtatgtccgctccttcctcggtcggagcacagtattcgtttcgggtgcgtagcgcatcgcatgcgtcacagtgttggagattccatggccccatctgcgagctcacttcttcataaaataataatctgatgtccacctacgatgtaggagctgctaacctgcgcaaagtgcttcagggcgaagatnnnnnnnnnngaatggccccatctgcgagctcacttctttataaacttatcatctcatgtccacctatgatataggagctgcgaacctgcgcaaagtgcttcagggcgaagatcagctcgtgcggtcccagtggccgccagccaccgccgccctgctgggccggcattccctgtcgaacctggctgggccagaccatgcccgtctcaggttgaatggacggacgcaattgctatccatagattcatcctgccatcaaccctgccctttctgtgcacccagcaggattcccttctttctcccatcacccaaacaggcgcatgatgctccctgccttcacccctcgggcggtgcaaggctactaccccttcatctccagcgccacctcggcggccttggaggcctggtgcggctcggcagaccctgtcctagcctataaagcggtgaactcgctggccctgaagatcgccattggcgtgatcgcggggaccggtgggccctggatgcaggccgaggcgttccctgccttccagcgcctcgtgacgacgtggctggagggcctgtttgcctggcgcatagacctgtcttggacacgcttcgggaaggcccgcaaggcacgagccgcccttgatcaggtagaccttgtatcttttctgtggagggtcgagatttgatgtagcactgcgtgaagtggaagaatgggtcagcactcaaggtggctcggaaaattgcaaggggaccggacagctcaaccctctgatgaacagtcctcaccatttgcattccccatgtgatgctggagccccagtactttcctccccatgcgcagatggtgctcgaaagcatcgaggcatcacgcagcgggacagagttctgtgccatcagggtgatgctggacgccagggatgaaaggggggtgccctactcgaccctggagctcctggacaacgtgatgaccctgctctttgccgggcatgacaccagcgccactgccatgctgtgcctgctggaggagatgcggaagcacccagagggtgtgcaagccctgcgtgcagaacaggcaggctggtcgaggggggaagctcctgtgtaggtgaatgtgcatgtgtacgagtgagcggactcgctgcgcctgtggtagatccttgttctgtgccgagtgcacttgcgcactagcaagaacggcatgcgaggccctgatgctgcattcatgacacgacacccctccatgcatgcaagccgcaggcagcagtgattgcggagcatggggaggagctgacccccacagccctggcagccatgcccctggcagaaggctgggtgaaagaaagcatgcgcaggaccccggtggtgcccatcgtgccgcgcaccgccatccagggttttgaggtgggcggattctgggtccgacccggccagccggtggtggctggcctgcgctccaccatgcagctggatccaaggtgggcggctgttgaaagttgctcgaagggagaaactgtttgggaggcagtgacggggatggggtgggcggagctgagggtaggactggaatgcgctgtgcgtggatagtacggtggcccaacacaagagcatgcaccagacctaggtgccagcggggggtggtgttcagcacccagggcccagcactgggcgtggagcnnnnnnnnnnagaggtgccagcgggtggtggtgttcagcacccgcacccagggcccagcactgggcgtggagcctgatggtcacctgacagctctccgacgaaccgtggcaggtttgagggcagcaaacctctggccttctgtccagagcggtggatggcgccagaggcatccagggacgccgcgtggatgccgtttgggggcgggccccgcctctgcctgggcaacctcctctccatggcggagctcaagatcttcctggccctgctgacacgaaggtgtgcgagcctggaggcggggtgttgggcgctgctatgcgatcacgtttcacgctggcatcccttgcacacagtcccctccccattttgcaaggtacgacgtcgagttcttggaccatgcggaggcatggcactacatccccctggcccggcccctgcggggaatgccaatccgcctcagacccaggcacctcactggcaaagcgcccagcgcctaatcctgcatgcctcgcctcgccgcccgccgtcgtcacagtccagtttttacatggatacacgtcgcgatgggggccgcagccagaggacaagggcatgaaggaggggtgaacagaggggtttggacatgggagggggaacaggctctcggcggcgggcagggtggccagcccggcgtttctcagcggggcgcggtccnnnnnnnnnnaccagccagaggataagggcatgaagacggggtgaacagagggatttggacatgggagggggaacagggtctcggcggcgggcagggtggcaagcccggcgtttctcagcggggcgcggtccgatactcgccgaggttgaaagggtcacgcgacacctggtccggggcatggtcaggcgctggagagcaggtcggagtagtcgacgtccagtacctcgtccatgtcgccggtgtaggggccctgcagtccgtagaactggaccatgtgggccagcgccccgacgatggcggtgttggcggggttggatggctccgcatctggcgagggtgtcgagggaggggtgggttccaaggattgtacttgtgcgagtgtgagtgtgaatggggtgtctggcgagggcaccccagcacaaagtttgcgatgtggccggtctggttgagctgagcagctccatgcccatgcaggcaggttgagaacatccattgccccatgggctgcgcactcccggtgnnnnnnnnnncttgtactcgtgcgggtgtgagtgtggatggggtgcctggcaagggcaccccaggacaaagttcgcgatgtggccggtctggttgcgctgagcagctccatgcccatgcatgcaggcaggttgagaacatgcattgccccatgggctgcgcactcccggtgtgatcagccccaacctctcctttccctccgacaactccccagccgactctcacaggtgtagtccttgcggctggcgatgagcccatcgttgtacagcggcgagccccagaccgcgccgtaggcgatgtgcggctgcggctgcaggctggagatcatgaccatctggccgcgctgcaggaatttgtcggtccctgtctgcttggaggaccagggcccgacgtcacgcccagtccacaacttctcccccatggcctcggtccaggtggaggtggagaagtaggagggcttgtgccagaggtaggtggggtagtcgttgccaaagcccacgatccagctgcgccccacgtcgcccagcaggtagtcgacctggaagtgggcgtaattgagcaggcgcgcggcgtagccggcatcggccgccgccatggcgtcggcgtgcatggcaccgagcatggccacattggccacgtgcatgttggaggaccagtggtaagggtatgccgcgccacccagggtgtgcccgatcgcgccggtcaggtactggtcgaagaagtggcgagcgccggcggcgtaggcgccgttgctggggtccagagaggcgagcaggacggcgttggcgccgtagtagttccagacctgggtcgtgatggggtggtggggtgttttttatcatgtgtcgcggggagacagggaagggtccgaggtggggcaatcccaacagatgcctgcactgagactcctnnnnnnnnnnctttatcatgtgtcgcggggagagagaagggtccgaggtggggtcatcccaacagatgcctgcactgagactcctggcggcgtcatcgcactgtgggccgccctcctaattggactcaatcttcgtgtgcagaaccaaaattccctcaggcaaaggtatgcaaggcctgcactgcacctacggctggccagactgaccaacacaggctttgagaccaaatcaccctcccctgccagccacaggctcctctacagcctccctataccacctcaaccctcaacctgatctccctcaaagaatcctgcagtcccacagcccacgccacccaagtcctcccagcatacctccagcgtgttgtggaaggtggactgcgcccaccacttctcggcctcactcaggaacttcttcttcccggttgccttgtacagccaggcagcggcccacgtcagctcgtcatggtagtcaccgtctgtcgcatacagggcttgcatgagctgcgtgcagaggaaggagggaggatgggatggtttgagaagattgacgggatcaaacacggtgacgcaaatgcattgctcgtcagaaatcacacaagtgaatcctatgcgatctaatgctcctctctccttcatattctttctatccagccagaccaaaaacacnnnnnnnnnncgacgggatcaaaacggtgacgcaaatgcattgcttgtcagaaatcagacaagtggatcctatgcaatctaatgctcctctctccttcacattctttctatccagccagaccaaaaacactccccgcaacaacacaccttgatgactgggtcggaggacgtcttgaaagacttggggttggtggaggcaaactcatacagggcagtggccttcgctatggtcgactggcgggnnnnnnnnnngggtggcggtggggaggaaagggtgtgggatctggcgcacagcatcgggatggaccagggcatcctatccagtcgcacatgatgagccacaacacatgtaaaaggatgtcgccggggtccctcctctctcttccccactctgccactcacgctgtaccactctggcatgtcgctcttgagcaggtaggcggcagctgccagggcggcggcggcgcccccagtggcctcactgcccggatcgccagcggtgaagtagccggtggggcggggccccacatactgctcgtagtactccaggggtgagaagttgtcaaaatccctggtggtatcataagagagacaggttgtgagggatatgggggctgatatgaatggcatgatagaaagatcaatggcctggtgggtgccatgtggccaccggctccccacggcagggcagtcatgccgctgctgcctgtatggacgtactgtgtggaattgccgttggcgccggcaaagatgcaggggtcctgactgacgagggaattgagcaggtagtctgcgccatgcttgaccttccacttgagctcgtccatggtcccagacgcctggaaacccttcttgaagaacacacccgcccaagccatgagggagacctggcatggcaacggagtctcagggtttggggtggggtaaaagagcccagtcatgcagatgcactcaacgagcacaacgcaaaaggcagcttactctcgtctgtacatctcgaggttgagattgcatttccctgatgggcgttgaccgctttccctaccacatttggtgcccttcctttcttcttgcccacctggaaattnnnnnnnnnnacatttccctgatgggcgttgaacgctttccctaccacattcggtgtccttcctttcttcttgcccacctggaaattnnnnnnnnnnnnnnnnnnnnnnnnnnnnnnnnnnnnnnnnnnnnnnnnnnnnnnnnnnnnnnnnnnnnnnnnnnnnnnnnnggttgacatgggacatttggcgtgctgcaacgcaggctatctttctcactggatgtggctgatgttacccatcactgatatgcatgcaaagagggaaagaatccactcnnnnnnnnnntttcctttgcaggtcaggcaggaatcgccgcgcctgggaggggtgtgcaggatggggttttggttgacatgggacatttggcatgctgcaacgcaggctatccttctcactggatgtggctacccgctgatgtcacccactactgctatgcatgcaaagagggaaagaatccactcaagagcaccagcttggggtcacccagccccattgctcaccatgtcagacgctgggccttgggctcgatctttccagagatctggccgtccaggtaaaccaggaccttggacagggcctcaacatagtcatacggggccggtgcggatcccgatggcatggcagtgttggccgcagcggcggtcacacctgatatggtggaagattggaatacggggaacgggaatcaagtggcggagccgctgcctgtcgtccagttccctgccctgcacacacatccctgctgaacgtaccacacccctcaaagcaccaccaagttcaaactcactcagtcccttcccgccggnnnnnnnnnnggggaacaggaatcacgtggcggagccgctgcctgtcctccagttgcctgccctgcacacgcatcccttctaaacgtaccacacccctcaaagcaccaccggggttcaaactcactcagtcccttcccgccggtggtgggaatgtaggtcatgacttcgccgtcgcgatcgccatagtcgcacaccccgggagcggagcaggcctgggggtacccgttgaacgtggcctccgccaggtttcggaaggtcaggccaacgacgcagtagggctgcacgctgctccaatcaccctcgactgtgcaggggatggcagcagcaacgtcaaaccaaggacttcacagcgcaaactggtctgaaatcctttgcttgagtcacgcatgcacatctccccccccccacctcccagttctcttcgggtgtcagccaccgcaccactggatccaggcgggtagcaagctgcgttgcacttcccagagtaggcgacgcgcacattcatgcacgaagggatgcacgagttgccgtaggtctgtgggcgtgggaggggtcacttagcgtttggggtccgggtgcgctcattcccccttggcaaactcattcaaatttcggattccctccctttccccatctggggatccttccgagaaaacccgcggccctggtttacctggccgtcgctgccacagacaggttcgtagtcggtgacattgccacactgattgcaccagtcggcgggggcgacttcggtgctcaccggggacggcccgggggcggaggtctccagaagtctgcgggttgcactgtgagcgtccacccagcccccagccaagaccacgagggccagcaggagacaggcggccgatggcgatgatgccattacccctggattctgagaggattgcctatttggtgcgagggagcaggaggtctgcacacgaacgcacggggttggctcacattcacgacggcgactggagaaaaagtctcgtccgcttgataaacagggtgccttgaacagggttcaacccgccgttgagaataagattactgcaaaatgagattnnnnnnnnnnggggggttggctcacagtcacgacggcgcctggagaaaaagtctcgtccgcttgataagctgggtgccttgagcagggttcaacccgcctttgagaataagattactgcaaaatgagattcttatggccagatcctgcacgtttcttgcggtatatggggtcagcactctgatcagccaataccgcgttgccgctggttggtggatcagggtttatcccccgggcgcgccacctgtcttgggaaccctccccacgggtgagtgagggagtggagcgggaagatacagctcacgccataccgcactcccctgccctggtcctgctcgttacagttgtgatcgcggcacatactcgatcacagtgatcggagcgggggctgtgacgcttgcgggagagctcagccgtgcatgctcctcgccgcatgatgatccgcgatccatgccggaccactcggcatgcgggggacccgacgctgagatgggtcgaaggccaaagaacagaatagctccctctcccaaagctgcagccgcgtggcgcatcacccggcgtgcaacaacagtgttgatggtgcgccgatgttttctttgcgaggggagaactgttagccgcccaagcgcacatcaatcaccgatatctactgcaatatgcccttatcctgtcataggtcgccgggctgctcatcnnnnnnnnnncagccgcctaagcgcacatcaatcactggtatccactgcgatatgctctgatcctgtcataggtcgccgggctgctcatccccttggcctaccatttcttggtgggagccggcctcccccggccggcctctgccgcacccgccgtgcactccgcagcccccgaagtgttccggtaccgcatcgtctcggagcactggcatgaccccaaggccttcacccagggtctggagtatggccgaacctgcagcaaggagggaaactgcaccgacttcttctgggagtccacnnnnnnnnnnttcccatgagcctctccccacttcccactcatcccctcctcgtccaggtatgtacggcgagtcggaggtgcggcaggtcgagtttgccagcggcagggtgctgaggtcccgggcgctgccctcccaggactttgcggagggcatcaccaagttgggcaacaggtgcggggcggcgtgtnnnnnnnnnnaggtgggtgggtggtgggtgggtgctggagtgttgatgtgtgttgggaggtggctgaggcggcctggcaggcaagtgggggcaggggccaaggccccagcacagagcaggggnnnnnnnnnngggtgggtgggtggtgggtgggtgcttgcgtgttgatgtctgttgggaagtggctgggtcggcctggcaggcaagtgggggaaggggccaaggccccagcacagagcaggggctccctcggatcaccgtcctatgaacctccccccacttcccactcggcccctcctcgtccaggcatgtatggcgagtcggaggtgcggcaggtcgagtttcccagcggcagggtgctgaggtcccgggcgcnnnnnnnnnnggatcggagcgcacccggactgtggggttttgctgttcgcgcagtggcagggtgcgctcacagccggccgcccggcacctggtctttgccagggcttgcccctgcctgtcacgaggcagcccccacaacatccctaggcccctgattcaccagccccaccccctttcccccaccgcagcctgtaccagctgacgtggcgctcnnnnnnnnnnaggccgcccggcacctggtctttgccagggtttgcccctgcctgccacaaggcagccccacaacatccctaggcccctggttcaccagccccacccccccctcccctcccgcagcctgtaccagctgacgtggcgctcnnnnnnnnnntgatcggggcgcacttggaccgtggagctttgctgttcgcgcagtggcagggtgcgctnnnnnnnnnncctgcaccagcgctccgtgcaggacgccggccgcgccgtgcccttcctcaacgagctgnnnnnnnnnncccccgcgcctgggtctatgccgcggaggacctgggcgcagcgcgcctggcctccacccccctcctcgacggctggggcatcaccaacgacggcacgcacctgatcctgggcgactcctcccccacgctcacctgggtcgaccccgggaccatggcccggctacaccagcgctccgtgcatgacgctggccgcgccgtgcccttcctcaacgagctggagtgggtggatggggccatcctcgccaacatctggggccgggagtgcctcgtgcgcgtcagccccaccgacggccgcgtcctggcctgggtggacctgcgggtgggtgggtgattgggccagggctgtgtgtccgcggaggtcctgcgtggtggctgcggtgtggggcccttgatggggatggggaaccagaggtgcatgctgaggcgccaccttctcgagcagggggtgatnnnnnnnnnncgtggggcgtgtgatggggatggggagtcagaggtgcatgccgaggcgccaccttctcgagcagggggtgatcagacgccatgtggcacggagacggggagggcacccttgtggggtgcacagccatcccctccccctctgttggttggctctcccctgcacatccttcccttcttcgagcggccaggacaccccgcgcctgctgagagccacttcccctcccattccacccctgcatcagggcatcacggcccacatgnnnnnnnnnncccctcagggatctgttggtttgcctccccccgcacatccttcccttcttcattcggccaggacaccctgcgcatgctgagagccatttcccctcccatgcaaccccctgcatcagggcatcacggcccacatggcgggctcgctgagcgccgaggagcgcaagggcccgcggctggacgtgctgaatggcgtcgcatgggacgcgcaggggcggcgcctgtttgtcactggcaagcgctggccccgcttgtaccgcatcgaattggtccccgtgccgccggagcatcggggctcattgctggccgacctgcgcgaggcctgcannnnnnnnnncctggacgtgctgaatggcgtcgcctgggacgcggaggggcggcgcctgtttgtcaccggcaagcgctggccccgcctgtaccgcatcgaactggtccccgtgccgccggagcatcggggcgcattgctggccgacctgcgcgaggcctgcatcgtagtcgacaccagcatctttggcgggcggcgctgagggggctgccttggtcacggggcgggggacccagacaccggagcttgggcgggtgtttgcaagaatcctgtgacctgtcctgcgctttcaatacattcgttaccaagcttgaccacccccccccccccaaggacgacgattgaacctgaagcttacactgagacccagtatgcacattctccatgcacacacaatgcaaggctcgagnnnnnnnnnngagaatcctgtgccctgtcctgcgctttcaatgcattggttaccaagctttgccccccccctccccccccaatgacgacaattgaacctgaagcttacactgagacccagcatgcacactctccatgcacacacaatgcaaggctcgagcgccatgccaccctcacatgctccacgatcttcacgtgtacttcttgcggatgagggcggccaggtcgcgcatgcgcgcgatcacctccggctgcatcatggccgccgcctggctggccagactggaggggttgctgtccccgacatgcacgccctgggtggccttgtcaaacagggccagcacgttggcgatggcattcagcagtgcgccgggggtggtgctcagcatgtccaccccgctctgcaccagggtggcgcctgaagagggaggaaaggggggattagtgtgaggagttgggggtgaagagactagaggctggacgggagagccatccgcgatgcgttcaaggcgaaggctcagtccgaccttnnnnnnnnnnaaggagttgggggtgaagaggctagagcctggacgggagagccatcagcgacgcgttcaaggcgaaggctcagtccgaccttccctcccccctcaaagaaaggtgcctgatcaatcccgcacaaggcaagcacccagcagtcagcccacctggctggaaggcctggtcgagcaggaccgctcggtccgaggggctgtccaccgacagcagatgcttcaggatgcggacctccacgggcgcctgcgccgcgaacgactccttggctttgaagtacaggtgggccatcacgtccttgacctgaggcgacgggatttggaatgggcacgtggcagaggggccacggcgaaggagtggatgtacaggtgctggcccccagtgcggcaggaccaagttcggcccgcgtacgcctggcagcacccgccgaaggcacagcgcggctgcagccctggcaaccgcacccacggcaccactggtcgcggcaacctccgagcatactcagaaaatctttgggagacacccactcagggaagaagcaaccccacgcacctcctcgcgcgtgtatnnnnnnnnnnaagtgtgtgggacaaggggtggcggcccgggtaacaaagggtgggggggcctctggagtcaggccgtccaaataccatcnnnnnnnnnngccccagcgcggcaggaccgaggtcggcccgcgtacgcctggcagcaccagccaaaggcacagcacggctgcagccctggccaccgcacccacggcaccactggtcgcggcaacccccgagcatactcagaaaattgttgggagacgcccactcaggggaaaatgcaaccccacgcacctcctcgcgcgtgtattcgctctccttgacgccgttgtaggcacggccgagggtgaggaggagggcggggtccaaccgccccgaggccgccaggctgtcgatcttggcgtcggcctcctccatgctgccgacggagaggagctccgccaggctggcgcgcgccgcgcccagcgctgactcatcagacagcacgctgtcgtgggccgtgaccagggccgccaggttggtcgacagcgtggcgagcgcctcctgctcctgcttggccgccgccgcgtcctcccaggcccccgccgccctgagtgtgtggggcaaggggtggcggcacgggtgacaacgggtggggggccctctggagtcaggccgtccaaataccatcccccagctccggcatgttgcgacgctccccaggcgctgagggatggtgaacacacccacgggtggcccgaactatcgaggccgaccccgcgtccagccatcccaaacacataaccattaccccccaagattgccgcggctcacatgtacatcagctccaggnnnnnnnnnnctgcgacgctccccaggcgctgagggatggcgaacacacccacgggtggcccaaaccatcgaggccggcccccgcgtccagccatcccaaacacatgcccattcccccccaagatcgccgcggctcacatgtacatcagctccaggtgcgagaagaactccatggtcagcgtgggccgatgcgtggttaccatgctctcccactcgcccggcggctgtttccggaaggcctccgccaggctcacgtactgctccagctcctcgtgcacagcgcgcagacggcgggagagcttgcgcagcgtcgctgcctcctccaccgcgtcgcgcgccgaggcggcgtcggcgcgcatgtcgagcctgcaagggcatggtgcggggnnnnnnnnnnctaaccccaaccatgcaccccaggagggcgctgctgcgccgccatccacaccgccgccgaannnnnnnnnnggtccgtgggcgatgccaagggggatgcagcccagtcccatacgtcgagcggccgccgcatggccaccccggatcccgtcttccacgtgcccccaaccatgcaccccaggagggcgttgctgcgccgccatccacaccgccgccgaattcctgcctgccctcttggatgtcagcaggccaggttgccccggatactatccctggctcccacctcttcaggatgccgtcggccatcccccgccactgcttgctgtaggcgatcagcttccgccaagcgcttggtttcttgtccgcaaacacctcgatgaccttgtcatagacctcgttgttgctctgcaccgcctccgcacggagggactgtgacttgtgccccggggcaggctccattgtcgaggagctctcatgcgcagaggcaaaggtgccatgcttctgccgggaggggcagggnnnnnnnnnnggccctggggcaggctccactgtcgaggagctctcatgcgcagaggcaagggtgccatgcttctgccgggaggggcagggcctgcgagctgtggagcggtgagaagcaggctgatgcagcctgaagtgttggcacaaagtatgtcatgcatcattctccctgtcctccagccatcgtacatcgtgggtgagagatgcaaacagaaccaaatgccttataggctctgaaacttgcgttgcatggcgcacaccatggagggctgagcgacacggccggagccatcgcgcaggcaggatcctcggatacaattcagactacacactcggcgtcgttgcatgcagggatttcatgggtgtacaccaaatgtgcgtaattttcacgtatggcaaaatatactaccttgtctggttgtacgctcgacagttttggcctcgggagcgattcacgttctgaagggaattatcgtcgcgccctgccatcgtcggggtcctccacgcgccgcagtaccctcctcgtacggcaccagacgttcaaccccaggcccacccagagatcgacttcgatgcccagatgatccgtgcacattaatagacccctgatcatccatccccgccggcatacgaggactcgggtcgcggcaggatgaccaccgaggagcccatctccgttcccgaggcggttgcggtggagccgaccgccacggcgcccaagaaaaggctgaagcagcccagccgccctgatgaggctgagtacaagtcgcagacggaggccctccagcagagcagtgcgtggggctggcacggaggggggaaaggcgaaggcgtgccagctgccccttaacgtggatacttgagcatgtgggctgacgggttcccacatccccactctggctccccgcagtcgtcgcacacaagaagcgcgccgcggagctgctggatctcatgcaggcacaccgggagggcagggggaaggacactggggagctgcaggaggtgaagacgaagctggccgagctgcgcgccaagttcaacgccctcatggtgagcagcggcgagggtgatgtcagtgggacggggggtgcaactggctggcgagtggcgtgcacaggaccgccagacctcgtgaatattggcctgggaccacgccgagcatcgtgccgggcgccnnnnnnnnnntgtggggtgcaactggctggcgagtggcatgcacaggaccgccagacctccttcgtgaatattggcccgggaccacgccgagcatcgtgccgggcgcccagccaaccgagcttcgtgccgggcgcctagccaaccgcctctctgctgggcccaggcttctgagttgcctcccctccacattcccccgtgtaagcggctctcctcccctttcccccccccgacatgcatccctcgcttcccccaccgttgcgcaggcccagcggcgcgaggtgcgcacccagctggaaagcgtgaccaagtcgcgcgacagcgtgcgcaccggcctgcgcgacctgcgcagcaacctgaagttcaccagtgtggaggccatcgacgcacaggtggcggctctggagcaccgccaggcccacgccacgctttccctggcggaggagaagcggctgctggaggacatccgcgcgctgaacaagtcgcgcgccacggtggcggagctgaccgcgggcatgggccggctggaggcggacgactcctcccgcacctccctccaggacgggctgcgggggctgggcgacgcgctgaccgcgctgcgcgccgaggaggacgggctgaaggcgcgcctggcggagctgcaggcggaggccgcggccaagggcgcgacctacccggactggaagaacgaggtggcgcagtgccgcgaggtgtgcaagcaggcctacgagaagatcaaggagctgcgcgcggagaacgacgagcgctgggcggcgtacaaggtggccaacgcggaatggcgcgagcaggacgccgcggagcgcaagcgcaagtacgaggagcgccagcgcgagcgtgaggcgcgggacgcggagtgggccgcccgcgccctggagaaccagccggagccatacgaccgcgaggtgcg

SEQ ID NO: 38552 - DNA, 94 bp, Chlorella protothecoides
aattcaatacttatgtgcacccgatagcgctgttcgacgaacagctttcgcaccagggtgatgccccccggttcggccagggaggaggcccccc

SEQ ID NO: 38553 - DNA, 61 bp, Chlorella protothecoides
agcggccaccatcacatacgatagcaggggggcctctcctggcaggaatgcagcggtcaac

SEQ ID NO: 38554 - DNA, 137 bp, Chlorella protothecoides
gccccagctcaccgtctgtcagcaccttgatgccctctgcacacagattgaagagagggtgagcatgtcaccagcctgcgcccgctcaggcagggggcacgcgccgcctgctgcagcaccccagcccccagtcctcg

SEQ ID NO: 38555 - DNA, 66 bp, Chlorella protothecoides
ttctttgcctcctctatgctgtgatgcatgaggagagcggggcaatgccggccgccgatggtgcac

SEQ ID NO: 38556 - DNA, 173 bp, Chlorella protothecoides
ccgccgcgacggacccgtcaaggcgagcacctgagtgtgcttgaaggggagatgcatggtagggtgaggctggccttggccagcaaataatccccttctgactgactttattaactcaccccccacaggtgacggagggtctagaggagctggggctgaccgagcagccggag

SEQ ID NO: 38557 - DNA, 219 bp, Chlorella protothecoides
gtgaggggcccggggtcgcggcgcgcggcggcccccgccgccgtgcccgccctggctctcgccaaggccctgcctgtggtcggcagggttgccggggatggcaacccgggaccaggaacggacgctgctgcggagcagctgcggcggcccctgaccatgccgcgcctggcgctgggcaagagctgccactccacgctggctgggcgggaggcggcggcg

SEQ ID NO: 38558 - DNA, 79 bp, Chlorella protothecoides
gacaaaggcgccgttcttggcggcacccacgtccccgccctccggcacaggcagcgcctgcttgaaggcctggaccagg

SEQ ID NO: 38559 - DNA, 61 bp, Chlorella protothecoides
caattgcccacgcccacgacggtagtcatgacggggggcgcgcggaactgctccgccagcc

SEQ ID NO: 38560 - DNA, 90 bp, Chlorella protothecoides
caggaggccggcggcggcaccgctggcgccatctgccagcccctccccctggacgatcaagtccagggagaggggctttgtggggctgct

SEQ ID NO: 38561 - DNA, 61 bp, Chlorella protothecoides
gcacgccatccttcccccaaagcgagtcagtgcatcatgcagcgcaggctgctcatccggg

SEQ ID NO: 38562 - DNA, 106 bp, Chlorella protothecoides
cccacagcatcccccaccgcctgcacctccgtcgccgccgcccgccccgatgggctggccggcgctgggtcctcaagcggcgacgggctcgcgctcgcgcacctcg

SEQ ID NO: 38563 - DNA, 77 bp, Chlorella protothecoides
gacagtccaggccctcaatgccagggaatgcacactctgtggtgcccctgtcacatcgcatcggctggagggcgagg

SEQ ID NO: 38564 - DNA, 61 bp, Chlorella protothecoides
gggccctgagcctgacctggaagccacgcagggggttgtacactgccagagcccactcgcc

SEQ ID NO: 38565 - DNA, 4869 bp, Chlorella protothecoides
  modified_base (180)..(189): a, c, t, g, unknown or other
  modified_base (488)..(497): a, c, t, g, unknown or other
  modified_base (669)..(678): a, c, t, g, unknown or other
  modified_base (1559)..(1568): a, c, t, g, unknown or other
  modified_base (1654)..(1663): a, c, t, g, unknown or other
  modified_base (1825)..(1834): a, c, t, g, unknown or other
  modified_base (2077)..(2086): a, c, t, g, unknown or other
  modified_base (2925)..(2934): a, c, t, g, unknown or other
  modified_base (3412)..(3475): a, c, t, g, unknown or other
cggggcggcagggggcggggcggggggctgggaggaaaggggggagggcttgcctttgccagcgtgaagaacggtgtcttgctgccgccgggaagcatccctacgccggtgatcttggagacggtggtggcctcagcgggggtcagcatctcctgccagacgagcgtcctggaggtcatnnnnnnnnnnttacctttgccagcgcgaagagcggcgtcttgctgccgccgggaagcacccctacgccggtgatcttggagacggcgatggcctcagcgggggtcagcagctcctgccagacgagcgtcctggaggtcatgaccttggtgaaggtgtacatgacctgggaaaggtgattgtatacggtgatgaccactgagtccatgttggtgctggtccggtccacactcagggtgagagtggtgcctgagataaagtaagtcccggacggggttgttgcaggcggaggcgtcaaagaggaagggggnnnnnnnnnnagtgcctgagacgaagtaggccccggacggggttgctgcaggcggaggcgtcaaagaggaagggggagggttgggatggccacggcggggagggagcacacttttaggagggggagaggtcttggtagagggtggaggtgaggaatttttgtggggtggaggagaggtcttnnnnnnnnnnacacggcggggagggggcacacttgtaggagggggagacatcttggtagagggtggaggtggggaatttttgtggggtggaggagaggtcttagtgggggaagggggtgggaccttcttgtgggttggaggaggggtcttggtaggggaggagggcgggagtgtcttcgttggggtgggaggaggggttgtcttggaaggggaggggggcggaagtgtcgtcgtgggggtgggaggaggggttgtcttgggtgggggagggggaggtcttgttgtagacggaacaggcggagaagctgttttaggggagggaggaggacgggccaccggctcgatgacctcggccacggagttggtggtcttgccagtggagggatcggtgtaggaggcctgtgctgtgccgctggcagtggtggacgacaggatccaggtgcccacagtggttgtggacttgggcgtcagtatcactgtacgcctgctcccatccttgaacttcagcatcaccttaagctgggacagtaccctggcagtggtgacgctgacggtgcaggagacagtggcaggggtcttggtgacgcagtctgcatagtcgatgctcaaaagggcggtgggcgagggaggaggggaatgcttcttgggcgagggagggggaggtcttgttgtagacggaacaggcggagaaactgttttgggggagggaggaggaggggctgccggctcgatgacctcagccacggagttggtggtcttgccagtggagggatcggtgtaggaggcctgtgctgtgccactggcagtggtggtcgacaggatccaggtgcccacagtggttatggacttgggcgtcagtgtcactgtacgcctgctcccatccttgaactnnnnnnnnnncggtgaggtcctgggacgggggccgggaggcatcttcaccactatggtgtctgcagtactgattgccgagagcttgcactgccgcnnnnnnnnnntggtgaggtcctgggacggggactgggaggcatcttcatcaccatggtgtctgaggtactgattgccgagagcttgcactgccgcttgtggccttgcaggtcattgcagatgttgaaatccccctgattccggctgccaatgttcctgttgccaaagttctnnnnnnnnnnattgcctgtgtcatcaagggtaaggactgatggctggctggctgaaggaatgacatgctgttctggcaagtgtctcgcgctccctacctgctgccagagttaggctcgaggaccctgtcgttcctccacaagcggcaacccatagtaaatcagcatgtacaggctcatccacaacccgtgcagccatgcagcacaactaacaccactcaccgatgttcttatctcctatgtttccggatccannnnnnnnnntgtgcagctatgcagcacaactaacaccactcacctatgttcttatctcctatgtttccggatccaaaattgtaccagccgatgtttccggcgccaatgttcccctgcccgtctgccttgcaggcggtctgccccttgcgcaggtactccacggccaccagtgcctggcacgaagaggcagtgcaggttcccagagtcgtcaggctcacggcgggggcatgcagccgtgtgaactcgatggtggcggtgcgaatcgatccggccttgtgaaaaccatgcttcgtgtggttgggtaggtgtgagagtgcgactcccccagctggagaaagctggagtcttcttcagggtgaatgagagatgctaaagcaatttttactcccacttacttgcagaacaggtcgctgctactaggtttgagcaagtatagggtgctctcagacctgcggggaggagtatggtgtggggaaggaggcacatgtggcatattcatagattccgcaaatacatatccgcatccgggttcgggacctccttccggtcgcaatggcgaggccgagaaggctccgccgatgaatggcgatcgcagtgagacttgctggggatgaaaaatcccaccttgcactcgggagggcaaaaattcttgtttcgcaacctgcctgcgtgtaggggcgcatggaagtgcaacgtttccgttcggtgcgccaggctccataacgcaacatgtgcactctaccaagtaattaaacccgtaccgctgttcctagagctgcgcaagtgcagaggatggagagcaagagacgaaggtgtaagcgccacatgtccaaggagtcaggccttgnnnnnnnnnngtgtgcactctaccaagcatttaaacccgtatcgctgttcttagagctgcgcaagtgcagaggatggagatcaagagacgaaagtgtgagcgccacatgtccaaggagtcaggccttgcactcttagttgtagggtctaggggccccaatgcgatgtgagactagatacacttctcgtcttggctcaggtgataatttggaaattaagaccttgaatgagtgggttttgcttatggaggccatttccttggaagaccgcttgctcgccctcctgtggacgagccgctgcagagggcccggttaccagggactattgagtgcttccagtggcgccggggttcacacaacgatctcggtcattttggccaggtcatacatgtatcctcttctctcctgtacgcatcgcatttttattgcttgacattaatggagtacatggtgtaactttgtagtgcggaagcacttccgcaacatcttnnnnnnnnnnnnnnnnnnnnnnnnnnnnnnnnnnnnnnnnnnnnnnnnnnnnnnnnnnnnnnnngtctgacatgtgcatgcgtacctaggtgaaattccttttaaaaaggcctcctcaccctgactttgccctcgcgtcgtcctccggaccgactcgccctggagggcaatccgtccggaaacaggcaggacgtccaccgagttgcggcacgcatcgccagcgcagcgcctcagagatgtagacagccaaacataccgaggtttggcacttgcatgctttaagctcatattgtgcatggatgggatatttgtgccaagtttctgcgccctcttcaagccagataagagttccatgtcttccaacgagtccatgtgaccctctggggatttgaaaatgatatcgagagcatgcgattgagtaaaagccagcagtggtatgcatgagatcgtttagaacacgatcaagttccaagttttgggtggaggctggaggcgatggttgtctctgccatcgacctgcacacccccttcattccagagaggacctcctattgtgttcgaacctgacgcaaagcatgcccgaggacttggtaaagctatagaaggagagtagccgagggaggagcagcatatgctccggcagagctcatctgtctccagataaccatgccacataagtttctgaatccctctggccttcagtatcactacagtgcgcgtatccaaacctagtcaaagacaaaccactgggaatcgtccatgaggcagcatgcaggagagatgaaggcattttcagcagcaattatcacggggtaaaaggtggcaagcacgtagagtgccccatggcctggaccgctgtggctctggctaaccagagaccggccgagtggctggaagtggggcccccttggcaaaccttcccacgacgccctaccgcatgagggctggcccaacagccactcccttgtgttgttgaaagccgcttgatacttcattgggaacagtctcctcatccgttgggcaatgcaatggcatccgatgtccgtgattagacatacgatgggcaaaagtcctgggtataaaaggggatgccttcacggcgctgtgtggcaggtggcaggcagcatgacctcctcgccacactctggatgtgcccagcagcgacatcgagcacctctgcagaaggcactgccgcaaggctgttgcggagctggcatgatcgttgctgagctggatgccgcgattgattgggggagggtgtatgcactttcgccccgccccaattgccctgatgggggaagtgaggactgccggtgcaagcagcccgagccggtggtggctggggtcgcgagtggcggtgtgtattggggcgcgtcaatggggagcctggggtgctgagccgggctacttcccctcccagggcgacggcgggggagaagggggcgggggagggggtgg

SEQ ID NO: 38566 - DNA, 61 bp, Chlorella protothecoides
gccgtggactgtgcacatgagtggtggctacaacctcattcctgtgtgtggagacccgacc

SEQ ID NO: 38567 - DNA, 127 bp, Chlorella protothecoides
ccttccctgtgagaatagcaaagccccgccttccacacctgccccgctcacctgccccatgctggccctgcgcgaggtgatgctcaggcggcgctgccccgccagggagctgcgccgcgtgtccagt

SEQ ID NO: 38568 - DNA, 67 bp, Chlorella protothecoides
accatgggcacgaccatgcgcacaaccatgcgcacaaccatgggcacaagcatgcccatggtcatgc

SEQ ID NO: 38569 - DNA, 90 bp, Chlorella protothecoides
tcccgatccatgatcgctgaagggctagagaccggagttctagcatggccgcatcgactacattctgaattggggtcgatggtctccacg

SEQ ID NO: 38570 - DNA, 174 bp, Chlorella protothecoides
cctttgcccctcccgctccccgccttcaaggcctgcgtcctgggaagcctccaagcggtggcctccgcggcgcagctggcaggctcgctcggggccgccctgcatggggccgtcgcgagtgaaggagttcggtcgtgcctggcggcgcggcaggacctgagcgtcgtgcacgag

SEQ ID NO: 38571 - DNA, 115 bp, Chlorella protothecoides
cccgcacggtctgttggcggccagcgggggccagtacccggcgggctcgccccgtgacccaggtttatggagtggggggaccggatggcagggggttttggctggcttgtgtggg

SEQ ID NO: 38572 - DNA, 77 bp, Chlorella protothecoides
tgcagccggtcccatcgccggcggttcccttaggaactgctgtgcaatttgggttaaaactccggggggtggggaca

SEQ ID NO: 38573 - DNA, 91 bp, Chlorella protothecoides
gccatgaggtgagccggtgtggggtggaggcaggtacagggctgaggggttggttgctgattcggtgagagtgccaggactgcctcttcct

SEQ ID NO: 38574 - DNA, 68 bp, Chlorella protothecoides
cctatttgttgggtagaggagagggtgcacatacatgttgtgtgtgtgtgtttctgggatagaatgca

SEQ ID NO: 38575 - DNA, 106 bp, Chlorella protothecoides
acagcacgagagtgaatgcagcctgctttctggggcacagctcctctggccatgcaccatccgaagttgtagcccgggccgtcacgttgccttggtctcctggcgg

SEQ ID NO: 38576 - DNA, 65 bp, Chlorella protothecoides
atcgcggtggggccctccccggccgacatagtataggcgttgctgtggctgtgtgcgaggtgggg

SEQ ID NO: 38577 - DNA, 75 bp, Chlorella protothecoides
tgtacatcactgttgtcctgacgcgagtcacaatcagaagagtgtgtgtgtgtgttgtgggggggaggggggggg

SEQ ID NO: 38578 - DNA, 61 bp, Chlorella protothecoides
gctgtgacgatgatggggcagtgggagggggatgagcatcacagcgcaggggtgaaggtat

SEQ ID NO: 38579 - DNA, 96 bp, Chlorella protothecoides
tcaccacatatctgcagggggccaagggggttgggacgaggtgttgaccccgggtttcatgcatagggtctgcccacagtggcccaggcaggcacg

SEQ ID NO: 38580 - DNA, 80 bp, Chlorella protothecoides
ccctggtcaccttcagcgcgcccacctggggatattatttgagcttgtatttgagtttaaggacactcacctggctttcg

SEQ ID NO: 38581 - DNA, 62 bp, Chlorella protothecoides
cgggtgctgcggaccctggtgaggggagggattggatttggctggacggcggaggggtgttg

SEQ ID NO: 38582 - DNA, 73 bp, Chlorella protothecoides
gaaggagtaacgggggaacccctcctctgcaaagactctgcatggcggcatggaagctgcccgctgctggtcc

SEQ ID NO: 38583 - DNA, 94 bp, Chlorella protothecoides
ccctgaggtggacctctttgagatgaggtgaggtgctgcagcaagtgtgggagggggggaagttgaaggggccccctgagctcgccgagtgctg

SEQ ID NO: 38584 - DNA, 78 bp, Chlorella protothecoides
cttggttgcgctcccgcgatcgcaatgttttgagttgtgctgtccgtttgtatctcttgttgtcacacgcacaagagc

SEQ ID NO: 38585 - DNA, 124 bp, Chlorella protothecoides
cacaaccggggccgtgcccgacagcccccttcccctcccatgcaccaaccccctctcacacccaccacacaccagctggcaagcgtgaaggaggcccaagaagacgagtacggctggctcaacg

SEQ ID NO: 38586 - DNA, 67 bp, Chlorella protothecoides
aacgaattgcctttctgactcgagttctgtcttattaatcatgaccggaatttggagtcaatcgtgc

SEQ ID NO: 38587 - DNA, 114 bp, Chlorella protothecoides
ccgctttcgaaaaatgcccgatctgcaaattacgcgcgcgtactcattgtgtggggtgctgcacctgggggaagccgtgctatgtggctggagtcatggtcaaaacatatctgt

SEQ ID NO: 38588 - DNA, 61 bp, Chlorella protothecoides
catgcgccttaggtatctggagtggggcagaggcggggacgagaccgtcctcatgttgcac

SEQ ID NO: 38589 - DNA, 61 bp, Chlorella protothecoides
cccagccccaggccctcggtcttcttggtcaacccctcaacgccggccacctggcccgtct

SEQ ID NO: 38590 - DNA, 16856 bp, Chlorella protothecoides
  modified_base (507)..(516): a, c, t, g, unknown or other
  modified_base (697)..(706): a, c, t, g, unknown or other
  modified_base (864)..(873): a, c, t, g, unknown or other
  modified_base (2327)..(2336): a, c, t, g, unknown or other
  modified_base (3182)..(3217): a, c, t, g, unknown or other
  modified_base (3362)..(3371): a, c, t, g, unknown or other
  modified_base (4568)..(4577): a, c, t, g, unknown or other
  modified_base (4895)..(4904): a, c, t, g, unknown or other
  modified_base (6601)..(6610): a, c, t, g, unknown or other
  modified_base (7362)..(7371): a, c, t, g, unknown or other
  modified_base (8462)..(8513): a, c, t, g, unknown or other
  modified_base (8862)..(8871): a, c, t, g, unknown or other
  modified_base (9274)..(9283): a, c, t, g, unknown or other
  modified_base (9482)..(9491): a, c, t, g, unknown or other
  modified_base (9917)..(9926): a, c, t, g, unknown or other
  modified_base (10267)..(10276): a, c, t, g, unknown or other
  modified_base (10346)..(10355): a, c, t, g, unknown or other
  modified_base (10484)..(10493): a, c, t, g, unknown or other
  modified_base (10545)..(10672): a, c, t, g, unknown or other
  modified_base (11076)..(11085): a, c, t, g, unknown or other
  modified_base (12159)..(12168): a, c, t, g, unknown or other
  modified_base (13318)..(13392): a, c, t, g, unknown or other
  modified_base (13500)..(13509): a, c, t, g, unknown or other
  modified_base (13617)..(13626): a, c, t, g, unknown or other
  modified_base (13804)..(13881): a, c, t, g, unknown or other
  modified_base (15061)..(15196): a, c, t, g, unknown or other
  modified_base (15582)..(15591): a, c, t, g, unknown or other
  modified_base (15689)..(15698): a, c, t, g, unknown or other
  modified_base (16555)..(16641): a, c, t, g, unknown or other
aggagggtggagcgcggaagggaggcacccaaccgtggcggccccccccccgccctgccatcagataccttcacggatcacctccatgttgccaactgcagacagtggcaaggcccgggcgctggtggattgcttcgcggacctgatggacctgaggcgggacaggagccgcttgcacgcctacttcagggccgccaaggagagtgtactgagcagagtgtgtggcggcgagcgccacagcgctggccacacgcgagagggagggttgctcctgaaggcggaggaggcggagtgcaaagaggtggaggaagaggggtgcgaagaggcggaggaggcggagtgcaaagagactgaggaagaggagggcggagcggcggcttgccaggcagcagacatccgagtgcaggtagcgcatcagagtttccatggagccggagcacatgctcagggttgcgcgcctgtgaggaccgaggaatttgcgccagcgagcctccacctcatcaaggnnnnnnnnnnatgccggagcacatgctcagggttgcgcgactgtgagggccgaggaacttgcgccagcgagcctccacctcatcaaggttgaacacattgcgctgtcaacctccacgatcaccaagggtgaggaagccgaaccgtcaaccccccacgtcgtcaagagggagcaacccaagtcacctacctnnnnnnnnnnaatcaccaagggtgaggaagccaaaccgtcaaccccccacaccatcaagagggagcaacccaagtcacctaccttccatctcgtcaagggagaaacccctgcgccatcgagccccatggctgttgaccctggagggtcgcagtccgccacagactggnnnnnnnnnntagaaacccctgcgccatcaagccccatggctgctgagcctggagggtcgcagtccgccacagactgggaggatggctcgcctggcggccacacaccttgctcaaagatgtcgacgaagccccctgcttgtgtggatctcgccaacattgacgtcggggagcaggcacgcattctggcggacatcctggcgcagagggcgggtactgggaagaggaaggcagccgccgctgcctccctggtccagggcagcctgaagaggctgtggggaggcggaaagggtgtgaatctcgaagtcagcccggctgcgaccccctgcatgcgcgtcggggccgacctgcaggccacatgactctgaccgtgtgggttgttgatatcgtgacagtagtgaagctgttcctggcattgtgccatgttccatgttccggtgtaccataatggttatgttatccacatgccaaaagcgatcaagtatcaagttctgctttgcgagacattcagcggcggcattgcagcaataaagaaaagaaagcaggggggtagagccgcgatttcactttcagtggtccgtcataggcgtgcggcgcccgtggtatcgaaaagctgacctttgacggcgcggtccctaaccacaagaacgctgtgggtgtacccaagcctttctgacaccccccccaccctcctctcctcatgtccagggataaaaattggggaggaggagggtgcccagcacggtgaaggccagcgcccagccccagagcacaagcgcggggcgcctgccctgtttgatccaggcggccgcgtaccagtacaggggcgggcagctggagaggaagcgcgtcgccacgttcacgtgcatggcggtggcggccacggccgtcatcagcgcccagtggtagatgtagggggccagggcgggggcctctggcggccaggcgcagggctgcgccacgcccgcacccagcgtgtggaaggccgcgcccacaccgccgcggcgggagggcggcgggccgggggcccagcgcgcggggcgccgcagcggccccgcccccgaccccgtccgagccagcggactgagcggcctggccggggcgcggcacgccatgcccagcgatagcgcgcaggcccagtccgcgcaggcccaggtccagcagccggcgaaggaaagtgcggcgacggggatggactggagtaccttgggccactgtggtgtgttcatgaggggggttgggacgggggggtgttggtagggctttgaagggaggaaggcaggcgggggttgcatgcgtgaagaaagatgcagaagagagaaggcggacagggaatggctgggtaggtttagtactggtgccctgctgaggtacaggggtaggagcaagcacgaaagggttgaggcactgaggggcgtctcactgccacgcaagcacaggccgccgcctgcctctcgccggtgccnnnnnnnnnngagcacggaagggttgaggcactgagggggcgtctcactgccacgcaaggacaggccgccgcctgcctctcgccggtgcctcacccgatccagcttggagtagaagcgcaggaaacccacgtcccagtactgccgctggacatagccatacaggcttggcaatgtgctctgacaccagggcgggggctggagtgctgcatccctacccacgccgcagtaggtcaagtaaccccgcactgcacatgcgtgtgaggtggaaagagggcaggggtttataaattccagggtggaggactagatttgaaggttggccccaggtcatacagaagcggctccatgccggctggcctggcaactgcaagccagccccagccccaactcctccgcgtcatgccttgcatgagggcgtagggcgcgcagatggtgaggcacccgatccaacatcgcaggacgccggtccacgacaccctgccggtccggaaggtgctagaaagtagcgcgtgcatcaagaaccagcacccgaggatgcctgcagcatgttccagggggtggaggacgggtgaggcacaggctgagccatggcaagtggccagggagtcagggtgactgcctggcacaggagctgaggagcaatcactgtggcaaagacacaggtctggtccccaggccccaccccctccccttgctcccacgccaggaggctcaccattggagcgagccatggctgccagcgtgaaggcggccaccgctgtccagggatttgtgtacacgaggagcatgccccagaaggtgaaggcagcgaagaggctctctgtgtaggccgcagagtagaacacagaggctggnnnnnnnnnnnnnnnnnnnnnnnnnnnnnnnnnnnngcccacctctcatcccccagcacttgcacagacagcctgcagagtgttttgtgtgtgagaggggggtgggggtggagcatgggtaggtgtagagtgggggggccgaggaacgttccatcccagaaacttgattgctccagagacnnnnnnnnnntgagaggggggtgggggtggagatggataggtgtagagtgggggggccgaggaacgtaccatcccagaaacttgattgctccagagaccgtcaccggtgagcacatccaccacacattgctatggactctgatgactttgtctccttcccccgccccgctctctgcgcatgcacacacctccacagggcaagggcggccgcggagaaggcggcgatgttgatcagcaggccagccagtgtcaggagagattccaacggcatgaggccgtgcaggggtactacgttgatggtggagatcaattgtaagtaacatgatgggctgtagccagggctcattgccccttcgtggaatccctgagctttgctttcacaactccccaccacaaacccccacacactgaccaccccccggcacaccccgtccccttcccaccactcacagaggaaggcactacccaatcgcatgaccaagggcagcagcggaaagaaagcattgatcatgtcggtttcataaccacactttgccacccggacaaagaacaccgagtcccaggccgacacatcatcaaagatggttgtgtgggcactgcctgtgtgatgaggaaggacaccaatgtgcttgcaggagagggggtgctgcattgttcgacatggtacaaagcggtcctctacatgtagataacagtcaccaaccctacagtcccctcatcctactcaccactggctaggcaggaggtccctgtgccggaacactgccgatcacagggtcgattctgctgggatgcagaagtatctagatcaacaaatgctgcatcggagagaacaatgccgaccaagaccagggctcgggagagggcagccaggccaagcagcttggttgttttgctcgccatggaagtcacaggagccgtgcgacggcatcagaatctccgcattggcttggcagagcataaattctggctttaactgacacgaatgtattccagcaagcatcctaaaggttctgagatgccggagtgcttagctgctcttccgacatgagccagggcgcgagggtgtggcttggccacgtgagccctccacccctctccaccgcccgggagtcgcgcctggttttcattacggcccgcgaatgggccagaggaaggaggtgcctacgcgactttacattgaggacttgatcgcttttgtttcaannnnnnnnnnatacggcccacgaatgggccagaggaaggaggtgtctacgcgatttcacattgaggacttgatcgcttttgtttcaatacaaggaagcaggactcatcgctcccctcgtcgctgaatcttttgggaccttcccaatacctgcccgttggggttgacactcacgcaggcgcgcaccgcggaccgagggggtactgctgctttcagtcgtcgtcccctctcaagtgtcatcgacgttgtgtgttgtttcaaggaggtttcctcccggccccgcacccctttgccgacgtcttgttggaacatctgtcctcccggcccgcnnnnnnnnnntaagaaggtttcctcctggccgcgcacccctttgccgacgccttgttggaacatctgtcctcccggcccgcccaccctgggaggccctcaccccacgccatggggcacctgctatagacctgccccctgtcatctgaatacgtgcctctgagtgggccgcacaccgcgcctccgccacactggctggctggactggggccgggccgcgcccgggcgggcaggcgaggcgtccccacgacctcaagaaggctttccccgcccggagcccggcatggcgcggccgcaggcgtcgacgagtgaccgtggcccaagtcgcggtggggttcacctgcctgatagcggccatgcacctcctgggcccctccctggggacgggcctcctgggggcccggccctcccccgccagccgctccgcggacctggccaggctgctgagcctgagcggggacttggagcctgaggagggcgtgccgcgcgtcccggcaatgcccagcgcccccaagctcatcccccgcatcctgcaccagacctacaagagcgcggacgtgccgcagtcggcgcggcgcctcatgctcagctggcgcacgctgcacccgggctgggacatccgcttctacgacgaccaggtggggaatcgagcaaggagggtgtgagggcggtggcatccagtgctgctcgctgcgtgcctacctttccccagccctggtgcttcgagccctgcgctttgcttcccgttctgtgttcccttcagagtaccccttcacatccttctccacaaaaccccccacaggactgcctggactttgttcggcgcgagttccccgagtacctggccgcctaccggagtctagagcgcgacgtccagcgctccgacttcttccgctacatggtggtgctgcgcctgggcggcgtctacgctgacatcgacaccgaggcgcggcagcccctggacggcctgctcgcctcctccgacactctggtggtgggctgggagagcgacttccccgacgcccaggccaccgtggacgcgtggtacgtgcgcccgcgtcaggtgctgcagtgggtgtttgccgcggcccctggccacccagcgctgcgcgccgcctgcgaccgcatcgcggcgggggtcgccacccgccactccctctcccctgccatcgacacgctggagcgcaccggccccggcctcttcaccgacgtggtgctggaggcggccgcgggctcgccctgggccggcgcggcgcgcgacccctggaccgtgcgcatcctgccgcgcgtggcctttggcgcacccaaggcccccgcccacgggctgacgccgctcgaccccggcgtggtggtcctgcaccacttcatgggcagctggcgctcgcgccgacgctggccctggcaggtgtcggcgggggaggtggcgcgtgccctggcccgccgcttcctggcccgccccggcgacgcggagtgagcatgggaagggggagggggcgaatgctcgccggtgggggggtgcgaaacaaacggggtcctggtctgggtggcgcgtctgtccaacagaccccgacaaaaggcagtggccggcttgtgcgtggtcgtggcagtcggtgcgtcgatgggccccccaccacactgccccgccatcgccatcctttcctatcctctgtcccctgctggtcccccctccaactcaacccccccccccnnnnnnnnnntcgacaaaaggcagtggccggcttgtgcggggtcggggcagtcggtgcgtcaatgggccccccaccacactgccctgtcatcgccatcctttcctatcctctgtccctcgctggtcccccctccaaatcaccccccccgctccaacaaccactcctagagctgcagaggtgaggaagctggaggctgcagaccgcggcgccgagcagctgtaccccacctcgctcaccttcgacccgccctacgtggccctggccccgcgcggcggcctgggcgagtctcagtccggcgccgacgtggctgctgcgctggccgcgcacgggtcctggcagcccagcgtgcagcccctgcgcggacccacgctggccgaggtgctggtgggcagcctgggcggcgttggccagcgccgcggcacgctggttgacgtcggcgcaggctacggcgtggtcgcgctggcggccgccgcgcgcgggcacgcggtgcacgcctttgaggccgggccgcgcagcgccgccgcgctccgcgcctcgctggcctacaacggctttggcgaccgcgtcgcgctgcacgagaccgaggtgctgggcgccgtcgtgcaatccgcgcggctgtgcctggatgtcccggcggcggggggcgaggctggcggtgctaccggtgcgccgccgctgggcgaggcggcggtggagctggcgcgcgggtacggcccgcccgaggcttacagagcgcgggaggagccgggtgagtgccgccnnnnnnnnnnatgctaccggttcgtcgccgctgggcgaggcagcggtgcagctggcgcgcgggtatggcccgcccgaggcttacggagcgcgggaggagccgggtgagtgccgccgcccagcgcgccgcacgaccctggcccaggccctccccgcggggctgagcgtcgacgccctgcgcatctcaggtgagggcgagggtaggtgggtggggtaggtgggggaaacatgtgctgagctcgaaggaactgccggaggccactgtggaggtccagccggccagcccctggtccagctgggctcgcttatacgcacatgcaaccccctccctccctgtcatttcccccacccccccaaaaaacatgcagccaacggctgggaggcgcacatcctggagggcttcgcgccgctcctggccgcggcaccggcccccgtcatcgcgctggagtggaacccagccgcgctgcgccgcgcgggcacgcccgaccccgtcgccgccatcctgcgcccgctgcacgacgcgggttacacagaggcttcgcacagtggctacgtctgtgacgagcgctggtacgcggccacctacggcgtgcggcgccgcggcggggtcacgcccgaggagctggccgcgctgaggcagcccacctggtgccgcctgcacgtggaggactggggcgcgctgctggagcgcgcctcgccgcgcagccccgagacgctgctcttcgtcaatcgcgaggccggcgcagccaggcggcgcatgggaggcggcgctggtgatgcagcggcgagggctgggcacgcagaggcgacggggggtgacgagggggccaacgacgccgagccgggtgccctggcgcgcgctgccctcggcgcagccgcggcgaatgccggcggcgccgaggcggtggctgccgccggacacggcagccgcgcggcggtggagagtgtcggtggcgacactgctgcaaatgccgatgctgcagcagcgacggggaccgcccacgatgcccaggctacaatggaaactgccgacggtgccaaggcggcagcctccccctcgcctgcggtcggcacccagccggccgcagcaggagcggctccnnnnnnnnnnnnnnnnnnnnnnnnnnnnnnnnnnnnnnnnnnnnnnnnnnnncgcgacccagggccaggtccgatctgccaccggcgcgaccaacagcctcggaggcgccgctgagctggaaaacatggatgcagccgtgcatgccacggcggcggccgtggccgacctcgcggatgcgcaggtggccttgcacagcggcggcgatgccacacggtaacgcccggcacaggcgcggcctagcaaggtctcccctcccaccctggagggtgtacctctgcctcgccgggcgccggccgccccgcccagcatagtccaccttacgttccttcagcccacacaaaatgccccaaccatggcccactggtttccctccaaacctgccgggctcgccttttgccgnnnnnnnnnngcgctccttcagcccacacaaaatgccccaaccacggcccactggtttctctccaaacctgccgggctcgccttttgccgccttccaacccctcggcagagtccgcaaactggcaggggcctgatcgttgcatcaccgccgggcatcacccccatgtgtgccgccgagcgacacacaggctactggaagaccaatctgtaccttgcagctctttaggacacccttgcattcctcactcgcagccagcctgctttcatttggcagccgtgcacataattcccttttcaaaccgcctatacactcatagaggagcagggcttacatccatgcgcagccaagggaaggtgaaagacgggcgcagggcggggagaatcgcgacgctgcaaagaatgggagggtcagnnnnnnnnnngaacgtgagacaggcgcagggcggggagattcgcgacgctgcaaagaatgggagggtcagaattgtgtttcaagtgtgacacggacaaatcagcagcgacagggtagtctaaaaacagggggtgctcgcctccccagtgtacacgagctggtgaggcttctttggaagtcccacgctgggtgggccgcggcgacagtcnnnnnnnnnntagagtacacgagctggcgaggcttctttggaaatcccacgctgggtgggccgcggcgacagtctttaacacgtccaggatttcagtggtccacaacgaaggcccccgcggcgtggttgtcggccctctgtgcgccgagcttggggcccatgagccaggagaagggtttgctcagtgcgccggcccaggaggaaaggctgaagtccatctccacacacagcagctgccggtcggtctcaggctccctcacgctcaccaacatcgaatagtgaccctgcgtgcatgcaaggggatgttgagcatgtgtgaaattcagacttgatattacatgtgagctcaccattagtaacgggaaaccaggaaattagtcattgtctgaaggacagtctcagccagacgggcacactgcccggccagcagggagannnnnnnnnngatacatgtgagctcaccattaatcacgggaaaccaggaaattggtcattgtctgaagggcagtctcagcctgacgggcacactgcccggccagcagggagatatgccagatgtccatgcatgcattatgtggatcacgaatgcgcatgctttgatggcgctcagtcaacagatcccccgatcaattaccacccaccggaggcgcgatggcaggcatcttttctttcaggacaaagctgccactcccagctggcaaggggcactgcactgcggaacacaaatctccagacttgtgatacctgcattgatggtccagtgaactggtcaactgcttacgtccnnnnnnnnnntaggcctcgcattcgccctatacacagcggagcgagaccgccacacataataaaactgcgcaccactccnnnnnnnnnnctcggagtgacaagtgcatgtatgcacatgggtcgagcatttagggctggcatgaaccccagggctcgcattcgccctaaacacagcggagcgagactgccacacataataaaactgcgcaccactccnnnnnnnnnnatcggagtgacatgtgcatgcatgcacatgggtcgagcatttagggctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaactcacacatgaatgccgaggtacttgacggtgacatcgagaatgcctgcactgacctccatgccgctctcgtactttatcatgaaagcagcttccttgccggcctgcaccggcgaaggctcgacgagggcctccacgaccgtgagaggcgtgggagcgtcggagcagtttctccatctctgctcctgagctttcgtcattggagttgtgaaggcgagcagtgctgtcaggcagaggacgagaatagtacggcgttggtgcgggtagagtgtcggggtattcctcttaagcaagctcgaggaggggattgacatgagcgtatggagagcaagtttgaggggttatgagggtacctcgggagtataggaccctccgcaccgctgctgggcagctcgatcannnnnnnnnnctgaggggttatcagggtatctcgggagtataggagcctccgcaccgctgctgggcagctcgatcaccgccgtgggaaactccaatagctggtgaatgtgcaccacagggtgtgttcgttcccgcgcgccggacgattcttaacccagatccagcatcctcgcgaacatgaggcaggcagcactccaacatccatgacacagctgtaatgaacatactgatgtccacatgcgcatcccggccactctatcgcggcatcctgcgcggggtccggccgcccaggccgcaagcttaccgtgctccgaatagtacttgcagcgcctgcagacccctgtccaccccatcatgcggtgtacggagcattaattatcgaccgaatcttcaatgttatgcatctgggcaatcggtcgaccaagatccagcccagtcacgctggacaggggttttcctcctccttgtggtttccttcctgtggggcagctactcgccaacactcaggcacgagtagtacctgggttggtgatgccatccatgaaggaggacgttccatagcacaagggcgactccacaactgtcatggaatagggcttgaacatcatgagccctgttctttgcaggtatgcctattccctgcccagccctccgtccgccgaggtcctcaccgctgctcgtggagtgctccagagcgtcctgctgcttgctgcaaacgcactggtcgacagtcggaaagacatgccggcccccacctcgaatgggtccccattcagcagctggggggaaggcgggagcaaggagcagctgggcccgggcacggccgcgccggccactcctctctccccagcttggctcctggccctgcccccagtgatgctgggcagtctcgagatcgggctctacaacaccactggcactacagcccaggcctggggcttggaggtgggccaagggtatgtgctgcagtcctgcccagggatgtacagtgtgctgggaggaaatagccacggacccccgccacgagggggcaggcagatgtgtgcctgctggtcgcaaacagccccaccagccccaccctgcnnnnnnnnnngcacagccacggacccccgccacaaggcggcaggcacatgtgtgcctgctgatcgcaaacagccccaccagccccaccctgccgccctgcgcaggtgacgggggccacccgcagcgctttcttgattcaggcctccgccctcttcacccctatgctggcggccgtcgggggccagcggctgaccaccaacgcctggctcggatccgcgctgggcctggccgggacgctggcagtggtgggggacaccacccagggcggcgctggcttcggggcaggcgtgtcgggtgcggcctctgggttgtcgatggcggggctggtgtgggtctgcaagaggagagcaagcagggacgcctttgatggtttccaaacgttcccaagggcttccaggctcgacagctgcatgaggaagctgatggacctgccgataatcactttctgaatcttgtcctgtcgcaccgcactccctcctagatcagtgcccggagctctgaccttggtaccccaccccttcccccctctccatcacctctgcaggcggcgacctgctgaccctgggcgcggcagccgcctactcagcggccacggtgcgcatcccagtctatgcacggcgcgtgcagcccctgcagctcgcgctgggcaagtcgctctttcttggcgcagtgtcctgcgcggcgctgggcctccaggtgcagcagcaccaggcgcacctctggcacggctggcacgacggctggcagggctgggccgccatagcctggtcggcctcagggccgggggccctggcggcctacctccatgtccaggtggcgtgctgactcggcttggcggatctgggagggggatcttgagtggcgatgccgggccctgctttgcaaggaacgccttggatttgcgcagaggtctctctgtgagggattgagtcctgtgcgtgactcttccgacagcagacactgtcaagcccaccgacatccacccttccgtgctgtccaacccccagggccaatcctccgtggacgccgttaccgcccaaatcgcattctccgccgtcccgctgtggtcagcgctgctcacagccctcctgctaccaggggactccgcagtggggcccctcacctgggcgggcgggggctgcatggtgattgccggggtnnnnnnnnnnnnnnnnnnnnnnnnnnnnnnnnnnnnnnnnnnnnnnnnnnnnnnnnnnnnnnnnnnnnnnnnnnnctgctgccgaggtggtcacgatgtaatcccctctctattcccttggctctatcccgatggagcacggattgcagcagagctgtgaacgctcacagcaacaagatagcnnnnnnnnnngtgctgccgaggtggtcacgttgtgatcccctctctagtcccttggctctatcccggtggagcatggattgcagcaaagctgtgaacgctcacagcaacaagatagcnnnnnnnnnngatcgcattctcggccgtcccgctgtggtcagcgctgctaacagccctcctgctgccaggggactccgcgttggggcccctcacctgggtgggcgggggctgcatggtgattgccggggtcgtgggggtgctgcccccaaagcccactccggcggaggccaagaagtgatgcgcccgnnnnnnnnnnnnnnnnnnnnnnnnnnnnnnnnnnnnnnnnnnnnnnnnnnnnnnnnnnnnnnnnnnnnnnnnnnnnnnacaaggcgaaagctgccaactttggagccaggacttgcggcttcaggatccgcgcagccagatgtcatcccaagtcaggtggtcagcagcttcctgcggctaaattctgcgagcatggactgtttggcctcctccaggccatccagtgcgccgtcataggcaggggtgacctggtgcagtttgcagaggaagatagcgctaagcccggggggaaacacagacgatggtctggctctcataccggtgcataatcacatggcgagtcagccaccatagtctttgtcaccaggaacacttggacccacgaaggcgagcccaaggtgtgcgacaatccagttcccccacctggaaggtgaccgcaacacagaagaggggcttggcggctgcatcggctccgcgcagagtcacagtgtactggccctagagtgcaaatggggcagaggattgccaccgacgcgacgacatggagggcagagcttgcaattcagatcgtcgtggcgtaacacgctccatgcgatgttgaagttatggaggctgcagcctgcaattcaaatcggattgctcctgcaaggatgcaggaacgctgtaagccatcattatacccagaatgcccctccatcgcaccacaaccaatgtctcaccgggggggtgatgacaggaaactgttgctggaagctgacggagacggggccttcagaggaggggcatgtcatcttggtgcaaaggtcgtcagcctgggtccagatgggaaatccagcatactgcaccaccatgttgatggtgccggcgagcacgggcgactctgtcaacagagggtcagcaggattgagtggggtttcgcgggcatgcaggataagccaggagacgggctttccggggcagacaccggcatcagacagtcgtacacacctgaggtagccttgatgttgaagactgcagtcgctccgggtgccacgggttcgggggtcagggtgacgtcctccagcgagaacccttggcccgcaccaccacagtctttccattcaaatgccaggcagcgcgatgccaggagggtgagtagtagcccggctaatgacgaatggcgtaccatggcgaagtgatccacaccggggtgtataggacccaagtcaagtttagcgccgggggaacgccacactcagatgcacaggatgtatagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaggagggaccctgccggaaggggcaaaagggagtggctatactgtgtgttcaacaaacttgcacataccatccacagaattcattgctctgtatccaaagaaaactacctgagccgtccaaccggaccctgctcgcggtgaaggctttggtgatgtcggggtgacgccctcctcgcggtaacaaccgaggagggcaatgagtgtgcccggcgaggtctgtgccggccagctagctcatgatggcgggtgagacagggatgtttgtcgtctgtggcctcattcagggagagggcacagggtaacgccatgcctggtggcttttccgctgacccgccctcccgtgcccccgcgtcgcagggcgggccaccgccgctggctgcannnnnnnnnngcttgcgcagatataacttgggagattgttccgccgcggcaattcacttcttgattgcatcccgttgtgccgacaccaattgcgcgcggacgataccnnnnnnnnnnaaggtttgccgtctgtggcctcattcagggagagggctccgggtaacgccatgcctggtggctcttcgctgacccgccctcccatgcccccgcttcgcagggcgggccaccgccgctggctgcagcgcgacctcctccaccgcctgccacaaacatggtctgagcgggagtacgtctgcaagaccctggacaaggcctttgcctgcgtgagtgttttcacactggcgcgaggttgcacctgctgggcagggcaggaggggggccgaactgccctggccattcatggacgacctggaagaggatggctacattcccaggtctcaagctccgccacgcatacccctgtgcactattcttgtcaccagcagccccctccccactgcgcgtcctgcaggcctgggaggacggcgaccacgtgctggtgggcaccaagtgcaaccagctgctgcgcctcgacacgctcaccgggcgcagccgggccatcccgctcccccccgccccgccgcgcgcgcgcgagaccttcgaccacgagtggggccactgcggcatccactccattgcgctgtcccccgcgcgccgcctggtggccaccggcggcgacaaccccgcggacgccgtggtcctggaccgcgccacctggcgccccgtggccacgctggtgggccacctggactgggtcttcggcctggcctggctctccgacgcgcacctcgtcaccgccagccgcgacgccagcgtggggctgtggaccctgcccgaggaggccgtgctgggcgacggcgccgggcaggacgaggccgatgcggcggccgacagggaggaggaggcgcgggcgggcggtgtgaggccggaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnngccaaccccgccacctcgggcctggtcctgaccaaggactacggccggcacggcgactttcgcaagtcctttggcgggaaggtgcgcggcgtggagtacgacgccgccacccggaccctggccacgctttccttggagggcgcggtgcgcctgcacgacccgggcgacaacctgcgcctcatacgcagggtgcgatgggggggggggctttgggg

SEQ ID NO: 38591 - DNA, 73 bp, Chlorella protothecoides
ggttggacaccatgttcaggtccatgcagctctgtacccatgtcacggatgtcccctccctctactacggctg

SEQ ID NO: 38592 - DNA, 97 bp, Chlorella protothecoides
gcctcctccctgtcgcgattcagcggcagccacctggcccttgcctcatcccccacatgtgcctcttcaccttcagcctcctccctccctgccctcc

SEQ ID NO: 38593 - DNA, 5400 bp, Chlorella protothecoides
  modified_base (167)..(349): a, c, t, g, unknown or other
  modified_base (567)..(576): a, c, t, g, unknown or other
  modified_base (873)..(882): a, c, t, g, unknown or other
  modified_base (1864)..(1873): a, c, t, g, unknown or other
  modified_base (2699)..(2713): a, c, t, g, unknown or other
  modified_base (2778)..(2787): a, c, t, g, unknown or other
  modified_base (3102)..(3111): a, c, t, g, unknown or other
  modified_base (3181)..(3422): a, c, t, g, unknown or other
  modified_base (3797)..(3806): a, c, t, g, unknown or other
  modified_base (4420)..(4429): a, c, t, g, unknown or other
  modified_base (4897)..(4906): a, c, t, g, unknown or other
cggggacccttccgcccccctgaacctgtcgctccaggatctcttcaggtatggctgggagtgtgtggggcctgaaggtccaacttggttgggtgtgggtgtgactgagggggtcgccctccacgctgtgggcgatccactgtgctggggatggtgacggatgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagcgacggcaccccagcggctgcagcagaggccacgcaggatgagcccgcctcggatgtgccaggtgtgaggaggcagctgcatgtcgatctcggggtgcttctgggtgtgcaggccgggcagtcccctctgcaggtgggccctggcttgcatttccttccagcttcctgttgtccagcctcggcccccctcaatgcactcctcccaccagcgannnnnnnnnncatctcggggtgcttctgggtgtgcaggccgagcagtcccctttgcaggtgggccctggcttgcaattccttccagcttcctgttggccagcctcctcccccctcaatgcactcctcccaccagcgacgccatcgccactggaagacatcttgggggttcagcccggggaccttggctgggccccgggcccggggtcgctggcgcccctgaccaacgacgcccccgtttccaagacgcatggcgccccgctctgggtctcgagcaaccctgtccccgacctggcccggcgctgggcnnnnnnnnnncgttccaagacgcatggcgccccgctctgggcctcccgcagccctgtccccgacctggcccggcgctgggcggcactggcccccggcctcgcccgcacctggcccttcgagctggatgtcttccagaaggaggccattgtgcacatggaggcggggcgcagcgtgtttgtggccgcccacacctccgcgggcaagacggtggtggccgagtacgcgctggcgctggccagccgccacgccacacgcgcggtgtacacaagccccatcaagaccatcagcaaccaaaagttccgtgactttggcgcggagtttgacgtgaggagggatgtcagggctgggtcctggggggcaaagggagatgttggcggtgatttccttggctaggggtggaggcagccccttccattattcctttacatgatgcctcaggcatccctcccctcaccagcccaccgcaccacccaccgcacaggtgggcctgctgaccggggacgtccagatcaaccccgacgcctcctgcctcatcatgaccaccgagatcctgcgcagcatgctctacaaggtgtgtgtgtgtgtgtgttggggggggggtgggggtatcagtattctatggtaaggactgccggggctggcatgcaaatgtggacctccgacccatccccaggtcactcaatttcatcgtggctcctgcccaccctcaccacattccccctttccacgcctgcacagggcgccgatgtcgttcgcgacattgagtgggtggtcttcgacgaggtccattatgtcaatgacgcggagcgtggggtggtgtgggaggaggtgatcatcatgctcccgccccacgtcaagctggtcctcctctccgccacggtgtgctttgggcattctttccttctttgttcagcacgggaggccgtgtgctgggggccgaggaacctaggaagccgccaccgatccaggcccgactctggtgctgggctgnnnnnnnnnncttctttccttctttgttcaacaccgggaggccgtgtgctggggggtgaggaacctaggaagctgccaacgatccaggcccgactctggtgctgggctgggcggtgtacactggcctccgcgcctgctgaattggcacctcgcctacgatgccgtgtgcctccatgctcccccggcgtcctcgccgctctccccacccaggtgcccaatgtgctggagtttgccgactgggtgggccggaccaagcgccaggtcatccacgtgacgggaaccacgaggcgacccaccccgctggagcacagcctgtaccacggcggccagctgcacaccatctgccggggcgaggcgttcgaccccgcgggcttcaaggcggccgccgcggcggccgccgcgaagctgggcaaggcgggggccgccccggcgacgcgcgccgaggcgcagcgggcgctgccaacgggcaggggcggctcggcccctcgtgagtagccatggctgctttgcttgaggtggtctcttgtcaccctcgacactggggtggaagtgcttggggtcaggtgggtgtggcctgaacccctcgaggccccatccctggagcgcctctcccagcagcctgcgttgccactcccagcaaggccaaattcacaccccacgcccacaacgcaggcggaggaggacgtgggggcccatcacacaagtttggggccgggggcgggcatgcccccgggcggggaggcgccggggtccagctgcggtcggagcgcagccagtggatgcagctcatccagctgctgcagaagaggcgaggggacggggggggggggggtttnnnnnnnnnnnnnnnttttgaacctcctcaccccagggagttgctgccgtgcgtcgcgttctgcttcagcaagaagcgannnnnnnnnnatatggtaggacatgcatgtaccaacaaggaccgagattgtggaggaaattgcatccagggccttgagagtgtgacctatcgtcagtatcttcaacccgattcacttgaaactcctcactacagggagttgctgccatgcgtcgcgttctgcttcagcaagaagcgatgcgatgctctcatcgacaatctccaggttgttgtcggaagaggaaggggggaggggcatgggaagcttgcccttgttttgccaggcattctccatcaatctcacatattcttgacaaaccagcccgaggaggctctttacccctgcnnnnnnnnnnctgccaggcatcctccatcgatctcaaatattcttgacgaaccagcccgaggaggctctttacccctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctgggcacgctgaaaagatgggaaagggagacccatggccagcgtgcaacatgcttccatgcatggtcaaggagggcatctccagacacagagcaacttggattcagcacgccccactctcgacccccccaactaacaacaggtcttacgggtcacggagatgctgaagagggggctgggggtgcaccatgcgggcctgctgcccatcgtgaaggaggtagtggagatgctgttctgccgcggcatcatcaaggttctgcttgccacaggtggagagggtcggaggggctgcagcgactcagatcgtgagatcctgtaccgcaccggcgatggcgccatcttcagcgccactgcctgcaccatgaccctgnnnnnnnnnnccggaggtgctgcggcgactcagatcgtgagatcctgcaccgcaccggcgatggcgccatgttcagcgccactgcctgcaccatgaccctgcatcatcacctgctaccagctcattgtactgccatcccagatgtcccccattccatccctcatgaccatcagtattccctccaaacccctctgctcacctccgatcgccagcctgagctcttgtctccccttgtcaccccccatcctccagagacgtttgccatgggggtgaacgcccccgccaggacggtcgtcttccagtcgcttcgtaagcacgatggtcacagcttccggccactgctctccggcgagtacacccagatggcgggcagggccggccggcgggggctggatgcggtgggcaccgtcatcgtggccgcctgggacgagctgccgcaggagggcgacatccgccgcctgctgacgggtgggtttggggcatggtggagcgagtggctggtgtagggtgtggagggccctgcaggtgatgtgagtggaattcaagccttgcagtcaatcgatggctgtgggcttcaggctgagaaatgtcggatggaccggagcagtgtgagcgcctatggannnnnnnnnntgggccctgcaggtgatgtgagtgaattcccagccttgcagtcaatcggtggctgtgggcttcgagctgaggtatgtcggcatggaccggagcagtgtgagcgcctatggaatgtccttgtcgtctcagttatgatggttggctagaggatgaccttgtgggtatgggatggcacaaactccacgctcagttccccccgtctcaccccctcgcaggctcagccacgcgactggagagccagttccgcctgacctactccatgattttgaacctcctgcgcgtggaggacctcaaggtgggtcagaggatggctgttgaggcctggaggaggcccaagcgctctccctcacgtccacaactcgccaggcaccgctgcgacccatgccgctgccccatgctgcccacccctcccgtcccccccaaaatgcctcccccccctacccctgccgccacgcaggtggaggacannnnnnnnnnattgaggtctggaggaggcccaagcgctctccatcacgttcacaaattgccacgcatcgctgcgacccatgccgctgccccatgctgcccacccctccgctcccccccccaaatgcctcgccctctacccctgccgccacgcaggtggaggacatgctgcggcgctcctttgccgagttccatgtccagaggcggcagcccgagctgacggcggtgctggaggaggggcaggaggccctgaggaagctgcgcgcccgctcctggccacgctccccgctgggcacgacgcgcgaggcggtggaggcataccacgacgtgtgcgccgaggtggcgcgactggactccctggtgcagggggaggtggcgcagagccgcgccgccgcggcagcgctggcccacggccgcctggcgctggtcacccacccgggctcgggcctggtcggcctgggggtggtggtcgagggcggggcgggcggcggccgcgcggcgccggg

SEQ ID NO: 38594 - DNA, 61 bp, Chlorella protothecoides
gacgagcacaggtcatcaaagctgtgttgcacctgtcacgccactctgcacgcccaccagt

SEQ ID NO: 38595 - DNA, 70 bp, Chlorella protothecoides
atttgacatgcggtgaccgccgcctcaacaagactgtgcggcgctgtgactggccattcaacgagacacg

SEQ ID NO: 38596 - DNA, 72 bp, Chlorella protothecoides
gttctgcagctgcatgaaggacagcgactcaaaggcgcccgcctccgcccaggaggcgggcagggaacctgc

SEQ ID NO: 38597 - DNA, 156 bp, Chlorella protothecoides
ctttggacctgcatctggggcagctgcacttgtgccggaggtgaagcagggttggaagtgtccagaacatgccccaaggggcaaagctgggcacatcagagcctggatgacgactttggggcacgacaagcaccgtggatccgtacaagaagcagc

SEQ ID NO: 38598 - DNA, 107 bp, Chlorella protothecoides
gccgcgcctgtttgacaagatcaggtgggtttggagggggcggcgagggctcgggtgtgctgaccttcaatcccccaaagccgccgcagacccccaccaacccatgc

SEQ ID NO: 38599 - DNA, 61 bp, Chlorella protothecoides
ctgccaagatgccctaccatcgtaaccccctccacctctcacacacacacacacgtgcttt

SEQ ID NO: 38600 - DNA, 72 bp, Chlorella protothecoides
ccccttcccaaacacacacacacacacacatcctccacacacaacttcacgcaggagtgttgggtggtggtg

SEQ ID NO: 38601 - DNA, 61 bp, Chlorella protothecoides
gagccggacagtccccctgtcatcaaccccaaggtgtcctgcaccaagctgccacactggg

SEQ ID NO: 38602 - DNA, 923 bp, Chlorella protothecoides
  modified_base (122)..(378): a, c, t, g, unknown or other
  modified_base (490)..(656): a, c, t, g, unknown or other
  modified_base (724)..(870): a, c, t, g, unknown or other
atgtcggcgtgactgagcatggcatgtaccgcggcacatgtaggtgggggggcaggattccaggtgggcaggtgcgtgcccatgcgctcaaggtcaccgtgccagaggctgctgaccctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgccagggtcccagattattcggcctgcaagagtcagcgatgccacttgggccccagcccacttgtcttgcaccatgcattcccgtacaatgtacctgagacggcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacgcacgcgaggagctctggggcggggtcgaaatctctcagatcacgcacctgtagacaccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagggattgcctcagtgcatgccctcgccaaggctttcatgcgatcctccga

SEQ ID NO: 38603 - DNA, 75 bp, Chlorella protothecoides
gaccacaccatgttggccacgcctgggggggtgggaggtgggggggggggattaggtgagaggatgacatcattt

SEQ ID NO: 38604 - DNA, 61 bp, Chlorella protothecoides
gattgaggaattgcagtgcctggggttggcgagatgcgggtggggtgggtgtgagcgacga

SEQ ID NO: 38605 - DNA, 95 bp, Chlorella protothecoides
gagaggaggggagaagggggggggagggggggagaagggagggaacggtggggagaaaagtgtgcgtgtgtgtgtgtgtgtcagccggtggggag

SEQ ID NO: 38606 - DNA, 61 bp, Chlorella protothecoides
cactcacccctgttgaagtcgccgacgttcatgtttcccacgttctcgttgccgtcgttgc

SEQ ID NO: 38607 - DNA, 72 bp, Chlorella protothecoides
gtgatgtatccatcgggtctcctgaccgtgtcgtgctgtgctgcggcatacatactctgatcctgtacacat

SEQ ID NO: 38608 - DNA, 61 bp, Chlorella protothecoides
aaagtgttgaaaaaaatactcaagataaaggtaacgaaaatacaaaaagtgttaaaaacaa

SEQ ID NO: 38609 - DNA, 61 bp, Chlorella protothecoides
tcagagggtggaaggtaatatgtggggggggggctggtctcaagcacccggtacgcattcc

SEQ ID NO: 38610 - DNA, 105 bp, Chlorella protothecoides
cagagggaacccatacaactgttttgagtcagtcagagggaattcgagagcgcatgggcgggccacctaccccctgcaagcacacccctcacctggacggactgc

SEQ ID NO: 38611 - DNA, 78 bp, Chlorella protothecoides
ccagggcatggagagaaccataactatgtctccctgtctccaggcagtgtccacctattggaccatgcagactggaac

SEQ ID NO: 38612 - DNA, 70 bp, Chlorella protothecoides
cagcagggcctgcacaggccgcccaccgccacccttgatgaggtccagcaccgcacggcggtatgattac

SEQ ID NO: 38613 - DNA, 111 bp, Chlorella protothecoides
cttaaggtgcaatgcctcgtcaaatagaatcttcgactggtggtacaggttgaacggcgattcaggcctttcttcccgcatgatcaggtttgtcaccagcaaatgctgcca

SEQ ID NO: 38614 - DNA, 61 bp, Chlorella protothecoides
accctttgtggagagaaaaatgacagagcacggaagtgggttgggaagggagacgcagggg

SEQ ID NO: 38615 - DNA, 83 bp, Chlorella protothecoides
aactgtgctgcgcctgtcacaccaccctgctcgcccaccagtacgtgccggtttgccgaggcgaggagaagctggtggacgtg

SEQ ID NO: 38616 - DNA, 79 bp, Chlorella protothecoides
tcggcacggtagatcctcaactcctcgagtacagagcaacgctcttaacctcctcagtcccaccagacagcggagggga

SEQ ID NO: 38617 - DNA, 1569 bp, Chlorella protothecoides
  modified_base (1034)..(1043): a, c, t, g, unknown or other
  modified_base (1491)..(1500): a, c, t, g, unknown or other
cggtggccgggctggcgtggcagccgggcggggaggcgctgtacctcgccagcttcgacggccgcctgtcgctggccggcggcccggcggcgagcgcggcgcccgcgcgcgacggcgctgtgcccgtgttcaccggcaggcccaagcgcgtcgacgcggaggtgcccggcgaggtgcatgcgctgctcctgccggcggcagagggccccttcgtctggctcgcctcggggggaggggtggtggtggccgccaaccgcaccgaccgacccctcatccccggcggactggggcccgtggccggcgccagcctgggcctggaggagggccggcccctgctctgggcggtgggccaggcggcgacggagggcccgctggcccacgtgacacaggtccgcgtcgcggagagcgcggcgcctggcgctggcggcgatgagaacggccggccgccatgggtgagcgcgtgtttctgaggggcgctgctctgtctcacccctcgttcttctggaggaggagggtcgaatgtcaatgcccctctgggtctggggctcatccgggacgccgcctgtcccaggtcgctctgcttgccagtgtgatgtgggcaggacggcccagggggcaggtctgaagctgcgctgcatgggcccgtcctcgcgcagccacaccctgccgtgacctccgtgccctcgcctcgcccaggtcctcaacggggcgtggccctaccccaccggcgacgcgcgcgagcgggtcgtcctctccttcggggctgggacctgcgtcaagctcctcaccggtgggtggctggggtttacaagccgtgtgggtggccaccactgtgcgggctcttgggagtgaaagggttggccgccctctccccccagctctcgacccctttcccctctcgcatcacgcaggggagggcgagctggaggacgcttcgcagggcctggcctttgacgcggacgccccgaccctggcctttggggccttgcccgggctttggcccgtccaggtcaccgcctcggccgtgctggcgnnnnnnnnnncggggccttgcccgggctttggcctgtccaggtcaccgcctcggccgtgctggcggtgctggtggggcgatctgcgccgcggccggcctggcggccgccggtcgggtcgagcattgccgtggcggccgtggtgacggcaggcgacgccgtggtcctgcagaccgccggctgccgggacctgctggtgctgcgcccggggctggggacgggtcccagcctggtacaggaggttcgtctgccgctggaggccgaggtgtcgtgcctgggcgcagcctgcgcagcgccgggggggggcctgctgctgccctttggcacgcatgcgccctctgtgggcgcggtgcgcttcgtccccggcgaactcccggcgctggcctggtccgcgccgctggccgcgccgctggccgcgctgcgctgcgcggggctggccggcgacgacgaccagcgcgcnnnnnnnnnncgcgccctcggtgggcgcggtgcacttcgtccccggcaaactcccggcgctggcctggtccgcgcagct

SEQ ID NO: 38618 - DNA, 61 bp, Chlorella protothecoides
aaggctgtgcgcaagcgatatgcacttcacccacagaattctcctttcactgcagttttgc

SEQ ID NO: 38619 - DNA, 148 bp, Chlorella protothecoides
ggggcacgcctgtggatgggcaggtgtattgtgtgtgtgtgtgtgtgggaggggttggaagggcgggtggcgggggccgcaaggctaccccggattctcatgcgggaggtactgaagaggcagggcccagcaagaagcgaaaggtggc

SEQ ID NO: 38620 - DNA, 61 bp, Chlorella protothecoides
gcccggggatttctaggggagggacctgcgacccctcagtaccgcagccagtatgtcctcc

SEQ ID NO: 38621 - DNA, 89 bp, Chlorella protothecoides
cagtccgccacggcctcggccgcctgcgctactgtctcctgcccccgaccttgcacgattatgaccaggtcgccatctgggctgggtcc

SEQ ID NO: 38622 - DNA, 64 bp, Chlorella protothecoides
tgactccgaggccaggggtggggacatgcatgggcatgcacggcatgcacgcttgacggcgccc

SEQ ID NO: 38623 - DNA, 115 bp, Chlorella protothecoides
aggtgtctgggatcgggacttgcccgggcagaacggtgtacgcccagtgttgcccttgcgctcttgcactgtggccgcgatgtgtcctgtcgctgcgacggtgcccgtcttcttc

SEQ ID NO: 38624 - DNA, 61 bp, Chlorella protothecoides
aaagcaaaaattaaatgtgcaaaagtaaacaaaccacgtgggcttgtacggaaaacaccat

SEQ ID NO: 38625 - DNA, 77 bp, Chlorella protothecoides
gtgggctgccacactgggcgcaacaaaggcactgctgcccccacgctctgattgcaatgcgcagctctgctggctgg

SEQ ID NO: 38626 - DNA, 106 bp, Chlorella protothecoides
cgcggcggtgaaccaggcggaggccatcgcgcgatttgtgcagggcaccatcgcggagcctgcgcccgtggtcccggtctccgcccagctcaagtacaacgtggac

SEQ ID NO: 38627 - DNA, 121 bp, Chlorella protothecoides
ggaagaagaccgcgctgcctgtgcaagggcggagaggggacgtcgggggtgcatggagctgtgctggctgggggaggtacgctcgccgctgcacaggcagctccggcccacacacggggcc

SEQ ID NO: 38628 - DNA, 61 bp, Chlorella protothecoides
cccggtgcgtcgcagtttggatctgttctttggagggaggggttgggaggagaggctgctg

SEQ ID NO: 38629 - DNA, 61 bp, Chlorella protothecoides
ccaggagatcgcggcggaggtgctgtctgcgctgaagcccctctcccccgacgagttcacc

SEQ ID NO: 38630 - DNA, 61 bp, Chlorella protothecoides
tcttgataccactaagttcgtgatagaattcacttccggctcgcaaatgccagtgcgattt

SEQ ID NO: 38631 - DNA, 72 bp, Chlorella protothecoides
aagcgagtgcgccaggcaggcggcgagggatgatgacgtgatcggctccagggcctccagtctgtcgctgag

SEQ ID NO: 38632 - DNA, 69 bp, Chlorella protothecoides
gatctccaccatgcggtcctccaggcccttgtccctgcagcggaaaagggggggggggggggggggggg

SEQ ID NO: 38633 - DNA, 121 bp, Chlorella protothecoides
cccctccctcctggagaacgcaggtgggcggacgcgcggggcgcatgccgagcattttgttgtgacgtcgtgaggctggagtggtgcttgtgtacaggaatcatgatcagggacgcttaca

SEQ ID NO: 38634 - DNA, 123 bp, Chlorella protothecoides
actgtggaagaggagtggggcggcccggggtcaaggggaggggttggggcatgtacactgcaatgaggggggcggggacatggcctcagctcgaacgggtacctcattggcgggcagacaagc

SEQ ID NO: 38635 - DNA, 71 bp, Chlorella protothecoides
tctccacctgcagctgcgcaacctcctccaacacccacacgctctccctcccccccaaataccatgcagtc

SEQ ID NO: 38636 - DNA, 156 bp, Chlorella protothecoides
accggcctgagccgcgattcgcggtgaccggttggtgggagtcgccgcggcgccgtggcccgctcgcctgaggcggggtgagggggtgagcacgttgtgacgaggtgtcgcagtgagagaggaaccgtggaagcttttggagcgatacgttccaat

SEQ ID NO: 38637 - DNA, 80 bp, Chlorella protothecoides
tctgtgctgcaggctgtttggtcacctgggcctgcttggcctggttggttacctgggcttccttggcctgcttggcttgc

SEQ ID NO: 38638 - DNA, 155 bp, Chlorella protothecoides
tgccggcgtggtggatgccgatgccttttgagaggagggagacgaggcgcgattatgtgatctggctgagccgccgcgaaccaatgcgtctctcatcacaaatataacacctcacaggcctcgtcaccctcccatccactcgacccaacccacct

SEQ ID NO: 38639 - DNA, 139 bp, Chlorella protothecoides
ggggacgggaaggtacacggcgctcctcgataagtgtcgcttggcatggatatgctgttggcctaggaacgaatacactccagtaccaaacagagtctccaattgacatgaggagaaagcaaggggtttaaaattgccg

SEQ ID NO: 38640 - DNA, 96 bp, Chlorella protothecoides
cagcctggtcatggccgacgcctcggtcgctgccgacagccgcgccgtgttcggtccccgcggctcccccctggccgccgtggtgcactccggcgg

SEQ ID NO: 38641 - DNA, 87 bp, Chlorella protothecoides
ccctggcccgtgcctggcgcagccaccggcgccactcacccacatggctgccccccacacatcgcaggtacaacatgaaggtgccgg

SEQ ID NO: 38642 - DNA, 103 bp, Chlorella protothecoides
cgacggcccctgccagtgtaggggtgggggatgagctggatctgtgtgtgcaggctcaatgcgtgccgagtggacaggggcatgtcttgagcgcggcaaagct

SEQ ID NO: 38643 - DNA, 78 bp, Chlorella protothecoides
agtggtgccatgctgagctcccattcccaacttcgtgtccctcttgggccccctccaaccccaggaaaccgtatgctt

SEQ ID NO: 38644 - DNA, 61 bp, Chlorella protothecoides
cagcgtctgcctcgccgactgcccgtctcgcgcagccagctgctccggggcctgccacccc

SEQ ID NO: 38645 - DNA, 8347 bp, Chlorella protothecoides
  modified_base (4211)..(4220): a, c, t, g, unknown or other
  modified_base (4565)..(4574): a, c, t, g, unknown or other
  modified_base (4720)..(4729): a, c, t, g, unknown or other
  modified_base (4892)..(4993): a, c, t, g, unknown or other
  modified_base (5373)..(5382): a, c, t, g, unknown or other
  modified_base (5567)..(5576): a, c, t, g, unknown or other
  modified_base (5928)..(5937): a, c, t, g, unknown or other
  modified_base (6548)..(6557): a, c, t, g, unknown or other
  modified_base (6910)..(6919): a, c, t, g, unknown or other
  modified_base (7225)..(7234): a, c, t, g, unknown or other
ctatgccctgcagctcttcgactatgtcgctacaaagtgaggtggcgcaagggattgtggatggcacgggcaattgggtagggttttgccatactgcccagcattccttgacgcgatgtccctcctgtcgagctcattcctcacatcaattctttccaggtgtgacatccggtacggagggccccgggccaaggctctggcagatggcggtcctaaaataaaagctctcacagagtcgtcgcacgaagtgcataccgtcacatagagcgtgcaggcggcagggatttgcacctccaggctgcatcccaagccggcaggcaaggcgctcgtgtctggacgccttgcgtgcaatgtgagaagagagcggtctcaagaagaatgggggctgctatcggaggtcaccctccgcaccgagcaccccttttttacatgcatgcgcaggtcattgctccctgctttgtcttttcaacagtgatcttcacattcacatttcatctgtggaagatgctctgttcccccccaccctgcaataatcctccaccaagtagtgatctctttcttgaatgcccctgtgtcaaccttttttggagaggtatacccctttgtaataatcaccttgggtatggtagcatgtgtggaatgcaggcatttggttcagtgagtttctcatccagaagaatcatccttgggaagtgatgacagcatcagcctgaacccaaatggcactgcacattgacaatctaagcctgggacgagtcctcggttttagtcctgcaagatccaccatctcgcccaggttacccttggctggtgcagggggatgcccagcagcatatgccgtggtagcggagatcgagcatcgcctcaggacaagttccccactggacaagcattgcccatctcgcccttcacctcatacagggcccacttataaatcgcggctgaccatacaagccctgatcttccgtttggattccgtccttgaccctttctgcatggcggagccctgacgagggccactgtgcaggccgggatgccggcgcaaaccggcccccctgcagccatgctatggagctatcgcagcccaactgtcgcaatctgtacaattcaaccctttgggacatttctacaccagcaccataggcgcaggagagcgcggttgagagcgcggtgtcaaggtgtgccgtattccgggcaggcattccccgcgagctgcgtgttccaactgatcccaaacccgggtgcaatgtccaggcacaacatgcagcctccatgcccggcatccacaggtggtggcagcggttcgtggcccccggaaccccggccccgcagcgatccgcccctggcagccagcaacctggtgttcctgggccccgcggactcaccccccgcgggccagcctcttggcccccccaacgagtgggtccccctggcccccagcgaccacccctcctcccctccacccgcctgggcccccctccccttggtcccctgggacctggccaccacggccaccgtgctcgccctctggctcctgggcttctggtgcctggcctacggcgcgctgccctgcgcgctggccctggccggcctggacccgggcagccccgcgccggtgttccaggcgctgcgccacctggcgctggacgtcgcccagctagcgctcacgctgggcctgctgggccgggcgctacgtgagcacgccccccgcgcgcgcggcctcttcgcgttgcgggccctccccctctccgactgggtggggccggcgctcgcgggcgccgccaccttccccgccatccacgccgtccaccgcctggccgtggcgctcaccgtgccgggagtgccggcccctggcggcggcggtggcgacgccgcggcgcgcgcgctgctgggctccggggacggcgccacgcgggccctctggttcttcatgctggccgcctgcgccccggtctgggaagaggccatgttccgcggtttcctcctcccctccctggccacgcacatgccgcgctgggcggcggtgctcgcgtcggccgccgtctttgcgtgcgtgcacttctcgcgcgagaatttcctgcccctgctcctcctgggctgcgtgtttggtgcggcttacagccaccgcgccaacctgctgccctgcatcctgctgcactcgctctggaacgtgttcctcctggtctccgtctgcggcttctgagcggtgcaagccggggccaggccgtgccccggccatgtgactccccctttgcgtgtccctgtgtacactgctcccttgccccagccgccccgggtgcaacaagcagacacccacttggctgcaaccaggcagatgcccacctgaggcaggaccggcgcttggaaggagacttggatggtggaggggggtcattggcatgaggcagttttagttagacactagtgggaagaaagggggcatgcacgtcacccctggaaccgtgtttgggcctgcgacaggcagggactatcaaggggtcctgccgtacgggacccaagccaatgcaaacgcagaagaatgcttggtataactccccaatcaaagttctcacattatccgtatttctaaagcattcaaaacagtggtgagtgagcctttggtgcttctcgccactatcgctcggcatggtgactaaggtggctggctggggcgatttacattctgctcaggcactggccacctcttaccaatggcatcgtcacaattgttctaacttttgttttccctccaattgcagtatggcgacctcttccgaagcttgcgaatgccagatgtccgtatcgctggtacagatctcacctaacccagatccctgccgcgcttgttagttttcaagtcatcggaaaatcacgagcacaattacgtgagtcccgtcaacgtaagcgtgcaagatagagacacagggacatcagaaaatggttccttttatggttaattggcaaatgtaacctggagtctgtggcatttgcttgaagttgcacacaagtcttcgctcagtggtctcgccacggactgtgcctgcccccgggcccgcctcgtttagattctgtccaggacaaaggacattgcatggtactctgctgatccaactgtactgttttgcgagctgcggcatgggtacggggacgctcgctccctctctcaagcaggccttatttgcctacacctcgtaagtcccgcggggatgggcggcgttcatcacgaacctcaagattgttggtgcaatctaagctattctggaccactcgcgcaggttcacactattgtacattttcggccagtttcgtgactttttccggaagcgctggagcaaagcctccctgaaggggtacgctcccatccgccaggattatgaagacttctacaccaggcgtatgtattacaggatacatgtgagaagattgggctgtgatgttggcttatttgagtagtcgaggatgaaggctgattgcaaaggcgatgtccccggtcaactgccatctgctggggaaagggagcaggtgatcaaccaggaactcagcagcttgcctcttgcccatgcgcatcgtgcaggactgcttcaatcggccaatcactggccctccctcctcctggatggacgtcttggagcgaacacccgtcaacagacaggagtgagtttgggagccccacttgcgtggtgggggttgactttgtgcgtccaatgcattatttgagcctcttctgctactgttgtgcgcattcttccatggctctaaagttctcaggcatgcacgggtgtaccagcgcaatgagcatcactggagctcgcttcgccatcctttgaagtgaactcccaccgaagtctgctatccttcacacctcatagacccctgacgactactgggaagatcaagcgctgtctgaatcttggctcctacaactacctcggctttgcgtcctctgacccatactgcaccccaagggtgcttgacacgctttcccagcatggctggagcctttgcagtaatcgcgctgatgccggtagggcggtggcccgcctgccgcagggccttgtagggaatggggtgactacagcattttcatcaatgttatgcaagccacgccctcatatgcagcgtagccctccagctctctgacatccatcctgacctcctccccatgacaggcaccactcctgtgcacgaggagctggagcgggagcttgccnnnnnnnnnnaagtgtagccctgcagctctctgacagccatcctgaccccttccccatcacaggcaccactcccgtgcacgaggagctggaacgggaacttgccagcttcctgggcaaggaggccgtcctgacctgcggcatgggcttcgccaccaactctgtcttcctgccggtgctggcgggcccgggcaccctgatcttctccgacgccctcaaccatgtctcgatcgtgaccggggtcagggcggccaagggcacggtccgcgtgtttgaccacaacgaccctgtccacctggagcagctgctgcgccaggccatgctggagggccagccccgcacacaccgcccctggannnnnnnnnntgtggctggcgtgagggcggcaaagggcacagtccgcgtgtttgaccacaacgacccagagcacctggagcggctgctgcgcacggcactggtggagggccagccccgcatccatcgcccctggaagaaggtcatcatcgtggtgnnnnnnnnnngaggctgccctgacctgcggtatggggtttgccaccaactccgccttcctaccggtgctcgcgacccctggcaccctggtcctgtcagatgctctgaaccattcctccatcgtggctggcgtgagggcggcaaagggcacggtccgcgtgtttgaccacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatggagggcgaggtggtggacctggccggcttcgtggcagtggccaagaagtacaaggcctacatctggctggacgaggcgcactccatcggggccatgggggccacagggcgcggcgtctgcgagcacctgggcgtcaacccggccgacatcgacgtcctgatgggcacattctcaaagtcgttcggggcctgtggcggctacgtcgccgcaaacaagtgagtcattggggtttcaaaggagtagggtattcagttgaccatcctacctgacaaattgaaatgtataggcatggttgtaacctaccgcaccacctcaattggcctttgcggatatgcactatctcctatattatgcacctgtctacctccccccnnnnnnnnnncactccttggcacgctactcacagacgcattctgttcatctcccgatgatggtccagctgaccaaggcacgcatgcgcgcatcagcattcccccaacccctcaccaccagggacgtgatcgactacttcatggcacaatgccctgcgcacctgcatgcgacggccatgaccccccccgccgtccnnnnnnnnnnaaggcacaatgccctgcgcacctgtatgcgacggccatgaccccccccgccgtccaaatggtcctctccgcgctgcgcctcatcactggcgcagacggcagcgaccgcggcgcgcacaagctgtcccagctccggaccaacgccaactacttccgctcccgcctgctgcacatgggcttcaacgtcctgggggactgggactcccccgtcatgcccatcatgatcttccagctggccaagctgtcggccacctcccacgagatgctgcgtcttggggtggcggtggtggtggtgggcttccctgccacgccgctgctcacctcccgcatgcgcgtctgcatctccgcctccnnnnnnnnnntgggcttctgcgcctgggcttcaacgtcctgggagactgggattcgcccgtcatgcccgtcatgatctttcagccggcaaagctgtccgccacctcgcgcgagatgctgcgcctcggggtggcagtcgtggaagtcggcttccctgccacgccgctcctcacttcccgcatgcgcgtctgcatctccgcctcccacacgcgccaggacctggactacgccctacagctcttcgactacgtcgcagaaaggtgtgtggtatttgtcagtgagtgtgtgtatgcctgtctttgatagcgtgtgaatgcacatttccactctgcactgggcagggaactgcagggtgtacctgcgctgcaggtgcctctctcaagcccagcctcacctctctgatgcagatgcgacattcgatatggcggcgacacggctagggcactggctaataccggacctaaaattcaggctgtataggtggcgtttgtccatatgaatgccaaactcaagtcgggcattgatcgccctgacctccttccatttattgtcaagcctcgctcctacgattaccatgcatgtgttacacgttcgaatggacaggattgtttgcatgagcacnnnnnnnnnngataccggacctaaaattcaggctgtatagatggcgtttgttcatgtgaatgccaaactcaagtcgggcattgaccgccctgacctccttccatttattgccaagcctcgctcctatgattaccatgcatgtgttacacgctcgaatggacaggattgtttgcatgagcaccagataggagattgttcgttgtgactgtatttttcagcacgttgagaatgagcttcggctccacaagggctccagataggaaagcgggggcaaatggaatggtctggaagttggagtccctttctgaatgagaggctgtgctgcctacaaaattgcagtccgtggatgagggcaaccatctnnnnnnnnnnagggcaaatggaatggtttgggagttggagtccctttcagagtgagaggctgtgctgcctataagattgcagtccgtggatgagggcaaccatctcgcatcggaaatagttgaggttttccattcactgatggtcatactccccttgtcctccttccaagaatcatctgagcatccacgcactgaaccaatcgacctgacgaggttgagagaagccagagcctctggttggtgaggcccgccgatgccatggcacctttgcacagggtgcatggcatcttcaaaacctgccttgtcctccttcacnnnnnnnnnncatggcgaggcccgccgatgccatggcccctttgcgcagggtgctggtatcttcaaaacctgccttgtcctccttcactacttgtacagagctctttctttacagggagggagtagggtacaggattcgagcaggttggcaccgcacggtgccagaatcttgggactcgcaggtaagtcttgcaagaaaacaagggggcgacccccgtcctgccgaggcgcacatgcaccggagtcggcaaggggtggggcgggggcttttatggggaggggtggagtggtccacccccacgtcttgcacgctccgaaaccaaggacagcaacacgcattgctagaggggcaaagatgacacagacagacagcgggcccggctgcttactacccggggcgcgacacaacacagctggagaaaaggacacatggacaggcactgacacatcgcacggggctggggaggggtgcggtaagggagtggtgacgatattccgaggggggaagggggggggggagctggggtggactgcgcgccgcacggccgcgctgcaggagtccgtacacctacacagggcgatcccggcgcacggggctcagaagcgggggcaggacatgcccggcagcatgcgcccccctgtcgccgggccctgcttccagaccccggtgcgcaatgcggcgccgatgcggcagcgcacgatgtgcatgaagtgctcccactcgtccccggtcaggtcacggaagacggcagaggagggcggggccgggtgggcagaggagacgtcgccgccctcggcggtcgtctcgctcatgggcgacgtctcgccggactccgcctggtgcgttagggaggggggattgagtgagcaaggaaatggtttgtactccggacgccctcgctgtgatcaccctgcatccccgtggccctgaccccgacatgtgtgctccccccgccgagccccccctgcaatgcccccaccccggagtcactcgcagtcctcacctccatggcgacggtggagcaggccgcgctggcgtcggagcgcagacgggtggcgcccggggcgcgtcgccggggtcgtgcgccgcgccgccccggcgcggggacgcgtgtgaagaagg

SEQ ID NO: 38646 - DNA, 74 bp, Chlorella protothecoides
acctgccgagtccagggagcaaacaggcagcgtgcagattgatggggctggtagtgtgctccaggatggcacca

SEQ ID NO: 38647 - DNA, 61 bp, Chlorella protothecoides
tgaagagaggggatggaagatgataacaatcaagggagctctatctgcagccagcgtgtag

SEQ ID NO: 38648 - DNA, 119 bp, Chlorella protothecoides
ccaaccctgcgccgccttttcctgcaaccatggcgcgagctccacttctgcgttgtgtgcggcgcgaggaatgactggttgacacagaatgtctggccatgtctcgctgatctgtgctt

SEQ ID NO: 38649 - DNA, 75 bp, Chlorella protothecoides
cctccacaggccgtagaggaagctgtaagcaagctgccatgggtgtgtaatgcagggatggtttatgctgggcat

SEQ ID NO: 38650 - DNA, 76 bp, Chlorella protothecoides
ggctgccctggagcttggagggctgccctgaggcgcgggcgccgtactggagctgtcagaattgggtgaacactgc

SEQ ID NO: 38651 - DNA, 5131 bp, Chlorella protothecoides
  modified_base (130)..(139): a, c, t, g, unknown or other
  modified_base (1333)..(1342): a, c, t, g, unknown or other
  modified_base (1770)..(1830): a, c, t, g, unknown or other
  modified_base (2663)..(2672): a, c, t, g, unknown or other
  modified_base (3350)..(3359): a, c, t, g, unknown or other
  modified_base (3597)..(3606): a, c, t, g, unknown or other
  modified_base (4400)..(4409): a, c, t, g, unknown or other
  modified_base (4612)..(4621): a, c, t, g, unknown or other
  modified_base (4677)..(4686): a, c, t, g, unknown or other
ccacctcggttacctgttcagttcgaaacgctagggattatgtgatggatacattcacgaaatccatcgaccctgctgctcgtacggccacattcaatatgccaatcgactataggacccttgtagatannnnnnnnnngctggggattgctctggccaggtaatctctgggatgccccctcatcactgcaggggagtacctttgtgcaatcgccacaggcatgtcaatcctctttcccctcttttcgcctgcaggccgaggcaggttgtgtcaggcgcacaccaggggctttggacgcaaacgagttggcaggcgcaggcgtcattgttggagtccagtgcctcgaggctgccagcccaagcacctcgcctgacaccagtccgaccccgccaggacccagcccctctccaagcgccagtccctcaccaagccccgggccatccccctcgccagctgaattaccagctccatatgggacctgggtagcgattaaagatggtgcgaattcccgcatcatgttgtctgtggaaagtgagtttgcggccacctcggttacctgttcagttcgaaacgatagggattatgtgatggatacattcacgagatccatcgaccctgctactcgtacggccacattcaatgtgccaatcgactataggacccttgtagatatcaggagtgtcgtttgcactgcttccgaccaaaacaacaacatctctccggagggacttttcaacaacagcacccccgcataatcccggatttgtaatgacgagatatcacgctcgaggagctatctgtggtgaattttactccatccgcagtgtgcttccttccaaccctcccaccccatcttctaattgtgtgaaagattcaccggagtgcaaggacacagcattggaggagattgtgtttgatgagcaggaatctcatagccagcagtacatgacagctgacttaacaactgatggcgacgtggatgtcaggctttttgctggtggagttttctgcaagccccttgaagtattagtttctatggtaccctcccagagtaaagcattgttggaccgttaagattcgtttctgcctttcctgcggtggaacttgtggcaggactggctcctaatggtgcaagggggggcgtgacccgtcagcaaatgaatgcaagggaataccttgttccaggcttgcgccggttgcaaacagcttcttcccgcaaatgggttaccgctggcgcagttggttgcctggaatggcgaaccattgggaaagggggaggggggggggattggaaagggggccaggcccccccaaaaagctgatggacgaggnnnnnnnnnnaaggagctatctgtaatgaatttcattccatccgcagtgtgcttccttccacctttcccaccccatcttctaattgtgtgaaagattcaccggagtgcaaggacacagcattggaggagattgtgtttgatgagcaggaatcttatagccagcagtacatggctgctgactttacaactgatggggacttggatgtcgggttttttgctgctggagttttctgcaagcccctttaagtattagtttatattgtaccctcccagagcaaagctttattgtaccgttaagattcgtttctgctttcttgcggtggaacttgtggcaggactggctcctagtggtgcaaggggggccgtgacccgtcagcgaattaatgcaagggaattccttgttccatgcttgcgccggttgcaaacagcttcttcccnnnnnnnnnnnnnnnnnnnnnnnnnnnnnnnnnnnnnnnnnnnnnnnnnnnnnnnnnnnnnattggttgcctcgaatggcgaactattgggagaagggggaaggggaagggtaggggatggctagggggccaggggcaagggccaaccaaaagctgttgaacgaggtgcgttcgcaaagaagcacctggtcagcatgagcatgttgactactacgtacatgttacggtttacaacatggactttgcagcccgttttggtacaccgcttggtgttccacatctctatccgctcctccacgccgtcgcagacctgtttgtgctggtgggcatgcagggaggtgtgacagccgcagcacagttgaaagtcctgtgctcgtcaaccaccaccaccctgcacacccgccgcaggcgccccaaggaacgtatccagggcctcggcggagtcccccgcatgatgccccctccgtcctgggccgaccagatgcccacgcccacgacagtggtcatgccagtgggggggtggaactgctctgcctgccagttgacggcccgctccctgccgacgtgggcatggtgccgcagcttgcgaaacggcatctcgtacatgatccaggccaggccctgtcgactttggggaatgatccacgcgacccacgacaaaagcacctctgtgctcgctgtctcatgggtcgggcacctgcgggaagaggggcttgagcaaggagattggtccatttggggcgacagggtgtcgtgacacaggccccagagggatggcaccacacacactccacaaggcaatcaccactcacttgtgtagctccttgacaaagtctcgggccttcgcgtgccactttgcaatggtcttctcccgccgcttggaccccaacatgnnnnnnnnnncgcgtgccactttgcaatggtcgtctcccgccgcttggaccccgacatggtgtggaactcctgtaaagagcaggaagtcgcgttggcgtgttcatccaccacggtgcacatcttggtgcgccctgggtcgatgccaatgtacttgtctatcctggcatcctcttggaggagggatcccgactgcagttttatttttgggtggggcggggggggtgcgcgcagggtgagttgtgttgttggagcaaggcagatttgggtggttggaggtgaatgggtaggtgggagggggggtgcacctcgctgctagtacacagcgcatccacattcactcccggaaacagagccgccaacacccccgcaccatttgcaagcgtcccaggcaatcactgcagcatgtcgactagccaggaggactatccctagcagcacacaccccaggagtccatggtgcagaccactcaccggtagtgctcgtcggcaattcccctgcctttggggcgcccaagggtgccccgccgcggtcgcgcttgccgctggtcttcggggggtcgggggggcggggcggggggtcgccgggccgggggtgtcctctcgcccgccgcagggtcaccgtgacgctgtagccattcgtcctccagtaccccgcagagtaccagccgcagccctcaaagcgccggnnnnnnnnnngtcgccgcatggtcaccgtgacgctatagccattcgtcctccagtgccccgcaaagtaccagccgcagccctcaaagcgccgaaagttaaagaggagggtgaagaaggcccagccgatgtggacaaaccagtccatcttgttctcctctctgtcgcccatcttcttctcctccttttcttcgccagctttcccttgtcgttcacctgcacctcgaattcctccagtttgctgtggagnnnnnnnnnngctttcccttatcgttcacctccacctcgaattcctccagtttgctgtggaggcaggtttcgatcgccctgcgtttcttggtggtgatctttgcgccgtcagtggcacagaccttctcaaggttgaggactttcagcacctgagattggagggatgtgcttggggttggtgtgggtgatgggcagtagtgggttcaggactctcccatggcaaaacaccgctgcaaaccggtccacagagtattgaacagtgaagggcaaccctaccgaagcttcccgaggaaagcagcccgtggtcgaggtaaatagcagaaggcctctctgcaacacaaaaccccctccaccacagtatctagcaacatccctcacctcaaccgcggtgtacatattccactccctctcagtgggcagctgcagccccgtcaacttctcaatgccgcccttgttgtatttctcatgacactgaagcagcgccagcagcgtcgtcaaggtgccaggaatgtgcaccgcctccaggccctgcttgtacggcaggaggctgaacagccgcgcgatgtgccgctgtggcgtcggtttctggggcggggctgccgtcgactctctctgcggcctccttgcgcttggccagcgccgcccgtcgaaccttttcaaggcctcgccgcctattgggaatgccctcgtccttttgcgccttgtgctgccttgcaccctccgagaacccttcatgcgccacaatatcaagccccgggaacaagtcgcaactcccccttccacggacataccccctcaaatatnnnnnnnnnngttcgccacgatatcacgcccccggaacaagtcgctactccccttccacggacataccccctcaaatattgtcaaataagccttttctagatcttaacatgcttgttcgcgatgcgaggccccctcgtttggtcgatagattttcgaatattgcagggcttggccatgtccgatggggctgcgaaagcgccgcacgatgcagnnnnnnnnnnggcagtctgccgcctcttgccacaccccctctcaaggtgggagcggatgcgacatnnnnnnnnnnttgcgaggccccctcatttggtcgatagagtttcgaattttgcagggtttggccatgtcctatggggctgcgaaagcgccgcacgttgcagattgttatgttgaattatcattctactggatagagtatcgatctcaagggcgatggaacgcagtatgcacatatcagtcgtgccagatcccccccacccggtcggggcctcagaaggccaagagcagtgcgtggggggatttcccacccccatcgcccgtccgagggtaatgctgccccgcacacgcgttgcctgactgcttgctgatccagtagattaaaaacatgggattcgcaataggtgcaaggtcatcttggccctcatttgcttgctgaagcagtctgccgccccttaccgcctcccctctcaagatgggagcggatacgacatgctttgcaattgacgtgccgctcg

SEQ ID NO: 38652 - DNA, 61 bp, Chlorella protothecoides
ccgcatcgtgcgcggcgctgctggcggggggggaggccgccccagccggcaccctctttgt

SEQ ID NO: 38653 - DNA, 61 bp, Chlorella protothecoides
gctgagatacagcgcatacactctactccacgccccatggccggcccatgcggtgaaggca

SEQ ID NO: 38654 - DNA, 66 bp, Chlorella protothecoides
gacgtaggcctggtgccgcagcttccggaatggctgcttgtcccggtgccaggccaggccctctcg

SEQ ID NO: 38655 - DNA, 77 bp, Chlorella protothecoides
catctccgcctgaaaggggggtcagggggggtacatggcttgagaaacaatggtacatcctcatagggagcctggcc

SEQ ID NO: 38656 - DNA, 71 bp, Chlorella protothecoides
gggggtaggcgacgggagggttgcggcggaactcttacatgaatccttccgctgggtgcggcatgagactg

SEQ ID NO: 38657 - DNA, 3513 bp, Chlorella protothecoides
  modified_base (458)..(467): a, c, t, g, unknown or other
  modified_base (1122)..(1131): a, c, t, g, unknown or other
  modified_base (1542)..(1551): a, c, t, g, unknown or other
  modified_base (2011)..(2079): a, c, t, g, unknown or other
cgtgcgcagcagctctcgtgcgacctccagccgcgtcgcgccgactgcaaccgaggcggcgcaggccaggaccgcggcgcgctgcgcggggctgagccggccctccaccgacgtgcgcaggcgcaggaagccgcccacacgctccagcgccgccgactccagccggcgcagcgcctcgcccgcgccgcggcgctcgcccttcagcagagccaggcccgccaggttgcaggccaccactgcctcggtggcggcgtcgccgggacagcaggccatggtttggtggtacagggcctccgcctcgcccgccgcgccccgcctgtttttaatattgagggggggatggggggtggtagggttgcggtgagtttatgctgggagggtggaggcgaggggatgtggttctgaggggtcgtggcgcaaatgaatgcagacgagagcgcccgccgacaaagctggcnnnnnnnnnnaccccgcctgtttttaattttgaggtggggatggggggtggtagggttgcgatgagtttatgctgggagggtggaggggaggggggatgtggttctgaggggtcgtgacgcaaatgaatacagacgagagcgcccgccgacaaagctggcgtcctcctggaactctccataaccccccccccaccccccagcacccctctgcacgctccccctctttcctccacctcaccgatgcgccacgtaggccagctgggcggtgatggggaccagctccttggccagctcctcctcctccagcccttcctcgatcagggtttcttccccgacacgctgcgccagcagcaggcgctcctgcgcggcctccagctccccggtttccagcagcgcacaggccgaattgaaggccacctcgaagctgtccttgggggacgcctgacggtgaaggggggaaaggagttaggtgatcgggggggggatctgcaagaaattgactcttcgcacatttgtgagggggcggatgggtagggaaggaggagctagtataataaggcggggccagtgctgtgcgatgaacagtatgacagaacacctagggattgcagatcccagacccagcacagcaaagacttggcacagagtgaggctgatactgcannnnnnnnnntgatgaacagtatgacagaacacctagggaatgcagatcccagacccggcacagcaaggacttggcacagagtgaggctgatactgcaggatggctcccgactcgcaccttcatagcctcgagcacggcagggacctccgcggcctggccgcccgccacataggcggccagcacattggtctgcacctccatggtctctgccttgtactgctggaacagctggcggtagatggcgatcgcctcggggtactgccccaggcggtaccgcagctgggcctctagctggagcttggcctcctggaaggcagtgagggagggaggaacagaggtcgtcgcagaggcggtccactgggtccagtaacaacaccctaccagccacccacagactcaccccatggggccgatgtggcnnnnnnnnnngacagaggtcatcgcagaggcggccactgggtctagtaacaacaccctaccagccactcacagactcaccccatggggccgatgtggcaagtaatccccaagcccagcgcatggctagtagggtagggaggcctaattgcgtctgcatgcacaccccacgctcacctggcggtccttagacaccatctggagcgtgacgagggcgtcctcaagcttcccctccctgtactggcagtaggcgcgctcaaaggctagctccttgtccagcccatgcgcgctgattgcagccagcgcgtcggcaaatcgattcagctccagcaggaggaccaccttgcagcggcgcacgtcctcatcgctggggtccacattcagcactgcagggtagtggaggaggtgatggggctgggtgcgggttggaagccgaggctatgcaccgggtgccaccaccatcacccaggcnnnnnnnnnnnnnnnnnnnnnnnnnnnnnnnnnnnnnnnnnnnnnnnnnnnnnnnnnnnnnnnnnnnnntcggcggttttcaaagctttcttgtgccttccgctcttcagatgagtgtccagacgattgatcaggacactcatctgactgctgggctgagactccggcatccgcagtggagcgcgatggcgccggtacccagtgcctgctgtgcgggcctctgaaaggtcagaggtgcggctcactgacagaatgacagcatctgtgattcatctgagctggcattgcatgttcgttggggacatgcgctctgctgcgggaccgcattcctcagatcagagcaggcaagtggcgggagctcccgaggccccgtcccgacatatagcctgtgtgggactattctggactccaatgccaagcattagtgcttctcatggacctcgggtaaaaagattagccgcactcgtcattactgcttcctgtactactcatgcttgcagttttgtaggtggagtgggaacgaactcgctcggagcccgcagcattggacggggagcactcatccctcagcctgccgggcaaaacgcccacatcgagcatgtatgcttgcttgaggacaccctgataccgaatacgacggggaccaatgtctagggcggcccaactctgtcacacgatggcctagtttgctgtaccatcccagggcctgctgagcttgctgctgtccccatggtagggatccagatcagcattcaccatgggagagctggggtgattcgtgagatggatgagcttcctgggcaggaccaccagtcaggtccccctccaatggctcggcgtcgtctccccctcacaggatccacccccgccgccgccgccgccgccctaccccgacacgacagcgggagcggccccttcccccgcccctccggcccctgcccatgctcctgggtacgttcaagatgggtatgcagcgcagcagcagtaccaccagtaccatgggacctggggacgggagcctggacctgcgtaccccgggcaccccccgcatgcgtatgggcactacccgggccaccagcaccccgggtaccactaccaacagccacattaccacggcccagacccggcatacgggtgagtgacctggccgctggcacagtggagggggtgaaggggttgcatgatgtcacactgtctgccacaccccctaggcatgcatggagcaatccgtcacagagcctgcttaccatggccccatgcgtccacccctcgtaatcacggaccccgccctccgaactccccctcccgccaggcacggcgcgcccaggcctagctaccaggccgccgcgtctgtgtatgccccgccgccgtcggtccccgcggccctccccaggcccccgcagcctccgtcccagccccctcaccccccacaccccccagagtcgtacaacgcagtgccccctccccccacgctggcgccgcagcggagcatcccccccgccc

SEQ ID NO: 38658 - DNA, 123 bp, Chlorella protothecoides
aggtgtggcgtgcgtcataatgtgccgcatgcctcacaaagggcgggcatggaggtctggcagcgctgaggagcaatggccggggtgcgctaagagcacaggcgacgggaccgcacagcaacc

SEQ ID NO: 38659 - DNA, 382 bp, Chlorella protothecoides
  modified_base (84)..(315): a, c, t, g, unknown or other
tccccagcctctgctgtgggtgagtgatggggggtggcatccggcgcctgttcgggcctggggcttgccaggtgggggcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagggccggcccagcgttgtgctgagtgtcgcgcagcccctggaacgcctcgcgctgcctgcaacc

SEQ ID NO: 38660 - DNA, 16366 bp, Chlorella protothecoides
  modified_base (621)..(630): a, c, t, g, unknown or other
  modified_base (1518)..(1527): a, c, t, g, unknown or other
  modified_base (1800)..(1809): a, c, t, g, unknown or other
  modified_base (2088)..(2097): a, c, t, g, unknown or other
  modified_base (4812)..(4821): a, c, t, g, unknown or other
  modified_base (5433)..(5442): a, c, t, g, unknown or other
  modified_base (5882)..(5975): a, c, t, g, unknown or other
  modified_base (6800)..(6809): a, c, t, g, unknown or other
  modified_base (9321)..(9330): a, c, t, g, unknown or other
  modified_base (13024)..(13033): a, c, t, g, unknown or other
  modified_base (14369)..(14378): a, c, t, g, unknown or other
  modified_base (14649)..(14658): a, c, t, g, unknown or other
  modified_base (15995)..(16004): a, c, t, g, unknown or other
catcgccacgcagacggtgctggaggcggcctgggcggcgaccaacctcgcggtggggccgggcgccgcggcgcgcgcggtggccgccgcgctgccgccgctcaccgcactccttccgtcggctgaccgggagctggccgagcagctggcgtgggccatgggcaaccttgcagccgacggcagggagctgcgccggcgattggtggcggcgggggtcgtgccgctgctggcgaggcgggtcgtggaaagcgccgcgatgttttgtggagaagaggccggcgacggcgtaggaggtgggcaagaaccagctggcggcaacggacaggaatgcacggcggcggccgtcgcggcctgggccctgggccgcaccctgcaggacgctgagtcagcgccagtccaggcgctcctgtgcccgggacctaccagcctggggcccgcactggtgcggctggtcaggctggcgccgccggcgctggccacggaggccgcctggctgctggcctgctgcgcctctgcgcccgaccccgggccggggtgggcggccatgctggacgagggcctgctggagaccgcctgcgcccggctgcagcgcgccgtggcgggcggggtggcgacccggcnnnnnnnnnntggccatgctggacgagggcctgctggaggccgcctgcgcacggctgcggtgcgccgtggcgggcggggtggcgacccggcgggggcccgcgggagccttggcgcaggccctgctgcgcacgctggggcacatggtcgctgccggcgacgcagcgcgcctccggcccctcctgatggaggagggacggggcacgctgcacgcgctctgctcctgtgtggagagtgtagaccaggggctgcgcggcgaggcggcctggaccctgggcaacctggctggcctgccggggcgcgagggtgctgaggccgtggcgcaggcgggcgccgtccaggtccgattgagactggtgaaggcagcgggtggtctgccggggcatctctgggcctgggcatcgcggtgtgccgtgccagaggcggggtgctgtagtgctgcaaggtggatggcccttggaaacaagctgccggcctcgcggctgcgctgtcgagcccctccatccccatccctaccccaaaccaggcgctgctgcgtgccatggggaggggcggtgcactcgccgtccggcacgccatcctgcatgccttggccaacgtgtgcgcgggcgggggggacgggcgcggcgacgctgctgcgatccagtgggtgctgacgcaggcgggcgccaaggaggcgctggtggagatcgcggcgatggccggctgtgcagatgcacagtcggcggcgctggctctccaggtgcgatgccaggcttgagggggtgttgcaccacccccaccataccataccattgctctgctcgcccgcaatgcgatttgaacctcttccaagccgtcagcaagaccaacccgctccccacacatgctcccgtggttcaggtccaggagatgattggnnnnnnnnnnatgcaagaccaaccccgctccccacacacggtcccgtggttcaggtccaggagatgattgggcgctgctctgctcagggccaagctgtgtcactacgtgaacagcaatacgctgggccttagccatctgcagccgctgtggtcgcctgaacttgacggccggctgcccaaaaacacatgctccgctgcacgatgaggccaatgctcccattctcttggctcattcctttgctaatctacaacattgccacatgctctcgaagtgctctcagannnnnnnnnnccacatgctccgctgcatgatgaggccaatgctcccattctctcggctcattcctttgctaatctacaatattgccacatgctctcgaagtgctctcagatgtttgctcggcagatgctgttcctcatggactccttgatacttccagaccagccagggcctgggctccaacttgccctctgcgctgcataccctttcccagcctcacatttcattcctatgatcaaccaaacttgacagatagaagctggagtggcctgggtgctcacagtcgccatnnnnnnnnnngcaatcaaacttgacagatagaaattggagtggcctgggtgctcacagtcgccatgacaggcagcagcacactcccggtggggcgtgtcagggatcattgcgcaggtctttacctagatgatgtcttccaggagtgataggcacacgagagtctgtggggttggaagacacctggagtacaatccccaccagtcccaaacggtatatgcaggtgagctctgcccaattctagtccgttcccgtagcttcaagtccatctacagcgctgggggctggtgccaagggcccctcctcgtcctcgtcagcaccttctggctcctcagcacccctgcacggcgggcatggacatgtgctcagtggagtgccatgccatggtgcatgactgctggtccgcagattcgagatctgaagcctaatgggaggggacgctgcggccttcatcaaagtaggccccaccttgctttctgagcatgggtgcagccgcagcgtaaaggtcccccgcaggactccccactaggaaatgcatgtggtgcaggcagcaacatcaccccctcctcttccccttcgctcactgcttgagcgacgccctcatcttgtagtgctggcgcctcgcctccctgaaccgcctccgcttctcctgccgttccgggtcggcgctctccacgtcgccatcccgggccacgtcccaggggtcgtccacgctgaagcgcgggctacgccccgccaccctggggctgcgcccgacgctgcggtccgagtcgctccagttgctgctgcagctgggggcggggcccaggccggcgggcaggcgtcgtaccccatcctcccagccatgcccgcccgcggtcgagccgttggcggagggaccctcgtcatccagcttcagcggcgacatgcccgcgccatctgagaggtccccatgtgggtggatcagacggcgggtgtggcggggagatccaagatcagccgtgctgtgagctcccagtgcctctcccctctccccacacaccctgcccactcacccatgtccagctcgtcgtcggtctccatgggggagaggtagggcgtcttgggttccaggatcttctgggggttgaggtcccgtttgatgccctcgttggcctccaggttggcctcgtccctgggttaagaaggggacaccgcgaggctcttttgtgctgctgcaggagcaacgcaagcagccctagaaatcctagcttccagacatgctcagcccaacctccacagagcggtgcattgcctcaccatcgtatgccccccctccgtttctgggagcctgtggcgaccgcgcgcaggggagggagagcagagagcggcctcaccgtggcctcctctttctcagtcatagtgtcatgctctgtctcataatgcacagcttgcgtgtatgagcagggcatccgacaccctttcgtgcatgtcggtgtcgcccggggctggtcaagcgacatccacggccgggctcccgcccccgaaattcgactcgcctggtgtcccgataatgcatgactcccaccccacggaaatcgcctgcctgtctcctctggattctatcacatgcattatttggaatgaaatggaaccgcacctcccctgcattggcgtgaaaggctagactccagccgatgcgcgtcgcgcacgggcccgcccagctgccccccaccatgttgcaggcagtggcccgacggctggtggccgcggtcccagggctgaaaaatctgcccaggccagtccgattcgccagtcccctgctcctgaggcagcatggcatgcggaggggggccccagccttctcttccacctcctcactcctggagtccctgaacggcgcctacgatgcagaccagatccaggtaggggggtgaaaaagggcgatggtggagtaagatacaggtctcaggccttcattcgtggttccctctggtgtgctctgtccctctgccagccttcatgatgaactccctggtgggagcaggtgggctggacccgcactcatgcctcccccactcgcccctccaccacacccacgcggcacctccccttccccctctcccccccccttcacacaaaacctgcaggtgctgcaaggcctggagccggtgcgcaagcgccccggcatgtacatcggcagcacgggccagcgcggcctgcaccacctgatctacgagatcctggacaacgccatcgacgaggtccagggcggtcacgcctcccagatctggcttgagatggacctggcctccggctgggtgcgcgtgcgcgatgacggccgcggcatccccaccgacctccaccccgccacgggcaagtcggcgctggagaccgtgctcaccgtgctgcacgcgggaggaaagttcggcggcgaggccagcggctacgccgtctccggcggactgcacggcgtggggctcagcgtggtcaacgccctctccgcccacctcgccatcagcgtgtggcggggcggggtgcggcatgcgcagcggtatgcgcgcggcgtcccgctggcgccgctcgcccccgcgcaggggccgggagacgaggcgccgggcgggccgcgcctgaccccggaggcggagctgccgcaggccgcgcccagcggcggcgccagggaggagggcccgccgaacggcggccaggcggggccgccgcgccgcggcacagacgtcaggttccggtacgacgacgccatcttcgccnnnnnnnnnntcaggccgcgcccagcggcggcaccagggaggagggcccgccggacggcggccaggccgggccgccgcgccgcggcaccgacgtaaggttccggtacgacgacgccatcttcgccgccggcgcggcgttcgaccccgacaccatccgcgcccggctgcgggagctggccttcctcaactccggcgtgaccatccacttccgggcccggcctgccaagggcggcgacgcgccctgggaggccctgcactactcgggtgagggccgtggacttgtggcggggtgatgcgctgcagagcccggtgccactgcagaacctggccgtgtgggattacgggcactgccgcggcactctcatgcccgtccatatgatcaaccacccacccaggcgggctccaggagtacgtcaagtacctcaaccgctccaagacagccatgcacgaacccatctccttttccaaaaaggtgcttggaaagatgatgctggtggtgggcggcattccgtcgagcatgcgtggcgacctgaatgcctggtagcccacccattcacatggtcattgtgtctgcaccggcccatgcccgcctcccccctttccaccccaggtggacggcgtnnnnnnnnnnggcccacccattcacatggtcattgtgtctgtaccggcccatgcctgcttcccccctttccaccccaggtggacggcgtcaccgtgaacatcgcgctgcagtggtgcagcgactccttctctgacaacatcctggggtttgtcaactcggtgaagactgtggacggcggtacccacatcgacggcttcaagtcggccctcaccaggataggtgggcgggggtggagtgttggtgagggtcaatttggtggacggggagcgcaccccctgttctcaggagacatggcggccggtgtgatcagcaggcatgggcatctgtaggctggtgcatgtgtgactcagcatcccatcccaatgctctgggtcagcagacacacgatggctacttccccctcccgctcctcctcctccatgcccaacaccccttttctctccacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcgctgaaggagggtgaccccaacctgcagggcgactacgtccgagagggcctgggcgcggtgatcacggtgcaggtgccctcccccgaattcgagggccagaccaagacgcggctgggcaaccctgaggttcgccgcgtggtggacggcgtggtggccggcgaggcggcggccgcgctggaggagcagcccggcactctggcggcggtggtcagtaaggcgctgcaggccgcgcgcgcggccgacgcggcgaagaaggcgcgggagctggtgcggcgcaagagcgcgctggtgcgctccacgctgccgggcaagctggcggattgcgtgagcggcgaccgcgacgcctgcgagatcttcatcgtggagggcgacagcgcgggcgggtcggccaagcaggcacgggaccgcgggacgcaggccatcctgcccctgcgcggcaagatcctgaacgtggagcgcaaggacgacgccaagctgtacaagaacacggagctgagcaacctgatcgtggccctgggcctcggcgtcaagggcgcggaggacggcggcggcgcgctgcgctacgggaagatcatcctgctcaccgacgccgacgtggacggcgcgcacatccgcaccctgctcctcacttttctctaccgctaccagcccagcctgttcgagcaggtggggatgtgtcgtgtgtgtgtgtggtggtggtgggtgggggccgggtgagaagaggagaggagcgaatagggctcaaggatgtgtgcgggggtgcatggaggccttcgagagcgggaaagtggtggagaatgcatgctgggcaggtagggnnnnnnnnnnttgtgtgtggggggtggtggtgggtgggggccgggtgcgaagaggagaggagcgatgagggctcaaggatgtgtgcgggggggcatggaggcctttgagagcgggaaactggtggagaatgcatgctgggcaggtagggaggtgtgtcacctctgctaccccgccccattgccgcatctgccgccgccttcttccacctccacctctccagctcatgacacatgacctctgcattcacaacaacagggccacgtattcgtgggcgtgccgccgctgtaccgcctcgacgcgggacggtctaagcactactgctacgacgacgaggagctggcgcagcgcacgcgggagctaaagcccgggtcctaccacattcagcgcttcaaggtggaagatctggggcggtggaggggtgggtggcttgtcgcaggccccacacttcgtatcgttgcaatgcagactttggtgcgcccttgtcgacctgagcatgcgcttcctcgcgccgcttcactgccctgcaacccgatgcgctcacgctgtccagggcctgggcgagatgatgccggagcagctctgggcgacgaccatggaccccgcccggcggacactgcggcgcctgtcagtggcggacgcggcggcggcctcagacatgtttggcatgctgatgggggacaagccggccctgcggcgggcgctgatcgagaagcatgcggccggcctgcagctggaagagctggatgtctaggggcaggggttggcgcgcgcgcgcgaggcctgttctccgacatgtatgtaaagcattgctgccttagaggaagggtcgaagtgagccgtttatcaaaaatcacacatcgtcctgacgacacaggaggttgtgacagggtctctcccaccgatggatcagcaccgccagcactggcgtgtgccggacgagtcgtaccaggaggacttaccgaacgtcgacgatcttgaggtagcggcagcggcagcgggagacctgatgagacctgccgcctcctcggaccaggtcagcagcagcgagtcgagcgaggaggagagcagcagcagcggggaggagagcacctccgacgacgacgacgacgacgagtcccaggcctccggctcttccggtaggagacagaccatgtatgccgcttttcgtctcaaaatatgtcgatgtggcatgccaatgtcgccatgcaccccgcaggcgagcaggcaggggcggagtatgtggcggtcaggctcctgcccgatggggagggcttcaggctgctcctggactacctgctggaggatgacatgagctcccagggctcgtctgagatgtccatcgatgactttgtggacataagggagatgctggaggctgcagacatcgatgacgaggtgcgaggcgcaggaggcaatgggacttttctgccttgcaacagggctgcgctgtgttgggaaggtgcacctgcttacaggctacgcactgcacctcagcctccatggcttccctgcctggccactggtcccccaatcttgagcaaggcccatcattacacccaccaggacggccctggggacggctcggtgtcagcagccaaccaggctgcgacggccctgctcggaaaagaaaccctggcgacagacgtgcctgtcatcgacgcagaggaggctatcacccaggccgggaccatccaaggggtcttggagggcctcatcgttgttaaagtgggtggaggaggctgctgggtgggacatgctgaaacccctcgacacgccggcatcccttcctgcctcgcatacattctgcacctccgtgcatgcccccccgctcgtcacacccctcaccacaacctccgccgccacacaaaccatgacaggccagcgcaagcgccccggcgctgcacctgggcacctggctggtgctggccgaccgctcgccgctgggcgtggtggaggacgtgtttggaccggtcctgtcgcccctgtacgcgctgcgggccggcggcgaggggtgcgggaccggggccgggcctggcgaccccgtgttcagcgtcgaccgcctggcagaggtggtccacacggaggagctgcgggcggcgcgctatgacgcggccgaggaggaggtgggggaggatggccccgaccccgacgccaccttctccgacgacgaggcggtgagttgctgggttgtgcgttttcttcctttccaagtactgagaagagggacatcctctgcgcatgcctggctgggtgtggcttcgcacaccccagccgggaggggtgatcttgcatcccttcccatccaacggcccgaggtgtccagcgcatggcattcgtgcgcggtgcaagctgtccagacggcgcaccctcctctcgctcgctccaccccctgtcttgtgaccccaacaggaagccgcgtatctgcggcagctgaactcaaagaggaaggggtcagaggcgggacggggggcggggcggcagcagaggccaccccgcggcggcggcagcggccggggcaggnnnnnnnnnngcggggggcagggcggcaacagaggcccccccgcggcggcggcagcggccggggcaggggacccggcacttcacgccgggagcagcagcccgggcgcgagcagcagacgcggggccggggcgggcgggggcagggccggggccatccgcggcccggtttcagcagccccctagggcctcccccgcagcagcaagccatgcaggcaatgccctggggagggacagggcccatgcacggcttcccgcagcagcatgcgcagcatgcgcagcatgcgcagcaggtcatgggcatgttcccgcccggcacgccgtcatactttcccatgcacggccccgccgggtttgtgcctccgccgatgggtgcgggcttcccgcgccctggccctggctacccctttgcacccccgctgaacaggccacccccgcctccaggggccccgcctcccaggacagggtgagaaccgctccttcatttggactcaggcagaccgactgaattcagtgtccattgctgactgacatgtgtaacaccattgacaagtcatcctgctgagcgtgaaatgcggtgccaataacccacaccccatttcgggggcaacgttggggaagtgtttcgttcagccagttgtgcttcatacgacgcgatactgaagagtgctcgaatcgatcccgttgaggtaattgagaaaaatcagaggacctcgatggctgtggaacaggcaagtcgcgggccttgccgtgaagtggtggatcactcagtgcttgcgggctgtcccaaggctgcatcgtcccgtcgcgttaatggaacagatcattgtcgccaataggttgtattgttgagctcggatggagaaacatttgaggtgtccagggaggtcgcgaggaagtctgtcaccatcgagaacaccatcgacggtgcgtttaattatcatgtcagggttggttgggtcgctctgctcatgatgggatttgtgtgaaagatcccttcacttgtcgttcaccaatttcattcctcccacgcgaggcacagagactggcacggaggaccccatccctctcccgaacgtctcctccaagatactgcgcaaggtcatcgactactgccagtatcacatagacgccgagcaaaaggacggatcaggtgaggctgtggtggccaggcacagggctgtgtgcatggcaggccttacgtcgcagcggggtgcccagaccgccatcaatcctccatgtgtctcggcccccccttgcagacaagacagtcaagagcgacgcagagataaagtcttgggacatcgcctacacagacatcgaccaagggacgctattcgagctcatcctggtgagtgggaatgatggagcttggaggttgaagttgatgcatgatcagaggacggcactcaagccctctcccaagcatccatacctggcaccaatcacccatatcccccataggctgccaactacttgaacatcaagcccctcctggacctgacatgcttgacggtcgccaacatgatcaagggcaagtcgccagaggaaatccggcagcacttcaacatcgtcaacgacttcaccccagaagaggtgtgcagggaggcggctgggcgcgagactgcttgctccacacatgatccctttcccgacatgagctcacgtcactgctggagtgcaggaggaggaagtccgacgggagaaccagtgggcctttgagtgaggtccaggcacccttcctgtgcaccctggaggtgcaaacaaaggatcatgaggcgcaacattctggagtgccctctccctgtactgctaccttgcattctggttgcctgggggcaggggatggcgctcagcaacaacgtcaggcatgaattttccactcggcttgacaccaggacactgggaaagtgaagttgttctgtcgacgcaaggtgcatctctcaagggcagcagtcagggcaggcgaggcacccagagcgcacagaactctttaagtccaagttgtttgcacacatgtgcctgtcgatggcatcattgcccatccttcaacttctttgccgagtcgctggcatcatcagacttggctgcatccttgagctcagattcgaattcctgtattgtaggaatggaatgatgagatcttggccaagaagcagcacactgctcctacagtccagctttgatggtgatcgttgcacacatctcagcaacatcatcaacgtccctctgatacaaccagcacttgcaccttggctgcgctctggaagctcttagcggtccttcctagtgtcttgccaagctcgggcagcttgctgggtccttagagagagacaaatacgatatgtgaatgcaccagccatctggatccgttccaaaatcccactgcagcagcaaaggcacgtgtgccctgcctcaccaaaaataagagcggtgaccccagcaatgacgaccagctccggcacgccgaggccgaagattccagacactgccacgttccggcctggattgcgggcggttctccagagaggtggaggtgctcgcctctgcctcgtgaatgcggatctgctgctaatgcatctgggcgacgcagcgagagcggggttcgccgtgcctgcgctgcggccaacattggatttgatcatgcttgccgacattgcggcagcctctcacgttgatatgttccgactttataccgattggctgtgtttacatcagcaggcgtgttcagcaatgaattgcgaaggtcaagggagattccggagcgctctatgcatggaggatgacatcggccgcgctttccagctgctacggcacacgtctggggcaccgttcttatgcaacatcgggggttcatgatcgcatgttaccaccagagagcacgtccaccatgttgtacaggcgcttctccgccccctcccctatcttggaagccaggaagagggcagcatccacggtgccctcggcatacacccgccgccccacgacattgtgcttgaactccagcgtcactgcagacatcgcacgagaggggtagggtggcacgccactatcccaggttagactcgcatttcagctctttggcgtgtgccctgcagcactccacctcggggtgtcgggtttccctgcaggccagacacatgcagacaccccccatgccctacctgatccatcgggagaggtcacggtgtaggtatggaaggcgtgcccgttcagcgcgtcttctggtacctgcatgcgccctatttgctccgcagcctcccgtaccagctcaatgttgctctgggtgcgtggtgttgggaagcaggttcagggcagcttcatgctggccaggtgcagtcagcagacagctgggcgtcctgtgcacgtgcgagcggcctgctatctacacacataatgcgtcaatgctgcccatagccgcacttaccaggtcaaactccaggcccatccgctggaaggagtggatgttggcaatggctgtgcccgacgcatcggcctttgtggcttggtgcgactcgaccacacgcagggtgtaccccgatagacagcccgggaattgggccgccatgagctccagcatggtctgcagtgctacaatctggtggtgtgggaggggaagttggaggattgggtttgtcagggtgatgtacctgggtcgagtgtacgctgcactgacgactcacgccagaccttcaagtcatgaagannnnnnnnnncgctacgatctggtagtgtaggaggggaagttggaggattgggtatgtcagggtgatgtacctgggtcaagtgtacgctgcactgatgactcacgccagaccttcaagtcatgaagacttctcgcacgtcccaccccagacccacctgcttgcccatattgggggcgatgacagcgtagaccccagactccgttgcctcccgcatgatcttgtccctgtcgccgccagtagtgcccatgacaaaggggacggagttttcgctgtagaatgtggcattgcctggggcagagggtggcaggcttgattggtatgagggtgaactcagcgcttgccgagggtcacatgcgcaggggccttgggtcagcctagatagctcgcacacaagcacatccagactccacaactgccgctcaccgttcacgactgagggcagggtgtagtccaccatgacggtgccggggtattcctccctgacctgcagcaaagaattggtgggatggtatgggatcagcgtcaaccctcaactcacctggccggggtggaaggtacagcttgtatgcacattgccaggccaggctccatggatggtgtacacccgggcgcacagccggcattccaggcccaccctgtgcaggacgtccagcttctcatcggggtgcaccagagtcacttgcacgccgcccacatccaccgcgcggccgctctcggtggggcccccataggagaagggcaccagggtcaaccctgcccgcactgcggcctcagcagcagcatggcccatctgcagccggagccatgcatcgtgagcagctgtcaggaaggcttgttgtgaacctcacagacgagatttgcatcgtcaaaggggcacttaacgccccgctgtgcagtctcccactcccaccttgccactgcagctgttgaccatgatgggcggcttctgagaggcctgagtggcgacggatgatcggcgagctccagcatggcgctgcgttctgggaaccagtggagacagggcagagggcctcgaggccacggcatgcattgccgacatgggtctcgcgcccaccacacgccgtacggccggaggtatgacttgatgaaaatgtgcagtgcgcagccgggggaagggaacttcggcaagctccccgtcgattgatacgatgcgagagcgcgatggtgggtctctgcgtgtgccacctactatgcatgctgcgtatgctgaggtgaaggacggcttccacgcgatctggacatgttttcggtcaaaccataaagtcaatggctcgtgagcgtcagtcaaaatgataggatcttgggcgggctactatgcaatgcnnnnnnnnnnagctcgtgagcgtcagtcaaaatgctaggatcttgggcgggctactatgcaatgctcctggcatgggatgggactcttgccattgggaccataccaagtatgcatggtgacattccctcaatcggcgtgctcctagctgagagctagagttccattacaaggaatatcaagctgcatccagacgggcagagccctcgaggtgttcctgcagacacaaaattgccatgatgctaagctcagcatcataatgcactcaattgcccagcgcaannnnnnnnnngcaaggaatatcaagctgcatccagatgggcagagccctcgaggtgttcctgcaggcacaaaattgtcatgatgctaagctcaacatcataatgcactcaattgcccagcgcaaacatattcacagcacagatttacacttggattgtataagtacaacttgcaatttgtatccttgaatcctttcccctccctctttgccactctgtgcatcgcccagaatctaattttcccttcaccccccggtgctttcctccgcgagagagcaagtgagctaattgttgcaaacaacagacaagccatcccgccttgcaatttccttgaacatgtgtcattagttcggccgtaaggatctgagcaggaagagtctctcgaccttgtcacagggagggttcgcaggtccgtaccgctgatcacaccgcaccactgctctgcgcatgcaaccagagccttgcagcgccaccgaggtcctcgctcacacatttaagcacttttggcatagtttggaccgacatcgtgactctcagcgctttttcattcagcgacatggcggatgcgggatcaagcaagacaaaatacacaaggtgggtgtgcatgggttgcgcccggcctcgttcccgcccacaggaccccaaagcagcttcccttgacatcacagggatgagatcatggccgtgaagagcgtctgcgtgagcttcccccggggattgaaacctgtggacatcaggtactgctccacgctccatgcgctcctgttcgccgtgcgggtgtgcatgctgctgcctcaagccagctcctgaatcgcgccaatccccgtccactctcgcccccaccctgcagcgacctcttgtgcagcgcggacctcgtccctgcaccggacatctacctgggcccgcagcgcggcccaggcagaggccccggctttgcgctgggcaggggaaagccccccgggctcacctcaccaggtgtgcatgcagccggggtgaatggggtgtgtgccggcggccatgctactgtgccccatgctcccccaaccaggctcagtgtcgacaagcgtgccggctgccgaaccccccaccttccccccccccgcctcctcagatgctcccggcgcgccaccgcgggggcccttgcctccacccggcgagccactgcgtgcagcgggcatggagcgggtgcctgggcggcccgtcaacatcccagtgaggccgggcgggttccggagggggttgctgcaccgacatactcgcatgctgcgctcggtgtgcgatgcacggagcagcgagggtggccggaggcctgtcctcccccgcacccgggtctcagagctcccggggnnnnnnnnnnggacatgctcgcgtgctgcgctccgtgtgcgatgcatggagcagcgagggtggctggaggcctgtccttccccgcacccgggtctcagagctcccggggtggacctgtgcccaagcacggggcgctgcctgggtcgccctccccctcgccccacccctgctccccctcgctctgctcacaggcccgggagccccgggacgagcggcaggagcgctgggacgcgaagaaggtggcgcccgggctgagccccggcgacccctcccccccctccgaagccaactggaacgcgggcaaggtggggcgcggcgcgcgcggcgccgaggccgaggccgcggcccggggcctgggccgggcgggggccg

SEQ ID NO: 38661 - DNA, 399 bp, Chlorella protothecoides
  modified_base (107)..(279): a, c, t, g, unknown or other
gtatgcgcccttgacgtcggcaatggcgacatgttgggcagcccgcagacctcgggtgggggcgagaacaccgcaagccagagcgccgcccggcccgtgttgaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgcaagcaacatcgcctgcgcccaggcctgtgggatggcgtctttgccgccttcgccagcgtcacggccgtgggtggctttctcgcccagctgcaggtggcaccagtcggcttgcccg

SEQ ID NO: 38662 - DNA, 1097 bp, Chlorella protothecoides
  modified_base (316)..(325): a, c, t, g, unknown or other
  modified_base (788)..(797): a, c, t, g, unknown or other
cgggcgcgggcgcgggcggcgctgacctggcggccgcgctggaggtgctgggcgtgctgcgcggcgcgctgaccacgccgggtttgcgccgcttgcactgcctccgtgggctgccggagcgctgcgccgccacggccgccgccgtggacgcgtgcctggtggccgacgccgtcgcgttgaccacgctgcgcgacctggagagcgtgactgcgcacgccgtggccaggttccgcgaggtgcgaggaccggtggcggcgccgacggggcagcgggacggggcaagcccggggcctgcagcggggccccctgctcggannnnnnnnnncggaccggtggcggcgccgacagggcagcgggacggggcacgcacggggcctgcagcggggccccctgctcggacgctggacgagtgcctggcggaggcggaggcggacccgcgcctggcggcaccgcccgcgccggccctccattccctggcggcgggcctggtgagggcggggcgagtggcagaggccgtgcgcgcgcagggcgaggcggcctgcgtctcgctgggcgcggtgctgaggtgaggagctggtgggggttggggagggggtggtcgtgcccatgtctgagacacgcccctcggtggtctcgcgcgcaggtagacgccgcagtgccccatcctcagcactcacaagcacatcccccacccccctcaggcacgccaccgcgggctgcttgagtgctgctttggccggcggcgcgggggagtcctgcccgccaccggccgcgcacgactcctcagnnnnnnnnnntccacccctctcaggcacgccaccgcgggctgcttgagcgctgctttggccggcagcgcgggggagtccagcccgccaccggccgcgcacgactcctcagaggaggacgtggcggcccccgcaatccccgccgcgctctgcagttcaccaacattccccgcttttctggacgccgcgctggtggccatcggcgtcgtgctgcggcatgccggggctcgggccgcggccatgcgcagcgcggtggccgccgccggggccgacgacgccgcgctgggcgcgttgggggcggcccagcgcgac

SEQ ID NO: 38663 - DNA, 61 bp, Chlorella protothecoides
gcaatggttgattgtggatatatcggtgaagtgaatgtgatgctggagtttgaggtagctg

SEQ ID NO: 38664 - DNA, 61 bp, Chlorella protothecoides
catgttgtggtggatggtttctgtggaaggggaaggagcggctgaacgcccgtcctcccga

SEQ ID NO: 38665 - DNA, 61 bp, Chlorella protothecoides
catctctcgtgccaccatcctccgcacatatctgtgcaaaattggggtgactggactgaaa

SEQ ID NO: 38666 - DNA, 61 bp, Chlorella protothecoides
gaggcagagaaggttcgacctaatggctcccatcctttcgccgcacggccaggaaaggatg

SEQ ID NO: 38667 - DNA, 77 bp, Chlorella protothecoides
ggtacctatgcaggcagtgagtatcggggaggggggtggctaggtgtacatgaggtagaggtgctgaggagccagtt

SEQ ID NO: 38668 - DNA, 61 bp, Chlorella protothecoides
gtacagcaggccaccctgttctgggcggaaccgggcgaggccccgtcggtgcgagtgcctt

SEQ ID NO: 38669 - DNA, 79 bp, Chlorella protothecoides
gaaattggaacctggcagcctcagcccagccacttctctgtcggcctgcccagccccctcgcccacgccatgcaggtct

SEQ ID NO: 38670 - DNA, 61 bp, Chlorella protothecoides
cttgatgcccagatagggctgaggggaaggggaggcgtccaggagctctcgggcgtccaag

SEQ ID NO: 38671 - DNA, 65 bp, Chlorella protothecoides
aaaaagggtgtggtccttgccctgtggtcgagaggcccggggggggggggggggggggggtttgg

SEQ ID NO: 38672 - DNA, 80 bp, Chlorella protothecoides
gcatgccagggcgtaggtattcaacaccccaccccccaccccccacccccccgcactgaatgcatgacctccagtcactc

SEQ ID NO: 38673 - DNA, 74 bp, Chlorella protothecoides
tgactgtaccgtgtgcgcgtgtgaacgacacgaagagtgccaccgcgtagcggccagcttgcccgattccctcc

SEQ ID NO: 38674 - DNA, 64 bp, Chlorella protothecoides
ggaggagtgtggagaacatgagggcagccgatcaggggtcggacagtgtccggtgcaaggcgca

SEQ ID NO: 38675 - DNA, 75 bp, Chlorella protothecoides
ggaggggcttgaattccagaagagagcaagcagcgtcagtgcgcggcggcctcgctggccccccacccatccaca

SEQ ID NO: 38676 - DNA, 61 bp, Chlorella protothecoides
tgatgtccaccatccccgaatccttgcctcccaggagtatgtcatgctgacctgctggcta

SEQ ID NO: 38677 - DNA, 78 bp, Chlorella protothecoides
gagccggacacggatcggacgggcgctaggtgggggtctggtgcctggggaagtttgtgggtgtggaggggagggcag

SEQ ID NO: 38678 - DNA, 92 bp, Chlorella protothecoides
cagcacggtcgtccttgtcgatgctggctctgcactgcctcatgcacctcagacggcccacacccggctcacataaccccccggctcacata

SEQ ID NO: 38679 - DNA, 74 bp, Chlorella protothecoides
aacacatgctaacctctgtgctgtgaagatgcctggcttgcatgggggttttcctgccccctgagctcaccctc

SEQ ID NO: 38680 - DNA, 61 bp, Chlorella protothecoides
gacggggaactgcagaccagccttggaggatttgctcacggccttgctgccggaggtcttt

SEQ ID NO: 38681 - DNA, 431 bp, Chlorella protothecoides
  modified_base (111)..(353): a, c, t, g, unknown or other
aaggtagatggtggtgtttggatggtaggtggcggtctgctcccctgcatgcagggttgtggtaggagttgtgttctcttactctttccacaccacaacccctgccgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacgtagtagaatatcttattgttcacaagaacataagaattacgggccctgccgctcgtacacttgcatgtacgtc

SEQ ID NO: 38682 - DNA, 105 bp, Chlorella protothecoides
gcatcgtcgccctcttcttctcaggtctagactgctattcaacttttgctttctgcgggggggagggtggccggaggggggctggtgggtaccgctgccaggggc

SEQ ID NO: 38683 - DNA, 99 bp, Chlorella protothecoides
ctggctcctcccagtcacccccctcgtccaacacaacccgtctcgaccacacctccaccgggcaggaatgacgcgcggctggacgagcgggcgctgtgg

SEQ ID NO: 38684 - DNA, 61 bp, Chlorella protothecoides
gaggaggcgggtcttcaccatggtgtccagatcggaccacttggacaccagatactccagg

SEQ ID NO: 38685 - DNA, 74 bp, Chlorella protothecoides
catgcgcgcccttcaccctcctctccagccgctctcctcccccaacctcggagttgagcgtgacgctggtgaag

SEQ ID NO: 38686 - DNA, 106 bp, Chlorella protothecoides
gcggccgggggcggcggcgatgcccgagccggcggcggccgagtcctcgggctctgggaaggaggggccggagggtgatcccgagacgggggccggaccgtcgctg

SEQ ID NO: 38687 - DNA, 71 bp, Chlorella protothecoides
ggacggctcgaccgcgctgcgcattttcgccgagctcgacacggcaggcaggggtgaggtggggcgttgga

SEQ ID NO: 38688 - DNA, 78 bp, Chlorella protothecoides
ggggtcgggtgctcagagggggagccaggggggcgagcagctgctggccgtgtggcgtgagtgatcaccgggactgca

SEQ ID NO: 38689 - DNA, 79 bp, Chlorella protothecoides
tcgccgtgcggggtgcctcggggcggcctcgtgcaggcccagctcagttcctctctcgccaggggtgcggcatccgaga

SEQ ID NO: 38690 - DNA, 1774 bp, Chlorella protothecoides
  modified_base (148)..(222): a, c, t, g, unknown or other
  modified_base (474)..(483): a, c, t, g, unknown or other
  modified_base (1264)..(1273): a, c, t, g, unknown or other
gccgccgccccgggcccgcccctggccagcgtgcggcgcccgcgagagccggagcccttcgcctcgccctttgcgcgcccggcccccggcgcctcagcgcgcgggcgtgagcggcatgccagggccggcgaaggggggcgtgccgcgnnnnnnnnnnnnnnnnnnnnnnnnnnnnnnnnnnnnnnnnnnnnnnnnnnnnnnnnnnnnnnnnnnnnnnnnnnncccccaggcgggcggggggaacccatcctgcccgggccccttcctgcagcggcagcgactcgcccagcaccagcatgagcgagtcatccatgcgcagcccaggcgagggatgggtggattggttgtttcttggggtgatggggggtgttgagaggcgggaagaggtccttgtcggccattggggtgtttgaaaagaggtgtccaggccccctcaggaacttccccacgctccctcagcctgcctggggccannnnnnnnnngcattggggtgattgaaaagaggtgtccaggccccctcagcaaccccccacgctccctcagcctgcctggggccatgggtgttggacaccgtgggcctctgttcttaaagctgcactcgccacggcttcacagccgccaccccagaatccccccctgccatctccccctccgcccctcccggcccgcagactcgctgctggatgtggggcacatgtcggggcggttgggcccgcggtcctgccaagcggggcccttccgcgccgtcaacccgctcgcgctgcacatccctttcccccaccgtggcggggacggcggcgggggcggctcacaccccgtccgcgccgccagcatgggctcgctgccggcgccgcaccgacggcgcgcgagcgtggaggcgtcggcgcggcggggctcgtggacggaggcgccggcgcggcggggctcgtggacgcaggcgccggcgcggcggggctcgtggacgcagggcctggcgcctccctgcgcctgggtcccctgcgccgtgcccgagggcgcccccgacctggagaggttcctgcagagctccacgccggtgctccccttccacgacgacgccgagctggccgccgccagcctggtgagcgtgcctgcatgcatgcgggcggtcgagggggaggtcggggccgggcccctgggcagatgcccgatgctccccgggacccggggccggatgcctgtccatggacaggggtgacacaccctggtccagtcgcccagcaccctccccatcccagtcacccnnnnnnnnnnggggccggatgcctgttcatggacaggggtgacacaccctggtcgagtcgctccgcaccctctccatcccagtcacccccagccccacccccaccccctcaacaggcggacgtgtggatggtgtacgaggagtccagcgcctttggcctggccacgccgcgcctgggcgcgcccgtcggcccctgcagcgccgcctacctgcccttcctctccgcgctgcacacctttgcccccgaggacgccccgccccacggcaggccgggcgccgccacggccgaccccggcgcggccgacagctgggccgcgcgcgcggcgcccagcttctcctggacggcggaggggcacatgacggagcgcgtgccgctgtgggagcaggtgcgcaagctgcgcgtgcgggaggaaagcgcggtgtggggcgcggcgctggccgacctgcacccattctcctggttcgcggtggcctggtacccgctgtacagcatccccgactctcgcgcgcgc

SEQ ID NO: 38691 - DNA, 84 bp, Chlorella protothecoides
ggagggaggtagatgggcgtcagagcacttttccagggttgtggctgcccattccctattctttcgcagccgattggaccatgt

SEQ ID NO: 38692 - DNA, 61 bp, Chlorella protothecoides
gctggaccgcgcgctggaggtgttcaaggaaatggggtcgcgcggggtgcggcccaacatc

SEQ ID NO: 38693 - DNA, 73 bp, Chlorella protothecoides
tgctctgctctgaactgccccgtttcctccttcaaaaccctcttgcagagaggggatgtgtcgtcggtgcggg

SEQ ID NO: 38694 - DNA, 95 bp, Chlorella protothecoides
cggggaatggggtgcagaaggagcaggcgaatctctcccctggacctacccctgggcccagccccatcacgcccgtgactgagcctgaccgcccc

SEQ ID NO: 38695 - DNA, 64 bp, Chlorella protothecoides
gccgctctgcatcccggaggtgcaagggcatgcggcccgctgaaacgaacccctcctgccccca

SEQ ID NO: 38696 - DNA, 77 bp, Chlorella protothecoides
gaggaaggtgcaggtctgcgactcggagacagagtcctcgacactgatgtcgtgtgctctgcaggccagcgctggca

SEQ ID NO: 38697 - DNA, 251 bp, Chlorella protothecoides
ctctggcgggcagagttttggcccaggttggagggcatgttttggcccctgctcaccgcagcggccctcaggcctgggcgtcacccacgagaaccctggaggccccgggcagccacccagctgtacacaagctcggcggtgtagcccagccgcctcccctccatgcagttcccttgtccagatgcacgcgccctttggcaccctcgcaaacacccctcgcgttggcccccctcttcaccccacccactcca

SEQ ID NO: 38698 - DNA, 61 bp, Chlorella protothecoides
tcccgcgaccccgacgtccaccgaggaggctgcgcggctgaggggcgcgagggaggaggcc

SEQ ID NO: 38699 - DNA, 61 bp, Chlorella protothecoides
tgtgaagccttgtgcgcccgaccgtgggccacccgccgtcttcgactccctctggcgtcag

SEQ ID NO: 38700 - DNA, 146 bp, Chlorella protothecoides
cgggcatggcagagcatgcccgcagccatcgaaagaattggcctctcttctttggtccatggacgcggggggagggggaggggggggggtggcggtgccaccccaggcctcctcagttcctcaacccccggtgctggtagaccggg

SEQ ID NO: 38701 - DNA, 105 bp, Chlorella protothecoides
ctcatcctgctgctccctccctcccctacccccgccccctcctaagcatcttacagcggagcccccagctcgccagcagggcagatgagcgtgtggggggctcct

SEQ ID NO: 38702 - DNA, 90 bp, Chlorella protothecoides
ggagcaaggggtgcaggcatgctggtccccgggcaaatgtcctttccctccacactgatgccccgccctgggcccacctctcccttgtag

SEQ ID NO: 38703 - DNA, 115 bp, Chlorella protothecoides
cctggccctggtggagaccggtatcaaggtagagctgcggaccgaggggcagagcccctttatcgcccacctgccgggccaggcggggctgggcgaggcgcacgccttccactac

SEQ ID NO: 38704 - DNA, 170 bp, Chlorella protothecoides
aggagcaatgacagtccccaccattccccttgcctccccccggaaatctcccagctccctgatacctgaaggcacttcaaacccctcttggatgcctctccctcactcctcctcggtacctttctgcggcttgggcgtcccccaggtcccgcaccagccggcacccgagg

SEQ ID NO: 38705 - DNA, 80 bp, Chlorella protothecoides
cactgtgcaagaccaagctccaggccagcgtcctcaggcgagtcacctcgcggtacagggatgggaagaggccgtctggg

SEQ ID NO: 38706 - DNA, 73 bp, Chlorella protothecoides
cgagaagctagaggtgtgtgtgcaggaaatgtatgtgataaacatgtatgccttactggcagcccattgcgaa

SEQ ID NO: 38707 - DNA, 75 bp, Chlorella protothecoides
ctcattcaccgaacggccaaggtcaggacatgcggagacccgagagagcctgaatcgccggatcaccatcctgcg

SEQ ID NO: 38708 - DNA, 69 bp, Chlorella protothecoides
tgaagtgtccccgaagaatcaacccccccaaccccccttccttctcaccgaacttggtgacgcacgcgg

SEQ ID NO: 38709 - DNA, 80 bp, Chlorella protothecoides
actgcacacaagatctgtttcatctgcacctcagtactcttcatcactacatcctcgttatttctgtgtattcggacgtg

SEQ ID NO: 38710 - DNA, 150 bp, Chlorella protothecoides
tgggggagcagtgggggggggcggaaggggggccagggagggcgcgtggctgatcttgagggcggaaggactccgggatggctttggtgctgtttggggacctctgcagcactgtactctacaacatcatgtgtgcgagtactggagatt

SEQ ID NO: 38711 - DNA, 61 bp, Chlorella protothecoides
gttgaaggcaactgcccgggccgcggggagatacctgtgcattggggaagggggggggtga

SEQ ID NO: 38712 - DNA, 11210 bp, Chlorella protothecoides
  modified_base (384)..(393): a, c, t, g, unknown or other
  modified_base (1260)..(1269): a, c, t, g, unknown or other
  modified_base (1649)..(1658): a, c, t, g, unknown or other
  modified_base (2175)..(2184): a, c, t, g, unknown or other
  modified_base (2724)..(2733): a, c, t, g, unknown or other
  modified_base (3435)..(3444): a, c, t, g, unknown or other
  modified_base (4095)..(4104): a, c, t, g, unknown or other
  modified_base (4742)..(4751): a, c, t, g, unknown or other
  modified_base (5813)..(5822): a, c, t, g, unknown or other
  modified_base (6596)..(6605): a, c, t, g, unknown or other
  modified_base (7341)..(7350): a, c, t, g, unknown or other
  modified_base (7431)..(7440): a, c, t, g, unknown or other
  modified_base (8245)..(8254): a, c, t, g, unknown or other
  modified_base (8891)..(8900): a, c, t, g, unknown or other
  modified_base (9024)..(9129): a, c, t, g, unknown or other
  modified_base (9203)..(9212): a, c, t, g, unknown or other
  modified_base (9581)..(9590): a, c, t, g, unknown or other
gcggcgcccaggcggcgccactggctccccacccgcgccgacccagggggcggcgggtcgggggatcccgccgcgtcgcaggccagggcaaagggcagcagggcctgccgggacatggcctcgcagtaccgctggtactgcacctcgatcgaacgcaggcgctcgcacccctcacaccaccattgcagggcgtgcagccagccctgcttcgacgcggggtcgcctggggccagcggtgggaagggtgccggggatcgactctgatggacggggcgcggctttcgggacgagagcaatgagtgtggagcggaggaggttgcagcgcccttccccgtcccccaccccctatcacgccgactcacaggcaaagaggaagaaggcctnnnnnnnnnnacgcggctttcgggacgagagcaatcagtgtggagcggagggggtcgcagcgcccttccccgccccccaccccccacccccccgactcacaggcaaagaggaagaaggcctgctccccggcaaacaggggccactcggcatgcgttatcagcagggggccccgccgaatgtactcagagcggccattcagcccatccctgaccagctcgactgtgcacggggcggaggaatggcttgcgtgcggtcaaggccgggggaggctgggcccagggcaggcggctgtcgtgtggctgcagctcagcatcatgtgggggcccgcggaccaaccaccctgcacccaccccgggccccctccctgcacagtggctgtgcatcctccccgccccccggccttgcccgcacccgagcacccctccaggggaatgccgactttggtgggcggcgcgctgtccgcgcccccgcgcgtcagcaccagcgtgccctggtcgagcaccgcatcccagggggccaggctgggctcggtgacgggagagggcggccacttgaccacggtggcgtcgcgccgccaggtggaaaggggggccaggtacaccgggccggcaaaccagccccgcactggggtcgtgtgcggcggccggccctggcacgccccagggtccggcggcggcggcatggcgcgggcctccggagcggggtcctgtctgcccgggctcgcctccggcccgttcaggctgccgacgtgcgtgaaggccaggaagagagcgacctggtcggcggatggtggggaagctcggaaggatgcgggtcgggcgagcagggacggccccgggccagcgaagggcgcccgcccgcgctcgcagcatgcannnnnnnnnngagctcgaaaggatgcggctcgggagagcagggacggcgccgggccagcaaagggcgcccgcccgcgctcgcagcatgcagcgcaccgcactcccaccggctcaccgtgcccgccacggtggctgcacaccccagcacggccccgaggagcaggacgccgagcatggggagccatgcctgcagtgcccaggctgaagcagccaccctgcagccagggacccagtggggggaaggcagggatcaaggggtcaagggcaggccaaagggctccactggagcattctccatgaaacaccactcaccctgctgccagggaaacatgggtccacggccaggcgtgggaggggcgccactgcgggaccctttcacgcagagtcatnnnnnnnnnnagagcattctccacgaaacaccactcaccctgctgccagggaagcataggtccacggccaggcgtggggggggccccactgcgggaccctttcacgcagagtcatgggtcccggcgcggtttgtgaggggaggggtgacccaaagcaaaagaatcagctgtgaaactgcccatggtgcgggtcagcagcacgaagcgaagcctgatcggtcgggagcatggctgcgaggccttggatcactccagggggccatgaactggcgcacccaaccgaccgtcggacgcttctcagacactggatccaggcgtgcgttaatctatgtttgccatgcagaccattacctggcgggtgcagggaaaccctgggcccctacatggatcctcgtcgccatgtgcaggccgagcttgcgccagctcagcaccagcagggaatctgcccctctctggcccgtcggcagtatttctgttctttcgtgtgatctttctgatgtactgaagcatactcctgtcgatccacnnnnnnnnnnttctatgtttgccatgcagaccattccctggcgggtgcagggaaaccctgggcccatacatggatcctcttcgccatgtgcgggccgagcttgcgccagcccagcaccagcagggaatctgtccctctctggcccgtcggcagcacttcttttctttcgtgtgatctttctcatgtactgaagcatactcctgtcgatccacagagcagcgcctcaaccggccagagacaggccatggatcactcgcgcctctccttcaccatgagagcttgtggggatgctctccggtgaggcagcatgccgcgggatcccttcttacccgcgctcgatcggcccagctccgtggtggttgcacgcaaccgcgctcgcaaccagtggcgactggtgctgaccaccccggccaggtgggggggtctggatcggtaccccttgggcctttatatattgctgggaccctgtgctcatgtgaaatgcatcattaaccaactgcacacatcacaccatgtatcgcttgcgcagtccccagaccgaggtcgtggnnnnnnnnnnataatcaactgcacgcatcacaccatgtattgcttgcgcagtccccagaccgaggtcgtggtcatcgatgacgccagtgggctgctcctgtgccagcccggcccaggcttcccctcagaggtttgtgcaggctaaagggcgctgtgggtttcctgtcttctctgccctgtaaggtagcagagcagcacgagggaggcccgaatgagcacagcttgggttgcagcaccccactcctggcacctccatctgactgatccctcctccccccctcccctccacgccatcgtccagctggcggcgctgtcctccctgcacgcgctcgggtacgaggccgagcaccggggtgacgccctgctgggctacgtcgcaacacggtgcgttgccggcgtgctgctggcgacgaggacgcgggagaagggggtgctgcctggcgggcatgcgctgctcacactcacggagagcgcctggctcctcctgcccctgtcgcaggttgaaggatggggtccctggttgtgcgcgtgtatgtgtggtggtggggggttgggggttgggaggcggcctggggtggtgaggcgccgaggagtgctttctgtggggcggggcgcatgcgtccaggccacatgccaccgggggtttgcccccccccatattcatcctttccaattcccccccacacaaattcttaggccggtccggggggcnnnnnnnnnngtcctggttgtgcgcgtgtatgtgtggttgtgggggttgggggggctggagggggcctggggtggtgaggagccgaggagtgctttctgtggtgcagggcgcatgcatccaggctacatgccaccgggggtttgaccccccccatattcatcctttcccatcccccccacacacaaattcttaggccggtccggggggcctggaggtggccagccccgcggagcaggagttctggcgcctgctccagcaggtgacgctggacggcgcgcactacttctgctggacggcggacctgtcgcgccccttcccctccccccgccctgccgccgaccccgcccccgagttcgtgtggaaccggtggctgtcggcgccgctggcgcgcgcggggctgccggggcgctgcccggtgctgctccagggcgcggccgaggtcagcctgcacgccggggtgggcgccgcgccgcccttcgccctggcgctcgtgtcccggcgcagccggcgccacccgggcacgcgctacctggcgcgcggcctgaacgaggccgccgggcccgggaacgagatcgagtgcgagctggtcgcctggacgctggcacgcgggggcgcgggcgggcgcgccagcgtgcgctgggcctgctgcgtctggcgccnnnnnnnnnntgagatcgagtgcgagctggttgcctggacgctggcacgcggggccgcgggcgggcgcgcaggcgtgcgctgggcctgctgcgtctggcgccgcggcacggtgcccatctggtggggcgtcagcctggcctccctgcagaaaggcctggcggcggaagtgtacgtgcgcgagcgcgacccctaccgcggcagcgccgcctacttcaggggggtgcagcgtgcctgggcgcgctacgaggccgggcagacggcggctggggcgggcggaagcgtgcgagctgggcaggcggtggctgaggaggggagcgcgtcaggcatgcaggcggctggcgggcagggaggcgggggggccacgcccgcaaaccccgctgcgtcagaggatgcagcagaggagggcctgcacgtccccgtcacctgtgtcaacctgctgcactgcaacccggccaaggcctccgagctcatgctgtcctcgcacttccaggaggtggggcgtgtgtgggctggcagcaggggggcctcaaacaggatgcgatgtctggatgctggggctgccacgcgctgtcgtcggggtgggcccacccccacaagctgtttggcgacacccaacgccctgcccaccgaccccaaccccccagcannnnnnnnnnggcactttcgtcggggtgggcccacccccacgagctgttttgcgacacccaatgccctgcccaccgaccccaaccccccagcagagcatgaggcatgtgcgccgcatcctcccccccggtgctcccatccgggtcgtgaacttcgactggcacggcaacatcgggaggctgggcgaggagaagggggtggagggcttctggtccttcatggagccctttgtcaagcaggtgggcccggggaagggtcccctggtgttggtgtgttgcatttggctgtggaccaaggtttgacatggaggtggagtggaggggcctgcatcgcagccttgccatggtcgagcccgacccttggtcatccatgtcgaacccgcctccattgctccctgtgcagacggggttctcgcacggcaccctgcacgatggcggcgcagtgggagaaggcagcgagcgcgacggcatcacgaccagcctgggccccgcgcgccgcaccccctgggccggcggctgggtggcggagtgggaggcgcgccaggcgggcgtcctgcgctacaactgtgcggacagcctggaccggaccaacgccgcgacgtgcttcgccacgctgccggtgctccaggacgcactgcgcacgctgggcgtcgacctgtgcgtcgggccggggcgggatgcggggggcgccgcgcgctcgggggtggaggagggcggcgccgtgcggccagacgcgggcgccctgggttccctgccgccgccgcttgtcgcaggccgtccagcgtctacggagcaggttccccctgtgagtctcgtgagggccaggatgcagtgccagccagctgcacgcatggctattctccgcccgacccagccatccgacaggcgccacttgccacccaatctccacgttttgtttttgcatgccattggcctctctcgggcagtgcagcagccaggtgttccagacggccaggcaatctcggtccccatcccacccctcctccccttcccatcctgctcgccaggggtgggaggtgcggtggcacggcggccggcccctctacatcgacnnnnnnnnnnaacggcctggcaatctcgatccccatcccacccctcctccccttccctcctgctcgccaggggtgggaggtgcgatggcacggcggccggcccctctacatcgaccacgccaaccgcaggacgcagtgggaggcgcccagctggccagaggggccggatgcacaccccgcgcaggcggcgagcggcccggcagccgctcccgaccccggaacgggtggcagccccgcgcgggtcgaagtccccccacccggcgccacggccgtcgccctggcacagctctccctgcggcaggggcgggaggacggggcgccggacccagccccgccgccgggacccgcgcccagagaagactcggggcacgtgcggccggtggcggggccgctcggctcccccggccccgcccccccgcaggggccccagccttgggccttcttcggcctgcggggcatggccgaggtgcgggcccgcctgcgccgccctgtggtcgccgacttcgtggaggccttccgcgtgcacggcgacatcaactccttcctctacaccggctccccggccatgcactcccacgtgctgggcctggtcctccaggtgccggcaggctcagttggctcaggggtgggagggagggaatcaatggatgcgcacgccttgccccccctccaccgagaccgcaggagcgtcattgtggggtgggcttcttgagatgccggtgcatgggagcgcaccccctcccaaccacgcaccccctctcctcacctcgcagaactcgagccnnnnnnnnnncctgggcctggtcctccaggtgccggcaggttcagttggggaaggaggggatccatggatgcgcacgcccctcttcccgacaccgcagatgcgtcatcgtggggtgggcttcctgagatgccagtgcatggcagcgcaccccctcccaaccacacacacccctctcctcacctcgcagaactcgagccggacgtacagcgccgccagcggcgtcggcaagctgcagaacatccgcgtggcgctgcagcgccgctggaacaacaccgtcagcgacggcgcgcgccagcaggcgctggagctgttcctgggcgtgaagctggacagcagctgcccggggctggatctggtgtacgggccggaggagggggcggagccggggctgcgagacccggaggggccggccgtggacggggcagggccggcgccggcaggggatgcggaggccgccgcgctgccgccgccgccctttcctcaccacgccgacctggcgtccctggccagccccgggcaggccccgccggcgaggcaggggccggccctcggcgccgacggcaccgcgggggacccgctgggcgcctcgccgggcgccacgctggtgaccaacggcgtgacggcgccgtcggacgcacaggcgcagcaggctgccgcggagctggacctgctgctctgaggtgccctcgccgggcgggggtgcaggcgggacgccggctttgcgactgttcaccccaggagcggnnnnnnnnnnattttgctggctttgcttttatacacactcgtcagacggggagggcacgtagcaggaaggctcgcagatcgtgcatctccnnnnnnnnnngcgggctggggtgcaggcgggacgccggaagcggctttgcgactgttcaccccaggagcggtgccctgtctgcccggctcgggataccgttcgtcatctgctcgcccttgaccctcctgtgtctgttgcgaacagcaccgtccctgtcccggctttctgctggcgttgctttcatacacactcgtcaggcggggagggcacgcagcaggaaggctcgcagatcgtgcatctcctccgtgcagcgttcgtgggcgaggccgggatacgtcttgaactccaggtccttggcccctgtgggggccggggtttgacatgtcagcggctgtcaacaggcactcgtcttgcccatgaggacatggcggtgcaagcatgtgctcgctactccccaaagccccactttcagagtcgggagcactgtttgcaatggattgcacgccatccacgccaggaccaagcctcgcacggcaccacaccgcaccagctttcagcagcacatcgcgggtctcctctccagttgcatagggaaccaggtcgtcagcgtcgccatgggccagaaagatggggcgagccagggctgccggggtcgcctggcaaggaggttgggggaatgggctggtgttgctgttccttgagcacccccaaagggttcacacccgccatgcatggatgaggaaaaggggctcatgagcctgtcatcggaccccatgcctcctcccaggggaagcaacccctaccgtcaccttgcaacccgccatcaggcccctcacctccaggtcctggggggccagccaggtggagagccccnnnnnnnnnngatgggctggtgttgctgttccttgagcaaccccaaagagttcacactcgccatgcatggatgaggaaaaggggctcacgagcctctcgtaggaccccatgcctcctcccaggggaagcaaaccctaccactaccctgcaacccgccatcagggccctcacctccagatcctggggggccagccaggtggagagccccgccacccccgccagtgtgggctcgtaggttgcaaaggtcttcaggaccaggcgaccggcctggctgaagccgaccagggcgatgcggtgctccgggatgccggccgcaacctcgtcgtcgatcaggccccgcaggtatgcctctgcctccctcaggccctcggggtcaaattccttgccatccatggcctccctgaactttgcagcacccactccatctaggtcgtaccagcctggggagggagccggcggagggagtattcacagggagggccgggctcgggtgtggggcgccttgcgtatgctgtcaagcattaggaacacggcagtcaaggccctgcatggctgcgaccctgggcagggacactcacacaccgacctagacagtgtacctctgtatgtcttgccggagccttctccaaggtcgagtgtgatggggnnnnnnnnnntggaacacggcagtcaaggccttgcatggctgcaaccctgggcatggacactcacacaccgaactagacagtgtacctctgtatgtcttgccagagccttctccaaggtcgagtgtgatggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatacagatccccgcttcagattcgtacaacgcttcgaactcaccagatccggtgagcccatgcagcaagannnnnnnnnnacaaacatcgtgccagacatgagacttgtattgagcgggagttgagcccggtgcatctccatgcccccatcggccccaataccccggtccagatcccgcttcagattcgtacaacgcttcgaacccaccagatccggtgagcccatgcagcaagatgacagtggcggtgtgctgttcccgtgactcgtgcacgattgtgggaccgtattccagcattgtgaggtttgattgggtcgcagtgttgggtatgacgcggtgacgatgactctcgtttcggagttcgcctttcagagccaaggtatgtcaaattcaatttgtcgaaggacctgcagagattgtcaatgcggaggagaagaatagggttgcgannnnnnnnnnggtgttgggtatgacgcggtgacgatgagtttcgttttggagtttgcctttcagagccacggtatgtcaaatttaatctgtcgaaggagctgcagagattatcaatgcggaggagaagaatagggttgcgatgggaattgcaacctgatgcgtgatcaaccggtgcgtcgctgcgttgctcagcccacacacactttacataattttcatcatcatcatcgccagggcgcgcattcgggggggggatgccttgccctctagagctgtgatcgcacgattcgatcgcggtgcatgatcttgcctcacagggaagttccaccggataagattatatgaaggtggtttcgagttctgagatgtgctgcagcatgtagagcagtcggcagaccccaccaaagccgggacaggacgcatgagctcgttctgggaggcttggcaaccgcggcccgccgatttgaaggctctgaggtacggagagtgatatctacatgtcatgagcgctggaactctggccaagctgtcagtacccgatgccaccctcctcccacagcgccatcccaatcttcccccaggaccccgaatccccacctgcccttccctgccacgtcccctctcctgatcctcccgggatcccccgtcacccccctgcaccttcccctcttcggagccacctgcacctccactgccggtgtgcttgcgcccgaccagcccctgccggacgcagcagctgcggaggacgtgtgcctcttcgtgggcggccccgtctgggcgctggcctggtgcccccactcgctgccgcatggaaagcatgcccccggcgccgcgcacgaggccgccgtggacttcctggccctggcctgccacccccccggccagccccggcacaccatcggcgcgccggcctccggccccgctgccgtccaggtctgggcgctgccccgtccgggggcgcggggtggcaaggatacccccctcccgccctccctccactgcatcctgccgcacgacggcggcgtgacctggggcctggcgtggtgccccgacccaggggcctgcctgcctgacgccgatccggggtccgagcctggcgccccggggcggctgggcctgctggcggcctgtcagggcgatgggctggtggtcgtgcacgccgtccccgcccggccgggccccgggcccggccccgtcgccgcgcgcgcgcgcgtggcctgcctgaacgtcgccgcgctgggcacgctgccctcctgcctggactgggcgccggccgcgccgcacgacaccctcctcattggctgctgggacggctcggccctgctgctcaagctcgcgccgagtgcgctgggggccgacggaaggagtgggccctccgccggggcggggggcctgcggccgctggcgcgctacgccgcggacaccctgcccctgcgcggcgtgtccttctttccgcccggtgagaacgacgatgccggcgcccccgaccccgccgcgcggcacaccttcgcggcggcgggccagggcggcgcgctgacggtctgggacgcgcgcgacccgctgggcccggcctacgcccagctgctgaccagcggctgcctgctcggcctggcctggacggcggacccg

SEQ ID NO: 38713 - DNA, 96 bp, Chlorella protothecoides
gggccggcccctgggccccatccctccaaagacccctttgcctggcgtatatcgcgcctcccaggtgtggcggcgagggctggcccctctccctcg

SEQ ID NO: 38714 - DNA, 61 bp, Chlorella protothecoides
cttggaaaagggtgtggggatgtgggatttgagacgagggtgcacatgggcgggagaagaa

SEQ ID NO: 38715 - DNA, 61 bp, Chlorella protothecoides
gaccggaagccgattcaccactgtacacacaccagccacagggtgtggaatggaaggaaag

SEQ ID NO: 38716 - DNA, 152 bp, Chlorella protothecoides
gacatggaggctgagctcaggttggggggctttgggccgggttcagtcagacatgaaggtgctcttgcacgcgtgagttgatcatggcccattgagatgggtaacaggagctgtgcatgcgatctgcgcctgactggtgcgccagctcaccc

SEQ ID NO: 38717 - DNA, 137 bp, Chlorella protothecoides
tatgcaggcgctgtgcctggggcccactccgtgcatcccgcttactgtatggcgtccagcacctcatgtgccacctgagcctccccttccccctttccatctcacccaggggaccggcgtgatggaggcggctcacc

SEQ ID NO: 38718 - DNA, 61 bp, Chlorella protothecoides
gacctcctccctcgcgcccctcagccgcgccgcctcctcggtggacgtcggggtcgcggga

SEQ ID NO: 38719 - DNA, 72 bp, Chlorella protothecoides
ttgcccatgtaccatgctcttttgttcccctcaaccaccccacgcttgtaccatcgcggtggcccttgtgaa

SEQ ID NO: 38720 - DNA, 89 bp, Chlorella protothecoides
atgaccagagggccgcgaagagctcttcgttcgggtgcatggatcccagcgcaccccagcccagctcaccctccttcccgcggccaggc

SEQ ID NO: 38721 - DNA, 126 bp, Chlorella protothecoides
cccgcccgcctttgccctgaagagtgtgattgggttttgagatgcaaagctgcgtgtcaatgtgtatctcgagtggagctgtgctggacacggaggccgccttggcgcagcatgcaccccttcaca

SEQ ID NO: 38722 - DNA, 61 bp, Chlorella protothecoides
gcccagcctgagatctggcgccctgagatgcggcccaatgccgaccccgcgatgcgaccca

SEQ ID NO: 38723 - DNA, 120 bp, Chlorella protothecoides
ggggggtgttggaggtatgcagatgctgcgggagggtggcggcgtcgaggagtccaaggcatgcgggaagaccctcgcgatgaggcaaaaccccccgctcctgtaccggctccatacgca

SEQ ID NO: 38724 - DNA, 458 bp, Chlorella protothecoides
  modified_base (238)..(304): a, c, t, g, unknown or other
ccccccacgccagcagagaacggcggcgagcccggcgaggacatggccgcctcccccacgcccacggaggccgaggcctcgctggccgggtttgcgggcggggccccctcccccgaccccgcctcgccttcgctgtcccgcttcctcacccccccggcccacctcaagtcggccgaggaggcggcggccgaggacgtcaacgccacgccctacgacgacgtcctggccctcctccgcnnnnnnnnnnnnnnnnnnnnnnnnnnnnnnnnnnnnnnnnnnnnnnnnnnnnnnnnnnnnnnnnnnnccgctggcctcggggtcgcccgcgccgggcgcgctgggctccgcccgtcgccgcacgatgcagccgctgggctcggccgcgggcccccactcctcggcgcggcgctccagcctgaaccccgccttcccgccctcggccggctccaggctcgggc

SEQ ID NO: 38725 - DNA, 75 bp, Chlorella protothecoides
cctttgacgcccttttcgagaagcattgtcgaccccgtgccgagacgtgccgagacgatgacgataccccacttc

SEQ ID NO: 38726 - DNA, 108 bp, Chlorella protothecoides
cttaacttcgagaaataacatacacatgccgaaagtcatcggatgagtttgaacaccagcgagggaccaagtgatccgacagtatcgccccctgcttccggaacgcac

SEQ ID NO: 38727 - DNA, 61 bp, Chlorella protothecoides
gatggttgtagtccgcactgcgggatccatgatttgtcgtcagctccgtcagctgacggga

SEQ ID NO: 38728 - DNA, 61 bp, Chlorella protothecoides
cctgacatgtgccaaatttggagaccctgccgaagtaaacaattgtagacatcaagcaaac

SEQ ID NO: 38729 - DNA, 70 bp, Chlorella protothecoides
acagccttcgaatcagcgatcaaaaccaaagtctcgagcactgaatatatgtggggcgcgttggctgcaa

SEQ ID NO: 38730 - DNA, 61 bp, Chlorella protothecoides
gagtcgtagtccagcagcctctgtgggaggtggagtggtcagcgggtggcctacgacatgc

SEQ ID NO: 38731 - DNA, 949 bp, Chlorella protothecoides
  modified_base (185)..(256): a, c, t, g, unknown or other
cacgggcgggagcaggggcgagtagccagcgccgccggggccgccgggaccggcgcccaattcgtgcggcggcgcaaagcccgcccgcggaatggtgggcaccaggtgccgccccgcggcgtcgtagccgctgccgccggccgggtcggggcccgtgcgctggaaggggctgtggctggtgccgnnnnnnnnnnnnnnnnnnnnnnnnnnnnnnnnnnnnnnnnnnnnnnnnnnnnnnnnnnnnnnnnnnnnnnnnggggggccacaggcggaccgagggcagcggggcgcgaggcggctcgctcagcagcgcgcccgccaacgtggatggcacggaggccgacagctgccggctggccgtggaggagagcatgcgccccaggtcctcagacgtcaggccggcgttggactgcggcgtggaagaggggtggatcaggggcagatgagtgtggcaggaggggggggagcgacttccagccgggccaggctggcgaggcagctgggagtcacctccagccttccaggtgcaagcgcaatgagctggccttgaaaccctgagactcggctcagggcagcaacactcacgaggtagatgtcacccactggcggggcgggatgacacaggaaagtacatgtccatggatatcaccaaccgcaccatggcccagttcaccaacacagcaactgctgttcccttaccccactccctccccgcgcccctactcacccagagtcccagcagctggctcatctcgttggacattgcgttggaggtctggcccctgcccaggtcccagctcccggccgggcccagggccacgggcctttgaccctggtgcggatcctcgctctgctgcggctggtggcgccagccatacgggccgcgcgccggctcggagaagatgcgctccagcaggccctgatttcgtgtagggggggggaggggggg

SEQ ID NO: 38732 - DNA, 77 bp, Chlorella protothecoides
gtacgacagagaccccaggccggcggggtggtggcgcgggggcgaacttgcctcctaccttgtacaaagatctgcga

SEQ ID NO: 38733 - DNA, 96 bp, Chlorella protothecoides
cgattgtgaagccattggctcgcctgcgtgatgtggggggtttcaggagagagggtgcaggattgagcatttgtttgctccattggggtcgacagt

SEQ ID NO: 38734 - DNA, 76 bp, Chlorella protothecoides
cctggcatgccatggcggggtcccgattcggttctcctgcctcacacacaatcaacccaccttcttagatgcgacc

SEQ ID NO: 38735 - DNA, 69 bp, Chlorella protothecoides
gtgctgttcccgtgactcgtgcacgattgtgggaccgtattccagcattgtgaggtttgattgggtcgc

SEQ ID NO: 38736 - DNA, 88 bp, Chlorella protothecoides
caaagcggagcatgcgatcgcccaggaagcggccgctcagaatagtctgactcgacttgataaagcggtgagcccgattcgcagcacg

SEQ ID NO: 38737 - DNA, 2325 bp, Chlorella protothecoides
  modified_base (137)..(146): a, c, t, g, unknown or other
  modified_base (252)..(261): a, c, t, g, unknown or other
  modified_base (721)..(730): a, c, t, g, unknown or other
  modified_base (1073)..(1082): a, c, t, g, unknown or other
  modified_base (1563)..(1572): a, c, t, g, unknown or other
gcaccgcgctgaaacgcgccgagacgaggggcgaggtatgtgggccctctctcttcgctaccccccgcccctgcgacgccctgggaaacaggtgccacgccacattcatcctcctctcaccggtacagattgggaannnnnnnnnnaagggctggcagggtcggcctcgcttgccctggaggtccccttcaccgaaccccggctgcaggtcagcgcacacaacacacaccttgccctccctgctccatgatnnnnnnnnnntcaaggtgtgtggggccctctctcttcgctgccccctgcccctgcgacgccctgggaaacgggtgccacgccacatgcatcctcctctcaccggtacagattgggaaggaagacggccaggaggaaggggaatcccagcccacccacaaagaaaccgaaactggccagggccgcattctgcacgaggccgggggcaggggtgggagttgggatgtgacaaattggcgagggctggcaaggtcggcctcgctcgccctggaggtccccttcaccgaaccccgcctgcaggtcagcgcacccgacacacaccttgccctccctgctccatgattcctgagcccgccaccttacccgccactcgatgtagttcaagtctgggtcctcgccgaggctggcggcgtgcgcctccaactccgcggtccagctgtgcgtcacgaagtggccgacaaagcctccgaannnnnnnnnnatacgtctccaactccgcagtccagctgtacgtcacgaagtggccgacaaagccaccgaagaaagttagtgcggtgacgatggcaaggtggagggggcctgtggcctgtggctgcagcttcctgcagggagggagggatgggtgggtgcgctttttctgtgttccagccaggacttgggtgccgaaaacttgcccagcagatacacacaccctcctcaagccctacaaggccatggtgcccaagtgctttcgcggcgtcccattctatgtgacccctttctcaagttcctgtcgcctgaagggttaactccttggctgggaaggaccatgcagaacccctcannnnnnnnnntcccagcagatgcacacaccctcctcaggccctacaaggccatggtgaacaagtgccttcgcggcgtcccattctatgtggccccttcctcaagttcctgtcgcctgaaaggttagctccatggctgggaaggaccatgcagaacccctcacctgacgcgattccaccagaagggcgaagccagtgggaagctggcagggatggtggagtctgcagccacgagtttggggagtctgtcgctgcccgagtcactgccttgggaggacagcttctccagtgcagcggacgccttcatctccatcgaggtgtgaagaggttgctggctggtgaggtagaggctgacctccatccacccatcagcgctcctgcagcagggggtttgcagctccacctgaggagggcggcggccttgctccatagcaccgctcatcaaatcctctcccctcttccccttcccctgcccgcatgcagggcgggtccnnnnnnnnnnggcaccgctcatcacatccttcccctcttctccttcccctgcccgcatgcagggcgggtccgggctcacatggcagcgccggcaacagcacggtccaggacgcaaaactcgacagcattgcgtgccgcccaaacaaagtatacccggcgggggctcggtgtctcgccctgggcgtggcgggccaccaggtcggagagcacccgcaggaccgccgtgctctacaggaggaaagaaagggaaggagaggcttgttggcgaggtgtaggacgccttctgacacgtgcgggcccatcagcgggcgggcgggcgggcaggctgccagcatgaccacttggcgggcacagacgggtgcatccagcaggctctcctcactccttcaggaagaaagaaagaagcgcccagggatgcataccgcgatgccgccagccagcacgacgacgacttcatcctgcctccactggaggggagcgccgtagggaggcaggcttgcacgcactgggaggatctccctcctcttcagccttgccaggagctcctgcacggttgttggggtgggagtgccggtcctgaggctgccgcgcatgtgcgattgggtagatagctggtgccttggcgtgcctttcacatggctcgcaccccccatacacagaacccaccctcgaccagtcgccttgcttcttgatgcgcatggtcagcatgccctccgctgacaggtgggagatggtgaaggggtgccactgccagcgggagatg

SEQ ID NO: 38738 - DNA, 403 bp, Chlorella protothecoides
  modified_base (113)..(200): a, c, t, g, unknown or other
ggcgtcgctcgggcggggcgagggccccggcgcgccgcgctgcgcggcgtcctgctcctggcgggccgccatctccgcggccgccgcctgctgctgctgctggcgcgccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcatgcggggcagcagcttctcctgcaccgcccgtgtggcgtcctccaccgagcaggtcttggtctggcgcagggtggcggtcatgatgaccagctgtgaggccactttccgctgcaccgcgggggtgagctgctccagcacggcgttgtaggcggcggagacgtgggaggcgggcaggggggccggggggtcgggggtg

SEQ ID NO: 38739 - DNA, 71 bp, Chlorella protothecoides
ccccgctcgccactgcgccaggctgacgagactagcgtgttgggcgacccacggctccaggcagtacctca

SEQ ID NO: 38740 - DNA, 24276 bp, Chlorella protothecoides
  modified_base (902)..(911): a, c, t, g, unknown or other
  modified_base (1684)..(1693): a, c, t, g, unknown or other
  modified_base (1749)..(1891): a, c, t, g, unknown or other
  modified_base (1948)..(1957): a, c, t, g, unknown or other
  modified_base (3242)..(3251): a, c, t, g, unknown or other
  modified_base (3974)..(3983): a, c, t, g, unknown or other
  modified_base (4516)..(4525): a, c, t, g, unknown or other
  modified_base (4803)..(4812): a, c, t, g, unknown or other
  modified_base (5005)..(5014): a, c, t, g, unknown or other
  modified_base (5897)..(5906): a, c, t, g, unknown or other
  modified_base (6196)..(6205): a, c, t, g, unknown or other
  modified_base (7358)..(7367): a, c, t, g, unknown or other
  modified_base (7868)..(7877): a, c, t, g, unknown or other
  modified_base (8071)..(8080): a, c, t, g, unknown or other
  modified_base (8546)..(8555): a, c, t, g, unknown or other
  modified_base (8849)..(8932): a, c, t, g, unknown or other
  modified_base (11739)..(11748): a, c, t, g, unknown or other
  modified_base (13174)..(13183): a, c, t, g, unknown or other
  modified_base (13995)..(14004): a, c, t, g, unknown or other
  modified_base (14446)..(14455): a, c, t, g, unknown or other
  modified_base (14939)..(14961): a, c, t, g, unknown or other
  modified_base (15811)..(15820): a, c, t, g, unknown or other
  modified_base (16270)..(16338): a, c, t, g, unknown or other
  modified_base (17362)..(17371): a, c, t, g, unknown or other
  modified_base (17539)..(17548): a, c, t, g, unknown or other
  modified_base (17944)..(17953): a, c, t, g, unknown or other
  modified_base (20993)..(21002): a, c, t, g, unknown or other
  modified_base (22394)..(22403): a, c, t, g, unknown or other
  modified_base (22770)..(22779): a, c, t, g, unknown or other
  modified_base (23687)..(23696): a, c, t, g, unknown or other
  modified_base (24003)..(24078): a, c, t, g, unknown or other
ggccgcccgcgcgcgaccccggcgcggaggagcgcgtgtacggcgagaagtgggcggcgcggcgcgcgcgcgtgcgcgcgcagtcgccccacggcgcgcgccccggctgggacctggcctgcgtgatcgtgaaggccggggacgactgccggcaggaactgctggccatgcagctgatcgacgccttccacgacatcttccgcgaggcgcgtctgcccctgaccctgcacccctacgaggtgctggtcaccagcaaccgcaccgcgctcatcgagctcgtgcccaacgcgcccagcgtgcacgccgtgaagggcgcctgcccgccgggcaccagcctgagggaccacttcctggagcggtacggagcaggcacgccggagctcctggccgcgcagcgcaacttcgtggagtccatggccgcctactccctcgtctcctacttcttgcagatcaaagacaggtgattctgcgtgggcgggtgcttgaggggggtggggggtgagaggtctcatacggaagggggataccgggggaggtggcgatcaatgccccacccggagcgcagcattgcactccggcggggcccagggaaatcaggcatcatcttcactcctccctttccacctaccccgatgcaggcacaatggcaacatcctgctggacgacgccgggcacatcgtgcacatcgactttggcttcatgctcaccaactcccccggtggagtcaactttgagtcgggtgagcgtgtgcatggtggaaatggctgtgagggaaatgatgggtgggctgatgggcggtgctgtgccccgatgagaagcgtggaaggcgtcgcatgcacccctgactgggcgagatgccacctgacgttgggcttgggtgtcactcctcatcgccccccttnnnnnnnnnnaaaatgatgggtgggcggatgggcggtgctgtaccccaatgagaatcgtggaaggcgtcccatgcccctctgactgggcgagatgccacctgacgttgtgcttgggtgtcactcctcatcgcccccctttccagctatcccggccccgttcaaacctcccccccccaccctccaaccatcccatgcgccgctgcagtgcccttcaagctgacgcgggagctgctggaggtcatggactctggtccctctggccaggcctcggagctcttcgactacttcaaagtgctcatgatccagggcttcctggcggtgcgacgccacgcggaccgcatcctgctcctggtggagatgatgagctcctcggcctgtccctgcttcaagtcccgcgccgcggcggtcggcggcctgcgcaagcgctttgccctggccctgcccgagccggcgctggtggagatggtgctgggcctgatcagcgacagcctggacgcctggcggactcggcagtacgactactaccagcgcgtcctcaacggcgtcctttgagtctgggttggcggcggaatggagggcgctcgaccacccgtgccgcctcccaacccctccctcagtcattccccacaaccctatagctcgcaccccttcccctgcaaaaccccttgtgctaccatctcatcccccccttgactcttgatcggtgatggaggcttgacgcacagtcgcgttcctctcctcgtgcgcgtacacccctaattgacgtccccctacccctttcnnnnnnnnnntacccctcccccggtcattccccataaccctatagctcgcaccccttcccctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatgccgcgacacaacgcatgctgcgggcaggcctcatgctgcgggcaggctgtnnnnnnnnnnttgctcgtcaatactgccgcatgtccggggtgcagcgcatcgccccacctcccatgcttgcacccgcacacccttgccacatgctgtcgtcatcacgcgagaagaggggcatgcagggagggcaggggcgacataattcatgccgcgatatatcgcatgctacgggcaggcctcatgctgcgggcaggctgtccctgggtgccgctgtcgccgcgcctggggcctcctccgtcgcagacccctcctgggagctcctggtgtaggcccgcagcaggtacttccccgccgggtcctggaccaggtgacgcaccagccgcgtctgcaagtttggttgggccgcgattcgggggctgaggaagaggaggtgctggaagggctgtacgagacaagtgcagatccatcgggggacgagggaacctccaggaaactggcttgatgtccggccccaaccgtatgcttccaagaggtccccgcccaaacagccatgcacaccaccttgatgggcaagggggccaacacaaaggtggtcccggcaaagacgaggagctggagggaggtgaggctggagcccaggaagccacgccactggcgcgtgggcaggctgaagaaggtggtgaagaactgggccgttggctccacccccatcttgcacagcagctccatcccaaagatgtggaacgcggcctgtaggtgtttgtatttggatcaaggggcaagtgcattgatggatggcagtcggggaggggccacaggccagtggagcatgcccacgacagccgaagccgcccctcacccctcgaacatcctcatgtacctccaaaaacaacctcagcccccgacccacaaacccaacctgcttgcgccgctcctgggaccagagggcatcccacacccgagatgccacgctgcgctgcgaatccgcggagcccagcgcggcggccgtggcggccgcgacgcccttggcctcccgcaggctgcgggccaggctgtaccccgtggcggggtgcaccagggaggctgccgccccaaatgcagtgatgggctggtctgccaggggcagcgggccgcccacggggatataggaccactcctcctcgtgcacctccttgatctgcagccagggcaatgtcgcgaggcaagggagtggatgtggggggatgtcggatgcaagtccaccccccatgccatgcgctggattgatgtagcacggacaggcgcccgtggctgcctgagaacatgagtgtcgggcgctcaacactccccaaaccattggcgaccccccccnnnnnnnnnnagaccataagtccaccccccatgccctgcgctggattgatgtagcacggacagacgcccgtggctgcctgagaacatgcgtgtcgggcgctgaacactccccaaaccattggcgcccgcccccctcccccccttacaaacatacgcaccccactaaccccagcccacctccaggcccagagcagcgcagcgccgctccaagcgccgcttgagtgtctggaagggcagcgcaggcttggccaccaggcacgtctcctccaggaacacgcgctggccgcccaggggcatggcgtagaggaaggagggcacctcgtccgtggcatcccacacaccgtccccgccggccgggtggcggccggggcgcaggcgccgcgcgccgcccgcgcccaggcccacgtggtgccgccggaagtccatgaagagcatgacgctggggtcaaaggcctcgtcgtagcccgccacctccacttcgatgccgtacgccgtctgcacggccacagcgggggcagagctctcgtacttgaggaagcgccccgccgccgcgccggaggccagggtcaccagcctgtgcgggatgtgcgagggggcatgcatgcgtcggggggtcctggttgccccacagagggccagcaactccaggaaacagtgcgatgtatgttccctgagcaccgccagagctgtgtgctgttgactccactgctctgacgctacccagcagcttcannnnnnnnnnaggcatgcatgcgtcggggggccctggctgccacacagagggcccgcaactccaggaaacagagcgatgtatgttccctgggcaccgccagagctgtgtgctgttgacgccactgctctgacgctacccagcagcttcagagatgcagactcgtgccaacaaatgccatgcacagcgcccacctcgcagtcaggacggagccatcttggcaggtgaccgaggctgtgccgttcttcacgcccacatccactacctcccccggctggaaggtgacaccgtttgcctggcaggcctccaccaggtgctgccgcagcttctgcctatgccaacggtcatgagctagggagcttgagtctcatgctgcactgatgaccggctttgccctgtttctgggcaccaaggttggaattcgggcagtccagccacggtgggcgcagtgtgctcccaagatagcacctggagtagggttcaatcagtctccactttggctgtcgacataacactcctctcaacacctcgaggccacacccacnnnnnnnnnnacgagcagtccagccacggtgggcgcagtgcgctcccacgacagcacctggagtagggttcactcagtctccactttggctgtcgacataaccctcctctcaacacctcgaggccacacccacctgtcgacgcgggcatatgcccgccccaccctggttgggcggccctcggagaaatagcacaccgcgtccccccacactgcatcagaggggagaagggccaagttcgcgccctagaaagctcctcggagcagggccatccacccactccaccatcnnnnnnnnnnggaaagtgccaagtttgcgccctagaacgctcctctggagcagggccatccacccactccaccatctgacaatcgcgttgcagaatgcagacatcctctgccccccaaattacagagacgctcacaaaggcgcacaccccattccacgcatgcccctcaccatgctccagggtgtgctccagtcccagggctnnnnnnnnnnctcctccgccccccaaacacagagacgctcacacaggcgcacacccagttccacgcaggcccctcaccgtgctccagggtgtgctccagtcccagggcttggaactcatccgcccaaaccccataattattggtaaagatgctggccgcgtcgcccacgagcgtggtcctcagcccctgagcgcccagctccgcagcaagggcgaggccggcggggccggcgccgacgaccaggacgtcgggcgagacgcgggcgtcgggcgtggggaggaggctggacaaggggtcctgctgatcgtcccgtttccgggcctggggggccaatggggcaaggcattgccaatgtttccgtccacgcatgctgcacccacggtgtcgcgttgggcttcggctgtcatggcactgccacgactgaccatggaagccctgcctgggccaggctcgcctcaaggccccctgccctcctttccccctaggcacctggcgttggaccaggggctgctcgtaggagccctccctgcgatcctgatttgcttccgcggaggcatctgccacgtcagagaggctgggggctagggaggggaccgcccacttggagggtctcagggggctaggcgtcacagcagcatggaatccagacggtctcctcggtgggttgagcgaacaaaagaaaggtcttcgaacgattgtttgggataaggacgacatcgccgtcacctcgggacaggcagcgatcagacggtggccgtctgcagaggcatttcgacggtccttccccggtggaagatgggctggtgttcaaccactctcctaatcgatgccatgcacataaattgcactttgaagcgccttgtcatatgaagatgtcgagatgtcgggcatgnnnnnnnnnngcactctcctaattgatgccatgcacaaaaattgcactttgaagcgccttatcatatgaagatgtcgagatgtcgggcatggctcggccccatcgcggggttcgctgggcgtggcccttgcaatctgaaaaaagataaaatctggccacgtgggtgagtggggacttccttgtcttcgctcacagcactagctcgatgtgcaggcacacttcattctgagcccttgccaaaggacagaatgaccgaaagggttaggttggactgttgttggtaacactgtaacgcacgcnnnnnnnnnnagcacacttcattctgaactcttgccaaagggcagaatgaccgaaaggggtaggttagactgttgttggtaacactgtaacgcacgcacttgcgggcagtcgccactccgttagacggagcagaccctgagcccactggattgatttgcacattttacgtactgacaagagttttctctgcattctacacccctgttttggggcgactggatgccctgatttggcatttgtcaagtgtatgctggtggaagggcacgcgtcatttgacccgggccattgaagccttcgccgtgggtcaccggggatgcgactcgcagcgtccccattctggagcagtgaggaccgaaactgtctcaaatactccctatctcccttcttgtcatccgtagcgcaaccatcttctgacatctgcacccctgcagagacgatcacaagcatgtctaagccagtgagttgggtctggattgttgtgaggggatgcgcttttgtatgcgcgcagcattcaccaacatgagaatgccctcaaaccccaacaggtcgtgttcttcgatgtcagcgcgggcagcactcccttgggaaggatcgagatggaggtgagccgtcgcgggtggtctcgatcccacaggccgcgccagcggatcatttcatggattcatgtatagcacgatgtgcgctgtcgacgtgcaacgaggatctctgcgtcccacggtggtagcccacgaatgagctgcacgtgacgccccaccctccaccgccccgtctgcagctgagggccgatgtcgtgcccaagaccgcggagaacttccgtgccctgtgtaccggtgcgtggggactcggatacaggatggatcatcccagggtctcgtcaggaggtggtgacccaccggttaagtcatcattatgccactatatgaccagaatgctgcctgcctcccaccctgcaggcgagaagggcacgggccgctctggcaagcccctgcacttcaagggctccaccttccaccgcgtcatccccggattcatgtgccagggtggcgacttcaccgcgggtgcgttgccatgagtgtctctgcatgagggcacggtggggccttgcaaacatctcccaagggtctcccccatccccctgcatgcccccatacgtgtgtaccannnnnnnnnnatgcaggcatctcccaagggtctcccccaaccccctgcatgcccccatacgtgtgtaccaagctgccatcccaatgatgcatcctcaccgtccccggtcccatcgtcccaggaaacggcaccggcggcgagtccatctacggcgccaagttcaacgacgagaacttcaagctgacgcacaccggccccggcatcctgtccatggccaacgccggccccaacaccaacggctcccagttcttcctctgcaccgccgccaccgcctggctggacggcaagcacgtcgtgtttggctccgtgaccaagggcctcgacgtggttaagaagattgagtcctacggctctggctccggcgccaccaagcaggtcatccgcatcaccgactgcggccagctggcctgaggggaaaacccgcagagcgtcctgattcggcgagcgctgtgcggatcctgatgcatcccgtcgctattcttgtgtgtaacgcatgacctccagaaggccnnnnnnnnnngaccccgcagagcgtcctgattgggcgagcgctgtgcggatcctgatgcatgccgtccctatttttgtgtgtaacgcatgacctccagaaggccagaacgagactgtcggccatcccgtggcacccggggacgcccctgcccgacggccgtactgctgacacttctctggcgatgtcacggcgcatgcgtctgnnnnnnnnnnagggacactcctgcctgacggccgcaatgccaacacctctctggcgatgtcacggcgcatgcgtctggtgggccatcctatcatgtgactctgagccggtacggggaccaacctgctggacaatcatgtgctcccactgactgcaaacgagaaccttcgggtccgagggccgctgtgctcaacggggtgtctctgtcttgcaatgccagggatgctggaggggccacactaccccttgaaccagaaaggagcaacagggggtgctcactttgacttggagtccatggcctgcagctcctccagggcacgctgacgccgcttcgtcttgcttgcgtctggcgcgcagggggaaaggaaagggtgaatgggtcatccccatgactgcaatgggggagatggacaggcaatgggtgcccaacctgaatcagaaagagctgcgcccgacgcgcacgtaccctgcaccgannnnnnnnnnagggagatggaccggcaatgggtgcccaacctgaatcagaaacaggtgcgcccgacgcgcacgtaccctgcaccgagaggtaagattggtgcccatagtaggcgatcagcgcggccgcgacagcgaagacagaccacttccagccattgacggtgttgatgttgccgccggtaagcttggagccctatgattgggaggtaggaggtgtgcagaagcggggttgaggtagaggacagggcgagagcacacttcccaagcaggtggcaaggagggtggaggaggtgggtgcaagcnnnnnnnnnnnnnnnnnnnnnnnnnnnnnnnnnnnnnnnnnnnnnnnnnnnnnnnnnnnnnnnnnnnnnnnnnnnnnnnnnnnntccactcgtcgaccagggtggaggtgacaaagtaaaggtatgcagagctcgtgctctgtgtaaggattcagaagagtacagcatggtgttggaactgggctacttcctcctggctctcatcacaataccagcatgctcgcctggaataaggtgcccttcccagcagcaacgcagaatgcatctcatccccataatacgtccgctccccaccttgacggagtcctcatcgtcctcgacggcctggtaagagacctgggtgggtggatgctggtagggaccagcctcctgggcggtcacctggtaggtgaagcggacggtggcgccagcggggatggactcgtagctggcagagaggtccccagacacggagaagaagggctcgggccacttggactcgaccgcctttacctccagtgccgacctgggagggtgggggatgcaagacaagcaggctgtcgggtgcggggagcacagagagtactgtccaagcgtgttccagccccacagtccaggccacgggacaaaacgcacacatccactcacgtggatccggcattgtatagctccaccgtgacggtagtggtcttgccctggatcggccgcttgtcggcaaccacccggcgcacgatcaggaaggcgcggtcggcgaagtcagaggagtcttcatcgtccacctcgtccacatcctcggtagccctgcgcatcgagttggcgatcgagtgaacattggctgagcgaggccacgcccaaatggataccgcagtcccaggcctcatcccacctgacaggggccagcagtgccgcacaggcgaggagcgccaggagcgcgagtgcggatgtcctcatgttaacctctgtgtaacgcgaacgggcccttcccccctgcattggccaacttgcaggacctgtcgtggccttccgtgggaggggcgctcggagggcaggacatggaaagcacggacgaaaagccatatgaccaggagtccgcctcctcccactctagctggctgccaggcgtcctctcctgggtgtcaagcatgcctagataccctttcacagggcgtctctcctcttttcagcctcgagacagggcccatgccaacagcagtcagaaaagatatgcgcaagcgccacaggaactggcaggcagccgctcctcgacacgctgcgcccgtgggtggtccctccgctgaacaggcgcatcacgtcaccggctgctccacctccttcctcgcctcggccagcgcgggcaccagtcccccgtcgtacttcaggaagcgctccgcgatcaggatgtcgctgggcgtcgtcacctgtgtgccgagtgggggatggtgagcatcccagcacgcagcacagggacgtccgagtgaatcgcaggggagcatctcccctctcattccccgcgtgtttgcccctctggacattgcaccccatctcgggcagcgtttcccgggaggctatcctcgaccgccccccgcacccgcctgacctacacccccccctgcacaccttgatgttggtgtatgacccgctggtcacccgcactggctcccccagcgcctccacgatggacacgtcatcggtgacctccagcccgcgcctgcggaccaggtcgaagcccgcgcgcagcaggaccggtgcgatgacctgcggcgtctgcacctcccacagcgcgtcgcggcgtagcgtgcgcaccacgcccagcgcgccgtccacctccttgatcgtggccttggcctgcacgccaagcaccgcggcgccgacctgggccgcatcctgcaggcacaggcgcacgtgctcgggcttgaccaggggccgtgccgaatcgtggatggccaccagggtcgaggagggacggatgacctgtttggggggccagatggtggagatggggtgtgttggagctggagggaaagggggaaaggttggcaggcacaaggagatggttgcaggggcccaggcggggcggggcgggtgcgccgggagggggggcggggcgcggggaatgcagcatcacagctccgcccaagaccagcgccaccccagtcctctcctccaccggcctccacccacgcttcccccgccgacccggaatccgttgaagacggagtcctggcgctcgacgcccggctgggagaagaccagggccgcgtgctgcgtggacccggcgtaggcctcctcgaaaacgtgcctagggagggttgggagggatgcaaacacatcggtgggaaggcctcacatcgacgctcagcgtgcaacaccgccggcggcctccccaccctccctcctacctcgcagcccatgggatagagcccatgctggctggaggagggtcctcgtggcctgcattggcccccccaacacacgacgcccatctcaccgccagctggggtcgcagacgaccaccacctccgcgacctctggcatggccaggaacgtccggaaggagtaggtgcagatcggctcgcccaggatcttcagatactgcttggggatggcggcgcccatgcgcttgccggtgccgccggagagcagcaccacgctcacctcgccagggcccactttgggaggctgcgcccctccgctattctcctggaagttgggggaagtgagatgtcaggaagtccatgcagcacctgaagtgcgcgccctcgacggggtcagaggcaggaatcgggcattccactcacggcttggcatgacaccgagagtgggcaccgggggtgcctgggagggaaggcccagtgctgactgccattccctctcccgcgtcgccgcgcaggccccgaagcgcgtatctgtannnnnnnnnngattctcctggaagttggggggaagtgagacgtcaggaagtccatgcagcacttgaagtgtgcgccctcgaaggggtcaggggcaggaatcgagcattccactcacggcttggcatgacaccgagactgggcaccgggggtgcctgggaggggaggcccagtactgactgccattccctctcccgcgtggccgcgcaggccccgaagcgcgtatctgtactgccacattcctcgagtgcaagggtgtcgccgcagcatgccccgggtgggagagccgcccggccacgtcggccaccctgccacccgcaaacatgctcgccatgaggacctgttcagcctacaacatcattatccgcgtaatagagccttgcacggtgctgggtcgcattcaatggtcatgcaggctcagccagggcttcaaatcattgcggaaacacgagacgcccgagatttgggaccgattttctccagtctggcggatctgggtggtggggccatgctgatgactcccacccatggcctctcaggacacggaacccttgcatcaattaggtaagggttcagtctgagcaggctcctgtgaatacatcagcacatggggagcaaggctaccctatggctccagtgcactgctcccagccactgccagcgcggtcttgccagctcgtgtgtgcagtagtccggtcttcttcagcacatgcaccagctgcattggcgaaaggcgctgcttggatgacatgctcacaacatgatctgaaccatgctgaaattcacaaactctgccttaccagggccactcctccctttgtgggtccccaccacccggcccaccgctgcatcaggggccctgtctacctccagtcccatggcatgccacagcttggactgcaactccccggtgtccgactcccggaacgaggcggtcggaccgcacgcccttccccagttcctttccaccttgggcgccaactgcagtggcacatgggcaacgggcaggtacgctccgtggtcgcagtccacaacaaccgccggatgcccaagcatgtccctccatgctccctggcatacttgcacaagccagctgtactttgggggtggtgagccaaacagaaaatctcccctcaccgaggctgttgcttcagctaaacgcttggcccgtgcctgttcgcgctccagcgcctcccgctcctcctgcctcctggacaccagcgccactgctgtgcggcccatacggcatcgtgccctctctgcatgcagcatgccatctcggtgctcctgtggcggcgggagggtgagcgctgactccttgatcagtgcagagcgggatgaagcgtgagggagtcgacgtgactcctcgagattgcatgagaaaatatcaatgatgaagctttggccctcagcttggtcgagagacatcctgcgctgnnnnnnnnnncacgtaactcctcgagatggcatgagaacatatcaacgatgaagctttggcactcagcttggtcgagagacatcctgcgctgtgccatacctgataggcctggagtaccctctctgctgcagtcagggcagcagcatgcctgcacctttcccttctctcctccctgctcctgagccattgcgtggcctggctgcggcgccaccccccttccggagagtcggggcaactgtggccatcctggagtgtggaaacttccactacggacagttgcaggagcctgtagccacaccgttgggttctgctggcccggtcaatctcatcctgcaatgcagtgcatgccgcctgcagagcagcaacggtgtcgcccaattctagtgcatcaggctgtttactactgcttcccaccgtcccagggtcgaagcacatgtggctctcgggttgtgctcgctccccgagcgaaggctgtcgctgggttgggtcattgagggcctgcaaagccaaactcagctccttttcgcaggcgagaagtctcaactgacgacaggcttgtgatcgatcagaaacccacttagacctggctgcatcaaccttgcttcgcatgagggctgcaaaggcttcatcagccccagcacataatgacggattcattcggtagcggcagcactcactgcacggcagtcttcgagcctcgttccgatactcgctgaattgactattactccaatggccatcagaaagcctatttgccacagcatgggtcattcagcatcagcataccagcactgggagggtatcgagggtcaaactgtggnnnnnnnnnngatgacggattcatttggtagcggcagcactctctgcgcggcagtcttcgagcctcgttccgatactcgctgagttgactattgctccaatggccatccgaaagcctatttgccatagcatgggtcattcagcatcagcataccagtactgggagggtatcgagggtcaaactgtgggtcgagttcgggaccgcttttcggtaccataccatcattggtaccgctctgtccaacacaccgatagaaggccttgcacacaggtttgaagagcacattgctgcgggatactggtcgatagaggttgccagacaggatgagtttactaggaacaggagcaaatcagaatgctgggcgcttcaaacatgtgcgccgggcttccggccgaaactgttggatggaatgtgttaagcgggaccactcgccattgacgatcattcaatcnnnnnnnnnngtgttgggtggaatgtgttaacccggaccactcgccattgacgatcattcaatcgaaccctcctctcttcgaacccagatgccatcgagatcgaatggtgcgggagccgtctgccagaagtgcctgcagcccgggcactggacatacgaatgcaagaatcctgcggcgtactcccatcgaccatcccgaacggagcagctgaagaatcccaaggcccgccctcgcttcatggatgcatcagagctgccagaggagctgcaggacaagcctggaaagccccagaagcaggaggggaaggcaagcaaacgcaagaggcgcaggagtccatcctcctcttcgtcatcatcttcttcgtcctctggcagtgattcggacagtagtggaaccagctccagcagcggaaccagctccagcagcggaagcagctccagcagcggaagcagctcaagcagcggaaccagctccagcagcggaaccagctccnnnnnnnnnnnnnnnnnnnnnnnctctagcagcggaaccagctcaagcagcagcggcggcacgagctcgagcagtgggactgatggcagcagcagcagtgactctgagtcgggcagcagcggttcatcctcttccacctccactggacgcacctcggcttccgacactgccagtccaccccccacaacagtgaagaagcgggcccatagatctggagcaacaccacccgcagaggagcctattgcggctcggaagcgatcgacgtccccatcggctgcagcggcagcagatacaagcgctactgcatactatcgacgccccagtcgctctccgaggaggagacgacgcagccctgacgcagagacagccgaacggaggagaattcccaagcaggatgatcgctggcaactccattgactcccctgctgagcgtgccagcatactgatgggagtgttttaggcacatgctcctcagagaccaggatgtgggtgtagctgagaatgaggctgagagcagaacgatgatttcaggcgccctcactccaagcaagacgtattggggcgaacgaatgcctgcattgcagcatggctgcagcctgctcctgggtggctggaccgcaaaggctctcgccaacttgaaccctgcttccaccagcaatccatacctccacacccagcctcgctcccatgctggccaaccgagtgcaccgcttgcaggtctcagggtaccactgggaatttcatcagaagcacaacatgcatcatacgactgagtaggaaaaggggcaaggaacacgccagggtcgagtacgtggccgccgtctcaggccgtgaggtaccgtgacgcttcggcgcgcagcttggtcatgactnnnnnnnnnnaactgagtaggaaaaggggcaagaaacacgccagggtcgagtacgtggccgccatctcaggccgtgaggtaccgcgacgcttcggcgcgcagcttggtcatgacttccacagccttctgctgctgggccgcccccgccgttgcgatgttctcgtccagcaactggatgaaggcggcgttgatgccgttcttcccagccagctccagcagcgccgccttcttgtcgcgggcctgcagcacccccttcaggctctccgcaggggtcactgtctccgccagcttggtcttgacaccctccagtgcctgcatcgcgacatgagtcaggtggggctcgcgtgaggagggggctcccttgcgatccttcagcctccttagcctggcatcctggtggcgaccccaggcacaacttgcaaggtgcgagtgcagagagttgtgggtgcaaagcttcccnnnnnnnnnnnnnnnnnnnnnnnnnnnnnnnnnnnnnnnnnnnnnnnnnnnnnnnnnnnnnnnnnnnnncagcctgtcagaccttggtgatgtcgtccctcagctgctccagctgcttcaagcgcgtggcatccggcttggctgcaaatcgctccgcgcctgtgcacagggcaggcttgagttgataggctccccagctcaagccaactgcagcaggtcctgcccacacacatgcctggcggcacgcatcctcgcgatcccatcacactctagaggcgcacctatgattcgatccagctgcaggaagaaggcgggcgtcaggagcggtgcgcagcgggcagcctcccacgcgatctcctcccccggaaggtccaggaagaaggtgaccagctgctgagggtcctctggcggcgtcctggcctgtggggaaggggtggcggcatgcggtgagacatcaggagaaatctccccacgaggatcaggtggatcatgtcatggtcctcccagcccccggcaggctataggctgctcacatccctgcggcgctgcagctccttttgctccctggccttgagctccttgacctccaactcagcggcgtcctccagaccatacttgcgcttcgtcctgcaccaggtcgtcagcggagctggttggtcagcgttgacgggagggggccaagaggctggaggagcacccagacccatggtgtaggggcgcagctcaggcatgcatggcatcctccatgctggacaggacaaggaactcattgcaatggtgcagcgcacatgttacgcgccagcaggttgcttgccgccggcttcttggcgaaaagcccctctggatcctgcaggcaggcgggtgaccgggcgatgcatggaggtctcctcacacgcgagatagccatggcggtggtgaggcgtcatgcgaccacgtctgcaacgctaccaagctttcgcatcctcgtacccagctcgtcatagcctgcggcgtcactcttgagcatcttttggggggacgaaggtgtgcgaaagagagactcagcctcgtgctgatttctgcggccgggccccggtggcccaaggacaccccnnnnnnnnnnagggacgaaggtgtgcgaaagagagacccagcctcgtgctggtttctgaggccgggccccggtggcccaaggacaccccagcaatagctccgatcattgcagcggagtattttaattgtttcggcgatttagagttgagatgcacaggacttttggtgctcatcggcnnnnnnnnnncagctccgatcattgcagcggagtatttaaatcgtttcggcgatttagagttaagatgcacaggacttttggtgctcatcggcaaggcatgctgccatgctggaccggataactctgggcgcgccatgaaggacaccatttagggacggcatgattttctgcactcggtgagaagtacttcccaacagggagaatcaatcaccgagtgatcccagagcgtagaagttatgtgctcccaccacttgaagatttgacaaggaactcaattaagcagaagtttcccagttgtgctcacgtaggtcacatgggggaccaccaaagtacaagcaacacatattgaaagcaaatacagacatcacacatggccctatcccagaactgaaagggaagaaattnnnnnnnnnncgtcacatgggggaccaccaaagtacaagcatcacatattgagagcaaatacagacatcacacatgaccctatcccagaactgaaagggaagaaatttgctgcgatgggaaaacatcttgagaacacatgtagaattgacttggtcaacatggtcatagtaaagctggttccatgacatgtctgcgagcaagacaccccccgccagtcctcaatgagttctcagcgaaggattaacgagtcaaacattcctctcaatgaccaatactagctagagagcaagtacgtcgttgagctgtcggtgcaagaccagttgtgagagtccgtaccattcccaactggggggatgattcccgatgcgccccgatctcctctccagtatgaggattcatggcgcgtggaacccaccggaagtcgggtgcggcgaaaatgagtatggcgcgttcatacatgtatggtggagcgatgtgatgaaatgctcaggcattgcagcgtcttccagaatcggagtcgcccatgtggcggtgcccatgcgaggtcctcggatgctcgaccctcccgggtgcttaggttgctcactcgagcctggggtctgctggcccagggatgtgctaggccaaccgacaagacccttgcgcgtcgcaccccgtcccagccattctatcgacatggatgtcagcgccacagcatgcgcggtgtaccccctggaggcagcctacgccaggagatgggcggagcagtatcagcgccccggggccgtcgctgccttcacccatgagcgcatgctgggggctctggcagcccaaacttcactttttagaggctgcatgcactgtgtgagctgctgctccaacaagcagcgacaacgcggccaacaacccggcaggtgaggtccggtcctcccctccgtacacagtgtcgggacccatccgtcgagggtcgggtgctcgtcttcccattccactaaacctgtaatgctgatcgtgactgattggagatgcactggaacgcgttgcgcctgcctgcgtgccctcctgacgaacccggcatccgggcacgctcccgcaggtatacgacttcggagggctggccaggtgggatcccctcccccctcgcctacttcgagatgagggcgcgccagctctctgtcctctaccgggcgtgccatgggtgagttgccgggacaatccaatggatttggcccggatgcaggaatcggctcctccgatgcccttcccggccccatgtgacctgggcaggcatccctgccagcgcaccttgaaaccccacccgcgccccccttcaaaccccgctcccctgcgctcacacaacccaccagacccagcacatggaggaggatggagggagtgtcagtcggctccgacctggcccagcggcgaggtacgcgacagctctcggtcctggtgccggcgtcccacaccaacatctcggcggtgggtcccgcgaggagggcatgctggatggcaggatgcagagcttgtagatggtcacaggcctggcatgcctggtgtccctggagctgtcggtatgtgcatccctgccctggacaagacccctgtcccagccctcttgcacccctcctcaacatagctccctcctgccctttgccccctcccctctgcagcacgactgcacggtccgattcgtgggcgtgcagctggccagcctggctggatccagtgcacagcgcatcggaaagggtcgtggcctgctggccacgttcaaggacgcgcccaagcgctcgcgggtgtcgccgcgggcagggcaccccgcagcgtcggcctccggcccccaccccggcccccaggcccctgccagcagcgcgcatgcagccccggcctgggccggtgtgcccggcctcatcccggcgtcgcggggcactcccgacaccggcctcatgccgccgctcaccggccacaccacgcacagctggaccagctcggccggctgcgtcccgccgtcctgcgcggcgggcggcagcttcagctgcaccgccggcgccagcttcaccagctccggcagcgccagcctcagcctgctgcacacccccacccccgccgcgggcgggcccgccacctgcctcagcctgggcgcctccggcagcctgccgagcagcctgggcccggcgggggaggagggcgagggctcctccctgtgcccgcggagtgcggggccggcgggcgtgggcgcggggcccgcccccccgcccggggtcatcttcgcgctgccccccgcctgcccctggggcgacgtcgaccgcgcgtcctactactcccgccagctggcgatcaaggccgagcaggcctacagctgccagcaggtggtgggggagggccaggaggagatggagcccggcagcggggcctggtccatgctgtggagcctggcggggaggctgacgcagcggcgggtcagcctccaggcctgactgcatggcgtgacacccgggggtgtcggcacccccggggcgctcgcgcaaccatgaaacatatccctgtcccagagcgctcgttgctgcgtgcaaacaagtaaatatacccgaaatcggccaggcgaggggttcaagcgttcctacaaggctcggtttcgagaaaccggctgccgacgagcttgcgaggggttgcccacccggaacgaacaaaatatccgatcccccggtttatgcctccggccaaatgatcagagtactgagccccggacggggggatgagcagttcaacacgaagctgttttcgtcggtccggggggaaaattgcatcctgtatcgtagtttcacaccaatccagaccgctgttcaattatgttaatgagaggccatgcacaccttggagggtggcagggtgcgggtccctccgcaacctcgcccaccgcaaaccacatgtgcgcggatcacccttggacgatgatggacgccaccgcccaagccatcggtgcaaatacaagatctgatgtctacccctgtctccgacaagtctctggagtcgcggaccaacccaggccgcatgccgacccctgcctgcnnnnnnnnnnagctcacacccttggacgatgatggacgccaccccccaagccatcggtgcaaatataagatctgatgcctacccctgtctccgacaagcatctggagtcgcggacgaacccaggccgcatgccgacccctgcctgcgccatcctctaccatcgcgcccgccgcggaaagggtgccgccattgcatcgcgtgcacgggctacggcccagccgcgcagccctcgcctcagctgtgagtggagggatcttctcctggagcggtaccggcgtcatgccggcatctcgtccggtgtgcttgccagctgatcgtgaatgcccctgattcccccaaccccaaccgacccccggctccagcctgaggtgttgaagcgctccccccaccgccccaggcccgacgagtggcagacaaccggcgcatggtcggccacgcagtactacagggcctgggcagcgcacccggccgcgccgctccgccaggtgcagccctggaacaaggacatcctgtgggcggccgccacgctcagcgatgccgacgccgcgggcagcagcgcgccccagtccgccccctggcgccgcatggaggatgggccggccaacccgtccatgctttgcagcctgcgtgggctccggcccctggccgttctcatcccagacgcgtacacccagattcccaaggtcaggcagggggacgaggagtaggcggacgtgtgggccagggacagactgccggcatgtggtctgagctggtggggtgtgagccagggtcccgcatgctcattatagctcagactgggtgcgccatcgggagctcctctccacagtttcccttgcccctttctgcactacaggcggggcgaggggtggagatgctgccttcccaaaacgcgccttgctcaaagggtcaggtggcgctgcaagctgctcacattccttacgactggccctgcagcagcagccaggggggcgcctccaccaaaagcaacctcccgcagcggcaggctgggccctgggtcaagacaccgcaggctcccctcgtagcacatgtctggcaaacctttgcggcccctggtcgccacacgcccttctttggcaacacgactgattacagtcgctcacaagggtacgtgtaaaggagaaaggggacgagcgcggcagtggcgtgaaaagatcgtggcgcccgcacaacgccggcagtcacggtgggaaatgctctacagatgcgatacgcgcccagaagggcgccccgccctggtggcagggtggcggcatgagcgtgggccgcggttgcccatgccccttggaaccccgccggtgcctccagagctgccccaggaccacggcgcgcctgacccaggggtcatctctcgccaggcatcgccgtgcaggctgcaggnnnnnnnnnntccttggaaccccgcgcgtgcctccagagctgccccaggatcacggcgcgactgacccaggggtcatccctcgccaggcatcgccgtgcaggctgcaggcgccacgctcctcacacggcggcggcgaggtcaacgctgctgctgcgcggcttccgcgtgccggcggccgggtctagggcggcggggtggagtgcggggggcgggctcgtacgataccgctgggccctctgcgaggcgaggccggggacgttggggttgactggtgcagggtggggtgggggaagggtgtccggagcgggtggggaaggggccaggcaggtgcgatgcatggtggagacgccagacccccatcgccaggcacatgacnnnnnnnnnnggggtgtccggagcgggtggggagggggccaggcaggtgtgatgcatgttggacacgccagacccccatcgccaggcacatgacgccgccgtgtacttgcccgacgcggacaccaaaggctccctcctcccccgcaccgtgagcgagtcggggaagcccgccatctgcacctccgagggagccaccgccagccaggactggcccgtgcccagccgcatcgacagctggagcaggaagggggtgaccaggagcgacagcgcagtgatgcctgcagggagggaatcaagcacgctgagggggtccagggtctgatgcgcagggcgagcgggtcggagtcgccctgccgcaggatgcttgcccctgccccctgcctccactgcagcgctcccctacggtatcccaccagcaactcccatgcaacccaggcccctctgcatcccacgcacagcgcgagaccagtggtagggtcctgaatgcccacctctcccttgcatgcatcttcttacccccataaccacacccaccttcccccccttacaccatccccccggctcacccatgaggaggagatagacctgcgtggccagcagctcctggccgtgcgccaaggaaagcaggacaaagacgaactcgccgacctgggccagggccaggcccacgccggccgccacctcgagcccgtacccaaacacgagcaccacgccgccaacctagatggaggggaaggggggagtgggtgggggtgagtgtttggcgaccttctcaggaaagtgtagggtgccctttgcgcacagcacgcctgctcatggaacgatgaaccgcgcacgacagagactgcggccactgatacagtgcaaagtgagtcgccatgcggctccagccctcaaccccccccccccccccccccnnnnnnnnnncggcacgatgaactgcgcaagacagagactgcggccactgaaacaacgcaaagtgagtcgccatgcggctccagccaacaccccccccccccccccccccccccccacacttcttcataaaccactcacgacgaggcccttgacgaggacgacgagcgcggcaccagcggccaggacggggaggtggtggaggaggaaggggggcgccagcaccatgcccgtggaggagatgaagagggcgaggaagaagtgggtgatggcgtccaggcgggcgtggatggcctcgcccgcccccgcggcggccagnnnnnnnnnnnnnnnnnnnnnnnnnnnnnnnnnnnnnnnnnnnnnnnnnnnnnnnnnnnnnnnnnnnnnnnnnnnncggcggagatgccgaggcgggtggtgaccagcgcggcgcagcagcacgcgcccacgcccgccagcgcctggatctcggcgctggcgtggcgtgcgacccagcccgccgcgcggggcagcaccaggcgtgacagcgcggcggccaccgccaccgcgccgcccagcttcaggcccacgcgccagagcacgcccgcgatgg

SEQ ID NO: 38741 - DNA, 127 bp, Chlorella protothecoides
catctcggcagcgatgagaactggcagatgcacaaaagtgctactcttcaccctactcccgggcatctcatgtccatcccgcagcctcaccattttcacatcactccaccactcattcctccccttg

SEQ ID NO: 38742 - DNA, 61 bp, Chlorella protothecoides
ttgttgggggcattgttgggggcattgtttagggcaatgtttggggcattgtttggggcat

SEQ ID NO: 38743 - DNA, 71 bp, Chlorella protothecoides
cggggggccagggggcaggccaggggctggacggcggaggcgaggcgtcggaccccggagccggcggggag

SEQ ID NO: 38744 - DNA, 82 bp, Chlorella protothecoides
ttggccaggactctcccgcaggcgtcctgcatcccccgggggggatggggtgccctgtgtggccagggctccaggcacacgc

SEQ ID NO: 38745 - DNA, 73 bp, Chlorella protothecoides
ccttcctgggtctcccctgtcagatggtcaacttgccccctcatgctttgcagcatccagttcctacacccac

SEQ ID NO: 38746 - DNA, 30938 bp, Chlorella protothecoides
  modified_base (235)..(244): a, c, t, g, unknown or other
  modified_base (452)..(461): a, c, t, g, unknown or other
  modified_base (1209)..(1218): a, c, t, g, unknown or other
  modified_base (1338)..(1347): a, c, t, g, unknown or other
  modified_base (1652)..(1661): a, c, t, g, unknown or other
  modified_base (3225)..(3234): a, c, t, g, unknown or other
  modified_base (4180)..(4189): a, c, t, g, unknown or other
  modified_base (4488)..(4497): a, c, t, g, unknown or other
  modified_base (4713)..(4722): a, c, t, g, unknown or other
  modified_base (4810)..(4819): a, c, t, g, unknown or other
  modified_base (5352)..(5361): a, c, t, g, unknown or other
  modified_base (5526)..(5567): a, c, t, g, unknown or other
  modified_base (5702)..(5711): a, c, t, g, unknown or other
  modified_base (5944)..(5953): a, c, t, g, unknown or other
  modified_base (6438)..(6447): a, c, t, g, unknown or other
  modified_base (7262)..(7431): a, c, t, g, unknown or other
  modified_base (7521)..(7530): a, c, t, g, unknown or other
  modified_base (7620)..(7629): a, c, t, g, unknown or other
  modified_base (7813)..(7864): a, c, t, g, unknown or other
  modified_base (8396)..(8405): a, c, t, g, unknown or other
  modified_base (8996)..(9005): a, c, t, g, unknown or other
  modified_base (9249)..(9258): a, c, t, g, unknown or other
  modified_base (9711)..(9720): a, c, t, g, unknown or other
  modified_base (10185)..(10194): a, c, t, g, unknown or other
  modified_base (10426)..(10435): a, c, t, g, unknown or other
  modified_base (10806)..(10815): a, c, t, g, unknown or other
  modified_base (11898)..(11907): a, c, t, g, unknown or other
  modified_base (12488)..(12497): a, c, t, g, unknown or other
  modified_base (13500)..(13509): a, c, t, g, unknown or other
  modified_base (14382)..(14391): a, c, t, g, unknown or other
  modified_base (14696)..(14705): a, c, t, g, unknown or other
  modified_base (15019)..(15028): a, c, t, g, unknown or other
  modified_base (16362)..(16371): a, c, t, g, unknown or other
  modified_base (16680)..(16873): a, c, t, g, unknown or other
  modified_base (16942)..(16951): a, c, t, g, unknown or other
  modified_base (18598)..(18607): a, c, t, g, unknown or other
  modified_base (19272)..(19281): a, c, t, g, unknown or other
  modified_base (19365)..(19374): a, c, t, g, unknown or other
  modified_base (19597)..(19606): a, c, t, g, unknown or other
  modified_base (19840)..(19849): a, c, t, g, unknown or other
  modified_base (20331)..(20340): a, c, t, g, unknown or other
  modified_base (20804)..(20813): a, c, t, g, unknown or other
  modified_base (22113)..(22122): a, c, t, g, unknown or other
  modified_base (22552)..(22561): a, c, t, g, unknown or other
  modified_base (22655)..(22685): a, c, t, g, unknown or other
  modified_base (22775)..(22784): a, c, t, g, unknown or other
  modified_base (24372)..(24381): a, c, t, g, unknown or other
  modified_base (24759)..(24768): a, c, t, g, unknown or other
  modified_base (25718)..(25727): a, c, t, g, unknown or other
  modified_base (26651)..(26660): a, c, t, g, unknown or other
  modified_base (26915)..(26924): a, c, t, g, unknown or other
  modified_base (27125)..(27134): a, c, t, g, unknown or other
  modified_base (27370)..(27379): a, c, t, g, unknown or other
  modified_base (28902)..(28911): a, c, t, g, unknown or other
  modified_base (29129)..(29393): a, c, t, g, unknown or other
  modified_base (29486)..(29728): a, c, t, g, unknown or other
  modified_base (29937)..(29946): a, c, t, g, unknown or other
  modified_base (30522)..(30531): a, c, t, g, unknown or other
  modified_base (30757)..(30829): a, c, t, g, unknown or other
acatatcttcgcatgtgttgcatatgttgcagtgtatgacaggagcatcaaccgagaatgaccacaggcgccgcaatcgcgaggtgattagctgtcgacgtttggcgttcggggctttgtcaatgccttgtagagcgccaacgcccacacccccgtcctgtcccctccaggcccagcaacggtttcgccagcggcaaaaggtcatgcatgatgcgcacctgaagcgcttgtacgnnnnnnnnnngggctttgtcaatgtcttgtagagcgccccccgtcctgtcccctccagtcccagcaacggtttcgacagcggcaaaaggtcgtgcatgatgcgcacctgaagcgcttgtacgcactggatgcagaggcagaccgacttttggatgaaaataaagctctcagggagaggtgggaggtggagaccagccaatgaggttgctcaacgattnnnnnnnnnnctgccatctgtagggctgagtggtgactggcgtcctccacgcttcgtgttcacttggacttccctctccctgcagcatagcaagtcagtttcgtcgactgcatgtgcggctggccatgctggcagtctttgaggcaacccccagctcgaagagcgacctgcagtctctgctgggaccccaggtgtggaacgggtaggcaacactgcattgccttggctgcagcctttgcaaacaggcacgaggcatgacagttgcctcaatcccagtatgtgccggcatgggcccacctcgttctcagtgcattgtcgggccaccgcctgagcacaatccctgccccggcgtgcaggacatcccggccctgcccgattacatggcggatgaggagcccttgccaacttcagtgcatgggatcgtgacaggccctgaagaggaggtggaggaggtccaggcagagcaacacgccccggccaagccaggtggagataatgtggcgaggggcctgtgggtgactcaccagtcgcagcaccatcgcagggaagcagggtcattcacacctcctactgacgtccctcgctcacctgccccatcaaacctgcagcccaacctcaccaaccgacggggacactgtacgaaatggcagcgaagatttgcaccgtggatgacctcctgcacttcaacgatgcctggaaggtggggtcccgctcggcccccactcccgcagtggcaccgggcagggcacgatgcaggnnnnnnnnnnttcacgctcggcccccactcgtgcagtggcaccgggcagggcacgatgcaggcaatgttgttctgtgtgacgaggggaagaaactcctcagcacccaacccacctctcctctgtctccannnnnnnnnngtatgtgacgaggggaagaacctccttagcacccaacccacctctcctctgtctccaagcacagatgcagaacaggctgaatgtgagcagctaccaggccaacccaacgcccgagactcaaagcactgtggaggccaacctctggttccagctcaaaaccatggagcgcctcatgctgcaggacatgaacctcgttcaggtgaagggaatgccacagggtcgtcaccagggtcgcaggcttctgcactttggatgccccccatgggccctctcatctatcgccagctgcaaggatgtggtctccnnnnnnnnnnggttcaggtgaaggggatgccacagggccgtcaccagggccgcaggcttctgcacttttgatgccccccatgggccctctcttctatcgccagctgcaaggatgtggtctcccctgctgccattccccacgcctggtcatggacccacgcctctcctccctgaaaactgcagggcatgatgcggcacaaatactcggagcaggggtaccaggacgacctgtgggagaagattgcggtgtgtggagggtgctgcactgttctgggacgcctggaaccccctgcccacgctgttgcagtgtgtcccggggacggcgatgcgcctgattcaccgggtgcagccacgcggtctcgaggacccagttgcgccagcccccacaccagcgtcccctctccacgacgtcctggctccatgcaacgcagaggcacttcgtggccaagctgccctccgccgccgtgctgcaaatcagcaaggcgcacagtcacctcgtggcgaccattgccgagggccgccgggtcaggctcgacgtgtctgccgagctggcgaggctgacctccccgtccgtgctggaggccgggggcctgattggggtcgccgccgcctccctccaggtgctggcagggtggggcctcggaggagcgctggaacaaactgccctccagactcaggactcaaaggttcacaaggctgctggcctgctgagtgctgcctgccgtgcgcgtgcctgtggcaatgcagcgcccccccacccttccggccctcgcaactgccccccaacccaatcacgtggtctccacgcagatgcgccgggctgtgatggaggtgcaggctgcctccgcccgagacacggttgcagctggaggcgtctccgaggcgcttataattgtgaggcggcgtgagaagggatttgcgatggagcaggggctgcctgggtttgcgccgcgactgtcaccgtcagcaggcagcgccggtagatgtggagaggggacccacgaccgcctctggccctctgccggttcccggctcccctgcgtgcctccgtagttgcccagtcatgcctgtgggcccccttcgttccactcatctccaatccaagtgcaaccctgcagaatttcgggccactcaactatgccactatgggggccaagtcgggtcgcaacttcccggacacactggagatagctcggcacatggtggagatatatgatcaggagaacgcggcctgctcagacctcgtatgaaatgcaaggccggccaggatgcaggcatatgatgctgggcactgccgtcgttcgattgccttccgcaaggctatgaatggatgtgcagcggtggcatcccgacctaggaatgattatgtcccacttgatatgtaagttgaggcctgcacaggcacagcatgtgttccaaatgcttgcccaataaatgaaatgatgttgatcggtctttgctcttttgacgactctgtgtccttgaagggtccttgccattcttcacgctctcaaacgctgctcccacctggaactacaagatcgtggcttgccatggagcatggcagtattcctnnnnnnnnnnactctcaaacactgctcccacttggaactacaagatcatggcttgccatggagcatggcagtattcctactctgaacatttgaaaaggcgtggctgctttaaaagttgagcttgtggcttgctcttgtgtaactcacttgcagaaccagggcgtgcttgttgatggagggactctgctctaatttgtcccgcatccccaccattctgcagtgactcgatctggactgaggacccaatggcggggaatcagccagcgacccgcgatggccatgctaaggacagtcacccatcattcagtggagctacaagcttagacggtgctcgactttgtactcaaccctgtctccacaccccggttgtccaaccacagcgtatatataagcgagtgtgatagagagcagcgcacgaagaggtacacctcgtcaacaccgctcgcccatatataatgggtttcaaacaacagaacattaggctgccagccttccaaaggggctgccaccttgtgaccagcgacattgtgcgggagatcaaccccctcctcaaggggatccatgcgggtctctgccatattttcatccaacacacctcagcatcattaacgatcaatgagaatgcggatcccgatgtccgagtaagagggcttgtgaaagagcagacgggaaggggcacagccctgccatggagaattctcatgaatgggcaagaggacagggagcatagtcgatgttgtatgctcatcccaggcccgttataatgacaggcagacatggagaccttcttgagcgcagtcgtgcctgaaggctccaaagccccctgggtgcatagtgacgaggggtgaggtgctggcagaggttgagggaggatggtgggattggctgggccctcatcccattcaaagcagatggacacatgccggtttaacaaagtccatcaacccccctctccnnnnnnnnnnaattcaaagcagatggacacatggcagtttaacaaagtccatcaacccccctctcctgtttaatcttgcttctctcaggccagatgacatgccagcacatgtcaagtccagcatgtttggagcgtccgtttccatcccaatcacccgaggacggctagcacttggaacatggcaggtggggtagccatggttggaagtgccagtagggcgtggatgtgtccaaggagagggctgctccacggggggcaaccttggattcagcctggcactgtcgcagcgacacgggatctgaggttcannnnnnnnnnaatgtgtccaaggagagggctgctccacggcgggccgccttggattcagcctggcgctgtcgcagcgacacgggatctgaggttcagcacaactttgcgcatcatcctccacagggcatctggttgtgcgagcaccgaaatgcgggggggcgaaggaatctcgtcgtcacggttcagggggagtgaagggcagaaagtgtctgaccccgggggggnnnnnnnnnnaggcgtaaaaagtacagagagcactttggtggagacatctccgacagactgcacatcgggaagaaccatttcgtggtaggatgttcannnnnnnnnnccaagcttgcctcgtggtaagagccttgctggaaatatgtccgacatgccattgagccttgtagatctaaaaggacaaaaggagggcatacaaaagtacagagagcactttggtggggacatctccgacagactgcacatagggaagaaccatttcgtggtaggatgttcacacatacctgcatctctctccgtgcagcgctatacaagattatggaaggcagagggcgccaaattgacgtcattcaaacaccaaagcctgatccttgctctcatacccgatatattcccatccctcgggcatgggcaggagtgggttggttcgacttgctgaatccccctggctgctccacatcaccctgttcactacatgaatcaccaagagctcgagcagtacccgcgactggtcatacgacgattatttaaagcttgccacctaatacttgagcgtaatcgatcctcgcagccatcattgcgggccatacacgagcgttgcaatgatgtgatttggtgcggtccaccctgggccgccgnnnnnnnnnnatagaatcaacaacagctcgagcagtacccgcgactggtcatgcgacgattatttaaaccttgctacctaatacttgagcgtaatcgatcctcgcagccatcattgcggaccacacacgagcgttgtaatgatatgatttggtgcggtccaccctgggccgccgnnnnnnnnnnnnnnnnnnnnnnnnnnnnnnnnnnnnnnnnnntacccgctgggtaacctaccaaatcgatgtcgaagggggaaatgcagacaatccgcgatcgtaatttgtcatgatgccctaatacctgcaagttctccatgaagcccccgttgggcattctccagtctggagagnnnnnnnnnncacccgctgggtaacctaccaaatcgatgtggaagggggaaatgcagacaacccgcgatcgcaatttgtcatgatgccccgatacctgcaagttctccatgaaacccccgttgggcattctccagtctggagagtttatctgcgctacgcgcacatcatctgagaggtcggaggaaaacccagcgtcatcaagaggataagtgcctcgtgcaaccaggatgagcgtctcgacnnnnnnnnnnaaggaaaaaccagcgtcgttaagagggtaagcgcctcgtgcaaccaggatgagcgtctcgacccgccagagcgctcccgacactgctcagggtacaaccgatccgggagtcctgcgagcccgacaactgaacaaggaggtgggtggggtcccacacgttcaggcatccggcagtccagcgcaatgctgtctgacacgcagcatggtgatcactcctctgtaggcccagcagcgtttcaggcagcggcaggcggccctggtgcaggaccaggagtcccgtttggttgcgggccaggaagagattgcctccctcaaacaggaaaaccgtgtactcagaaggaggtgggttttgggttccagctgatgcatgcccagacagttcatcaggagtggaatgcggcatcacctgtgctctccgccgtgcagcctggcactttttgctccacccggccccttccacgtgcaccactctctcccagcatcgannnnnnnnnnatggtgcaggaccaggagtcccgtttggtcgcgggccaggaagagattgccaccctcagacaggaaaaccgtgtactcagaaggaggtgggtttcggggtccagctgatgcttgcccagacagtgcatcaggagtggactgcggcatcacctgtgctctccgccgtgcggccaggcgctttttgctccacccggccccatccacgtgcaccactctctcccagcatcgacctccagctgcgggtgctgggctgtcgagatgccatgctggcagcctttcgggacggagtgcatctcaatcccgccaggcagcggcctgccggacgagagatgcccactgagccgcaggccctgccggggcagcaaccttcatcaccccagccacgcgacgaggagggtgcagggcgagcatgcctcggcgcatctcccaagtaccaggcccacgatgccagccctgggtcgggcagcggccatccagtgctgcaagcaccctgtggtggtgtggcggcccgggcggaggcggcctctggtgtggagggtgagcactgcggtgtgtcctgggtggcttggcaggacgtgcatggggatccggcgcgggcacctgacccactcaccctggatccagagggcagagggagagggtggtcgcccccccccactcctcctcagaggagtgggaggagctgctggagggcagcatccacaccgcggacgacgtgcgcgacttcttcgatcgatggcaggtgggacagggtggtgctctttttgtgttttcttttctgctgaagcaaagctactgctgactaggaggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgaaattgttgcatcaccaggcgaggaacgctctcctggtgcgggactatctggcgcggcgcaacgcggcgagcagggagcggctgnnnnnnnnnnacatgaatttgttgcatcaccaggcaagtaacgctctcctggtgcgggactatctggcacggcgcaacgcggcgagcagggagcggctgnnnnnnnnnntgtgctctgtttgtgtttccttttctgctcaagcaaagctactgctgactaggaggcagccacgcccttgccgcgcagagcaggaatgccctggcaccgaagccagggcactgcagcccacgtgggcaagtgtagcatttcacccccatgctcttgcgcagcctatacatcctcctctcacccnnnnnnnnnnnnnnnnnnnnnnnnnnnnnnnnnnnnnnnnnnnnnnnnnnnngaaggtcacatggcccacatgatgcgcatctgggaggggctgtaccagcggctgggcctcctcgtgctggtgagtcgagccggggacaggggggggggaattcagacccctgcctgacgagcagggggctggtggggtggcgggacgtcggagcccagctcgcacattgcttgcctgtgccggctggatgatgacgacccagctcagcgagccgtgcgccccggaccccctcctcccccccgcccccctttcttcccacaggccgtggtgctggagctggtggtccagcgagggtcgcaggcggggccgccagacctcgcagcggtgaggggcgggggtgcgtgagtgggcggcgccgtcctggcgccggcggcagggcgcgcacggcctgacacctgccgcggttgcaggcctgcccgtgcgcgccctttcctccacgaccctcctgcgcttccagcgcccctccgcctcccgggtccacgccccgccaccctccgccgccacacaggccaagctgctgcgcctggtgtcnnnnnnnnnngctcccgggcccacgccttgccaccctccgccggcacacaggccaagctgctgcgcctggtgtccagcgagaacctgtcgaagatgggggcgatggtacgtgaggaaagcgccgcgcgcgccgctcccgggcgcgagtgccaggaggcgatggcggagctgatggggctgggtggcctcccatgcgacggggagcagctcagtatgggggcttcagcctccctcaccctgcgcgtgagtaccctggaggtaatggatgggtgaaggtgcctacattcgcgctcaaagcgtcgagtatgccggcggtccccgcgcaaacgctcaagatggccacgccagcgcgtcatctgacccatggtgcacacgcctgcggtccctccccggtgcagatcagggggctggcagagcaggtgagcaagaacgcgagctggaacctgcagcaactggtggagtggcacaccaagtggaagacggtgagcaaggcaatgggggctcagggttggtctgggtgtgcaaacctgcgggctcgggatgcaggagagacacaagccgggggacgtgtcacctttgggtcgggccaccagccagcggnnnnnnnnnntagggttggtctgggtgtgcaaacctgcaggcttggcatgcaggagagacacaagccgggggacgtatcacctttgggtcgggccaccagccagcgggaaaggctatgctgccgtcccagccagcaagtgttaatcaacccacgggggcaccccgtacagagcatgcccatccatcaacatcctgatgccttgtgagcataggatgccttcccgcaccactggatgtgactggagcaggcctcnnnnnnnnnntacacgggggcaccctgtacagagcatgcccatccataaacatcctgatgccttgcgtgcatgggatgccgtcctgcaccactggatgtgactggagcaggcctcatctctcacaagggtgtccctttcagaccatcgacaatctcactcacccacatgaccatgctgggtttgatcacgcccatcccctgcctacccatgtgcacagagcgtcgggacgctcggctacgcgctggccttctcttgggggcgtggggctgcggtcgacttccctgagatcatgagggccatggtggagcaggcttgggcgcaggaggctggggtgacagagtttgaggagaagatcggtatggccggtccggtcttgtgtggcaatcgggcagaggactgacgtgtgagagtggaggcatgagaatgagttccaatggcagcacagccagtgtgcagaccatnnnnnnnnnnatggcagaggactgacgtctgagagtggaggcatgagaacgagtttcaatggcagcacagccagtgtgcagaccatcatatgtgtgcctgtggtttttggctggctcggagcaggggcctgcataccctacccagcatactgcgcagattgattatttaactgcagccagtacatgtctctcctttgtgtctttcgtacgtgtccagaacatcacaactggcagctctcctgcactctgatgcattcgaaccatccttgcgtcaagtactataccttgcgtgctgattgatgcctctctcccatatattgttggagccttggaagcctcatcatgctggacttcttctgttagaccccattcttagggcaaatgtcgacttcaagtttctactcatgtatagcctgtacttccttggctctcatctcaggatcatgtctggtgctctttcctggtgtaacaactnnnnnnnnnnttttgggggctggctcagagcatgggcctgcataccctacccggcatactgcgcagattgattatttaactgcagccaatacatgtctctcctttgtgtctttcgtacgaatccagaacatcacaatcggcagctcccctgcactctgatgcatttcaaccatccttgcgtccagtactataccttgcgtgctgattgatacctctctcccatatattgttggagccttggnnnnnnnnnncagggcaaaattcgacttcaagtttctactcatgtacagcctatacttccttggctctcatctcaggattgtgtctggtgctctttcctggtgtaacaactctcctcaccctagtgtactgacaggttctcggcacccaacaccgtttccttcccagtgggtcccctgggagatgttttgcagcaagtcgatgtgcttcggttcctggtccaaggtgggcgttgaccacacatcagcctgcagctgtgcggtcgtctgacgagcatccctccagcagggcccattgtgcgtttctcccttcctaggctgtggtcccccccccactgtccggtgctgcaagccctcgagtattgcatggacaaagctgcttnnnnnnnnnnttctagtgtactgacaggttcccggcacccagcaccgtttccttcccagtgggtccccagggagatgttttgcagcgagtcgatgtactccggttcccacccacatcagccagcacaccccttgacagtggagctttagggactctcaataaccctcaagtcatagctccttctgggatgcctggtccaaggtgggcgttgaccacacatcagcctgcagctgtgcggtcgtcagacgagcatccctccagcagggcccccttgtgcgtttctcccttcctgggctgtggtcccaccccctctgtccggtgctccaaaccctcgagtattgcatggacaaagctgcttgagttgggtggagggaagatctgtcgcgcgccaatgccgaggggcgcatgcggcgcctcccggggggggcttgttcatccaggccggggcgaaactggtggcccccggccccaagatgggctgggggccgatgcggtcagttttggtcaggctgggcgtgtgttttcagcgcagcggtcagagggtgttgccaagggtatctggtcctgaagcaagacgagcacccgccgggcaggcgggcggcgtcgggtgacaagggcagaggggaggtgcgctcagcgtggcaagggaggaaaaagaggagcgggcttgtttgtcctcagggccccggctggtcggggccctcctgctgctgccgtgccaccgcctccagcagggcagacagcgcctgcaccaggggtccaacggcaggctcggcggcgggctcggcgggggcgggcgccggggtctgcacggggggtccctccggcatggcgccccgcgggtcccgcgaagcgcgcgccgccagctgcaccgacccctgctggctgctcagcagcagggccagggtctccaaggcgctcgggggggacccccggctggtgctcccgcccgagccccgcccgctcgacatctgctgcggggaggagggggaggggggggttgcagaagttgagcaggccgtcaggggatatcgagagagtgacccatgtctgggatggcctggcggcaactctgcaagatcaatctgtggcnnnnnnnnnnggggatatcgaaggagtgacccatgtctgggatggcccggcggcaactctgcaagatcaatctgtggctcagggtgggattgcctgaccagcacccctctaaacatagatgctcccgagcaattgtgggggtggggcggccgcccggtctgctgtgctgccccgccgcacctggaggaagggggagggcgtagcgcgctgggcctcgaatcgcacgcgggcgtgcgggtcggcgaccacctcggcgggggggacctcgccggcctgcagcgccaccagctcctgcaggcggctgaggagggaggagaggctggaggcctggctggagggcgcaaggctggggtggggcaggcgcgccgagacgcgggagatgaagtccgtggccgggctggagtagggctcgccgggggcgggggccctgtgccccccctgcagccgctccaggtggcccgaggccagggggctgcgggcagggcctgcgagcggcgggcaggccggagatggtggtggctcgaggcaggggtccggggacaaggtgggaagggcggtcaggaaggcctgcaggcatgggcccgcgccgannnnnnnnnngtgcgggcagggcctgcgtggggcgggcaggccggagatggtggtggcacgaggaagggggtcggggacaaggtgggaagggcggtctggaaggcctgcaggcatgggcccgcgccgatcccaccggtggtgtacaggcatcgccccttccctcgtgatccaccctcaccatcgtccagaaacaaatagtctacacacaccccctccccctcgaattcccacatctcctggaggctcaccatagccataggacgcgcggtggagctgggcgcgctgctcctcgcgctccatgaggaaggcacggcgcgcgcgccagttgagcatgcgcagcagctccagggagacgacggcgtgggtgtgctccgagtccgccaccgcttcgttcagttgggtgagcaggtcgacgggcgtggggaagagcgcgctggccgggaggtaggaggtgaggccggggagcgcgggcgcgatggcgcccgcgcccgagggagagggggcctcccccgccgcggcggacgggccggggggggaggggcgcaggccggatgtgcgacgcgggcgcttggtcggctgcccctcctcctgggaggtggaggtggcgggcccgctgccggccgctgcctcggcggcctgcatcgccgcggcctgctgcaggtggtagttcacgtgcagacccgagcgggtgggcccggtgcgctgggggggggtgagcagggccaggggctggggaggggggccttgggaggggccggacgtgggctcgctgctagaagcccgcccgctgggggactccggcttatcgcgaccagggcctccggagagcatgacggggcggggagcgatgtcgaacaccctctaagcttggaccgactctacggggtgagcggcggggaggggtgcgagggggacccgctgcggctcatgaatggacgtacgaaaccaccgtgggttcggtgtgcgggcgacggcctggtggtgcggaatgggggggcatgctggactcttnnnnnnnnnngcccgctgcggctcatgaatagacgtacgaaaccactgtgggttcggtgtgcgggcgacggcctggtagtgcggaatgggggggcatgctggactcttcactacatgatcatacatggcacgctcgcaggtgggggttgaaagggagccggggtatgagactgacctcggggagccgaggttcaaatccggggaacggtcagacgctgcggaggtcaaggtcccggctcaactttcgcctgtggaacatccgttatccttgcacattccctcatgtacctcggcatactagggagaggagaatgcctagccatactggacaccgtcatactcgacgcactcccctcctccagtcgcaaccatcccaagaagccacgagaagacgccccggatatcttctacggggcctccatggcttgttggcgattaatcgtgattgggtggctggccaagtcgcgcacttcgtcgaggccgccatactcgcacacggaaccccagcagatctcgcctgcacgcccccaggctgccccaccagggtcacgggcacaatcgaccgcgccagcggggcagtacagggcgtaattctaccttgcgaaaccatcgcgacacattacctgggattattaatgtttacatggcacgctcgaattcgtggagcccggtgcggaggccggaaaaacggacatgtcgagtgcccttcccacgacatcggcgttccgtaccatactcgtccttcccccggggcgacgctgtatgatgttgcaccctcccatggcaccgcgcacgccgtggccagaccttaatattagcattcacaacaacgaacaaggttttcgcaacgccaggctctgcatggaagtcggactcgaagccnnnnnnnnnngggattcacaacaatgaacaaggttttcgcaacgcgaggctctgcatggaagtcggactcgaagccgcctgggaaggtgcttaatgggaaaaacccagggcgacggcgagatcaggttcgtgccgcacattcccaccagcaaccacgccttttcctcccactagcaccagggaaggtacgaatcgctgcagttggcgaatctgcgggggatcgcattatggtggtgacgtctggtcgatccggagagacttcaggggaaggaccttaaatgggttgctgtccatacaagggtatggggatgaagnnnnnnnnnnccctcccactagcaccagggaaggcacgaatcgctgcagctggcgaacctgcggaggatcgcattatggtggtgatgtctggtcgatcgggagagacttcaggggcaggaccttaaatgggctgctgtccatacaagggtatggggatgaagtgcaggggtgcacagctccgtcgatcccccagccacatacgctccacaccccacgagccacctgccgtccacgtcgtcttccctgcaccgtttcccagccacctgctggatgcctcctcaccgtctcggcgtcggcatcgatgtgcagctgcggctccagcnnnnnnnnnnccgatcccccagccacatacactccacacccacgagccacctgccgtccacgtaatcttctctgcaccctttcccagccacccgctggatgcctcctcaccgtctcggcatcggcatcgatgtgcagctgcggctccagctgccggaccatggaggccttgccctcccgcgtcccgcagaacagcaggcggtgggggggcagctggccatggtttgggcccaggagccccgcatgctccagggctccccgaacggtagcctcgccgacgtcagaggccacgtgcgccagggcatacaggttcccccgccgtgccagctccagcaccagggggatcatgctgggcatcacgctggccgagtcctccagcgcattggcggagggctcctgagggcaggagggaggtgggtttgggagggccgtgtcaagctggtgcagtgaccagcctcgcaggcacctatccctcagaggggcatcccaaggcatggggcaaggaccacagaggcaacggggtcaggcacaggagcacaccccagacaccatgaaaatacggtcaacccccaaactggcgccagcttgcacgcacggcagctcccagtccctctgaaggacatgatgcattcatgatctccaccccgcccccggatgcccctcccagccaggcacctccagcagagtccctgggagggagagtgtgaggctgctgacgccctgcaggcaggcagccaggcctgacagccctggaagcacagaggactgagcctgggaggcgggagcggcagacctctccgcggcagcactccctgagagtgcatcaggggccctggcagccactggaccctgagctcaagaagtggggagggggccgcttgcagggcgcctcttttgtgcaacaatgtacagccaacatgggcgaccagcagttcccgcatcaagagcagcaaagggacgcccgcatgcttccgtttctactcactgggtatgaagcagaccgcagccctgccccatccacatttgcctccctcttggtcctcactgcaaacgcaaggtggtgtggaaccaaggatgtcacactctctctttcacattagcaggcccggcatacaaagggtccgaggtgagccctgcctcccatccaaggcctcacatcgttgggctctaagctggaggtatccatacaccacagctgccaggcccaagatacccgtgatcgaccaggccgttgcggcgtgtccctgcgcaaggttgtttttgctgtgagcgtggagtctggtgcagtgcaggccagcgtgcacggcagcagttgctcaccccagtgctattctgcaggcgcaannnnnnnnnnacaaggttattttggctgtgagcgtggagcctggtgcagtgcaggccagcgtgcacgccagcagtcgctcaccccagtgctattctgcaggcgcaacagcaccccgcgcataatggctcgggggtagttcattcccgagctcataacgtatcgagatattgtccaaggctcgctgacatgacgtcgaattcctccctgcctggatgctggcaggggctaagtctccggggagatggtccacgtctgagtgtgggcccgcgcgcgccactgcaaaggtgatgaacgatcacgcaggccaacatagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgggacgttgaaggtagtgttggactgcagatcgctttggtatatgcgtgttcgttaccgccaatgnnnnnnnnnncgctggcaggggctaagtctccggggaggtggtccacgtccgagtgtgggtccgggcgcgccactgcaaagcttatgaacgatcacgcaggccaacatagggagcagcggggactcgtgacgcgccttgacaaatcttaagataatgcttgtcgaccccgatgaccacaatacctgactgcatggggcaaggccggagcatgtgctgcgaatagggacgggatgagtgctggaggcacctcacgaagtgatctggcagcagcaggccgcaagaaggtgcgatgggacgttgaaggtagtgttagactgcagatcgcgttggtatatgcgtgttcgttaccgccaatgtcacccctggatgcacagctggccgagtttcgaaggcagaaggccgctgctgctgccgctgcaagcaaggtagccgcacaatctccgcccaatggagcccgaggctcgaagaatggctttgggggctcgctgcagagttccacagaggtgctgactaggccgctacccgccgtcagcagcagtcctgagcccacccctgaacccagcaggactgatgcaccgcaggcatcggatgctggccttggtgtccctgcagccacctcacaggattccactggacctctgcactggctggacaggactgatggcgtgtcaagtgggacccaacccgccgcaccatcctccccatggctaggtccaagcccacccagtgcctcaccggcgcctccaccagccaggcagccagatcctgtgctcgacagcttgtttctcgccaagcgcagtcacgaggggatgatgcagcatgatctgccaccacagcccgctcctctggtggcagaccctggcccaggtggcaggcccgcccgcccggactggcttcaggccgcccctggtccttcggcgttcatagccgacaggacctcgaggcctgaggccggcagcgggcccggcacgcagcctgtcagctcaagctggcttgggccggggctccccctgcctgccgctcctagcagcacttcacgcctgggcgagccccgcccatggagcggcacccttacgccacccctccccgcccctcccccgccatcctccaccagcgccgccctcccttcggcggccagcagccaagccgggagtgtggcgggggacaacccccaccagcccgcggacggcgtcgcctcctcccgtagccgccgcgccgactttgcggatctgcaggcccacattgccgagctgacggaggagcgatttgcgctgcagcggggcctggcgcagcaggcgcagcaggccgccaccgtgacggccgagcacgagtccatggtgcaggccttcaaccagcaggcacgtaagggagtgggggaggagagggaggggagcatgaccgttcagggtgtccgctttcagtgggtattgttgtcagggtgaggcagaggcctgaggtggtcgcaagtgaagcagcacctggctgctctgaatgcctggcggttaaaggcagtgacgtgaggccaacaggctgaagcccctcccaaggaaaccttccctgcttatcaacttgacacgatacccaggtgttgaacaggatcaccccaaagcacaccatattacccctttttaaacccgggttccagggcgcggtggnnnnnnnnnncgtggtcgcaagtggagcagcacctggctgctctgaatgtcacgcagttaaaggcagtgacgtgaggccaacaggttgaccccccccccaggaaaccttccctgcttatcaacttgacatgatacccaggtgttaaacaggatcacccccaaagcacaccatattacccttttttaaacccgggttccagggcgcggtggtggaggcgctgcagcacgaggtctcagcgctccgggagcagctggctgaggcgatggcgcgggaggaaagcctggcgcagcaccgggacgcgctgacccacgccgccaccgtcgcacaggagagagcccaggtgggaacactgaggatccgtgtgtggcagggctgacgagcggggctctggctgtccccagggtctggcatgcacacctcgccaaaagctggtgcacaccttggtgccgatccccgccgtgcatcaccacgccaggaccttgccatggaggtcgtggcgctggaggagtccctgctgcagcacaagtccgcgaccctgaagcagggcatggaggaaggcgcggcggcggggacagccgcccgcctgcaggtgcgcacaggagctgcagcccgctggggaatgaacaaagggagagtttgttcacttgctggagccccccccccccccccccgcnnnnnnnnnncgcgtcactggagcagtcgagatgtcgcagcacttgacgctgctctttccttcctcgagcctcgcagacacagctgatgtcctnnnnnnnnnntgcgtcactggagcagtcgagacgtggcagcacttgacgctgctctttcctttctcgagcctcgcagacacagctgatgtcctccgagaggcagcggcatgacctggaggaggacctgcgcagcctgcaggaggagaacgcggccctgaagtaccaactgcgggccgcgtttgcggcaaaagatgcaggggatgcagagaaacaggccgtgggcgtcgcctcnnnnnnnnnnattcgggaggagaacgcggccctgaaggaccaactgcgggccgcgtttgcggccaaagatgaaggggttgcagagaaacaggccgtgggcgtcgcctctaggtccgccgccggagcgggcgccgcgcacgaaaccgatcatgcaggcatgctgtcagcgaccgaccctcctgtgccggaggctggggaggctggggaggctgggaccgccaggaccactagggaccccctggcnnnnnnnnnnactgtcagctcccgaccctcctgtgccggagactggggaggctgagaccgccaggaccactagggaccccctggctcccagagcgccggcgcccgcgccgacccatggccacggccccccgccgggcctgccccgtcccgagcccgagctgcgccaggggtctgcagccctgccggccgccctggagctcctgctgccgaggtacaccctggtacaggcggaggatggtgggttgatggagagcgaggcggtgctggagacggtgcagtccatccagggtctgctgaagagcctgggtgtgcggcagggggagctcctggccgccctgcgccggaaggaggtgggcggccttgttttgggggtgggaggaggatgcctaggttatttgggatgcgctcgtgagcacatgcatgtcgacatcaggggggggtctccgcctcagcagggaccactccatctggtccatgcacaggagcaattannnnnnnnnntgtctccgcctcagcagggaccgctccatctggtccatgcacaggagcaattagctgccctgctgacggcccatgaggaagcaaggtcacggctcgcgaggcagcaggcgcagatggagcacttggcacagcaggtggacgggagcgtcagtgtgggaaggtagccatgtctttgaccctgccgggaagctagagggcatgcatgacgcgcgaggcgcgggcaacaggctccgtgagtgcctcatgccctccaatgctgtaacaacaaatatccatttcattgagtgctctcatcatggtgttggcaacgctcatcggcgcaccactgggtgccgtggcagggctcgcggtgagatgaatggccaggcctcggatcgctggtgctttcggtggggggggagggggtgttgagatgcctgtctatacatacaacccagctcccacctttcaccatgcgtagatcnnnnnnnnnnagtgagttgaatgcccaggcctcggatcgctggtgctttcagcgggggggggagggggtgttaagatgcctgtctatacatacaatccagctcccacctttcaccatgcgtagatcggaggactgatcacgagccgattcatcggcatcacccccgattcctccctgacgcggctggacgtgtcagcggacgaccaggacaactttgatgtcctcgaaaccgaggggaaaccggtgggaggcaaggaagtggccttgctgggcgacctttcccgctggttggaggacccggatcaccgcagggtaggtgcaccgtgcttgggtgggaaggggcaaggaggacatgggagcccagtccctgcagctgttgatccccagggatcactggttccctcgccacccgcatgcaggtccagttcatcaccagcatcctcggcctgctgtggccgaccctgtcctcggctgtgtacaaggaggtgctggtgcaggccaagcaacccctggaggatgcctgcaagatgaccaatggcctggttgcctccctggccatcacgaagctggacctggggaccatccccccgcgcctggacagcttcagaaccatgcactcagagtcggatgagctgatcctggaggtgggcaggggctgggtgtgccatggcgagcagggcacacgagggttttgggccatgctgcatggcgccctgcagctcagaggagcatagctgtgactcttcatgccagatgcagtgtcctcacgtcagactgtcagccacagagcacggcttgcccttgccctcccaccgcattccaggccccgctgttctggggcagtgacttaaaggcggcagtgtctgccgtcctcaaagtcggaaagtttgggctgatcgaggtccccgtggaaattgcaaatgttcaggtacacaggctctcatgcaggctggcaggctgaggggtgtgtgaagcgctgtgggcccatgtggttctagatgctgaggcacgtcagccatgcttcctctcacctccccagatcaaggcgcttgcaaggatcaccatcaagcccctggtggagacactgccgtgctttggtgggattacgctgtccctgatggaggtgaggttttggggggaagattcttgcacccattccaggaaggctcgggctgagacagtgtcttgctcgtgtgcatgaggtggtggggtgctctctggaacacgagcaccgtagcatttggtcgtatggtccctcaactggtctgtccttcacaacggtaggcgccacatgtggatctggatgtgcnnnnnnnnnngctctgagaacacgagcaccgtagcatttggtcgcatggtccctcaactggtctgtccttcacaatggtaggcgccacatgtggatctggatgtgcacctggctggctccgcagatctgctggccctccccctcgtccccgaggcagtcaagcttgccatcaaggtgggtccacacggtgctcaagggcatgggagatcatgcccttgagtgctgattgcccttgcgttcctggatatgctgccccctcatcagtctgcatgatcatggagggaggcacaggctgcaaacaagggtgtgcatgagcatcgcaacacccttcctcaccacactcttttattacctgcagatctttgcggggcagatgctggtgtaccccaatgaaatatcggttcccatcatggagaactttggggtcccgcccccccccnnnnnnnnnntgcacaggctgcaaacagggatgtacatgagcttcgcgacacccttcctcaccacaccctttaattacctgcagatctttgcggggcagatgcnnnnnnnnnnnnnnnnnnnnnnnnnnnnnnnacctgttctgagtctgagggtctgggttgcatgcatcgctgacgtgctccttcatgcctggggtcgggtcaagcattgcccctccctcannnnnnnnnnccctgttctgaggctgagggtctgggttgcatgcatcgcttccgtgctccttcatgccgggggtcgggtcaagcattgcccctccctcaccttctcaggttgtcaacggtaagaatctgaagagctcctggtttgacaaggtcgacccctttgtgaaagtagaggtgcgagccctgctccgagttgggaattcaggcagtgtacggggcctgcagccggagtgggtggtgactcctggggttctcatgccgtgccactcagcagctccctggctggacgactgggaaggaggagcatcccggccgcaaggacctctcccttcctccccttccaggtgcgagagggcaagggcctgcagacgaccaccatcgacaacaacagccaccctgagtggaacgagacactgctgtttgtggtggatgatccggtgagcgagagtgcagctggattgctgtgtcacgccctgcctcgaggcctagcacacagcgctcggcttggtgctgcatccgttaccaccatggaatccggaggctgatggcctcccctcgtgcccacatcaccaatccttgcagctcaagcagagcgtaaagatctgcgtgatggatgaggatgtcatgtcctccgacgtcgtcggtgttgccgaagtccccctgaagggcgcaggtgcaggccaacagaggggtgtttgctggtggcgtcgtcgatttcaggactgatgactattacttggtgctgtctgtgattgcagaatctgcagtcccctggaaggcagcaacctcgtgtgttccatgattggcgacatctcgtgtgacgcacttgctactttcacgtgccaagatctcacccctgagagacccatcgacggccccttaatcccttggtccccgccttcagagtttatgctgcaagcaggacgcagcgtcagggccaccatccctatccgtgagccgccgccccaggacgacgccgtgctgcaccctgaggcggcgccggatgcacacgaggtggcaagggacctcaagggcgagaacgccaccgatgcgcaggcagcgggggcggtggtggaggtggggccgtcctccgagacctccacgccgcgggagagtggggacacaggggccagtgggggtgggaccccggagaagaaggagaagaagatatccaagctcctgcgcaagctgaagtgaggaactgttgtgtgtgtggtgaagagggggggggggaggaataactcgggagagtgcatgagaggtggtgggggagggtaagcaatcttttccaggggactgcatgtagccaagcttgccacatcaggggcatggctcgatgcatgggcagggctgtcaccatctggttctcccttgcccccctcttccgcggcaggctcaagaagggcccctcgcatcacgaggaggacacagcctccagcaacgtgacgacgcatgcaaaacactcccctgcatccaagaagaaggaggggcaccggaagaagcatgggaaggatgcgcagggtgaggggccgggaggtggcgagggcggcgcatccacagctgcctctgaatcgtggggttggtcgcccggcgggcannnnnnnnnncgtcaccctctggttctccatcgcccccctcttccgcggcaggctaaagaagggcccctcacaccacgaggaggacaccgcctccagcaacgtgacgacgcatgcaaagcactcccccgcatccaagaagaaggaggggcaccggaagaaacatgggaaggatgcgcagggtgaggggccagggtgtggcgagggcggcgcatccacagctgcctgtgaatcgtggggttggtcgcccggcgggcactcacctcgcgctgcagactcgcctggcttccgtcctgaagcgggctgcctgacgcggctgctcctgccctcacccccacgcgcaacccaacttccggcgataatggttcgcgcaccacccggcgcgcaggnnnnnnnnnnatcctgaagcgggctgcctgacgcggcagctcctgccctcacccccccgcgcatcccaacttccggcggtaatggttcgcgcaccacccggcgcgcaggcgaggtcacggggcacctgaccctggagttcaagttcacgcccttccggggcgcagccacagtgaccgacggtctggaggagcccaagcgcgtggcaccgcgccaggcagggccggggtgtggggggaggaggatggcccgcggaggggtatgcggccgcgcggcgggcggcggccagtgcacgcgccagtcagctgacgagtgcccggaacccctccacgacccccctggccaccccacctcttcacaggtcagcaggagcacgaccaagcgacccagggccgaggacagggggctgctctcgctggacctcaagcgctgcatcgcgctggaggtgggcgagggggctcgggcagtggggcgaggccggggcggagtgtgctgtgttggatgcgttgctgcatggcctgggcgggtcctgaaagggcctggaaagggggaatgttgggcgaacgatgcatggtgtggctcccccggggcatcacctcagtatccatcatggagcctctgtacggcttttgtgcacccatgttcctgccactattcccggcctgtcgctgacatgtgctggctcccctcaccccatcccccttttcctcctgggctgaacaggaggaggccgacacgtttgtccagctcacgctgcacgaccccacccgggggtccagctccgacaccgtaagtcggggcggctggagttcccggaggggtcctggaggggccgatctctcgcggccgcgaccctgcgctgcatgacgtgtcagacgacaccctgccgctaccgcacttgacctcgagtgcccttttcgtcgtcggccctccccgcaggtctacaagacgccagtcgtgcnnnnnnnnnncgacctcaagcgcccttttcgtcgtcggtcccccccgcaggtctacaagacgccagtcgtgctggaggagcagaacccacagtaccgcttcaagaccgactttgtcaatgtgtcggccatgtccaccctcaccctcaccgtcttccaacggcccagcttcacggcctccacgatgggcaaaatcccgtttgtgcacaaggtgaggcggcgcaaaggggtggagttcttgagacgattccttctacgtgcctgtcctggggcctgatgatgggtaggcgaggagataccaggcccagcaggggtgcggcaaggcatcccaccccacccttccacactatgcaggccaaggccaagcagatggggtacgtgcagatcaaagccaggaatgtggtggacgaggagcgcatcagtgggaagtgggcgctgcaggaggcacaggtatgtgtggaggtggaagtggggtggtgtgactgcgcatccagcgcagcttcgacttgaagtgctgagggctggtgttggccagcgggtgcgcaggcagtcgacacatttcacacccgtcttatcccgccacggaattcatcggtcacagacgggagagatggacctggcgatttcctggcatgccatcgacgtcgaagactttggtgacctctgaggaaggggcacatggagggcccaaggggtacactgggtggcataccaccgttgtattatcgaccacacgctgctacgtgtacaccttccggacgtgtttatacctttttataagtatcgccggtcgaaggctgactattcttggatgtcaccaccaagcatgcgtgtaggccgcaataccgccgagcaccggcgaggaatgcctcgaggctctttcgccaaatgagacgagcttagagtattgatcataccgctctgatgatgcttcannnnnnnnnnagccacaaagcatgcgtgttggccgcaataccgtcgagcaccggcgaggaatgcctcgaggctcgttctccgaatggaacgagcttagattattgatcataccgctctgatgatgcttcaatgtcttttcgtcgaaagtcatactcggagtatgagcattccaaacacccgagcaaaccggcgaaagcgagacacgttggtgctcgggtgttctttcatcaatcactgtgagcatcatcaggcttaggatgaagnnnnnnnnnnaaatggggtgaagtacgtcgcaaacccgcataacgcaacgatcacaagctcatacttggaaaacgtgttcctgaccagtttctcgccttatcggtgtcactgccccgcaacccgaaatgaggcagccaaccttcaacttgtctttgcttgctagacctaccatcgatcacggcgtcgtactccttctcagagcaatcccannnnnnnnnnggtatgagcctgtgatcgttgcgttatgcgggcttgcgacgtacttcaccccgtacactggatgtcataagcttcaatgcttcatcctaagcctgatgatgctcacagtaattgatgaaagaccccagagcaccaacgtgtctggctttcgccggtttgcccgcccacagtacgggtgttcggaatgctcatacttcgagtatggctttcgacgaaaagacattgaagcatcatcnnnnnnnnnngtttcaaattttgtttgcttgctagaccaaccatttgaacatggcgtcgtactccttctcagagcaatcccacatgagcttttacagcaagaatgtggacccaattgtctcagcgctgtctgccacgctgtacgaagtctcggccgagacaaccttaaccctagggatggaaaccgagaatcagcatgattgtgctgcgatatccaggcggctcgtactaggttccgaatctcgacaaagtatgagttctgttgattatcaccatcgcctttgcagcttccaactccagtacagaccaatacacccccaagctccgctccggaggctgcgctggacagatgtcgacaacgtccccatgcgcgtcggagctagagcagacgagtcgggtgcgaggcggggagcagatatggcgtcgcaactcactgtccaggcgttagattgcccttttcgaacacagctcttgcccgttcgcctgcagggtgacgctgaaccacctaagcgacccaagtctgccttcctctgcttcctctcccattaccggtgagtggacgctttcggtgtgtgcgtggattgtttataatggtaatggctcgatatctagctctccacagtccctcacgctcaccaatctcgcccaacgtgcagagcgatttacaaggttcgggccccctgcagtttggcttccggcgccaagggttgtttgcgtgcgtgcgctccggccagtctccccgtgctcatagccttcgaatctaaatcagttctactcacgcccctcgcagacggcttatgggggtcgctgcatgcaccagcgctcgatgtgcgctgctgccggggaggcatggcgtggaatggacgccgctgcgcgggagccgtacgtcgccgagtcggacgcgagcaagattgcctggtcgcattacatggcttctcccgaggccaaggtgtcgcggaagtccgtcggaccccagggcaagaccccttcccgggcaccctccaggcagactggcaggacgccagcccccacgccagcctccacgccgccgcccctactcttcgagcgcgccctcgctccccaggtgggaggcctgcccctgcatgcagctggctgtgggagccaggggacacagagctggtgtgccggtggtggtgagacccctggatggaacttgccctcctctcaagggcgtcctaagagcgcaccctagcccattcacccatttcccatccccatccacaggacatgcagcagagccagagctgggggtcgtccatggcgcacaccaccgtgtccgtctccgtcccctccccctccgccagctggcccctggccagcgccgggcccagccccgacaccctgcccatgctgacggggcatgttatcccctggaccaccgactgcttcctgaacccccccttctccgcctaccccctttccgacctggcgcccgcggcgcagcccaccccctcccccgcgcccctccccctggagcccagtaaggccgagctacccaacccttttgcggtcnnnnnnnnnncaatggctcgatacctagcgctccaaagtccctcacgctcaccactctcgcccaacgtgcagagcgatttacaaggttcgggctccctgctcttcggcttccggcgctaagggttgtttgcgtgcgtgcgcaccggccagtctctccgtgctcatagccttcgaacctaaatcagttctactcacgtccctcgcagacggcttatgggggtcgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgcccctgcatgcagctggctgtgacagccaggggacagagctggtgtgccggtggtggcgagacccctggatggaacttgccctcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccgacccggcgcccgcggcgcaacccaccccctcccccgcacccctccccctggagcccagcaaggccgagctacccaacccttttgcggtcagtgcggcagcggagggccggcgttgctccgccgtcccccgcccgggacctggccctggctccccctttgccagccaggcgggagagctgccagcgccgctgagcctgcccaacnnnnnnnnnncggctccccctttgccagccaggcgggggagctgccagcgccgctgagcctgcccaacctgggttctgcaggcctgcccaacctgggctcaacaggcctgcccaacctgggttcgctgggcctgcccaacctcgggtcgctgggcctgcccagcgtggagtccctgggcctcggcgccctcgggctgccgcagtggtcgcagggcctgctgcagagcatggacagccgcggcccctgggtgcgcgacatggacctcctgccgctgtgggatgaggtgctcgccctttccaccacgccccagaccagtgcctggccgtgcctgccctccgtgagggtgtgaggcatccccctctttctcgttttatcacctcccttccatcaataaaaagaagggcccgaccagcgcctgagccccctcccccccttcctgtgcacgcccaacccccttcctttctgtatcctgcccccccccctgctcccccccattttttgtgagcctcgttggctcctcgatgaagctctactgagcgttgcctcataagcttgatggctttgtccatcgctgcagctgctgcnnnnnnnnnnatttctcgttttaccacctcccttccaacaataaaaagaagggcccaaccagcgcctgagccccctcccccccttcctgtgcacgcccaaccccctacctttctgtatcctgccccccccacctgctcccccccaatttttgtgagcctcgttggcccctcgatgaagctctactgaccgttgcctcataagctcgatggctttgtccatcgctgcagctgctgcnnnnnnnnnnnnnnnnnnnnnnnnnnnnnnnnnnnnnnnnnnnnnnnnnnnnnnnnnnnnnnnnnnnnnnnnnacggcatacgccctcccaagcacgggcgcccctctccccaaagcccagtccccccacgcccacagcatctctccccacaatgcacacaacttccccggatcctgacgct

SEQ ID NO: 38747 - DNA, 68 bp, Chlorella protothecoides
cccttgtctgactgaatcccctccccccccaccccaaccacgactggaggtcaaacttgcttccccgg

SEQ ID NO: 38748 - DNA, 77 bp, Chlorella protothecoides
ggctgaccgccaggccgcccgcgagcgagaggcggagctgtgggagacgctccgagctctggccctccgggccacag

SEQ ID NO: 38749 - DNA, 67 bp, Chlorella protothecoides
ccggcgcccacggcgcccttgccgccgccgccggcgctgcgcccctcccccttcttggccgccgcgg

SEQ ID NO: 38750 - DNA, 61 bp, Chlorella protothecoides
aacaatccgaaagattgtgagggagccaggcagtcagcagagcgctgacaaggcgagagaa

SEQ ID NO: 38751 - DNA, 61 bp, Chlorella protothecoides
cccagccatcttgtcaaagatatcctgcagatgggggcaagccaggtgtcaggcagtggca

SEQ ID NO: 38752 - DNA, 97 bp, Chlorella protothecoides
ctgggctcctgatgacttgcaaggctgcacagcggcacatacagcacactatcgcatctccccacctccgcacctctgtggcaccaaatatctttct

SEQ ID NO: 38753 - DNA, 61 bp, Chlorella protothecoides
tcgactttgagctggatgagatgcggcgcaaccgccagtactgaggggctggcgcgggtgg

SEQ ID NO: 38754 - DNA, 78 bp, Chlorella protothecoides
caggcgtgggggccgctgctgcgtcccccccggccatcattccacacacgctccgaacccaaatctgctccgcaggca

SEQ ID NO: 38755 - DNA, 61 bp, Chlorella protothecoides
aactcggcatctgcatggcaagaggctgggttgatactcatccgacatgaagtctagccca

SEQ ID NO: 38756 - DNA, 71 bp, Chlorella protothecoides
gtgggatctctctcagaattggtaccgtgtggacgtgcaattgtttgtctgggacttgttcaggctgaagg

SEQ ID NO: 38757 - DNA, 61 bp, Chlorella protothecoides
aaccggtgccagctcgccaggcatgggggttgggtgctggggcccatgtgtctctgtgcat

SEQ ID NO: 38758 - DNA, 71 bp, Chlorella protothecoides
tccccgtttctgaaagcgtgtgtgtgtgtgggggggggttggggggggatgaggagaggagggttgacgtg

SEQ ID NO: 38759 - DNA, 72 bp, Chlorella protothecoides
attcttcgattgtatccccgggcttgcaccgtcagggtcaagcatgggccggccttgcaatgggccacaggt

SEQ ID NO: 38760 - DNA, 79 bp, Chlorella protothecoides
gcgcagcagctcgcacccctccaggtcgcaggctacctgtaggacggggggaaggaggtgggcgcctcaagcaggggga

SEQ ID NO: 38761 - DNA, 65 bp, Chlorella protothecoides
ggagggcctgggccgacagatcaccattgggccacctttcatgagcatctctccacattccttgc

SEQ ID NO: 38762 - DNA, 64 bp, Chlorella protothecoides
ggccctcactgtcttcaacctccaagtgggcattcatcaacccccaaccaccaaggaaatcctg

SEQ ID NO: 38763 - DNA, 126 bp, Chlorella protothecoides
ggcgccccccggcgccccccggcgcccctcgcgccgacctacattcccatggtttcccccccgccaaccccccacggcagaacccctgacgagttcgcgcggcatgtgcggcacgcaatgacccag

SEQ ID NO: 38764 - DNA, 71 bp, Chlorella protothecoides
gtaatagtggtgcaatgttatccactggggcacgatgcaaggatgatcgtgtgtcacttggaggggcatgg

SEQ ID NO: 38765 - DNA, 89 bp, Chlorella protothecoides
tacagtatggacctggcaaaccctgctccacataccggacgtcggagcagggtgcatggtaatataatgcgactggactgccttgcaga

SEQ ID NO: 38766 - DNA, 76 bp, Chlorella protothecoides
ttgtcacttacagacatgcactggttgtttcgtagctggcatccagcagcagcaggggacaggggatgggcatgtg

SEQ ID NO: 38767 - DNA, 103 bp, Chlorella protothecoides
tttcgatgcttcttattatttttaggcgggcctgacttgccctgtcattcccacagaaagacgatggtgaacagagtgactggggcacggtacccacatattg

SEQ ID NO: 38768 - DNA, 119 bp, Chlorella protothecoides
catttcccctgcatgacattctccagcagctcatagagaaaggctctaacaaagtcttatcatcaccttatacttgatgacaatcttaccgcagctctggaactgaagcgggcagagcg

SEQ ID NO: 38769 - DNA, 61 bp, Chlorella protothecoides
ctggtacattgattatggcattgcacaaagaggagccataatgtttaagccatatctgccg

SEQ ID NO: 38770 - DNA, 61 bp, Chlorella protothecoides
gcgtgatgatctgggcgggaaaggggggaactggaaggcagaacttgcgagaggctccaga

SEQ ID NO: 38771 - DNA, 61 bp, Chlorella protothecoides
gcgagcctggccgagtgaccaaagaaatccccccttgtgcaggaaatgacaaccatggaag

SEQ ID NO: 38772 - DNA, 61 bp, Chlorella protothecoides
atggaggtgggcaggggatttagtggtggggggtctcctgtccccaagtgtgcggcacagg

SEQ ID NO: 38773 - DNA, 9313 bp, Chlorella protothecoides
  modified_base (3493)..(3502): a, c, t, g, unknown or other
  modified_base (3978)..(3987): a, c, t, g, unknown or other
  modified_base (4725)..(4734): a, c, t, g, unknown or other
  modified_base (6092)..(6101): a, c, t, g, unknown or other
  modified_base (6270)..(6279): a, c, t, g, unknown or other
  modified_base (6865)..(6874): a, c, t, g, unknown or other
  modified_base (7028)..(7037): a, c, t, g, unknown or other
  modified_base (7336)..(7345): a, c, t, g, unknown or other
  modified_base (8123)..(8132): a, c, t, g, unknown or other
  modified_base (8260)..(8269): a, c, t, g, unknown or other
  modified_base (8384)..(8469): a, c, t, g, unknown or other
cggccgcttgcgcgacgcgccggcctgccactcgcagaaggggcggctggccgacccctccgacgtctcggcacgtccccctgcctcggcccgagcggccgccgcggcgctgctgcccggcggcgaccccgccaggatcgtgctgagcggccgggcctgctgccgcggcgtgggcaggctcaggcagctccccgtgtcggccgacaccaggagcaggcgggcgggggactggacctcggagtggccgtgcggcgtgccggggcgctgcggcgagagcgcagtgcagcaggagccctcgccgccgacccccgccgcgtcgaggcgggggtctgccgcggcagacgcggcgccgccccgggagctgtcagcgtcggtgaacacgcgcgtcgcggaaccggacaggctcaacagcggctcgtcctcgaacccaggcttgggcacggtgtctgatgatgccaggcaggggacctccggctcctcacagcaggccctgcaggttttgttgggagggggagcggaaaggggttgatggcaggatcgatggggcacgccattccccattctgtcgaatgaatcgaaaaacatccacatgaggagccactggggtgccagaccatggcctagcccaggcaggcaaaggatgccaggcaagaatgttgagggaaccctaccccacatccaaaaccaggggcaaaatccaagcgccagggtaacaacgacgcaccatgcatcttccagctccctggcttgttcctcaaggtgcatggccaggcatgggaaggtctcggcatccatgaggtcagaggacagcagctcagaaggactcaacaggccctcctgtgggggggacgagggcgagggttggacggtatcccacccaaaacaggcaggtgtgacatgccccgcctagagacggcgcgatcaggtgacaatggcccatgatgcatggaggagcatagcactggggcgtgcatggtcgcattggccggaatccatgcccgccgactggaagcatcgatgggaactacccgctccccccaaattcaaacacgagcacaacggcaccgtcagggagcagcatgccgcatcgcagtcgctctgcgatgccatatcatgcccgtcaacacacctggcagggggaatccagactccgccagtccaatccgcatcccggggttggcggagttgacatgagcgccgtcgctagaagctcctggtcccctctctcgccacaggcatatgggagttcgctgagagcatccatgagaagctttttgtgtccagcaaagccgaagcgtggtcaatgttgggagaaaggggaattactcctgagtttggcgccaaaacgtgtccggtgccggagacaggcagcactcgggtctggggagatattcggatcgaccaccccacccaacaatgccaggctggatcggactggtctgtgctttgggcaggagctggtgaaagcgcctgctatcaccgtgtggagtcccggagctgatcaccctgcgcgtacgacgcctgatcccaccctttccaccgcagtcaacgggctccaccttcatctggctgcatgagcccgcgctggaccgcggacccgaggcgccgtgttcccgcgaaactctcaaaaacaccggctcccatgacttctacaccaagtgcagggtatgcagcatcctcactccaggtccatgctggggccgcgcagggacagggtgtctcccgccctgaaccgcatggaggtgctgaagctcccagaaggcagcgctgccagcgacaactcgtcagggtagaggtggatgtcctggtacaacatccgaaggcgctccgcctcggcctgagtctctgcctctccctgtgtgggatgggtgccggctgagcgctggggaatggaacagcatggaatctctgatgcatcgcggacgtttacgcagcaaggagagggtctccctttcggccaggttctgaattgcaatgccatgccaaatgcttgctggatgtcgtcccagacacaggacaatgcaccccccccaccatcaccaccaccccctggtgatgccgatgcaggctatcccccccctcggccagttccccaaacctgcgcagaatcctgccggccgcccacgcaggccccgcccgccttccgacccgaccctccgtgtgcttggaggaggagcaggggctcgtcttgggcaggcacgctgtctgcccactccttgcccagcactgggcgccagctgaccagccactcggcagccctggactggtctgcatcagagtaggcgggggcctgggcttccaggctggtgccagagatggtgagactgtcggtgagcactgcggaagggtgggacggggcggcaggattgtgggagaggtgaccacgcttcaggagccctggtgcaaagcaccctcaaaggtgtgcggtgggcagcaagacgctctccttcgtcggggtcctggcctcaccgttgccgaactcggggatgccgggcagatgccaggcgcggagggccgcctcgcacaccagcagcaccccgcaggcttgcgcggggttcaggggtgagaaggacggcgtcgaggccgagagcgccccccagttgccctcgccttcttcggccgcggccgtgccgggcccccacacccggtcccgcaccagggtcgcgaccaggggcgccccaaccgtggctggcagggcctgcaccagttcgcccagcaggcacagcgtctgcggggtggcctcctcccaccaggcctggcaggcggcgggggattggggcggcgtgagtgtgggccggtggagaccgccaggcgcccgcctcgcaagaccagcgactgcaggggatggaggcctcgtccccccgccgcacctgccatcccctccacgcccaccggccctggccccaaacccccgcccaccggccatgcccccccgcgcacctgtgactcgaggcagcgcgccagcagctccccctggcaggcgctcaggctgcagccctccagcgcagccaggaggaagccgagggccggcgcggcgccgtctggggccgaccgtgcggcgtgggcccaggcgctcagcagggccgtgggggcgcggccgtcagaccccggggggaacccgccgcggccaaggaagcggtgggcgagggcccagggctgcgcgccaggcgcgctttcctccagcgcgtccgccagcgcctcgagtgcggcggcgcgcgaggccaggcgcggcgcgagcgccgggagcaggcaagcctccaggctctgggccaggacggcgggcgcccccggccgccacgccagcccgagggcctgcgtcagcaggacctgggcggggccggggcccagcgccgcagaccgctgcgccagcacttccaccacggcctcgcgctcctcggaccctagttctgcgacgcatggcaccgtcagtggaaagggggaggtgaaggggtgcgcggatggggctgcgccaggcgcacatggcgacgcagcnnnnnnnnnngccctagttctgcgacgcacggcaccgtcagtggaaagggggaggtggaggggtgtgcggatgcggctgcgccaggcgcacatggcgacgcagcctggacttggtccgcagacggccgctccgccctgcctttgaccctccccacatgcacagccataccaggcagccctcacctgcggtggccaggtggcgaatcaagcgggacagcagcgtgtactgcgggaattgcgagtcggggcaggcctcctgcaacgcgccgaggacggcctcgcgcacgggtgcgccccccacccagcgccgccgcctgtccaggaactcgagcgccgccgcctgctccgccgaggccgggccagaaccctttggcagggagtggcgggaaggggagttctgggtgtgttgtgagcatgcaggcatgggaaggccctgctgatacggtgggcacagtggctggcgattcgcaaccccatcccttcctnnnnnnnnnntgggaaggggagttctgggtgtgttgtgagcgtgcaggcatgaggaggctctgctgatacggtgggcacagaggctggcgattcgcaaccccatcccttcctgtgccgaacccacttgttgctcctccccaatacccaaggctcctcaccgaggaaagggcgagcaggctcgccagcgtgcccagcgcggcccccgcatcgtcctcctcgccctcctccagcgccgtctccagcgcatccagcgccgtcagagtcagcgcgcggcggtgggcggagggcgcgcccaggcgcgaggcgagatccgcgtgggcgagcagtgcggaccaggcgccggcccgcagcgtgcgcagcgtgctctcggccgcgtgctcccgcccagagaaggggaccctggggttggcctcgctgcacagaccggggacaaacgtgtccaggggccgcaggagctcggcggtggtctgcaggggagagcgggggggagagggggccgtgtgaagaggcgacaggccagcaggctgctggctgtgtcgctctccccatctttggcgcccagctctgcacccaattcattagagccgcccaccaatgctgcagagtcctgcctctatacctactgacctatgcaggaatctggtaagcctgcaccgcctgcccagcccagcagcccgctcagtcagcacaggatcatgccatatcgatgcagccgcccaacccccccggtccccccccacccccgannnnnnnnnntgagccgcccaccaacgctgcagagtcctgcctctatacctaccgacttatgcaggaatctggtaaacctgcaccgcctgcccagcccagcagcccgatcagtcagcacaggatcatgccatgtcaatgcagccgcccaatcctcccggtcccaccccacccccgagcagccctcccatgatctcacctgggccgtgacaaggtcgcggaggagctgggtgcccaacaggcgcacgccagggctgtcatcctccagcagccttcccaccacgctgtgcctctctggagagtcgccgacagcgccagaagcgcaggagctccagcaggccgtgaatgcattcctggtagggtcctggcgaggtgggacagttgaaccatcagcgtagctgctggagcagaagcctgagctggtttaccactgttgtgtcatgcattcctcactgacctggatacatgccccgaaccgatgccatggcactgagcctcctcaacattcaagcgtttccaggaaagaccctcttcatgcgcaatcaaccctccggcctaccactggccccaagatgagctcccgtgccagtgtgttgcagagggggctgccaagctccttaatcatggttcggtaggcctgcactgtaatctggacatagccgagacgccgggaggcaaggtccttggccagcctcctggccaggcgccgagaggcctgtgggatggatgggtggggtcctagcggctacagatgcatgcctactcgcgatccgaggtcacgaaggcaccataaagactcgtgtgtcgccggcctgggcacccaaccccctccgcaccttggggatgcgatgctcatttcgagacaggtactcgcaaagcttcttcacgctccggtcaaccccagggccgggggtctgtcccaggctgggttccacctcggcagcttggaaaacactgggaacaaggaagttgtagcgcttcaccgggactcgggccgccgtggcgacccccatgcagttgcatggcaggtccatcctcgggcgcctgcgctgcttggggcgcagctcacccgatcagagatgtccagacccgagcatatcctacagatgagtatgtgcagggctgtgatcagccgatcgatgtctgctgtgctcaatggtctgtcgaaacctcagcgcttcatgcactacggtgatctcagcgcgcacggcgatcattcgagcttcccggtggtgcacccactactgcatgcagcaaccatcactgattgtgaaagaattctacatgaactgtgtacgtgcatgaaaagggtagtctggcttcaaaacttggggtcgacaaaactggcgcaggccgcgtccggcacccannnnnnnnnnttgtgtacgtgcatgaaacaggtagtttggcttcaaaacttggggtccaaaaaactggcgcaggccgcgtccggcacccacgctgtggcaggcagcaaagactcgccaccaggactcggatcgggctcacccggagccactggggacctccaggcagatctccccaaannnnnnnnnnaccaccaggacttggattgggctcacacggtgctactggggacctccaggcagatctccccaaatttcaggtcccggaagtcgcgcaggatgcgctgccccgccctctccacctccgcattgaagaggcgctgcgcgatgcgctccacatactcctcgctggtgatccccccccgccgcactcggtatcgcgcctcgatggccgcccagatttctgcctcacgcggcaggacgctgacctggtccaggaaggaggcggcgatgcgcgaggcggtgtatgccgcctcgccgatgtcgttgcacatggccagccgcgcggcggcggccttgtccttcaggctgaccgggatgatgcctgagagaagtggagtatgggaagggaagaagattgggatgatggggcatgattgcatgcagatgctggcttgtgggctgatgcttgtggtagggtcgggaggcttagaaccccagcgctgcagctgcaggcacgggtgcccgagcccggcaggcgccgtccagcgggctgacccctccccctccatctccaagcaagcggaccccaggcccaccaagcctaacaccccccnnnnnnnnnncgtgggctgatccttttggtagggtcgggaggcctagaaccccagcgctgcagctgcaggcatgggtgcccgagcccggcaggcgccatcctgcgggcagacccctcccttctccaagcaagcggaccccaggcccaccgagcctacccccccnnnnnnnnnnccctacaaccctacctggcgtgtccagcaggtcgatgttgccctgctcccccgccctggcccaggtcagctggcgcgtgaccccggggcggggggcgctgtcggccgcgcgacgacccagcaggcggttgatcagcgcgctcttgcccacgttgggaaaccccaccaccgcggcgcgcacggcgcgcgggcgcaggccccgcgcctcgcgccgcgcattcagcgccgcgcccaggcgcgccgcggcctcctccacctcccgtactcctccgccgcgccgaccgtcggtccaggtggcgnnnnnnnnnnccgcaggccccgcgcctcgcgccgcgcgttcagcgccgcgcccaggcgcgccgcagcctcctccacctcccgtaccccaccgccgcgccgaccgtcggtccaggtggcgggcgtgcccgcctcccgcaggtgccgcgaccatgctgcgcgctcctcccgccccaccatgtccacacggttgagcaggagcagcgtgcgcttgccgcggcaccaccccgccagcgccgggtgggcgcttgccacggggcagcgcccgtcccgcacctccaccaccaggtcaaccgctgccagcttggcctgcagggaccgctccgcagccgcgatgtggcctgggtaccactgcaccaggcccaccgactgggggggggagggggtgggggggggaaataggccgagggacaagggtagatgggtgaccctgtccctaatgcccaggacccgcccctggtgcccacgccgcgccacacgcggcagcgtccgaaaccacctcacatctacacgacgggtctcctccacagggaaatctccatgcttcttcctgggctgccgaccagtggtggtgggggcagccttcgcgccctgcacccgcacgctgcctgctcgtgggcagggccggacgaccccgctatcatgacctcgacatagcccagccccaaggctgggtcggaaggagatggcgaaggccggcatgcatgccctgtgcctgtctgtccgacctgcgacggtgtccaaggcgccgagggtcggtttacagcgacagccctctactccaagaatnnnnnnnnnncgggtaccactgcaccaggcccaccgactggcgggggtgggggggtgggggggggattaggccgagggacatgggtagatgggagaccctgtccctgatgcccaggacccgcccctggtgcccacgcnnnnnnnnnnggggaaatctccatgcttctttctgggctgccgacccgtggtggtgggggcaaccttcgcgccctgcacccgcacgctgcctcttcgtgggcagggccggacgaccccgctatcnnnnnnnnnnnnnnnnnnnnnnnnnnnnnnnnnnnnnnnnnnnnnnnnnnnnnnnnnnnnnnnnnnnnnnnnnnnnnnnnnnnnnngcggcatgcatgccctgtgcctgtctgctcgacctgcgacggtgtccaaggcgcccggggtcgctttacagcgacagccctctactccaagaatgtatggaagtggagaagcccaatgcaatgctcaatgcatgaaagtgacaatgattggttcggggagcatggaacgccatgctgggctccaacgtgcgccgcactgtgtacaggattgggcgtcgcggtgacagcgcgcgacgaagggcttgcctcaatttcacggggcatcagcagcacccaggcaccagcacccccgtaaaggatgcgataagctggtacttggaccccagtgaagggtgcattttgggccgatccccgtgattcccgtcacgaaccctccccagtgcgagcaatccagaatcctgcttgcgcgtgctcttcccagggggtcgactctgcccgcccagcgaggggcaccctccccaaccttgctgcccgcgcggccttttcgcctggagcctggggacatcctcacactggaggctccacatccccaggtcttggcgggcatgacgcagctgcagccggcccccgtgccgcccagcggagagcctcaggtacggcggccgtggacggggcccaccacgcgccgagctccccagcatcccctcccatacaccaccacaaactcacctctgacccgcacattattttcgcaggcagtggctggcgtccctcgactgtgcgtgggaccccgtgggttcgcatggtctctcgtgccgtagggggtcggttgcggatgggggtcccccagccctagggcttttggacccccaccccgccccccggcccgggtccctccccccac

SEQ ID NO: 38774 - DNA, 61 bp, Chlorella protothecoides
gcagcgggcagtgtggtagggggccggtgtgatggcggtgagactctgccgtgcactactc

SEQ ID NO: 38775 - DNA, 76 bp, Chlorella protothecoides
agcaccgagcacccacctcttgccggccgccagagacgttcagcgtgagtggcacctcagcgccgtaggcgctcca

SEQ ID NO: 38776 - DNA, 104 bp, Chlorella protothecoides
gccagaacaccaataccttgtggcactacgtgccccacagttttacccacacgacgagtgatacatagcgagacacctgccctgcctcccctccagtctcctgg

SEQ ID NO: 38777 - DNA, 61 bp, Chlorella protothecoides
cctggcgggagacttcctgctggcgcgggcgtcggtgtcgctggcctcgctgcgcgacacg

SEQ ID NO: 38778 - DNA, 106 bp, Chlorella protothecoides
cgccgcggagcagccacaggtgtgtgtgtggatggggggaggggagaatggctgtttatcacctgggtttacccccgcccgccgcctgacgaccctgggcagcccg

SEQ ID NO: 38779 - DNA, 61 bp, Chlorella protothecoides
ggcgaggcgggcctgcgcccggccggcttccccagcccctcgccatccgtatacgccatgc

SEQ ID NO: 38780 - DNA, 67 bp, Chlorella protothecoides
caatctcggcatcgctccatggcgagcacacaggccagcaagccggcctggctaggtccgacctccc

SEQ ID NO: 38781 - DNA, 64 bp, Chlorella protothecoides
tctctatgccgctggagtgggtctgtggcggcgtcagcgccagcgcctccgccggtagaagtgg

SEQ ID NO: 38782 - DNA, 80 bp, Chlorella protothecoides
gggacttgcatcccttccttgcaagatgtaatccaaaaaacaacatacaaacctgagtggcttcgctgtagtagtaaaag

SEQ ID NO: 38783 - DNA, 62 bp, Chlorella protothecoides
ctggaggcacaacgtgagttagtggagtttcatcctgcagcctcatcctgtcgatgctgctg

SEQ ID NO: 38784 - DNA, 13939 bp, Chlorella protothecoides
  modified_base (138)..(147): a, c, t, g, unknown or other
  modified_base (605)..(614): a, c, t, g, unknown or other
  modified_base (6091)..(6100): a, c, t, g, unknown or other
  modified_base (6587)..(6596): a, c, t, g, unknown or other
  modified_base (7209)..(7218): a, c, t, g, unknown or other
  modified_base (8641)..(8650): a, c, t, g, unknown or other
  modified_base (8822)..(8831): a, c, t, g, unknown or other
  modified_base (9076)..(9085): a, c, t, g, unknown or other
  modified_base (9909)..(9918): a, c, t, g, unknown or other
  modified_base (9971)..(10018): a, c, t, g, unknown or other
  modified_base (10076)..(10085): a, c, t, g, unknown or other
  modified_base (10284)..(10293): a, c, t, g, unknown or other
  modified_base (11218)..(11227): a, c, t, g, unknown or other
  modified_base (11439)..(11448): a, c, t, g, unknown or other
  modified_base (11951)..(11960): a, c, t, g, unknown or other
  modified_base (12497)..(12506): a, c, t, g, unknown or other
  modified_base (13644)..(13653): a, c, t, g, unknown or other
gggggggggaggaatgatggtgtaatatttgggttggagcgccttagcaccacgacgatggcgacgatgaacggcggtggaaatggacctgttcacatacatcgcagccagcccgcccgcccgctcacaggcagtcgnnnnnnnnnngggggtagtgcagtgtcaggcgtggagggaagaggaatgatggtgtactgtttgggttggagcgcctcagcatcacgacgatggcgacgacgaacggcggtggaaatggacctgttcatatacaccgctaccagcccgcccgcccgctcacaggcagtcgtggcggaagacgagctggaactccttggtctccagggcagcgccggagtagtcgggggggggcagggagttgagcacctccgccgtcacgcgctgcacggtaagctcgctgagcgtggggttcagccgggaggccagcacgctcccaaactggcccatgcgcgcccggacatactcctgcgcatgggtgggtgagtgggcgggccggtggcatgggggagggcagaggttttcgcagagccgtgcacccaatacacatgtgcccactcttcatgagtcctgacatgtgaacatgggtnnnnnnnnnngatgggtggaggagtgggcgggcgggtggcatgggggagggcagaggctttcgcagagccgtgcacccaccacacatgtgcccccccttcatgagtcctgacatgtgaacatgggtgcatgccggggccatggccctccctggccgtgcagcggcatcgcagcctcggacccaaacatcgacggcatccgcggtgcggttcgccacccccactgagcacacacctcgaggggacggggcggtacggcatgcaactctgttggcactttgagcccttgcagggcctctgcggccgacatcgcaaggcgagcgggccgactaggagtccaggaccgaggtgggtgtcccggggtgaaaatgtggtactcgggtggctgccgaccccaccatgcactgcaagggccctggccgacgacgcggagaaccggggcgtcctgtgtgggacgcctggcgtcaccagggtgggggtcccgcagtcgtaatgtgtcgggctgtcgggtggcggttcaagggctggcttcacagcagagtcagggagagttgatgagaaggagtccggcctggcgcccttcgcatgaaacgaacgacatcggcaggtagatgcttcgaagctaccttgaactcggccgattttcccgggaacggacgagtccggttacgtaatattggtcacctttagtgaccggatgccgacaccaaacctcagcgcgatcaccaagtataaaagcaaagcaacaaccactctctgaggcctgcagaagtcatacaccgttgaatcgattggcttgcccccttgaacgcccctgtagcagcgaagtgggctctgtacgtctccgtcgtcacaggggtccacctcttgtaaggcctcaaaggggggccgtccccacggaaatgcgctcttcagaggtgagatttgtgttatgaagtgatccaatgcactgttgacctgtggcaatcgctcagagcgcctcctgcagttgctgggcaagaagactgtgagcgagaaggaatggcgcgcgatcctgggcagcacttcgacctcgcaaaccagcatgaacaacttcgtgatggactacctggttacggaggtggggacagagggtttcggggtggcatcctgcctctccgggtgtctgtgcagactctgactggcctgtccctcacccccccaccccccaccacctcagggctactatgaggctgctgttgccttcggccgggagacaggcacgacgaccagtgccaacgtgtcttcggcaatagagaggacacagatacgaaaggccatccaggatggggacatccagctggccatggagctcctgaatgatgcccacccccaggtattcctgatggtgcaatgcagagaaccagcgaccagggcccatgctgcgcagtctccctggctcgtacctgtccccaacttccgcatcttctggaaattccacggtcccaccggcccacagatcctggaggagcagtctggcctgctcttccacctccaacagcagcaggtcatagagctgatccgggcggggaggacggaggcggccctggactacgcgcaggagtacctggctccacgcagcgagaacaaccccgacctgctcctcgaactgggtgggtgctgaggatctgcggacctgatctggagggactgggcctgctggattccgataatgtttggaggaaggggtgtcatctgcgcatcatacaaaattaacctcgacgatgcctgttcgtagacagactggctgtttcatgtcccttggatgcctgctgagccggcagtggggttcttgcagtaccatagctcccttccctgtccgcagagcggaccatggcactgctcatcttcgatgatgtgagcaccagtccgctggcagacctgatggacgtcgcacagcgacagaagacggccgacgaggtcaacccctgcatcctgcgcacccagctggaggtgggatcgctgggcaggggtggaggtccgagtggcttgcaatcgattcctgcggcgcacagcagcgttcgtctcgtccagatcaccaccgcgactgcccccctccaagctcattccccgactgccccactgcaggaggcggagtcccagctcccagtcctgctcaagctcatgctctggatgcaggaccgactgaagggcaaggtggtcttccccgtcatcgaggatgtgctggttgctgagcccatcctggctcccagcaatgaggctgccacatagcagtacacctactgcatgtatgatgatgtattctcactggttcgccatggccctcaggtgttggagacggaaatgtatcgcaagatgtcgatgagggggagatcctcagaacccacgacgcacgcatctggtgcaaggggacccaccgcccatcttccggaaggtgcgagatcgctcgagaaaccccatcatcgccatgcgccccgccgaaggccccctgcagcacattccagactcaatattcgttcagcattcttcgttctcttgcaacacttggatcgtaccatcacactcggacttggcattggcttgcaaggtgcaccgaggtcgactggtccagaaaggaccctacattccgcactccccagccctgttatggacgtgcatggcattcagatgaacacactgggtgagtggcgctggtagagcccccttcattccatgcacgccgtccatcgctcgcatgtctccgcccctcccgctcacaccccccactccaccccggaacagttcgattatcgaccgtgcgcgccctgcgcactgcctggcgggcctccgcgactctccatgccccacttccccgctcatcgagggcgggtgtcggcagcggacccctgtccgccctcagggcctcccccgccgcctctggcgtgaccaccgcgcccgcgggtctctccagcctggcctccctctcctccgcaccccgcctggccgcgcccttcctcccctcgcgcctcgcgtccccaccccggcggtccatggccgcgcatgcggcgtccggcggcggcggcaagcgcatctcccagaccgacttcacggagaaggcgtgggaggccatcgtgtcggcgcccgaggtcgcgcgctcctacaaccagcaaatcgtggaggcggagcacctcttcaaggccctgctggagcagcccagcgggctggcgcggcgcatcgtcagcaaggcggggctgcagcccgggcgcctgctggagtcggccgacgccttcctgcgccgccagccccgcgtctccggcaccagcgagcaggtgctggggcggtcgctggagggcgcggtggggcgcgcgcaggagctgaagtcgcgctggggcgaccagtacgtgagcgtggaggcgctgctgctggcgctggcggaggactcgcgcttctgcggccccgccctgcgtgacgcggggctgaccccagcccggctggaggaggtggtgcaggaggtgcgcggcggacgcaccgtgaccgaccaggacccggagggcaagtatgaggccctggcgcggtacgggcgggacctgacccaggcggcgcgcgatgggaagctggacccggtgatcgggcgggacgacgagatccggcgcgccatccagatcctgtcgcgccgcaccaagaacaacccggtgctgatcggggagccgggcgtgggcaagaccgcggtggcggagggcctggcccagcgcatcgtggcgggggacgtgccggccagcctgcaggggcgcagcctgatctcgctggacgtgggcgcgctgatcgcgggcgcgaagttccgcggcgagttcgaggagcggctcaaggccgtgatcaaggaggtgcaggactcccagggcgcggtggtgctcttcatcgacgagatccacaccatcgtgggtgcggggaagggcgaggggtccatggacgcgggcaacctgctcaagccgctgctggcgcggggggagctgcgctgcattggcgccaccacgctggacgagtaccgcgagaacatcgagaaggacgcggcgctggagcgccgcttccagcaggtgtatgtggatcagccctccgtggccgacaccatctccatcctgcgcggcctgcgcgagcgctacgagctgcaccacgccgtcaagatctccgactccgcgctggtggaggcggcggtgctctccgaccgctacatcgccgaccgcttcctgccagacaaggccatcgacctggtggacgaggccgccgccaagctgaagatggagatcacctccaagccttcggcgctggatgaggtggaccgcaaggtgggtgggtgtttcggggggtaaactattcaagaggaggagcagagggggggacgagggggggtggggggaagctgagatctgctgcctgctcgagccctggaggtgctcctggcactggccgcaccctgcagcaagccctccaggagccttccagaccctgtctctcattccaatgtcccccgtcgtacaaagtcagtcatgacctgtcccccaggcagcttgccacccacttgtacacaagtaacacacacacacaccctccctcctccttcccacaacaggtgctccagctggagatggagcgactgtccctgaacaaggcggcgcccagcgacaagggcgcggcggcgcggctggcgtccctggacgcgcagctgggcacgctaaaggagcagcaggcggcgctgtccagcgcctgggaacgggagcgggacgagatgaccaaggtgcagtcggtgaaggaggagatcgaccgcatcaacatcgagatccagcaggcggagcgcgactacgacctgaaccgcgccgcggagctcaagtatggcacgctgatggagctgcagaagacgctggcggcggcggaggacgcgctggcctcctccgacaccgcccaccgcatggtgcacaccgaggtcaccgagtcggacatcgccgacatcgtggggcggtggacgggcatccccgtcgcgcgcctggtcgcctccgaccgcgagcgcctgctgcatctggacgaggccctgcaccgccgcgtggtgggccaggacgaggcggtgtccgccgtggccgacgccatccagcgcagccgggcggggctgtccgaccccgcgcgccccatcgcctccttcatgtttctggggcccacgggtgtgggcaagaccgagctggcgaaggcgctggcggaggagatgttcagcaccgaggccgcgctggtgcgcctggacatgagcgagtacatggagaagcactcggtcagccggctgatcggggcgccgccgggctacatcggctatgaggagggcgggtgagtcgggtggaggaggtgtgcttgtgtggggaggggggtcctcagaatcatctcactgaaggtgcatgtgggggcttcagcactgcctcccaaacatcctccagaccttcctattttcctcccacccacacaaaggcaactgaccgaggtggtgcgccgccggnnnnnnnnnnatggctgtgtggggagggggtcctcagaaacatctcactgaaggtgcatgccggggcttcagcactgcctccccaaacatcctccagaccttactgttttcctcacacacacacacaggcaactgaccgaggtggtgcgccgccggccttatgctgtggtgctcttcgacgaggtggagaaagcccacgccgacgtcttcaacatcctgctccagatcctggatgacggccgggtcaccgactcgcaggtgggcagcctggcgtggggtgtccagggaggtttgattggatgcttggttttgtggcaaagatccaggggtgccagggagcatgaatgatacctggagtcgatgctgccgttcaagcacgcaacttgccagccaggtcctgggcgggcaacgcgagcctcctctcccatgccataccttgtttactgcaacatcctcccaccacatataaccagttccgtcttgcaatcgctgccacnnnnnnnnnncaccttatttactgcaacatcctccaacctcatgtaaccagttccgtcttgcaatcgctgccacagggtcgcgtggtcaacttcaaaaacacggtgatcatcatgaccagcaacatcgggtcggccaccatcctagagtccatggagcgcgacccggcggacatcaaggacgcggtgaccaagcaggtccgcctccacttccgccccgagttcatcaaccgcatcgacgagttcatcgtcttccagggtctgcagcgctcccagctgcgcagcatcgtggagatccaggcgcggcgcgtggcagagcgcctggccgagaagaagatgggcctgcgcctggagcccaccgcggtggactacctggtggagcgtggttacgaccccgcctttggcgcccgacccgtcaagcgggtggtgcagcaggagctggaaaccgcgctcgccaagggtgagtagattgttaaggggacgggaggggggtattagagggtgggagtgtagaggagtagttatacaacttggctatcctatacactatttttagctgagctaaggctctgacatttggggtgccaaggtctgaggcctgtgctccatggatccccagagaccnnnnnnnnnngggttaaggggacggaggggggtattagagggtgggagtatagaggagtagttatacaacttggccatcctatacactatttttagctgagctaaagctctgacatttggggtgccaaggcctgtgctccatggatccccagagaccaaaccctatgcatgctgcccagtatcccccagcctgtatcccattcctgatcacatgtcccaaacccttcccatgtccacaggcatcctgcgcggtgacttccaagaggaggacaagatcgtggtcaaggcctctgcggacggcacccgcatcgagctgtcggtggcaggaaagaatggcgcgacggtgccgggtgacacagtaagccccgtgcagttggtgccgtgatgggtgcctctgatgggttgcctctgctgacgccttgcaggatgaagtactccagcctgcgatgctcagtctaccatgtttttgttgggaaccgcgggcgatacaggatgcccttttccagtactgtacactcactccttgccctgttgccccaaatgtgcacacaaacccttctctgccgtatgtgctcccttcgctgttcagtgtccctcgcatgaatgctggcatgattgcacgtggtaatctgttacaattcaaagaaagggcccatagaggcgggtcagagcaacgcatgcatataagtcagtgtccccgagcccccgctcctcccagcgtcactggcgtgtcattgcgacaggtctggtgccctacccttgatatgctctggccagagagcgcagacgcacagattgcacgccgaagtggctgccaaggatacacaggatgccggtccgggcctgtctgtggcttcacagtcaagtgccacgcgggttcatgcatctacgagtgcaaggcaacatgtgaggggcctgcatccatttcggtaatgagctggagatagctgcacaggaatcaccacgagtggtgccttactgtctttcaggactcagtttcagcaaagttcgtccatgggaaccaaacagtctttgcattagggctcaactgagaatgtcgagtcctacaaacttgggaggttcagatgctgaagagaagagaccacttctggcaaatatcagggtttcagcactcactgaggatctcctgttgcacagataccaagggtccttgaaggtttgtctgacattcacaacaccataacaaaacagcatgaacctcgattagtctgccacggcacagcaagagggcacaccgctgctgagtaccgttctttcaccacattatcgcccctctggaacaagtcacaactcgcacttcgaatgacaggttaccctcaaacattgctgaagaagctctttctgtggcttcaagtgcttgttcgcgcctcgcgagacgccctcgtttggttgatagattttcgaactttacnnnnnnnnnntcccctcgtttagttgatagattctcgaactttacagggacatggaatgtcccgtcggggtgcgaacgggccgcacgcggcacattgttgtgtctaaataacattaaaatcgtaaagtatagagtgaaaggtagatggagcactgcctgcaactgttggtcgtgcccggggnnnnnnnnnnctgttgtgtctaaatatcattataagggtaaaggatcgagtgaaagatagatggaacgcttcctgcaactgttggtcgtgcccggggcgttcccccgtcgaggccgcaagcgacacaaggaggggtgccagaggagggacggtcccctcctctcttttgcccgtctgaagggactcccggaccccacacgctctgcctgcctgattgctaagctggtagctgagaaacatgggatccacaccagnnnnnnnnnngccaaccggcgggggccattttcgcaccttcgggagaccccgtcgtggccagtagggatacgaacgcatcgcaagaggcatttttaattcgttaatatcatatgaacgtaagagcttcgagtacagagcgatagaacgccgtcgccaaacatcggtcgtgcctgatgggcccctggtggcccaggggcctcccccctccttagcccttagaggggccagatacccccctcctcatgcactgcccttatggatgctggtccagtcgtttacttaaatgggatccacaccaggtgcaaggtcacctcggccttatgtgcccgttgaagcagtctgccgccttttgctgcttcccctctcaagatgggagtggatgcggcgcgctttgccatgttggggtttatcttcgacagtggagaccagagggcgacaccctgccattcagcggcagtgacgtggtgcgttgcccagcctactgcgggatattgtttggcggggagacagctggtggtccgtggtgtgattctggccaggggatgggcggtgtgtcatgcgggcggggttatccgctatgcaggactcatttataagcttctcatcgcacggatgcgccggtgcctcagcagcagacttaacaccttccctttctctatgatgctgccaatgtcccgccacttcctagctccactggtggggggaatagtgcacatctatgatcgaaagatggctgacggccatggatcatagatgcagccggtcccatcgccggcagttcactaggaactgctgtgcagagtgggttaagactccggtggagggaacgaagnnnnnnnnnnacattgcacagatgcgtctatccctcagcagcagacttaacaccttccctttnnnnnnnnnnnnnnnnnnnnnnnnnnnnnnnnnnnnnnnnnnnnnnnnggatggctgacggccatgaagcatagctgcagccggtcccatcgccggcagttccctnnnnnnnnnntatcatagtggatcagcacgtgccacccctcccacccctccgtgagtcaacaacacgttgctcccacgcccccacaaacgtggtagggtatccttccatattatgtgatatatttttctatattgttgaacggtgcggcattctcatttgattgctctctgcccgtcccccaccgcaaccaaccttgcgaacggttgannnnnnnnnngtgaggcaacacgttgctcccacccccccacaaacgtcgtagggtatccttccatattatgtgatatattcttctatatttttgaacggtgcggcattctcacttgattgctctctgcccgtcgcccaccgcaaccaaccttgcgaacggttgaatgagagggagcttcgtcatgcgagcctggaggctcaccggggcctcgaactggcgcttcgggcctcgtcgttcccacaagcagggtggtgacgccaagcgcggctcccactccgcacgcgctggcgcgtcagcgtccctgcccttcgaccccaagtggcttctgctcccccccgccgctgccgccctgctgggcggagtggcctacgcccacaacacccagttcagtctgtcccccagcgtcgccacggccctgcagcagtactcgggccaacacacacccgcccacgactgggaggaggtcatcgccagcgagccgggcaccctgcgggtgctgaccgcggaggcgctgctggcccaggaccaccctttcctggaggatgaccacatgttctcggccttcgtcagcaagggcatcgtggaggacctgacgggttactacaaccccgagcagcggcgctggcacagcgtggtcgctctggggcgcgaagtttgtggcttcccccgcgtcgtgcacggcgggctgaccgccgccatgtttgacgagtcttttggcggcctcctcttcagcctcaagcaggccaaggccctggacttctggggtgagtgggccggggggtggggaatgggcaagggccgggaggggccggggtggaggggaggggccatgacatgggcccgaactccttgtaccaaatatgtatgtatgtacacaggcccgctctggtgagggaagagatcgaaggtcctgcgaggaagagacatcgcatcnnnnnnnnnnaagggggcatgacatgggcccaaattccttgtaccaagtatgtatgtatgtacacaggcccactctggtgagagaagagattgaaggtcctgcgaggaagagacatcgcatcccatgtctggcgcctgacacccacctccctctcccccccctacctcgtccctcaggccccgcatacacggtggcgctggaggtccagtacaaggccaagnnnnnnnnnnccccctcccccacctcgtcgctcaggccctgcatacacagtggcgctggaggtccagtacaaggccaagatcccggccgggcagcgcctgctgtgcaccgcagaggtggaaagcgcggagggcaggaaggtgtggatgaaggccacgatgacagacgggccggggggcaaggtgtttgccacctcccgcgccctgtttgtggcgcccaagctgcagaaagtggtccccatggtcacctcctacctctggcaccgcgtgttcgggagcaagaaggcggcccctgccaacctggagtagaggggcctactggggaggccccgcgctgagccagggtctcttctccccacagaggagaatgaaatgttcgtggagcaccaggctctgccactctgctactgtttatgcatggtgccgtcctcccgctgcctctctttccacgcgcccatccgaaggagggcacggggggaaggcagacggtgagcgcacctcctgagccatgccgnnnnnnnnnntggagggcaggggggggaggcggacggtgagcgcacctcctgagccatgccgtctcagtccttccatacctccttcattcaaccaggcattgcatattggggcactccttcctgccctgcatgcggaccctgtcaccgctcatgaaccctccatcttgctcctgcgaggccttgcttctcacacacacccaatgcccccgtgactgcacattcttacttagcctcaagatattcttttgcgccccttctgaccatcggaaacccttagactggacttgcatgtcccccttgctctctgtgatatgcacataaatcttggattcgaagcaagctcaggtacagggcgaacacctgtgagttcgcaaagtccaagatggcactcacagcctcattctgcaatactcattcttacatcacatatttatttccggaaggataatggagtagccgcgaggtaccggagtcgtcaagaccgtcaccagggcgatggcgccggtggtcacccacgagttcgtggccacagtggccgacagcatnnnnnnnnnnagtcacagcgcgatggcgccggtggtcacccccgagttcgtggccacagtggccgacagcatcgcctgccgcgcccaccccgacgcctgccgcgccctggctcccgatgtcgagtacaggatgcgagaggtggtgcaggacgcactcaagtttgcccggcactcccggcgcacctacctcaccacccaggacgtgaatgccgccctcaagatgcgcaacgcggaggtgaggatagggggaggggagggcagcaggagaccgggtggctcatttgaggcctaaaatcttgctgacctcgtgagagacaggcacagcttgcatgactcacaggcagcgcctcgttgacgcggatgctgtccttccttttttggtgggccgtgatctaaggatgcatacctcgacacgggtccctgcccccccttctcctccctctaccatgctcgactctgacctgctgaccaatccagagtcccctttccccccttcccctttctcactcgcagcccctgtatggcttcagcgggcgggaccccgccaagttcctccgcgcggcagggcaccccgacgtgtactacgtggatgaccccgacgtgtcggtggcctccatgctcgccacccccctgccccggccccccgtggaggtggcggtggtgccgcactggctggccatcgacgggcgtcagccggccacgcccgagaacgcaccgcccgcggtgcccgcacgccgcgccgcgcctgccaaggccgcgccagctgcggcgcaggttggcgccccgccggccgccgcccccaacaaggccctgccggcggccagttctggcggcgagggggcgacgcccgccgttgccgggccccagcccgccggcgaggaggcgctggtgcgggcgccgctgcgccatgtgctcacgcgagagctgcaggcttacctggaccgcgtcggcgcctggctgcgtcacggctcgctggagggcgggggcgcgctggtggcgccctcccccgccgccgccgactcggcggtgctggccagcctggcgggcgacgcggggctgcaaccgctactgccctacctgtggcgcctgatcggggaggaggccggcgcagacctgcgcgagctggcccgcctgccgcgcctcatggnnnnnnnnnnacctgatcggggaggaggccggcgcggacctgcgcgagctggcccgcctgccacgcctcatggcggcggcgggggcgctgctgtcaaacccggcgctggactccggggcgctgctgcacgaggcgctgccgccactgctgaccgcgctggtggcacgccgcctgggcccgaaaggaggcgaggcgcactggggtgtgcgccgcgccgcggcgcacgcgctggccacgctgtgcgcgcgctacgctccggcccacgcctcgctcctaccacgcgtgcagcgcacgct

SEQ ID NO: 38785 - DNA, 74 bp, Chlorella protothecoides
gaggcctccgcagcagacggcctcgtggtgagttgccgggaatcggtcacgcggccccagcatgaacaagagag

SEQ ID NO: 38786 - DNA, 80 bp, Chlorella protothecoides
tttggagctttttgtggaggggaaagggggaggaggtgaggaccgtgacgcgaggaccaggaggaggacagggggacacg

SEQ ID NO: 38787 - DNA, 110 bp, Chlorella protothecoides
gacttgcacacccgcctgcgcgcccgactcacgctttccacgcacccaacccaggcgcacggccagactggagtgtgcgcggggctcagctgagcgaggatgactcgcct

SEQ ID NO: 38788 - DNA, 75 bp, Chlorella protothecoides
cgagctttcagccacatgtattaattccaactccaatccgtccccatttgcacagatttatgacacagagaccgt

SEQ ID NO: 38789 - DNA, 62 bp, Chlorella protothecoides
ctcgctcccggcacgcgggcgaggggcaccacgcggaaacgcgccgccggcgagccgaccac

SEQ ID NO: 38790 - DNA, 86 bp, Chlorella protothecoides
cccatggtgtagccggctgtcggggggagagtaggttgtatcaattatacggtgtgaagaggcatcagatgatgaggggaaccaga

SEQ ID NO: 38791 - DNA, 61 bp, Chlorella protothecoides
atcgcgtagtcggagtctggaaattccagcaccgccaatcctctgacctccctctgtcggg

SEQ ID NO: 38792 - DNA, 61 bp, Chlorella protothecoides
ccctcctccatgtccccagcctccatcatcatcctcagtgtcctcctccccaccctgcccc

SEQ ID NO: 38793 - DNA, 75 bp, Chlorella protothecoides
cgcggtgctgggtgtagggtgcgcagtgatagccttcttccaactaccgccttgattgaatcgtccctccccagg

SEQ ID NO: 38794 - DNA, 61 bp, Chlorella protothecoides
cgccgccgaccgcgacgtgggcccctggcttgcggcggctctcaaggagcggcacccgggc

SEQ ID NO: 38795 - DNA, 6892 bp, Chlorella protothecoides
  modified_base (761)..(770): a, c, t, g, unknown or other
  modified_base (2251)..(2260): a, c, t, g, unknown or other
  modified_base (2374)..(2383): a, c, t, g, unknown or other
  modified_base (2588)..(2628): a, c, t, g, unknown or other
  modified_base (2703)..(2712): a, c, t, g, unknown or other
  modified_base (2917)..(2926): a, c, t, g, unknown or other
  modified_base (6732)..(6741): a, c, t, g, unknown or other
ccggcttgttcaatagaaggtagaactttgctttaaaagcaggcttattttcgatgttctgatagaaaaggctaaggtccggctgtatatatagactgcgatgtgcccctcgtgggatctggttcccggaatatagcttccccggcttccgtccggagagacacacagcgccacccacggcttcctaggccatgttgcatcctcgaagccatgtgaatccacgtcagcgtctttaggtctaaggatagttgggcgtgcctctcggcgggcctgatgaaagagatctccgcgaggatcttggggtgtggccggagattcttcgcgtagggccgatgggatcagatcaggcactgacctcctgaacacacggcagcgaggttctgccttgactgcacttctggagaacaacccggcatgtaagcgttacgaaggcatggcgtcctaagactgaaagcgtacattcggtcatctgtccatccaactatatacagtaacacatcaaccagatttgcggagatacgggcccattcccgatgctctcaaaactttctgacatggaggttccatcgcgctgaacccttctatacgatgttgcatacatcttgcagggctcaatgtttgggcagtcagtgtgaaggacaggaggaactcgagagattgagtcaggatgaggatctgagctccgcgccaatcgatcttaccttgggataatgttgatctgatgccaagttgaagagttgccaggttgatgatcacgcacnnnnnnnnnntgatcgatcttaccttgagatcatgttgatctgatgccaagctgaagagttgccaggttgatgatcacgcactgcagaagaatccaccactcaatgcaagcgctctgcaatgcagcagccgtgtcccagcggacagtagcttgcctgcacatctgtttcctacccgggcccagcaccgcagcagctttcgtatgcaacaaactgctgcgtgtcatgcatagcactcccaggtcgacattccctggctgtacaacaatattcctccagctactccatcaaccccagtgggcgtcgtggcctcctccggctcggccctgaaagtcgcagcggataccgtctatccccctgtcctgtggagcggacgcgtggccctcagacaatacacgatttgcacagcgcacgctcccagggtcgacttttcttgcctgcatctgtatctgcacatttcagctgctctattaactacccctgggcctcgtgaccttcttaggctagggctcagctgcggacacccgtcatccccccacggacgcgtggctgagactcaggtttagaactcagactcggggggttactgtgaatctgccccgtattggccattcagggcaattcgtagcggccagattgacgccgttcgacccgacccatcttcgctctacacatctgatgagcgtcagcgcttgatcaaggtctgattgtcaccagcttagccggacccattcatgccacatcgcgaggtattgccgtggccagtcggggtttacgaacgcaccgcacaaggcagatttttgtcacaaattttcattttaatggtagaataacgagtgcaaaggctatggatcgcagtctgcacagatcgattgtgccctgtccccccccaccgtcggagcctcgaatggcccagagggaggccaggccatacacgccatcgctgcacatcccaccgctttctctcgtttaggtcattggtgccatgcgtgctgtcgatccacatagggcggccatgcgcatagtcgcgccggacacactggtgattatcgttgagctcgacgaattcaatcagcccctcattgtcacgctcaacgacggcaaagtctgaacgccgagcctggaccgccttcatcaggcttgtggttgcgtctggttccagcatccatgggttggacttcttggatcggcggatattcctgcgatggggagcgtatacagttgggactactgtagagcatggaattgcaggtgagttgcacctagcacccccactctgcaacccatgcgatctccttgtttgtgatcgagtaatccctgtgaagatctgggtggttttgctggaaggccaagtggtcggccacactggtgtagacggccaaacctatccctgccttgcgcagcttctcgcacggaggcaacgattctggggttgcgaaaggcagggttgatggccagcagcgactccacgaggtcaacggcccaccgggacnnnnnnnnnncctacttgtttgtgatcgagtatccctctggtgcagatctgggtggttttgctggaaggccgagtggtcggccacactggtgaagacggccgaacttatccctgccttgcgcannnnnnnnnntatctaaatatacagccggaccttagctttttctatcagaatatcgaaaataagcctgcttttaaaccaaagttctaccttctattgaacaagccggcctacaagatggcaaagatgcactgcttcgcagtcgcgttcgcttctgcgatgatcgtgcttgccggtgagtctgggatgttgtcttcagttgagggggccggcgggnnnnnnnnnnnnnnnnnnnnnnnnnnnnnnnnnnnnnnnnnctgcaggtgtgcaagctcgtcccgcccctgatgcctcccaggttgggaggatcatccatgctggagatgatgccnnnnnnnnnnatgcaggtgtgcaagctcgccccgcccctgatgcctcccaggtggggaggatcatccatgctggcgatgatgcctcccaggtggggaggatcatccatgcaaactctggaagtgccatggccccgcttaccaaggcgcaccacatcagccctgtggccaaacagaccgtggacgcctccatgggcaccgagaggcccgccgcccnnnnnnnnnngaactctggaagtgccatggccccgcttactaaggcgcaccacatcagccctgtggccgaacagaccgtggacgcctccatgaagaccgagaggcccaccgccctgcagaccgacacctccatgaagaccgagaggcccgccaagtccgccgcctacgagttccccgtcgacactgagaggaccgccatgggcaccgtggacgcctccatgaagaccgtcgacacctccatggacacccagtcctgatcgtttgcatgccacatccgtctgctgtccctgagtatcgtgatctcattcccttttatgccacgctgtgacccgctcactgcgtggcagccttccatgtgcctgtctgcccctctggctgcctgcaccggaatttttggcagtgaaaagacgccctgtgtcgtactaagttttaacaccctttgaatgattgctcattacagcttcagggggtcagggacgggctcttccagcggcacccaggccatccacccccgcctcatgcccatgggcatcgacctcaagcagccacaggggcggccagagcttcaagcagggcacgacccatcgccttgcagcctatcgtctgcttcccgggctgcgcgatgtcgcccgtgcggacgccggaggcaagcacggccgccaccgccgcctccagccgccccgcgacggccgggatgccaagaccgtgacggcacatgagggccgcggagaggaccatggccagcggattagccttgtcctgccccgcaatgtccggcgccgagccgtgaacctgcgtgggtgatggggttgtcagagtgaggggggttattggaggtgggcaggggggagtctcacagggcgagcatgtgtttgtgcattggggacaaggcagggtatccattggccgagcaggcatgcgggcaggcgaacgcagcagggcaggcgggcatgcgctttgcaggggctgcagttccgcccccatggagcttctcgccgtcaggtgaatgtgtggatgctgcaacgccatcaccctggcccctcacatgggacaccctccagccaccgcaacaccctcgtgcaaggaacagcccagcctgggctgcgcaccggctcaaacacgcccggcccatcgttgctgatggaggccgagggcaacatgcccagtgacccggtcagcatcgccgcctcgtccgacaggatgtcgccgaagaggttgctggtcaccagcgtgtcaaaggagcgagggttgcggatcagctgcatggccgcgttgtccacgtacctggccagggcaagggtgggcgggggggaagggggtgagtgcgtaaggaaggcgagggggccagggtcctcggggggttgcggtggctggctccaggcaggcaggagcaggacccagaaagtgcccctgggcatgccctgcccacccctcctaccccccccccttcccaacaaccatcaggcaaccctgcatgccccgcggcgcacatgtggctcagctcgacgtcggggtactctgctcccacgcgcgtcaccacctcacgccagagctgcgacacctccagcacgttcgccttgtccacggaggtcagccgccgcgagcgcgtgcgcgccgccttgaaggcgacgtgggcgatgcgctccacctttggtgaggagggcgtgagtgaggggttggggtctgggccagggggtatgttgacggccgggggttgtcgcctctttatggattcaaggggctgtgtcgcacgtcctcggcaagaaacccaacaacacgctgtgcaaggtgccgcacgacacccccactcccacctcagactcggagtagatgtcagtgctgaacccaaccttctcgccgtcgcgctcgctgaaaccctggggggtgtggcgcggcttttcggagagtgagggctgggcagcgtggcaggaactcatgcagccagtccttggagggagggccagcggcaggttgtgcggtgatggaaacctgcgacctggccacccccacccgtttcgcagggcatgcgcttcggtagatggcccattgcgccatggcccgggtgacgcgccaccctcagtacttgccagcgccccgcagcgaccttgcctgccttcgtctctgtccgcccgggccattcactcccaccgccagaagacctgcccccccaatcctcacgacctcaccccttccacctatgagaaaagcccatgcagtcccccctcacccggggctggccaaagtagatgccgcccaccagctcccgaacgatgagcaggtccaccccctccagcacctcccgcttcagggaggaggcgtccgccagctctgggatgaccttggcgggtcgcaggttcgcaaaggcattcaggctggaccgcaggcgcagcagccccgtctcgggcttgctggcgctgggtagcgagtcccacttgtacctgcagacgagagggtgggaggggggacaagggcatggagttggggtatggagctggtgtggtgagcccaggactgcaggcatgcactcccaagggtgcagggcgactgcgcaagtactgactcagtgccttgggccttctccccgcctgttacaccgcccaaacccaccctccgatggcagccagcagcaccgcatcgctgtctgcacaggcgcggtaagtggcatccgggtaggggtccccggtggcgtcgtaggccgcccccccgatcagggcctcggtgaaggtgaaggtctcgccctccgcctggccagcggcctcaaggacggacagggccacggcggtgatctcgggaccgatgccatctcccggcaggacagtcacgcggtgcgcggcgcaggcgcaggcagcggggcgagcccggggtatgggtgtcctagccacgaaggcccgacgggagggggcggccaaccccaaacgcgcgccgggagccagtgccgccattccgtggatctaaatatgaaaatgctgcggatcgtatatgcatgttgtgcagcctacagtgtggattaggtgtctgcgcgcgctgggtccacctcggcacgtgatgggtctgtgatcagcatggagtgtcggggcgcggatgccgtgcgcatagtgcacgagatgtactgatgttcttcgtttgctggttgggcactccccacagtgagcgatggggtcggccgcacagatcggcgccacgctgcctgaaccctctccggtgcaagagcgatgggtgccctccatttgctgctcctctgttgtctcttcagcaccctgccctggtgccatggtgtaggcgaggcggaaactttgagcacccgtgatcttctgctaaacacacctcgccgcggggacacactcctcattggccgggagactgtcaggtgcttggcttggtgtggctcagtggatattgctgcccatcctccacagtcttccagcatcagaccgcacccctcaccgccgccagaccctctgccccctcacaggtatgtgccgctcggcctcgcgcccaacacaacctacgaggcgcgtgtctcctaccctgccacggtcagagaccatggggggggtgcggatcgcgttctgcacacaccagctcaatccttgagtacctggcgcctgcatcaccccacccacctccctcgtgaagctaccccatgccgtcccatccctcgcacagaacccggcgcgggtccgcctgtggctggagggggaggtacaaggctcggcgcgcatgctgctcgacgccgagcgcatcatcttcaggagcgacgcccgggggcgcatggtggggactgaccgcaaccccggcgccatactcatgcgggcnnnnnnnnnnaggggcgcatggtggcgaccagccgcaaccccggcgccatactcatgcgggcggagcgctgggcgatgcatcgtgatggcgaggccggcgcgcccaagcagctggcgtatgacataggtgggcggtcttgaaatgcggggggcgggggggg

SEQ ID NO: 38796 - DNA, 65 bp, Chlorella protothecoides
gggcacctggggcccagcgcacccagcgcacccaacgcacccagcgcacccagcgcacccagcgc

SEQ ID NO: 38797 - DNA, 109 bp, Chlorella protothecoides
tggccgccaagcacggttggttcgacttttcgggggggtattcttgagcggtggggcgcctcggaaggggagggaaggagctctttgatggagggacccgggacagcaa

SEQ ID NO: 38798 - DNA, 68 bp, Chlorella protothecoides
actatcgccaggacctggaggtgggggtgtgtcaaagggccggtggggagcatgccaggccagtggct

SEQ ID NO: 38799 - DNA, 84 bp, Chlorella protothecoides
tcagccgcccgacctggagtacatccgcccccttgtccacgaggcggcggggggctcggctacggcgacggccacctactacaa

SEQ ID NO: 38800 - DNA, 61 bp, Chlorella protothecoides
gtcaggaaaagggcgtcattatggtgggggttccaaggtcggaagcctttttcgccacggt

SEQ ID NO: 38801 - DNA, 71 bp, Chlorella protothecoides
ccagcagagctgactcatcccaccctccacgcatgccatccttgtgaatccaccccgcccccaagcccacc

SEQ ID NO: 38802 - DNA, 61 bp, Chlorella protothecoides
tggatgcccattcatgcgtgggtgcttcatacacgtcccttcatgcgtggatgcccattca

SEQ ID NO: 38803 - DNA, 74 bp, Chlorella protothecoides
ggacacctgtaaactcgaaaagctcgcaactagatgggatgcctttcaataggaggaggaaagcagcagcacca

SEQ ID NO: 38804 - DNA, 8094 bp, Chlorella protothecoides
  modified_base (2633)..(2642): a, c, t, g, unknown or other
  modified_base (2700)..(2709): a, c, t, g, unknown or other
  modified_base (3413)..(3422): a, c, t, g, unknown or other
  modified_base (3627)..(3636): a, c, t, g, unknown or other
  modified_base (3717)..(3726): a, c, t, g, unknown or other
  modified_base (4331)..(4340): a, c, t, g, unknown or other
  modified_base (5069)..(5078): a, c, t, g, unknown or other
  modified_base (5255)..(5334): a, c, t, g, unknown or other
  modified_base (6010)..(6019): a, c, t, g, unknown or other
  modified_base (6318)..(6327): a, c, t, g, unknown or other
  modified_base (6637)..(6646): a, c, t, g, unknown or other
  modified_base (7127)..(7136): a, c, t, g, unknown or other
  modified_base (7200)..(7209): a, c, t, g, unknown or other
  modified_base (7644)..(7653): a, c, t, g, unknown or other
  modified_base (7867)..(7876): a, c, t, g, unknown or other
cgccccccagccggtgcttctcgccctttgccgcgctcgggccgggggcggcgcgggcggcaggtgcctgccgcgtcctcttcgccgggcgggcgtcggagggcggcgcctcggcacctgcgggcgtcgcgggggcgccgccctcttcaccgccctgctggcgcttcttcttcctctcctcaaaggtggcgcgcttgctggcaacctcgacctggaccatgtgaatgttgtgggtgagagggtggagccaggaagatgcaagggagcccaggccagaaatcacatgctcgcaggacgaaagcccttcctgtgacacctcatgccccactttccaccttgagcttcctgcctcccaagtcggtgccgttcaggttcgccaccgcccgctctgcatccgaggccagcgcaaactgcacgaagccataccccttgtggggaccctccttgccctgcttgaccaggaaagatcgcgacacgggaccaatgtcactgaagtagctcccaaactgctcgtctgtaaccccaaatgccacgctcttcacgatgagggtccgggcccccccggcctccgtggccatgcctggtgcgagaaagcaggcaccggagtatacacctctcaacttgccaaaacaataatctgggtggtttagaaatcaacgctttatgcaagcgtgagcgttggtgcgatgtatgagaaggacgcgagtcttagcgcgcgcggtggtggcggaaggaaggagccaggatgggtgagagctgcggcatactgaatgtcacctctcaccacatctgctgcaagtcatcctttgatctgcttgaaaaatattcagagcttgtatactcagattgattctgcagtacagatcgcttcccgagactcttgttgacattccagcgagctgcacgagaactcgacacaagctcgaccatgcgttgaggaggaggatggggccagggaattcaacaaagctatgaagagaggccttgatgggcctgctggcccgtccaagcttgccagaccagaggaggtggaggtgcggaaggtgcaggggtgtggggaccattgctgctggcgcgctgcaggcaggtctttcgagggttccggtcgctgacttgggaggcaaacccaccccacaggactcggccgaggcacgacgccagcctgacgacattgccgacgaagagctaggtgattatggaatccccagcgggtggaagcagtgccctgcccagggccagcctatcagcaggttcatcccttccaaggtgaactcctagggacaagtcttgtgtgccgccacattgtcaggataaggctggagtactgcctccaaggagctagaaagattgctcagtgttgtctccagttttcctcctcctcccttccaacaggtgccgctgggcgcccactttgacgactacatcccggcagcacagcggtacaacgtggaccaggcgcgggagagagctgacgcaaagggggctgcccttcaggcgcgctgcgccacggtgatcgacctgacccgcagtaccaggtactacgacgtgcgccgctggcaggagctgggcgtgcgatacatcaaggtgagagcttgatcggcgtgatgggggtgggtgcgcatcggagcccggtgcagcggtctgttattgagtggggtgcagcccctcacccgagacaagcacaggtggcagcaccctcacttcaccctgcccatgtgcccctctcagatcccctgccgaggtcgggggcaggtcccacagccggaggctgtcaacgactttgtctgggaggtcgccagtcagagggcagggcagtccactgtcctcgtgcactgcacccacggcttcaaccgcacaggcgaggagggttgtggagtgggactggcgtggagcacatctacctcagtgctgtgccgctgtgcattcctcgggtaatgctgagccctgtctttccctctgtccctggtttgagacaattgcccaggactgcacagcagtccatcctccctcaaccctctgcctccccccaacacttccccccttcctacacacaggctacatgatcgtgagctactgcgtgcgcatgcaccactggaccgtggagaaggcgctgcacgcctttgcgctctcccgccccccgggcatctacaagcactactacatccgccagctgtaccggtactaccacgaagcggtccccgccgcggctgtcatgcccgcactgccggactggaaggcgggcgacgcacccgactcgggcgacgagggcggggaaggggagaatggcgccgaggcgccgccggagcacatggagcatgacgacgtgctgggcgaggaggtgtcccccgccgaggcggccacggtctgcggcagcatcgtggagatgatcgcggggccggggcaggaccaccgcagggcctggttcccggggtcgcagcccgtcagcctggaccggagcaacctggagctgctgcgccagcgcaggtgcatggtgtggtgttcatttgcgggggagggcgtgctcggggaaatgaaagcgagccgaagatatcgacccctgggtgccaagacttgcagtgcccggctcagggacccacttcaccccccccatctcgaccctacctgctctcccnnnnnnnnnntgtgtgaaggaagcagaatgcgggggattttgggggccctggagatggtgggatgagnnnnnnnnnngcgtgctcggggaaatgaaagcgaggccaagatattgaccctgggtgccaagacttgcagtgcgcggctcagggacccacttcaacccccccatctcgaccctacctgctctcccccccttcccaaaacggcgcaggtactgggtgacgtggaaggccgacgggacacgctacatgctggtcatcctgccgtcgggcacatacctggtggacaggaagctggccacgcgccgagtgcagatgcgctggcccctgccagccaagccccaggctggggtgccccagaaggcccccgtgggaccaccccactccctggtgtgtgtggggtgtgaaggaagcagattgtgggggtttttgggggccctggagatggtgggatgaggggacagctgcatgctttgaccctatctcatgccattaccccatgcattccgttcaccctcccctcatactccactccaaagacgatcctggatggtgagatgatcgtggacgacgacctgctgtcagacaggaagcagcggcgctttctggcgtatgatctgatggccctcaatgggaagtcagtcgtcggcctgccctggaaggtgcttgggatggggggtgttgggtgttgggattggagacggagatctgctctgctgcggcttatacatgggtagcacatggtatcatttctcttggcaggataacaacagggaagannnnnnnnnnttgggtgttggaatttgggacggagatctgctctgctgcggcctatacatgggtagcacatggcttcgtttctcttggcaggataacaacagggaagaagctactttggggcaaatgggaacttgcgaatgtgtttttttgagagctgccacacgcgtgacaatgtcccccctgcaggagaggtacgacatgataaagcgatacnnnnnnnnnnctggattcttggagaccagtatcatccacaggacacttgtgagagtgtgcgctgtgtacctcccttgggcagtgaacctgnnnnnnnnnnaggaacttgcaaatgtgtttttctgagagctgccacacgcgtgacaatgtccacccttcaggagaggtacgacatgataaagcgatacgtgatggacccaagaaagttggaacggcacgtcatcgagaccaagcagtggtccttcccctaccagtacggcgaggtgagtgacgtgtatggaatcttggacaccagtatcatctacaggacacttgtgagagtgtgtgctgtgtacctcccttgggcagtgaacctgcgggacagcactcgtgtcatgaggaatatgatatgccggccccaaaagttacacggccatgaatccctttgcccacctttgcaggaactgtttcacgtgcgacgaaaggagttttggccgctgacccaggcagacaagctgctgcacgacttcatccccaaccaggtctcccacgagtctgacggcctcattctgcaaggtgagctggcagagccactgtgtgcgtgtgttttgggggcacagagatcttagcgcacactggctctagatagcaaacggtggatgtatattcacagaggagggtgcgccaccctgcgctctgtcatctccccgccctcaccatgcctcnnnnnnnnnnctgtgtgtgtttggggggcacagagatcttagcgtacactggctccagatagcaaatggtggatgtatatttgcagaggagggtgcgccaccttgctgtctgtcatctccccgccctcaccatgcctctcaaagttcccccaccccacccttcaaccatgccaccctagggtacgaggacgcctacgtccccggcacctgccaggagctgctgaagtggaagttcgcgcacctcaactccgtggacttccggctgcgctgggaccccaagacctccacggcggggttggagctgttggagactcgggcggggggggctcgacctcgtggctaccacctcctccccggcgccaccatcgccttccccggcggcgaggacccggccgcgctgcatcagcggattgtggaggcagcctacgatgccgaggcggggtcctgggtgtacatgcgcgagcggcgcgacaagcccacgcccaacgcctaccacgtgtacgagagcgtggcgcgctccatccaggacaacatccaggaggaggagctgctggaaagcatcgctgcggccctgcagctgccgctgtacgagcgagaccgggcgcgccaggcggcagggggccgggccgcctgactgagattggcttggaggcgggccaggtggtgtgcgacaggcgcgatggaggggactgggtggaggaggccgcgcctatctttgtccttttggaccctggcatgnnnnnnnnnntccgggccgcctgactgagattgtcttggaggcgggccagatggtgtgcgacaggcgcgatgcaggggactgggtagaggaggccgctcctatctttgtccttttggaccctggcatggcagtgtgcccattcataaccccctgtcaccctgtcctgtttttgttctcgccctgccnnnnnnnnnnnnnnnnnnnnnnnnnnnnnnnnnnnnnnnnnnnnnnnnnnnnnnnnnnnnnnnnnnnnnnnnnnnnnnnncaaccattccctgcgtgtggcgcatgtgtttcagggtcgggcatgcacgcacgatcaaccaaaaaatggagcagagtcgggggggggtgggatctgtcatggccgcgttctgtcggcaggctctcgagtcacggggtggttggttgggtcgggaggacggtcgggtgggacactgtgagctgattgcgctgaggtttcgggggtccagggccgagtgccttgcgctgtgcaccccttcccccactcccacgattgctcttcgcagcgtcgcttcgcatcccgtccgccccctcagtacacatcgtaggagtggttgatgcccgacaggttctctgccagcagcttgtgcgcgcggtccgagtgcgcgggcaggcccaggtccttggacagcaggtcgttgcccatggaggccgtgagcatggacttgaagaaggcatccaggccacgcaccgccacgctggcgttctgccggccgcgccaggcgccctgtgggaggtggaaagggagagcagggaggggggaggtcgccgtgcgcgtgaatgtttgcatgcatggccgcacagcgcatggatgcacagggcgggggggagtggcggtgcggtgcgtctcggtgtgagaggccccagcttcagacggagcgaggcgggctcgcctgcagccgcgcctgttccgtccnnnnnnnnnnaaggttgccatgcgcgtgaatgtttgcatgcatgtgcgcacaacgcatgggtgcacagggcgaggggaagtggcggcgcggtgcgtctcggtgtgagaggccccaacgtcagacggagcgaggcaggctcgcctgcagccgcgcctgttccgtcctccgctcgggacgatccctcccaggcaccagccaccagcagcgcctcgcgccgtccccacgggtcacctcccacaggtacggtctccccctccctgcaccaatcgacgccacccacccgctggccgccgcccccctcctgcagnnnnnnnnnngagcagcgcctcgcgctgtccccacgcgtcacctcccacagcaccggtctccccctccctgcaccaatccacgccgcacacccgctggccgccgcccccctcctgcaggtcctcggcgtactccagcacgtccttcgaggtcaggtcccacagtccgcgcgtgacggctacgtacacccgcgtgtccaggctgctggacagccagtggagcaggcgctccagctcctccatgatgctcgacagctgcggggagtggggggtgcgtctgggtgtggcctggtgccgaggaagaagctgatggcggggccgnnnnnnnnnnactgcggggagtgggggttgcgtttgggtgtggcctagtgccgaggaagaagctgatggcggggccgcagcaccaacactgggatgtcagcggaggtcatgcctggccccctacctccccaacatccgtttcaaggcccaaacgcatctcaacaaccaaccgaccgcggactggagctgggaggggtgggcggtcaggccgtcgcggcgcaggaggagcagggtggaggtcgccgggttggccgccagctcggcggccaggcgctcggcgcacagcgtgatggccgcaaagtattcggagcgtagttccttgaccagctgcgccgactgcgcgcccaggtcgggcgcgtcgcgcgcgatgcgctccgaccccactgtggaactcggggggaaaggaggtgagggcttctcgtatctgtggtctggggggcagtgtcacgggcgaggtcgtcgcaggtcgctcccacaccaactcctcaccnnnnnnnnnngacactgggatgtcggcggaggtcatgcccgggcccctacctccccaacatccgtttcaaggcnnnnnnnnnncatggtctggggggcggtgtcacgggcgaggtcggcgcaggtcgctcccacaccaactcctcacctgcgacgggggggaacgcggcggcggaggccgcgacggcggcgccaccgcaccaccgccccagccggtgctccagctggggcgagaaggccagcaagtggcgcaggctgttgagcaggagcgcctggccgggcgtgatgccgcgtgccagggccgcgggtgcccctgggattcagtgggggtgagggagatggcggtgtggtgaggttcagtgtggtgaggctggagtgagatgaggtggacagctggggcaagaccgtgggaaaaggggcagggctgcggccgtccaagctggggcgctggcccggctcaagaacgcattgcaagcaagtcggcgaggcctcgccctgccctgctcggccctccacccnnnnnnnnnngaggggcagggctgcagccgtccaagctgggtcgctggcccggctcaataacgcattgcaagcaagtcggcaagtcctcgccctgccctgctcggccctccacccactctggcaacgctcatcctgtgacccctcacgtgcactcacagacacgatgcttgcccaccgcagaggacgctacaccccccaaccctcccgaccggcgccccacctnnnnnnnnnncgcactcacagacacaatgcttgcccacctcagaggacactacaacccccaaccctcccgaccggcgccccacctcggtaggccagggtgggggcgttgcggggcaccacccacttccaggcgctgcgctggccgccggcgcgcgaggcgggcgacccctcccccatgcccggggacggggagcgccccgcccccgcgccgtagccgcgcgccgccac

SEQ ID NO: 38805 - DNA, 92 bp, Chlorella protothecoides
ccgggcacggagtggtacttctgcttaaccccccccctcggaggccccccctcaccccttcaccggcctcgcgcagatccacctcctgcatg

SEQ ID NO: 38806 - DNA, 74 bp, Chlorella protothecoides
ggcgctccagagtcagggtgggcggggggggtcgctgaggtttcggtgcctggcgcggattgaatggtgaacga

SEQ ID NO: 38807 - DNA, 11088 bp, Chlorella protothecoides
  modified_base (949)..(958): a, c, t, g, unknown or other
  modified_base (1510)..(1519): a, c, t, g, unknown or other
  modified_base (1653)..(1662): a, c, t, g, unknown or other
  modified_base (4059)..(4068): a, c, t, g, unknown or other
  modified_base (4757)..(4766): a, c, t, g, unknown or other
  modified_base (5531)..(5652): a, c, t, g, unknown or other
  modified_base (8824)..(8833): a, c, t, g, unknown or other
  modified_base (10634)..(10701): a, c, t, g, unknown or other
gccccccctcgccccccctccctctgcatgcacagcctgtctgccaagtacgcgcagaccatgccgtacgagctgcgggccctggaggtggcgctggccacggtcaccgctacgttggagtcggaagtctgcaggctggaggcacgggcataccccgtcgttgaccgcctgaccacagatgtgagtgaacgggtgtggtttgtggcgcaggccgacatcccagctcaggtcgcatgagagtcctgtctgtccttttgcccgccccgcttccatcgccgcgcttctcacccctcctctgccctccttctggtcgcgacaggtcagcacgagcgtgctggagggggtgcgccaggtcaagcacgagctgaaccggctgcagacgcgcgtgcagcgcgtgaagcaggagctggaagagatcctggaggacgatgatgacatggcggtgcgtgagtgttgttggccttttttcaagatttttaaacgaggccgctgctggtgccgacccgtcggtgcatgttgaggctccctgcccagaaattacgagccctacatgtcccttccctcaacattccaaaccctcggcaggacatgtacctggcgcggcgcgcggcgacgtatggggaggagctgcccgcccagccgcgtgacctgcccgaataccagcagcagccctgcgccgggtacgacggcccggaggcggacatggtccccctgctgcagggcacgagtgacgggcccacgcccatcggccagagcgaggccgggtcgcaggcgcacgggcccaccccccgcagcagcccggggtcccgagtcggcttccaccccgacccaattgttgtcgacagaggtgggcgggacgggaggtacttggcggtgtgagggtggtcagggcagggggaagggtggggtggggattttgtgcactgggatgcgcgtgagatggcatggnnnnnnnnnntggtgtgagggtggtcagggcaggggggagggggggaaggggatttcgtgcactgggatgcgcgtgagatggcatggtgtggcttgcgtggtgaagaagtgggcctgtggcgggaatatccaccccggccctggcctcgatggccccacactcaccccctcaccacccctcctcgtccatctcagggcggagtcgcagcaggtccgagccggagggcagtgcctcggagggcgccgagtcggaggccgactcccggcccggcggcgacggcccacgccggaggcggacggagttgcggcggtcgaggagcagggtggatccgcatgagatcgaggacgcagaggaccagctggagaactactatgtcaaggtggacggcatgctgcgccgcctgctcatgatcgccgagcacatcgacgccaacgaggacttggtggagatccaggcgagtaggggtggggattggggattggggggccggcagaggtgtaggggattgagagcgaggggagtggggggatatggggcaggccagcgtttggaatctgctgnnnnnnnnnnggtgtagggggttgagagcgaggggagtgggggggatggggcaggccagcgtttggaatctgctgtgtgtctcactggggtcagtgagtccatgatggtttaacaagaagggcgccctgctgccacgtcttgtnnnnnnnnnngctggggtcagtgtgtccatgatggttttccaagaagggcgccctgctgccacgtcttgtgacctccactcccccttctgctcggctacaactactttccagatggatcaccgccggaacgagctcgtagccttggacctgctggtcagcctggtgaccgcggcctttgcctgggtctccatgattgcagggttctgggggtgagtgggggctactcttgattgagcatacatgtactgctgtgcagcactgggcctgcttggggctggggagtgcctgggtaacacttgatatttctcctttgcccatcactggccctccactcgaacctgcaccccccaggatgaatctgtacaacacggtctggcaggagagctaccccctcttcttctggacctgcttcacctgcgggctgggcgccatcctcctctttggcggggtgatggcagtcatagtcaagaggaagctcatgttcatcaccagcagcatatgagcctaggacggcatgagattcttttccgtgactttggcagtgtaactaggcatgactgacagctctgtgcgcagcagcgcaatgggataggagtgggaggcaggattcacacgacaacgttttgcctttgaggtgaacagcatgtgactttgacccagggtgcagcctgctgcatttacagaagaggccagaatgcattctcaacggccaggagagaggccggcccgatggagctgggagggggctttgacttgtgagcacgacaaggtggagctctcttgacatgggtgttacaggggatccaaggtccttttcagagagtcgacgacacaccagcagttgattgcaaccccctctcactgtgcaatgattttccagaccagcgtctgaagcctcgtccgacagctcccgagctactctcgccaccgctcgatgcccgagccatcatctcgctcccaggcggtccaggacgacattcaggtccaccgactgccccgactccatcagctgcttcaggacacgacgcacctcctcgcgggagaagcccatgaccgccacgtcgtcgatgaccttctcgatcggcactgcctgaccgccatcggccgagggggggtcctgcagcgggccgatgcatcgtgccgactcaggcacagggaacagaggcacactgttggggctgcacgccatgcagaggtgccacgaccatgatgcccccatctgtcgtatgatttgactgtgacaatggccagcatcctctgcgatgccacaactggtaaaagatggaccactcaacccccaaatctgccccaccccccccacacctcgttgcgcgtgaaggaggaggaagagggcgcgggcccggggcgggtggtgcgggtgtagcctggtggaggcatgggcacctggtttcggtggggcagcgaggacggcagggtcgggtagccggtgtggaagttggactgaggctggggtgggtatgcagcctgtgttggcggcggcgggggcggtggaggtggtggcggcggcactggcgcctgaggaagtccgttggggtcagcctgcgaggaggtggtgggaaaggggtggagaaggctggacagtgcaccacggagtgggtgccgtcgtacactagcaaggaatggttttgctgcgcaccattcccctcatctacttcattcccggatgttctcgcaccccctccccaaccaccagctgaactaaactcacgtatgcgtgcggcgccccaccataggacggaggggccgcagggtactgcccgccatactgcgaaggcccccccgccccagcgcttggcgagttcatgggcccgctggggccctgcaccccgccggcggaggacaccgagcccatggagtaggccctatcgtacgactgcagcccaggagccggtggcggcgggtgctggtgcggatacgcgggcggcgccccggccccggtctgatagtgcggggccggcggcaccggctgctgctgcacagggccgggctgatggggcgggggggcgctgggcaggtactggtgcggggagggctggaaggcggcgggggcgggggcggcggcgccgtggggcgaggaggctgtggccacggggggcagcgaggcgggtggctgcaccaccacggcctgtggatgcggggctggtgcggggggctgggagaagggcggcgccggcgccgggggaggggcagaagcctgctgccctggctgcacggccggcaccgggggctgctgagcagaggccatcaagggcgcaggggccacgggcaggccctcagcgaccccggccagcggcttgccagcggctgcggcaggagcggtggtcgcagcggggggcccgatggccgccggcgcgtcccctgcaccagcggcgccagtgtcggcgnnnnnnnnnngcggtcgcagcggggaccccgatggccgccggcgcctcccctgcaccagcggcgccagtgtcggcggcgtgcctgacctcggccagggagggcccggaggactgggtggagagctggcgcagctcgtccgccgcgctggccagctcctgcttgtcgcggatgatctggacgcagcggtgcacctcacgcagcgacttctccaggccgccaaacctctccctggcggcgtcatccctcaccgcccccacctcctgcaggtctgccagggctcgacccgtctgctccacccggttctccagcgactccaggcgtctgaggggagcgggcgggcacatgtgacgtggagctggaggtacacccccgatgcacgagactgccaatcctccctcctccccacacctgtccacggactctacgacccgctgcaggccctccgtcagcttgcccaggaaactctgcagcgcagggtccagctccttgaggccttccttgtgctgtgcctgtcaaaggaacggaatgggattctcagggtgacctggccacccatcaacgcgctgggcagagtgatccagaccgggagcacccgcagacaccgtaccatcggtggaccgggctggttccgtttcgggctactaagcacacgatcgttggacttgatgctagggagcacgctgtcgtcgttcaccgannnnnnnnnntcgtttcgggctagtaagcacacgatcgttggacttcaggctagggagcacgctgtcgtcgttcaccgagtccctggccttggaccctggcaccaggtccgcgaagatgtcgggcagcgagctctccgacatatcggtggtaacagggatcgaatcgacggtgcaatacacccgtcaagatcgagtgttgctcatgtagataatagatgcactagggacaggccttcctatccccctcgtgtgctagcatcccgcctggttggtttccgtgaacgcgccttgtggggtgatcatgtttcacctcctccccggatggtgggcctgtgtgggaatgcaatacagatctgccagctggagggacttgctgtattatcgagtacaactctcttgacatgggcatggctggctggcaattactgttgtataccgcctgcacaggtgctagacacatgatccggcacaaccctcacaccctcgaaaggtgacaatttggaacagcatgaagcatggaatggtttcaagcaatccgtacagatcctagtcaagtctcagagaccgcacacctggccaccacatcacttcttgaggctccacaagcagcccgacccataatccgtgggtccaaatttgcacgggttcatatacccagctgccgcgcttctcaacggctggacctagtagcgcaggtctgtcatccaagtggaagctttacttcggggattgctaggcgatctgtcagggccattcgtgtcttgttgactggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaaactcagcagcccacatcggaacctcgatcggcagatggataacgagcctgagagatgcggtggagttaccctcgtcagtcgcacttgtgagactgatttttgctttttggttgttccttttgtggctgccatccttttgtcgagttggtcggagtcctctgccagacctccttctgcggttgcacccccacctgcactctcgccggtatcgacacgtctcttcctgtctcctctgttggcgtaattgcttggtctcaaccccaatccctacagcctccgtcaacctccaggctgcattcacacgccatgcacatcactttttcttcttctgctgctgcatggcctgcttcagcttctgcgtaccggccgcctggatcttcaccgtgcccaccagcgtgatgacggcctccggctcggggacggccctgcagagatcacgctctcggcccgtcgtgtccgccgccctctggaacagctccatggcctgcgttgggaaggagtggcaccagagggcagttatgcatgctgtgagggcggactcgaccttgagcatgggcatcgccaaagcaaactgcgggagtcacttcagtttgtagcttcatgtctcccccgctctagtgaacaaacacgggagcacaccaaccacacaatcacccacttcacctgtcggacggccttgcccttcttctgcggccctggcaccatcttcaccttgaacttgtagctggtcaatacctgacgggtggagatgttggggcagtccagggggttactacacactgtcagcctttgagcgtcgatgtgtcagggttgaaaaaactatagtccctggttgcacggcccgtcgcactgtacagcggccaccctcagagccccagacggcacacccagcagcagcaaggcccacctggtatggcgcgcacaccggcagggcgtacagcaggacgtcgtctggtctgggcaagcccgtgagggcgtccaggtctgtcagacgtaggcggtcctcctcatctgtgtgagttacggaagggtggggcattcaacctgagtactgtgcggctgtctccttgcagctgggaacaccgaggcttgcgcacatgttgatccggttggcatgtagaattgtatccaggtgtcagctttcgggggcctgttgggacctcctcaccagccaaccctaagcaatcacctaggagctggatgttttcctcctgcaacagggctgccacctcgcgtgcatcgtccacattgccggcttggcctccctccggctctccgtcatcagcatgcacagacacacccgcctccgcctccggctcaaatgtctgtgcctctgggcaggcgtcgtcgtcctcaggctccccctcctgggtgcccggagctatcgccgtcccatctccgtgcccgtccgagcccccctcccgctcctcctcccgctcctcctcctcccgctcctcccccgccaactcctcaaactgcgcgtcaaacactcgggcgatgtcgtctgccgtcaccggctttgccgtcaccgtgttttgcgccgtcttcttcgctgccagctttgccttgtgctcctccttcctctggcgccggctctttgcgggacctacaaaggatgagagggcagtgctggtgtcggctgtaggggatggtggacagcaccgtcagccccgccatgcacgccatctgtccggcagaatactccaccaggagtgttgccagcaacttcatgccggtcccatccaggggccagcggaattgtgtggatgctgttggacaacgaatgcatccctcctaatcacccacacacaatccatcatccacacctcctgactggagtgcctgccgtgcaagctcggcgtcctcatcgtccccgtactttccgccaaccttcttccctcgccgagtggacgcgccctgccccctctcgacggtcggcgcagccgcggtcgaggccctgccgccgccacgctgacccgtcccggcctccacgccgggagtgccagccttcagcgcctgccgctccttagcagacaggtgtcgcactgccctgccgccttgccgaccaccctgcgccaggccagcatccggccccgcgccgtacacctcggcgcccgcgcccgggcgctcgcccagcccgtacctctgaaactgggcctggagatcctgcgtcgccgcaggacccccccggccgccctgtcccttgccgcccagggaggggagtgcctccaggccagagtccatgaaggtggccagggggtctggccccggagactcctcttcctcctcctcgtgcccgggcgcgggttcagagggggcgaggggggcatgtctcatgtttgcggcaacataggcgtcgtcctcttccccatcctgtccagacttgacggccctctcccccagatgggcggcgatgcagctgtcctccacccggaagagcaggccaaatcctaccaccagtggctgcatgcatgggtgggagagatggaagggaagtggaaaagcagaggcagaggcatggagcggtgcgtacagcatagaggattgggaactgcatgagaaggtccattcgcatcccagtgcagcactcgaacgctgcggcaaagcccacaaacatcaccacaccaagaccacatcccgtgccgcccctgacacagagactagtcatgtcgaccttccaccaatggcccgcatgctgtacctggggcgggaggtaattctttcgtccccgaatcatgaaagacccagtcgtcaggtactcccccgtgggcgccgtctggctgacctgtcccaagggttcaggggccgaccaggaatgagtcatggatgttgttcgggcaggtgccaggctccacaagggaactgctcgccgtgctgggcagagccagacatgagacccgcgagtggggtgcgccatgcaagcccggggcgcacctgctctgggtggacccaccaggccgatgtgaccaccttgctgttccaggccgcactcctgcacacacacccggcaccagcctgtgagtggttggagggtgggaatggggaggaggcatgtgaggtattgaagagggcagggggtcctgcgagctccggctgccaacacaatgctgcaccagcatgcccagtgctgagcaatgtagttttaagtggggacaagcaggatggnnnnnnnnnnacacacacacccggcaccagcctgcgagtggttggagggtgggaatggggagggcgcatgtgaggtattggggagggcagggggccctgcgagctccggctgccaacacgatgctgcaccagcatgcccagtgctgagcagtgtagttttaagtggggacaagcaggatggcaacggaaagtatgcaggcagagaaaccggggcctgggtagcagtgacgacaccaaaatgtgtttgccctcactcttgaccatacgctgtccagcgtgaccgggtgccctcccctcacctgtgccagggtcaagggagggatgggcacctccggtctgtggttcttcactatggtgctggacgcgccatgcaggtcggcatggcagtacacatcgcccttcctacggtgggtggggggaatgcatgaggttgccagcagagccgtgacactggaggactgtagctgtgctgcacatggagacacagaccgaggaatggcactccaatcttgcagggcacagggcagatgatccacagagcccccggccctcaagcacaagcaccagtttcgatccttgctctcaacctcaaccccccactcacttcatgtaccgcttcaccagcagctcgttctgctgagcgtccctgcccgacacgaccaggtagttttcggaggagatgaaccagtgaaaccgctcaaaccagtgtggcttgcgggcaatggcagccaccggcgcagcgtgaacctgggacgggagggcaatggagtgcttgggaaatgggggcatgggagttctggccccgcatgcgctggagcgggggctgcagcaggtcagcattcggcaactgctgtggcaaagcctgtgacgacttctcagcgaaagtaagtcatttggctctgtagcagcccatccctcatgcacgaccaagttccaaccagccaggttttcaacacacacacctccaagaagcctaacctgcttaagctgggccgccgccttgcgctcggcggccttgatggccttgtcgctggccgccagcgttcgctccctcttggcctggtgcttgcggcgggcgtcgtagtagaaccgcgcattggcgtgggccgacagggccaggtccaccgtcaccttggccacgtgccgcctggcgcgcccgtgccgcccggcctcaccagccgcagtcccttcctcctcctcgccggtcgcctccgccgccgcgtcgtccccgcccgcatcgggcagcaggagtgtcacctggcccttatccaggttcaggctgtcgatggccgccgcgatggggttgccggccgtcgcctcctccctcaccagcttccccaaggccgaccagtctaggccgcccgccagcgcctcgcgcaccgacgccagcgccgcctccaccagctccgcgttagcctcgatgcgccgcgccgtgccctcgctgctctccacctccccggccagggcgaccagccgggccgcggcgtcccgctgcacggcctccagcttgccgtgtgccgccttttccttggaggccttggccaccaccgcccgctgcccgctcatctggtgggtgggtgtttgttgatgggggttgaggggcttggggtctgacttttcaatgacagacagggatgtgatcccagcctccagaggcatgcacccaggacgaaaccgcccgtcacggggcgcgtgccatccaggagccacgctcgtcgcccctgggcggtgcggtgcatggtggcggcccgcctcgccgcctccccggctgtggcccccacctcatacaaaccgcgcaccctggacccccnnnnnnnnnnnnnnnnnnnnnnnnnnnnnnnnnnnnnnnnnnnnnnnnnnnnnnnnnnnnnnnnnnnnatacggcagcaccttgccgaagaaggtctgcatggcggcgtcaaaggacccaaagtcgacgacgtgacgtccggcgtgctgctccagcagcagcggctccacgctgtcgtacacctcggtggaccccggcgcgaacaggatgtaccccgcgggcggcgcggcctccgtgccggccagccaccgctcgtaggttgccgccgctgcagtgagggcggcgagcgcgtcgtcgctcaagcctgtcgcaaggggggcatcggggtcgagccccgcaacgcgcgcgacgtgctccgcgacagccgggccgtagggcagcgcgcgccccagcgcatccttgagcgcgccgcgcgccgccccgctgccctcccccgccgccccgtcggcctcgcg

SEQ ID NO: 38808 - DNA, 89 bp, Chlorella protothecoides
ggcgaatgcactgctactcccacgacccaccacgaaaccgaaacaacctccattccaacaggcacacctgcagcatccactgggcgatg

SEQ ID NO: 38809 - DNA, 389 bp, Chlorella protothecoides
  modified_base (131)..(295): a, c, t, g, unknown or other
cggacgaggaagccttccaaagggctgccgtgcaggagggctctcttgatgtggcaaacctgggcacaccagtctccattcctggggactgggccccggaatgtgctggcggtgaactctccctgcagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctccagggaagctcgggttgtgtcctgatggcttcatggatccccccttcaaaacatatgcattcgcaggccctgcacgcccgcctgcagccc

SEQ ID NO: 38810 - DNA, 104 bp, Chlorella protothecoides
gcgggccggaatcctggaggccaggcagcccgaaggagcgcttgccggtgagcccaccgcgatgcagtcccgcccgcaggatcctgcgcctgcgggcaacactg

SEQ ID NO: 38811 - DNA, 34208 bp, Chlorella protothecoides
  modified_base (478)..(487): a, c, t, g, unknown or other
  modified_base (2388)..(2397): a, c, t, g, unknown or other
  modified_base (2886)..(2895): a, c, t, g, unknown or other
  modified_base (3652)..(3661): a, c, t, g, unknown or other
  modified_base (5670)..(5679): a, c, t, g, unknown or other
  modified_base (5961)..(5970): a, c, t, g, unknown or other
  modified_base (6534)..(6543): a, c, t, g, unknown or other
  modified_base (7110)..(7119): a, c, t, g, unknown or other
  modified_base (7469)..(7478): a, c, t, g, unknown or other
  modified_base (8416)..(8425): a, c, t, g, unknown or other
  modified_base (9114)..(9123): a, c, t, g, unknown or other
  modified_base (9761)..(9770): a, c, t, g, unknown or other
  modified_base (9976)..(9985): a, c, t, g, unknown or other
  modified_base (10494)..(10503): a, c, t, g, unknown or other
  modified_base (10943)..(10952): a, c, t, g, unknown or other
  modified_base (11343)..(11352): a, c, t, g, unknown or other
  modified_base (11498)..(11510): a, c, t, g, unknown or other
  modified_base (12234)..(12243): a, c, t, g, unknown or other
  modified_base (12304)..(12313): a, c, t, g, unknown or other
  modified_base (12367)..(12376): a, c, t, g, unknown or other
  modified_base (12615)..(12624): a, c, t, g, unknown or other
  modified_base (13233)..(13242): a, c, t, g, unknown or other
  modified_base (13349)..(13358): a, c, t, g, unknown or other
  modified_base (13615)..(13624): a, c, t, g, unknown or other
  modified_base (13776)..(13785): a, c, t, g, unknown or other
  modified_base (14825)..(14834): a, c, t, g, unknown or other
  modified_base (17548)..(17557): a, c, t, g, unknown or other
  modified_base (17982)..(17991): a, c, t, g, unknown or other
  modified_base (20151)..(20160): a, c, t, g, unknown or other
  modified_base (21845)..(21854): a, c, t, g, unknown or other
  modified_base (22928)..(22937): a, c, t, g, unknown or other
  modified_base (23146)..(23155): a, c, t, g, unknown or other
  modified_base (23488)..(23497): a, c, t, g, unknown or other
  modified_base (23733)..(23742): a, c, t, g, unknown or other
  modified_base (24196)..(24205): a, c, t, g, unknown or other
  modified_base (25198)..(25207): a, c, t, g, unknown or other
  modified_base (26247)..(26256): a, c, t, g, unknown or other
  modified_base (26502)..(26511): a, c, t, g, unknown or other
  modified_base (29103)..(29188): a, c, t, g, unknown or other
  modified_base (30705)..(30714): a, c, t, g, unknown or other
  modified_base (30867)..(30876): a, c, t, g, unknown or other
  modified_base (30940)..(30949): a, c, t, g, unknown or other
  modified_base (31060)..(31069): a, c, t, g, unknown or other
  modified_base (32427)..(32436): a, c, t, g, unknown or other
  modified_base (33562)..(33571): a, c, t, g, unknown or other
gccgccagccgccccgcgatggcgcgcccgcgctccagcgcgccgcgctcctgcgcctggaggtctgccgagcgacgcggctcggcgcgcgacgccgctgcggtggtgcagagcgacgccccggccccctcctgcaccaagcccgtgacgtcggcctgcaggccgatgtacaggtccacgggctcgtgcgtgccgcccaggcgcacagggtgcagggcaaagcagttccagaagggggcgccgtcgcggcggtagttgagcaggcagacgctgacggggcactcctcgcggagcgcgtcgcggatctcgaccaccgaccgccggcaggtgtcgcgacctggtggacgggggagaaggatgaggggggtgtctagcgctggtggaaggcgcggttcttcatgtggagaggacccacacgttaagatttaccccccccccttgcccccaatgcatggcctccaaacaaagcgagccctcnnnnnnnnnnccttcatgtggagaggacccaaacattaagatttaaccccccccccttgcccccgatgcatggcctccaaacaaagcgagccctcaccctggaggacacggcagttcctgcccacgatctcctctgggctatagcctgtcgtggcgtaaaagccgggcgaggcgtagcacaccggctgggttggtgtggaagggggaggaggctgagtcaatctatgctggttgatggttgggcagagccaactcgtcgcgttgcgaagcgcgcaatagaccggtttggcacaccaccacgcacattatccggcattcgtgggttgctgatgacgaaactgaagtcgatgtccgccagcaggtgcgagaaggaggattccaccgcctgggaggaggggtcctgcctcccgcccgcaagcccggcacgcacggcctccagggggctggggtcggcgagggccgacattactgggtcgcaaggaaactctttagagctacttattatcgagtatgcagtggacaaaggccctcagtggtggctgctgacaggtcttcgtgtcgggatgtctcgggcactgggcatatttccggtcaagcaatcggttctatggcagccaccgagatgttgagggaaggaaggtgcaggccttcattgttcagcatcacatgtgctggtattctggaggagggcgacagcaatagggtgctgggttcctcacccggcagatttcaacacagcacatgctctccggcacgtggggagtcacatgaccatcaatccacaagccctcaccaacgaagctgacccgtcactgcctccccctgatcctgcgattcgcctgggatcattgcatgggcccctgagacccctcatcccagccgcagcaccccgatgggcctgcaaataacaccttgccgcgtcactccacctgccaccaccggaatgacagcgcggtccatcctatcacgcgcggtgcctgaagccctcaggtgggcaactagccgaggccccagcgtgcctagggcagggatgagcacctccatccaggatctggccgtagaggtgcgtgagcgggatgcgtgcgcaatacgtgtgccagggagaaccgtgagccacccttggggtgggtgagggcaaccatgcctagggtttgaggcatgatgcacggccgtcctgagcatggccctgccccaccccgccacagacgcacaacaagggcggcaagtttcgcgtcttggtcaccaagaacctccccggcgaggactggctcaaggtgctcacgtctgccggcgctcaagtggacatctgcactgccaagcagaccatcctcgacaacgccagcatcaccaagctcgtcggcaataagtgtgatggcgtgatcgggcagctgaccgaggtacggctgggaggcagcctgcgtctggcgcaagggtgtggtgccgcgatgccagggctgtgagcagttggcatgggagcaaactccgtggctggtgctgcagttgacttaccatcaaggcttgctcgcccttcctgtctccctgccgcccataccgcttctcccccaaaccccatgagcttctgtatctgaacatccacccaggactggagcgatgagctgtttggcgtcctcaaggcggcaggcggcaaggtgtactccaactatgccgtgggcttcaacaacatcgtgctggaggatgcgaccaagcatggcattgcagtgggcaacaccccaggtccttgcggggctgagggtagagatgggatcaggggtgtctgcagggtgtccgtggccatcaggcgccttgaaggcatggctgggcacatgacgaccctcttgagcccagccatggggtgccaagagcaagatacagctggatgacagcaaatgaggctcgccagagtgagaaatnnnnnnnnnntggggctgagggtagaggggatcaggggtgtctgcagggtttccgtgaccatcaggcgccttgaaggcatggctgggcacatgacaaccctcttgagctcagccatggggtgccaagatcaagatacagctggatgccagcaaatgaggctcgccagagtgagaaatccagctccctttgccgtgcctaggcgtgctgacggagaccaccgccgagctggcggcggcactgaccctggcagcttcccggcggctgctggaggctgagaagttcatgcgggggggcaagtacgagggcttcctgcccaacctcttcgtgggcaagctcctgcaggtggagtagtgcagcgaggtttggcagcggaatgcctgataatggctggtcgttttggtggcattgactcgggagagctcttgacttgcacatgggggtgtcctcatagccattacctcatccttccctccttacaaaatggaccagggtaaaacnnnnnnnnnnggcagcggaatgcctgatattggctggtcgttttggtggcattgactcggaagggctcttgacttgcatatggggatgtcctcttagccattacctcatcctcccctccttacaaaatggaccagggtaaaaccgtgggggtggtgggccctggccgcatcggcttcgcctatgccaagatgatggtggaggggcacaagatgaacatcctgtacaacagccatgagccacagccggagatcgccgactacttcaagtgcgcgctgtttgtggaaaagccatgatggagatgtggcagtgacggcattcatgaatgtgggccagggaggctgttgttcggggcgaagggccgggcatgctgaggcttttcttcagaatgccagtgttgattgttcagtcccatttcttacgaattccatcaccggtctgtcttgaaccccctgcagcaagtacagcgacttcctggagagccagggagggacgagggtgactgcccgtcaggtggagcttgaggagctgctgcagaactccgacgtgggtgcagatggccgtttgttggaggatgcgtggtgtggtccagcttgcagggttggcttgttctgtcagcaggagtgcataggctgctgggatttcatcattgctgggggtctgcctttcctgcaagggacatcattcccattgtcgtccataccacatgggggtagggtgtgggttgtggatgtgtgtttggaggcggtgatggtggagcgccacccannnnnnnnnnctcccattgtcgtccacaccacatgggggtagggtgtgggttgtaatgtgtgattggaggcggtgatggtggagcgccacccacatagcatgaccctgggactgttcagccgtacctccctcacccgtcccctcgactcccccaaacccttcctccctccaggtggtgagcctgcactgcgcgctgacccctgagacccgccacttgatcaacaaggagcggctggggatgatgaagcccgacgccatcctggtgaacgcggcgcggggccccaacgtggacgagaaggcgttggtggcgcacctccaggccaaccccggcttcagcgcggggctggacgtgtacgaggacgagccggccatggcacccgggctggcggagtgcagcaacgctgtgcttatgccccacatcgcctcggccacgctgtggacccgctccggcatggccaagctggcggcctgcaacgtggcgggcgtgctgcgcggctaccccgccctgaagagcgcgggcgacgtgctgcagttcgtggacgccgaccccgggtcggtgcccaagctggcccccagcatcctgaatgccgaggcggtgggtctggagcgcagctcctgaacctggcgcgtgtgcaggggcaggcgcctcgcgcccaggcctgggcgtggaggaccctcacctgccaatcattttcgttcgcatgctgtgcacgatatccttgtggtgcatgctgtgaagccaccggcagcagcggatctccaacatgctggatccccgagattctccccgcgcccccccgccccacgatcatcagtcgcgaacggccggtcagggatcacaacgagccggcacaccgggggattagatgcaggtcggcgccaccaggaccctgttcaagtctccctcgacaatcaaacacccatcacccctcccgagacagcaggcggtacgcagatcgacgcgggccatcatggtgtcgtcggcatccggtgtggtgcttcccagaggtgcgcggcccttgtcccttggagatcagggcgtccgcgatgccgactggcacaatacttgggagcagttaacaattcagcgcccacacccctcatcacaccgtcacaggcgtagagcccctcccggccacggaccagcatgagctggagcgtgtggtggcctccctgaaggccaaggccccggagtgggtgggcctcgacccccccacccgcgcctcactcctgcgtgcctgcctccccaccctgctggccaccgtgccgggcgccgcggcggcgggggaggcggccaagggctcctacggctcggggcgcgcggaggaggccctgaactggacccccatcgccatctgcctgcgcgaactggccgaggcgatggaggcggggggcgcgccgcccacgctgggctcccgccgccgccccgacggccagtgggtggtcgacgtcttcccctcgggcctggagcgcctgctcaacgccggcttccggggcagcgtctgggtgaccccggggcaagagccgacccagggcgcgctgtacgcgcgcaaggcggcgggcgtgcccggcccggaccccggcgtggccctggtcctgggcgcggggaaccaggtgtcggtggccgcctgtgacatcctgcacaagctggtcgtggacgaccaggtggtggtctgcaagatgaaccccgtgaacgagtacatggggccctttgtcgcggcggcgctggcgccgctggtgcaagccgggtacgtggccgtcgtgtacgggggcggcgaggtggggagggccctgtgcacccacccagacgtcgactccatccacctgacgggagcggcggccacgtacgacgccatcgtctggcagggcaagcccaaggtgctgtgtgtgtgggtttttgttttaggggggagggggggttcgatgggaggcaaatgcgttcaaagggtcctgcaccatgcatgcatggtgcctgagggcatgcatcgcagcggggccagggcgctcagaatatacttnnnnnnnnnncgtgttttgttttttttggggggggggattgatgggaggcaaatgcgttcaaatggtcctggaccgtgcatgcatggtgcctgagggcatgcatcacagcggggccagggcgctcagaatatactttatccattccaagggggccaccccccattccagaccccccggcttctctgtatgccctccaaatcgccccgtgtctccccccagttctccccaccacatgtttagcatccccatctccgactccactccactcaggtgggcgacccgccctgcacnnnnnnnnnntccacccacttctccccaccacatgtttagcatccctatctccgactcccctccactcaggtgggcgacccgccctgcaccaagcacgtgggcgccgagctgggctgcgtcacgccttacatcatcacccccggcccctggaccgacgcggagctggcctaccacgccgacaccgtggcctctgccctcatcctcaacgcgggccacaactgcctcaaggtggagctggtggtcaccgacgcggcctgggagctgcggcccaagttcctggacgcgctgcgcgccaagctggcggcctgcccgcgccgcgtcgcgtactaccccacctccgacgagaagttccaaggtggggagggcgattgtttggggggggggagccagagggtgggcgactgatgtcaagttgatgttcttggcacgcagctggtgtctagggatggtggatgatcatgcaggtaggatggaaatggatcaagcacagaccctgggctgcaagtcggtgcggtaccccccgccaccacctgctcatgtacttgcccaatccctggcatcctctggccatcnnnnnnnnnntgatgatcatgcaggtaggatggaaacggatcaagcacagaccctgggctgcatgtcggtgcggtcccccccgccaacacctgcacatgtagttgcccaatccctggcatcctctggccatcgctcctccactgactcgagccccgttcccccaccgacccagctccaacctctcaacccccatgtcgacccccgcacgcagccttccgggagcgcttcccagagggcgtggaggagctgggcctggaatccggccctgggaccagcccctggctgttcaaggcggggcagagtgtggacagcgcggacgcccagcacgagaactggtgcggtgtgctgcaggaggtggcgctggagggcaccggcggcgacccggccgccttcctgcgcgcggcggtggagtttgccaacgagcgggtctggggcacgctgtccgcgggcctcatcatccacccggccaccaaggcgcgtcgcggcttgcaagggaggggggatggaggggttgtgacgggctggtgcctgtgccatgcaggggtgggagggcaggcacggctgaatccccacacnnnnnnnnnncctggggcacgctgtccgcgggcctcatcattcacccggccaccaaggcgcgtcgcggctggcaagggaggggggatggaggggttgtggcgggctggtgcctgtgccatgcagcggcgggagggcaggcacggctgaatccccacacccatccccatccctccctctcccaggccgcccacagcgaggcctttgatgccgcggtggcggagctgcggtacggcgccatcgccattaactgccccaccaccatgtgctttgtcaacacatgcctgccctggggcggctacccggggagcacgccgcaggtgggtggccgaaggctcgcaagcttgcaaggccccagcagnnnnnnnnnnagcctgccctgggggggctacccagggagcacgccgcaggtgggtggccaaaggctcgcaagcttgcaaggccccagcaggcgccttgtgcacctcgaaaccctgcccagcgccttttctcgcccaacttccccaatgccaccacgccatcatcgcaggacatcgggtctggcaactgctatgtgcataacaccaagctcattgatcatccccagaagggggtcctggaggccccatggacagtccggcccaagcccttctgggcgacgcagaatcccagcctggagggcatggcgccggccgccctgaagttcttcgcctaccccaccgtgtggaacatgatcaaggtcatctggaagacgctcgtgtgagaccaggatctgcacacggtcccctcacaggcatcacttttcaagcgtactgcccttcagagtgggcagggagtggctaagtaattgtttccactaccagggccttccatttcaaggcccccggatgtttcaagcctttgtaataagttttgtagcctatgtcttgccaaatcaagtgagtagggagagcgcgctttatgtagggatgtcggcatcatgtacgaggaggatacagtcgaccttttagtagtgcagtctgcaatacgcaagctcaatgatcatttcaatccctttggcttgcttgaatgcgagcatcggtgcgatcacacgtgcttctgctgcctacggcccccatttcgcgtgtggcgttggcaaggcctgtagtgcgaagtccatgcaatcgagcgtttcatcttactaagatctcatacgacgatagtgtacattcaactttatgcaaggtatcccagcggtcccgaaggaccatctgctgtgctgctgacgggacgatgtccatgcaagtgatcaggatccttggcgacggccgctgcatgtaccgggccttgnnnnnnnnnngtaagttttgcagcctatgtcttgtcaaatcaagtgagtatgtaggggagacagcgcgcgatctgagcgcgctttagggatgtcggcatcatgcacaaggaggacacagtctttgctgcgaccttttagtagtgcagcctgcaatacgcaagctcaatgatcatttcaatccctttggcttgcttgtaagcgttgaatgaatgcgagcatcggtgcgatcacatgtgcttctgcagcccacttcccgggtggcgttcgcaaggcctgtagtgcgaagtccatgcaaccgagcgttccatcttactaagatctcatacgatagtgtacattcaactacatgcaaggtatcccagtggtcccgaaggactatctgccgtgctgctgacgggacgatgtccatgcgagtgatcaggatcctgggcgacggccgctgcatgtaccgggccttggttcggggactgcaccttgctcagaatagtgagtggataaggcgcatactcacaagctggtggcatgaggacgttcctggccctgcttaatgtctctggtggcaaagatgcttgcatcctagaaaggcatccagctttgaggagaattcttcagccgcccgcatttcaaggcgcccaccaagccagcctgctcatgcatttctcctggcgcagagcctctgcagccctcggaggagaccnnnnnnnnnngttgcatcctggaaaggcatccagctttgaggagaattgttcagccgcccgcatttcaaggcgcccactaagccagtctgctcatgcatttctcctggtgcagagcctctgcagccctcggaggagaccaatcaggctgacgcactgcgccggagggtgtgtgacgaactgggcaagcggcgggaggactttgagcccttcatcgattgcgatttcgatgcatacgtgcgtgatcagcgccgcccatccgcctggggcggtgagctttatttgtggatttcttaggagtgcagatggggcaatgcatgggcggctcagctcctctcccccgatctgatctgtacttgccattccacccttctgcaggtgaacccgaactcgcttgtgcggccactgtcctggaatgtgttatccatgtgtaccagcagtcaacccagggagggctggggatgatctcacagtatggcgagttggcgaagggtggcagccgcccgcccgccatcaacctgctgtttcatcgattgggccactatgacctcctgatgcccggccagatacagtcgaagctatgactgttgtcgttttctcgcatgaacccaatgatttactccttgtctctacttcagtcgctgccacannnnnnnnnngtgactgttgtcgttttctcgcatgaatccgatgattcgctccttgtctctacttcagtcgctgccacagggcaatctgaatgccggtactgcttgctggtgcaccctttggccagggtgtcatgatctgtcctctcaagactatcgagatgcactccatgtgtgtgcaggatgatacacagcacattgcaaggattcacagtctnnnnnnnnnnttctgtcctctcaaggccaacgagatgcactccacgtgtttgcaggatggtacacagcacattgcaaggattcacagtcttgtgaacgtcacagcagctagccttgcggtctggtgggcacagtgtgaaacatgttgacaaagggcggccgcggcaccatggggtacatgaagggagccatccctggcatggcagggggacccatgtgaggcagatgtgtcccaggatgcattggcaggggctggtaggggggaggtgggggcttcccaggacccatgggagggggcggcggggggttggctggtggccttggcacagcaggcgctcccatgggcgggctctgggcctgcagtgaggtctgctccagggcacgtgcatagtcggccttgcctgtgggtgaggagtgcggtgatcacggagggctcaatcccgtcttgaatcactgaggtgtacaaataacgacatgaaggaaaagattgctgtcaaggctcttgagtgctgatggggcnnnnnnnnnngggagggctcaatccagtcttgaatcactgaggtgtacaaataaccacatgaaggaaaagatcgctgtcaaggctcttgagtgctgatgaggcttggccaagcacagtaattgattgtgcatactggcacatcatgacaccgagcacaggcctctgcagtgcctcacaacgctgccaatcgaacaaccacctacttcgaaagccttgcatcgtgtcaggatggatgtacatgggagtaccagggggtactctttccagcttggtcacattgacatggcacctggtgttgattggagcggtagaattgggtgctctgagggcaggctcaagcatcttctacacagcggaccgggcgcaaaggccatcgagcactgccagaggcctgcccacgccatacccgctttacaagagcaactcacagtcggcatcgagccatggannnnnnnnnngccgggcgcaaaggccatcgagcacagccagagacctgcccacgccatacccgctttaatgaagcaactcacagtcggcatcgagccatggaagccgcacaggccaagcagaatgtgtgtaagcagggggccaatcgtccatatgctgcaatgggggccttgcaggccaaacacagatgcagtgcaagccccgcatcgggagtggcgagctctgcgtacatgaagataatattttggcaaagctgttgtgcggtttacagctgagacagaatgttgcaggatggttggtgtgtcctacagcaaagcaagaaaaggcaccatgctactaggagtgtcactacgacagggtcgcgcattacaatgtatacatcacatgcttttcagcagtatnnnnnnnnnncaaggcacgatgctactaggattgtcactgcgacagggtcgcgcatcaacatgtatacatcacatgcttttcagcagtataccatacttccactgcacttgtaattgcgatgttcgcctgcagctctgaacaaagtgatctcatcnnnnnnnnnnnnngaacctggatgcgtaacttactgcaaacccaagagtgcatgacccccttaccgagcctgcgcatcgcccgcataccctcctcctggtccgaactgcccgagacaaagcacagctgtgatcgagcgggcaggcccctgggttccggccatgtctaacttgttgaagggagtgtcgagcctcaaggtgaaggaggttcccggcttcgtctccaagtatgccggcgagaacctgaccaagaacaaggtcgagggacggctgacgagctggtaccaccggtacaagaaggaggtgcgtcgaggtgctctggttgtcgtccaggccaggcctgcccggcagcaacatggtcagggtgtgcgccctggatccctcaggcaggccatgcctatgtcagaggcccagttgtagacgctgatctgccgagaagaatgcctaatgccctgtgcgccgctcacaacatcgtccctcccaccccctgcacccactgcagcacattgacaccggcagcttcaagcccttccaggacctggtggtgggcgtcttcctcttctcctacgtcatctcctggcccaaggagtacgcgcactacaagcacgagcaggaggccaagctggccggcggcgccgcgcactagggcctggttgttgccggattttggccttccctgtggggcaatggcatccccgaactggatctgagatcccgggcgcctgtgcacacccatggnnnnnnnnnnatggggcgatggcatccccgaactgaatccgagatcccgggcgcctgtgcacacccatggnnnnnnnnnncggggacagcaggaagggaggaagtgtgtgtgtggaggggagggggctgggggnnnnnnnnnntcctgaggtcccgaatgcgcactgtatgtacagacgaggagcggcagcaaaggaaggggacagcaggaagggagggtgtgtgtgtgtggaggggagggggctgggggaccggcccgcatggcactccgtcgaggagcgatcgatcaggcaccacacgccccggccacccaacagacgcagcacggcaacatgccgcagtctctcaaactctaggccttgaggatgccgaccagggtgtnnnnnnnnnngcagacgcagcagggcaacatgccgcaatctctcaaagtctaggccttgaggatgccgaccagggtgtttgccaggctgaaggtgcggacagacaggccccgcgccttctccagcagcgcgtcgttggcgcccagggtctcggtctgcattaccaccgtgccggccttggcgtcgatcttggcgttcagccgcgcgttcctggttgtggagggtggcggtggattttgtcaggttgtgatgatgaccactgacgctgcacagagtaaaagaggccaggcccaaggctgcaagggtccgtggtggcgacccacgcgcccatggcatggccagcgagacacaccccaccctctccttcccccctctctccaaccttcccacccccttcaccatacctgatgaggttcacgatccacttctcggtagcctctcggtccatgcccagctgccccgccagctccgccaggtcgatctgctggtgcacgcggcagtaggtctcgaacaggaaggtgcgcgccgcgtccatgaacgcctccttggccgccaccaggaagaagtcattgtccagcacctggaggcgggggcagggtggggaggaggacactgaggannnnnnnnnncgcccaccaaagactggcagcatcaaagtctcctccttcggtgtcacctccttcccctgaataacccatctccaacacctaccctcagatccctattcccccccccnnnnnnnnnnccctggtggtgcatcgcttctgtgtgcagtgtgctgtcgtccatgcaagcagacctcgcaactcccatctgtgaggaccaggcaccgcccaccaaagactggcagcatcaaactctcctccttcgacgtcacctcctttccctaaatcacccatctccaacacctaccctcaaatccctattctccacccccccctccaccccgccccccccacacacacacttcacccacctcctcgcactgggccagccaggccnnnnnnnnnntgccgtcaggtacctgggaggaaagcatgaaggggtgtgtttgggtgggggaacttctcaaaaagaccagtcagggtggtgtttgggtaaaaatagcatgggagtcgttggtgaggacagaacgccggcggtgtatttgctaccgatgtgcnnnnnnnnnntgcgcgccgtcaaagtcggcctccacaaagaggcagcgcaggaactcggtgatggggtcgcggtactcgtactgctcctgctggatgacgcggaccaggtccttgagaacgttgcgccgccgcttgttgatcaccaccgcgatggacaggtagcgcagcaggtgctggccggtcagctgcagcgccgtcaggtacctgggaggaaagcgtgaaggagtgtgtttgggtgggggaaaccctcaaaaagaccagtcaaggtggtgtttgtgtaacaacagcatgggagtcgttggtgaagacaggacgccggcggtgtatttgctaccgatgtgcatgcatcaaaggccgccagtgcatgggcaacacagccatgcccggggacccacggctgtaatgaatgtccatggacccctgccaggcaggcctaccttcccacgttcaacacccctccccctctctccccccaccccccctcctgaacacacacacacacacctgtcctggaggaagaggtcgatgagggcgttcataccgttctcgtggttgaagaagacaaagagggaccagtgcatgagccaggagcgggactgcagctgcttgaccacaggcgcaaaggtgtccagatccaggaggtctttgagcttcagcaggtcctccatggccgcctcaaagtcctgcagcaggatgtcggcggccaccttgccccacagcgccgatacgcagcggtctgggtgagtggataggctgcggtagtggtgcaggtactccgcggccgcgctgtagttgccgcactcaaagttccacttggccaggtggtacagtgcgtccacctggtcggggcctgtgtcagggggaagaagggaggacatacctttgagcgttggacttggcgagagaaggggacaccggacacaggttggattagggtagaaggatcgggatgtgcaggtgcatggatgtagacatcctggcatgtaaagtagcatgcaggctgaagcatggaggggtgtgagacctcttgctcctgttcccacatccannnnnnnnnnggatggggacaccggacacgggttggattaggctggaaagattgggatgtgcaggggcatggatgtagacatcctggcatgtacaatagcatgcaggctgaagcatggagggggttgagacctcttgctcctgttcccacatccactccagcaggaatcagtcctactgggtcaagggacagcacccagcgttccctctgtccagaatacacccttgcgccctcttaccaatgccgaactcggactgcaggaaggcctggttctgcgtcttgtcctgcttgagcagccggacattgtcggcattgctcaggaagtcggtgatggtcttcacctgtccctccagggtgcgcagcttgttcaccacctcctgtcgtcgagccaccagggagtcgggcacctgcgagcggatgtatgttcgtatccaggcagtgggttggcccaggcggggatggtgtcggaagccttggtgtagagccggcttcaggccatcacggtcgggacaccgcgagcccggccacgcccagcatcgcgcgggtgaccacattgtttcctactgcgttatataaatgtgcttgaccccatttacaccatccaggccacgcacctcatccgtttgattgaggccctggtagatatccacggcatagtcgaccatgtttgtcttctcgatcagttccagtttggcagactcgatgtcctcggctgggtacagctgcttctgggacaggaactccagcagcgggaacacgaggtggcggtccagggacttggccaccaccgtggtgaggtcatactgcaaaggatcggcgctgctggctgccgccggctcggctgcgcccagggacgccatgattgcgaggaaggagaggggatgatcacacagcggggaaccagtcgccgcagccctcaccatgcgggcacggggcccctggctggactgggccggtttgggcggcctcggtgccctgccgaggccgatgtggcatagcacgcgggtcgcggcgcccctgccagacagagaggatcaagggcccgctccgtcgcctaaagtgctgacctgcctcgattcagcgccaaattcatccacggctactccgatctagacatagataagaaatgatgctcaagagcaccatgcagagcacccggccggcatgcggcgtctgggccgtaggcccttcacccatgcggatgtggaggcagcccgccagggcacccgctgccgcgccgcgcatgaagcctgtcagggcccacaagtccatggatgaggccgccttgtccctcctggccgctacggggttcatgctggccctccctgaggccgcccatgccgacatcctgaccggcaggatcgccagccttgctcacccagtcgccatgattgcgctcttcgggtccagcgtgtacacagccgtcctggggttccaataccgccgcacgcgcgacctggcggcggagatcaaggacctgaaggcacaggcacccccgcctccaaagggggagggagaggaggcctcctcggccgtcgcgtcgccggagcagtccaggatcaaggagctggagcaggtgagggaggagtgagaccaagaagtagagattttatcatgtgtctgtggccatgctcaaggaggcacttgtgaattttgcgtggagggcctctacctctgacgagccggggggagcttcggaatgatcgccctggtgcccaatcccaaatcaggagcgcaaggacctgatcaggaagaagctgaacgagaagcactacacctggggttctgtgctgctgggcctgggcatcaccttctccatcatcgggcctgtcaacacctacctcagaactggtgcaaccgggaggcggaggaaaggcagaacaacggggtctttgtcgtgactcgcatttggtagtggaatgcaaaatcatgactgtcttgctgcattaccaggcgttttacttgacagattgttgacacgtcatccttgcaccaccccacctccctcacccttcccgcaccaggcaagctcttcccgggtccccatctctactttggcgccctgatcacggtgctgtgggcgctggccgcctcgctgtctccagcgatgcagaaagggaacgagacggcgcgcatcacccacatcacgctcaactgcctggccctgttcttctttgcatctcaggtgatgttttgggggtcacagggaaggtagggtggtgagggtagggcagtagtgcagggtctcctgcaccatggggtcatgaggaggtcaggcaatgcctgtgtgtttggatcgaactgcttcgtaatgtggattagggcttgttgggtggcgtcctccacacatctcaagttgacgaccattgacccctgcagattcccaccgggtgggaaatcgtcgtcaaagtgctggagaatacctctttcccctgaagacctgctgctccggcaattgaacccagagaagaacatccagaagaataggcatgctcacacactcccagcgtttaatctttgtcgcatgatatgaggggatcccatcgctcgtcgcttgatctgtatgcccctgttccccaattcctctcctatcccttgagggtgggaaaaggccttgtgtgccgtcaagaatgcattcggccggcaattttcttcccaactttttacttttgcccccagcaaggttgacgttttggatgtaggttttccagtgaacgagtccannnnnnnnnncatgcattcggccggcaattctcttcccaacttttcacttttgcccccagcaaggttgacgttgtggatgtaggttttccagtgaacgagtccaagtgtctaatctggcagcaactacttcaaatacacgcagtgcagagataagaggccgcgatacagcaaggaccgatctcgatacaaaaaatgttatagcattgctcagtacccatagagtggtagtgggggcgatccaagggcatcgggcccagtcgccactcagggatggcacccattccgccacccgagcctccgcctgcaacgtcgcctggacagaaggaggtgagcatgtcgatgctgtattttacaatgtggatcgtgcttgcccccacagtccttcctgcgtgatcggcgggcacagggacatccccagtatggagtgtcctctnnnnnnnnnnatttacattgtggatcgtgcttgcccccacagcccttcctgcgtgatcggcgggctcagggacatccccagtatggagtgtcctctccaccttgccctgctgccctgaggcaccccctgcctccatgctgaagacggccgctcccgatctcaatcaatatcatctgcgcagggttcggcagagaagacagttgagccattgatacgcctgagggagttcttcgagcgtcaaggtaggccaagcttaagaactgtaccgcgcggtgccagtgggcagacctttcacttgcggccccacatccgcctcccctctatacaggtgcgacactggaggaggggtggtccatagagatcaagcatcgcagcggggggtccacagccggcacgaccgacacggtagggcgggcgagtacacggctggcggacatgaagttccagcacaccatgaacgacactggcttcacaagacattccatgaacttgattgtcccactcttgcgctcctgcagtactatcattctcccaagggcaagcggtatcgctcaagagtggaggtgaggggggctcaaggtctggcctgcctcgagagtgtctgctgttgggggcagcatttttctcatcagcatacctcctacccctcgccacgccctcttgccccagattgctcgggactatggcctggtcgtggagccaccagcacgcaagcagaccagcctcagcagcttctttgaagaacacaagccagtctccagaccagaggctgtgtccggcagcgctgcctgcctggcgagcctcacgcttccgctgacgctcgccaatggcaccaccatcacatcgtgcgcagggattgagtgaaggtttctggaagctggcgcatgctggtggctcgtggggaggcagccttgcagccccatcaccctgagagcatgctcatgcagttctatatacaagcaatgcgagcttccaggaccacaccaacccgccacaggctgggcacaggtgcggctgtcactggcactgagccgccgaccctgctgcccgttggctttgaggcagagcgcgcggcaggagctggcagcagcaaccgcatccatttttccattgatgagggcccagtgtgcaggtggggagcataccgacgccaccatgcctccagcctctctcagaatcggaagaccatgcatgcagcctccacctgatcatgggctcaagtggaaacactgagaagagtgtgcctgccctgcaggattctgctcgggcgacctggtgagggcttggagctcggcgccggcgccagccctgacgcagcgtggactgctgcggcagcttcgactgctctgcaagaaagtgggcatgccgcggtcccagatggactcaagcaagacctggagatggggtgggggacggagcgctttgggctggcctccctcccagtgctcaaagcagtggaggtggggcctggagggcggtttggtgggcctggaggaggtgtggcgtcgagggcggatgaaagacaaccgtcacacagaatctctgaggacgcatgcgctccatgcgctcttactctgtgagttcagcgtccatcatgctgccagaattgctccgagctgactgttcctgccatgcagggcctaccaaacgtcaaggacgtgccggggtacaagtatgtggacgaaggggaaggctggagcgcggtgggtgccaggctgagggcgcaactgactcagcgtggcatcatgaaggccaaggtgcgatgagagccggcaccttgggcctgaggtggcaggagtctggctgtgggagtggggtgaaggttctatcgattggcatttggtagagtaacagtgagggaggcttgttgcgatgcagtggttcggccgccagagacattgccaaacaccactgaccaccccccttcaccaaacatgtgtttgtctcgcacgcacagtccaaaccaggcaagccatctgagaaggtgccaggcgggaagaaggccgatgccaaagccgttgccaaggtgtgctgtaaaatctctggcccccgccccatctcatgttgggaggtggggatgctgaggttgcctgcagcggagcatctgagtataaatgtgtatgcccccacgactttgggctacatgttggtgtgcacgccgccagcctcnnnnnnnnnntgccccatctcatgttgggaagtggggaagccgaggttgcctgcagcgaagcatctgattatgaatgtgtatgcccccacgactcaggcctacatgttggtgtgcacgccgccagcctccatctcttcgacacccccaggccatggactccatgatccgccggatcgagcgggaggaggagaggaggaagtccatggcagagaagtctgcggctgcgctggagcgaaaggcgctgaagcagatgtgcgtcgctggggcatgggggatgggagaggcctggcagtgcgagtggcataggtgcatgcaccccacctgtgcacgagccatgcccacctcgctctgcgccacagggaaagcgaggcgcagcgatcgcaggctgtccaggcacagcatgccctgttccttgcccgggcagcggccatccagcaatcccgggaggccaatgccgtcagaggtgtgctgctgaggttgcgagatgtgtgccgtggggaaaagctttctcacgcacctggggcgcctcgagtttggcacctctgtacacacacgggtcctccacctcccagtgacaaccctgtgcctcctgacttcctggcacgacagacgacgccaccctccctggagcccatctcccgccccccacgcccaagcggctggggtgtggcgccatccccgcggagggcgatgctcttttgctggagatctggctgtttgcccatcgcttccagggactgctgggcctggaggcccccctgcccaccattgcgcagctagaggtgggaacctccgatgtctgtgtgcatgtttgtttgcaggcttgtctgcagggtgtgggggtgctactggattcccaaccttgggtgcattctttggcatgccaggtgagcaatgcgtgcgtctgccggcagggacgcttcccatccatgcactcccttcccgcaccaggccggtttggtcatggagggcttccaccaggccagtgccccagacgaggaggtgcccagcccctacacactgctctgcatggcgctgtgcaacctcctctgcatcgacctgtttgatggtgccatggaagctctggaaggtgcccgatcttcgtgctgatggtggcttttgggattcggcgggggcgttgacagttccagcgtccctgcgctctgttgccagggagcagggcgtgaaggcagtgccagtgtcttggctgccgtttcataggaggccgcgcatgctgaccaccctgcccgctccccttctgatgcctgcaccccccaccccccgcagagtcccggcccgaggtgagggaggccgactaccggcccagcgccaaggcccagcatcccctgcccgtgaccccggagagctggccggaagctgccgcccgcatcctgcgcatccacgccgcggcggcccgcgctgaccgcgggctcgcatcgagggccaagggaaccgcggagccgttggctgtactgggcccggacctgctgctggacctgctggtggcggggctggacgcggccaccgcccagcgggtgggcgggctgccgccacacgctggccctcagacggccgcctcgatccgcgccgcggccgacgccgccggccgagcagctgcgattgctggggacggcaagctgggggtccgggcccgtgagggctcgcatggctccaccccgctgctccgcgcggcnnnnnnnnnnggctggggagggcaagccgggggtccgggccggtgagggctggcatggctccaccccgctgctccgcgcggcgctgctccggctgtgctcggggcggcacgccagggccttggcgtggcacggcgcaggagccgccgccgccaccagggcgccgcgggagctggacttggccggcgtgggacggcgtgtcgaggcgggggcgtacgctatggctgcgaatcccctagaagccctggccgtcgacgtggaagccgtggtggccctgcacgccggcctggcggggaagcaatcggaggcagctgtggcgctccagagtcagggtgggcgggggggatcgttgagattttggtgcctggcgcggattgaatggtgaacgacaagaaacagagtacaagcatgccgtgtttccctctgcgcatcatggacttctttgttacgtctgctccctggcccttgcccactctgcataccatgtgcgtacctcgtcaggggtggtggagggcgccgcgactgttgccagccttctggaagcctgtctggctgagatcaggaaggatgggccggagaccttcatacagggggtggagcgcgcccaccccaagctggcacggcacctgcgggatgtcagcaggtgacggtgggggtgccgttgctctggacatgacattgcgcaaggaaggttgatgtggaggctcacaatggctggaggtttgatgaatggacgtcaccactcgaggtcatctgcacactgcatgctgggtgcgccgccctgtcatttgcacaaagggacctgccgcgcaatccatgtggacccctggacctgatctggaggaccacgtgcacataacgttcccccccctccatcacaagaccaggccgttctcgcccttccctgggtgtgctgtgtgctgggacgagggtgacgagccccacaccctcatctgcgacgggtgcgacatcgagcggcacatgtactgcctacctgtcccgcttgaggaggtgccagaggtgtgatctatgtggaggggctggagatgagggctggggccgagggtgctgggcacagggacaaannnnnnnnnncggaggggctgaagacgagggcgggggccgagggtgctgggcacagggacaaagtctggaggcggcgtgtccgtgcagggcatgaatctgtgtgagagccttccctgttgagcggtgtctccgcgcctgtcgtgaatatcactgcctctacatcaaccaatctcttaccaaccctcgctgcgtcgcaaaccacagggagcctggcaatnnnnnnnnnnctgtccgtgcagggcatgagtcagtgtgagagccttcccttttgagcggtgtctccgcgcctgtcgtgaatattgctgcctccacatcaaccaatttcttaccaaccctcgatgcgtcgcaaaccacagggagcctggcaatgccctgcgtgcgaccccacctcaaagggcaaggatgggcttgcaggccagtcaggtggcgcacccaaggactgtctgacagagctgggcgaattcctttccacccacgacatctggtgagcggcggcgcagggggattgaggagcgacagcaggctctggaggggtctacctggcacaggtcctgcaggtnnnnnnnnnntggcgcagagtgtatgaggagcgacagtaggttctgaaggggtctacctggcacaggtcctgcaggcgtgcatgccacttcacgcctgcatcactccgcctgcaatataaagaaagtgccaggagccaggtatagcacaacagcagacgcgaaccgctcaccctcgctccatgccccggccctctccctcccacacccccacccatcctgtgcctccctgtccagcaggcaggccnnnnnnnnnntccaggagccagttattgcacaacagcagacgcgaaccgctcgccctcgctccacgccctaccctctcccttccacacccccacccgtcctgtgcctccctgtccagcaggcaggccgcgcccgctgcccgcctcaacctgttgcatgccctgacccagctggtggccgagtcgcggatggtgcacacctcgctcgtggaggaggaggaaagcgcgaggcagttaagaagggagatccagggcatgcgtgtggagatccgcacctggcacgccgaggcggcgctgaggagcgccgggggggcagccgcgcaggagggcgtgtctgcacggtgagacgtagtggctgttggcctttgggagattcgagcgtggttggtggaaggcctccttgggtgaacagagtgtcagcatgaatcttggcggctgggtttcatgacgacatcctccagatcannnnnnnnnngctgcacggtgagacgtagtggctgctggcctttggggagattcgagcgtggtggatggaagggctccttgggtgaacagagtgtcagcatggatcttggcgtctgggtttcatgacgacatcctccagatcatgcaactccagcaagggcctccgcccctcctcccgctgcagcgccacgcgatcggtggaccccttgtctcagattgaggctgcggtgcagcgcacctctcgccttgagcatgagctcagtaaggtgagatgctatggaggggggctggatcatgacgattggaggtctgtgcacgaggccacctcatgggcacatgcgctcggcatctcgaccgggaaggtgtcaactgtccgctggacgccacctgacagcacagcagcctcgcagtcgcagtggtcgccgctcgatcctttgcttcccccgcttcactcagacaccagtgccccggctgacccctatcggggtcgaccgacactggaaccggtactggctgctgccccaggaagcttttgcagaggtgccgagcggaggcggcgccgccgtcctgggcgtcgaccgccccgcaccatctgacgcgagcgctcccgctgagcgctggactgcaggcatttatcccggcccggaggacctcgacaggctcctgcgatggctggacccgcgaggtgtgcgagagcgggctctggcggccgaggcgaggcgtcttcatgccgagtcgctagcttcacaggagcgggaggaagtgcgggaggctgaggcgcgcgcggcaccggcagaggcgcagcaagcgcaggacggggcagagcagggttttgacgccactgcgccacctgtcgcagatgtgatgcagcctggggaggatggcactgccttggctcctggggcggcacctgctcccgacgcggcacctgctcccgaggcggcacctgctcccgacgcggccacggccaccgacgccctcgagcccctgcgcagcgccgtgnnnnnnnnnnccactgccttggctcccgacgcggcacctgctcccgatgcggcgcctgctcccgaggcggcacctgctcccgaggcggccacggccacggacgccctcgagcccctgcgcagcgccgtgctggcgttgcaggagggctgggcggcggccacgctgcaggcctcggaggaggagctgatcgcgtggcgggagtctgtcgtcgtggcagcgcagccagtcgacctggcgcgcgccttgctgcgactggagggctgggtccggcccgagttcttcaaggtgcactggcgcttctgggcggccatcacgccgcacccccgcagcctgggtgagttgtgggaggggtgggcagggcgagggaacccacctggagccggccgcatgcttcccgacgacaccagctgctgtgtccggtcgcgccgatgcgatccccctacctgcccaccctcgacctccccatcttcagccaccccggccgccctctggatgcggtacgaggcgctcaagtcggcggtcaaactgcgcgtgacgctcaagctgcccggcaacgcaccgacggccgccggcgggacgacctcccgcccgccctcccgtggcagcggccggtatccgctgcgggagcgccgcgctgcggtaggtgccgccggctcgggccagaagaggccctggtgggacgccctggaggacggggagaccagcgactcgcccgccgcgagcgccgagcccgcagctgacgaccgcgcgtcccgcctggccaagcgccagcgcgcccaagaaagggaggcacaggctgaaagtgagcggggccggcgcatggtggagcggagcgcgggaggcaggagcctgcgctcgaagcccgccgacgaggtcgcccgcggcaggctgcgggaagggtgagcgcagcggaccaggtggttctggtggagagctgtgtcgatgccgcggtcctgcactgtctgattcctgtcgcgatgcccgactcccaacccaccctgccctgctgccgccccctccatgccagggggcccagccagagggaggctnnnnnnnnnnatgtctgattcctgtcgcgacgcccgactcccaatccaccctgccctgctgccgccccctgcatgccagggggcccagccagagggaggctgtggaggaggtggtgtggatggactccgaccaggtgggaggctgtggcagtgggcatggggggtgtctttttgaagcaatgcattgctatagcctgttggggtgtgggtgtgaaggcaggttgagagcatgtgtgatgacacagtcccaccaccnnnnnnnnnnaaggctgtggcagtgggcatgggggttgtctttttgaagtaatgcattgccagagcctgttggggtgggtgtgaaggcaggttgggagcatgtgtgatgacacagtcccaccaccacaacacccctgcaacacaggaggagagcggggaggatgcggcaggagacacccaagattcgcctgcagcctccgcccccacttcttcttcttcttcatcgtcatccggggcttcaggcagcctggcatgacgctccagtgcagggcatgcgcctatgtgtggatcacagatgaaaaagcaatgccgcaccgggcacccgggctgcaagcaggaccgaaatcgcaggggcaaaggaaacccgggccggccaggatggggccaggagttgggtacttggggcacatgtcagccttccacgacagcatccagtcgctggtgcttgcggtcatggagcgagtcgtcgttcctgcacgcaggcaggcagccggtggcgccgaggggagcccacgccggggtgcacaggggttctacggggagcatgtggctgggtattgccctatcccatcctgctcagccatcacagctcgctggcgtcgcggccctggccacccaccaccccctccaccatgggcgccaggcgcgtgcggaacagcgagtcgctggcgaccacggcctccagctcccgagcccggcctgccgccgcggtcaccgcggccgtcagctcctccacctcccggtccagggcgggccactctgcgatgatgcgccgcgcgctctgcagcttgggctccttggtcagcggattgttgcacaggtcgatggtgcgcgccgcggggcggctggccgcgccgcaccaggtctcgcaccacagccactcctggtccaggctgtggatgggcacgatgctctgggcatagttgggcaggtcctgtggtgttttgtgtgggtgtgtgtgaacagagggggtctggtcatggaggggaagggggagggatggcaggggctgagggaggtgggatggcgcgaggagtctggtgggctacccgccgagggtccctgatcgacaggcttggagacgaatccctgcgcaccttccccccattccctccttaaagagcccaatctctcacctggtcgaggttggacagggagttggggtccttggacagccgctcgtacaggatgcgcagtttgtccccggctgccagcgtcctgaagcgatccaggtccaccaggtacagggccgagatgtggtagggcaggccctgggaggatttggtggagggggttgggggtgggggccgaagagaccagcgtgttgtcaatcgcaccccaaccctccaaagagtctctcgtgacatcaaaacactttaccttgaatgcatgcatcgccccattgatctctggtcagcagctgcatcattgggaccccttcacaaaaggttccattccatcaccccgcccaccaatcacgcacaaacctggaggtggtccttccagaagccctgcttccagaagcggaagccctccatctccttgttggtgtcgcagaagggggtgtaggcgtagggcgccccctgcaggtcggttgcccagagctgggccaggtcggcccggaccacctggtcggagtcgcagaagatgaccttcttgaggcccagcgggaagaggacgtccaggaacaggatcttgtacgcccaaatgatgcgttgcttctcgctctgcttgtgcagccaggtaggccacttgtatgtcacaaacctgtttgtaggggtggcaagggtggcgggttgagggatgggcggtcttgaaggtcaggagcctggcaatgaaactggtgcatgccgctccaaggaagacaccgtgagtctgctgtcaccctggcactcatctcccccacgctccaaggcactccctgctccccgtgcccgcccactcactcatagtcaaagtcatatcgcctggccatgaccgggatgaaagccttcatctgtggtgggtggaaggggatcactttactcaacacaacacgaacatcatcaaggatcaggattaaattgtgagactgcgttagcttggaagatggtcatccatcatgagggctgttgaagtcgttaccaatagcatcatcatcgattagtggacaccaccccccacttccgcctactgcatgcacctggggcgacatgtagttcttgatgaaccagaacttcaggcgagcgcttgtgcgtttgacagcggagaggatcatgatcttctgcaggcgctcatacctgggaggaggacagggtaggctgacgagctgcgcagcggggctgcagccatgcgctcaggccaagaatgtgttcagagtgcacaagctccctcctctccccttcccccacacctacattgtccctgaggagacggtgaagatgtggattcgggcatcctccccttctttcgcaggggcaggggcctcgtccttcttgccgccccagaccgggaggctggaccaggcacctacggttggccctgctcagcaaggtggaaggttagtggggtttggggcaggaagcaaggcatcggacattatgcgaatgtggcagctgagggnnnnnnnnnnnnnnnnnnnnnnnnnnnnnnnnnnnnnnnnnnnnnnnnnnnnnnnnnnnnnnnnnnnnnnnnnnnnnnnnnnnnnnaacgctacaaatgcactctcgcttcctgcgcaaacctccgcacctgtgcccgggctgggggccagcacgtcctcatccaaccgcgccgggtccttcttcaggaacaggcgcaggtggtgacctgatgacgagggaatgatggggggtgacctgagcgggcgagaaggttgccacgcgcccgctaccgcgcgtgcagcagttccgcctcgatgacatcacgagcacgaggatgagccagtggactctctctcatcccccaaacccacacacaaccccctccttcaatcgcccacccatcaggctgtcgactgtgaccggcagttcaaaggtgaggccgccttgattcctcggcgccgccgctccctccatcccatggtcggcctccagctcgtcgtcgcgcgcgacggaaaagagctcgcgggacctgcccggcgccaggcccagcgtccactcccccggcgccgccttgagctggaagtagcccaggttggacatgaccagggtgtccaccagcgggaccttgcccgccgggcccagctccagcttcacgcctcgcgggtgcacctgacgtggatggtgggttgtgttgcggggagatttgtaggtggggttcgccttgtaagtctgggaacccagtggtgcaggctgaggctgagatgggctggctttcgcagtgccgtgccaatgcacgtgcctgctcctcccccaggctgggcctctcgaagcctttaggacccctgacgtccctgtttccctagcaggtgccgtgttctccgctgtgttcaggatcccagcccccctagaagaccaaagaagccctttaacgcccctccccccctgtctcacctcttggctcgggtcccccgacctggccgccccgaggtctatggcgctgccggtgaccagcagggcctccagctcaaaggtggcagccagacgctgacctggccccagctcggccaggcggatgttgtccaggtcgtggtcggtggccaccggctccacgagccagggctccggcacctccatgcccagggtcagcgtctggtcggcgggcaggccgtcgaagcgcgctgcgggcggggcaccatcgccgcgcgggagcacatagcgcaggaagcccttgaccgggaggtcagccaggccgcggtcggggttgagcgtcagcatgacctccgcgcccagagcctcgtgcaggtacgccaggacctgtggagaaagggggaaagggggggggggtgatgctggtggggaagggtgggcaggcaggggccaggcgaggagaaggcgtcgcggcactggcgaggagggcgatggatgactcataggcaccactcctaacctcgatctccaacatactggggtgagcatggcggcctgcttggacagggggtccaccacggcttggatgaacagggggggggggacagagtcgttccgcccgaccctgacggtgttgagctcgtccgtggggaagcgctcccacagcccccgcccactcagctcatactgcaaannnnnnnnnntggcgaggaggaggcgtcgcggaactggcggggagggcaatggatgactcatcggcaccactcccaacctcgatctccaacacaccggggtgagcatggcggcctgcttggacaaggggtccaccaccgcttggatgaacagggggggggggnnnnnnnnnntcccatctgcgactctactctcccatgaacacctccaaccacccatgcatgcctggtccagggnnnnnnnnnnacggaagggggcgggggtgcggatgggcgagcagcaggcatgacgttgttgtggcagcggtcagtgcctgggggcggcaagccgctgtggtgatctcaatgtcccccaacnnnnnnnnnncggaagggggcgggggtgcggatgggggagcagcaggcatgacgtcgttgtggcaacggtcagtgcctgggggcggcacgccgctgtggtgatctcaatgtcccccaaccggctgggatgtgcgacccgtcagcgactctactctccaatgaacacatccaaccacccatgcatgcctggtccagggggccggaggcgaggatgctgctggccactcccgcatcctcgagaccggcctgctgttcttccgaatctccatcgccggcaaactggtaccaccgcgcgtagagctccagcagctcaaagtcttcggggacgaagagctcgccactgggctgcagcgtgacgactcggccattggtcaccacggcagagctgccgcgcggcagccgaagcccctccctggtggtgatgggcgcggggatgggggttgcttgagagccgtgcagccagccggatgcatgcagggcaggcagccctgaggctggtttgtctgcgatttggcccctcccaaaggtgcaattgcagctgccctgccatcaggggtggacccagccgcctcgcaggagtggcagcttttcagcaagctcatgatggcacccaggtccgagcatacgctgactgcccaacacacgcaccttgcaaagcgggagtgcgctgccgcaacctgatcggcatcgggaagctcggcccagctcaggccatgcgtgttctggatgtcactttctgacagggatcccagatccgtgtcgaggggcagtgcaagtatggactccagggcggcagccacatcgagcgctgcaggagcacaacgagtggaagatcagccagcaaggacgactcacaatccaatcatccacgcaggtccaggtctcccgctgaatccagggcctccagaactgaaaccaccacagcaccgggtgcccggccagacaggtgcgcactccagtcgccactcatacctggcacgggtttgtctgctcgggtgagcatggccagcagacccctttccaagggcgccagactgccttcgcccaaccccccagcactgttgagcaggagagcggtccgggagtgggagctctcatgctgcagcgcggccagcacgagcgagagcccctcctgcatcagtcatcaggggcgatcggccaggggtatgaagtggcttgcgacagatgcacagccgagctttgccagacgtccaaggtcccacgcccgaggcaagctctgctcacccatgcatactcacaaatccctggctccagcagcagatggcgctgtcagtgccgacactggacccactgccaaagatacagccggaccagaaacacagcacccctccaccgagcctcaccctnnnnnnnnnntcatgcatactcataaatccctggcttcagcagcagatggcgctgtcggtgccgacactgtacccactgccaaagaaacagccggaccaggcacacagcacccctccaccgagcctcaccctggtgagcacgtcggcgaccgcccagtggatgatggccggcgcgtccgtctccacgccatccccaaccttccagtaggccagccccgcggcgtggcgtgccgccgcgcccaggccaggccccgtcagcgccagctggcgcggcgcgctggggtccggcaccccctccagcccgccccccgcgccggtcccctgccggctggggaagatgcgggggttgatgcggggggctgcccccctcagctccagcagctcgtcctccaggtcgggcatgtcgtcggtcaggcggtgcaggtacacgtcctcctgcacctggcgcagctccatctgcagcgcctggccgaccagccgcgccaccggctcccccgcgcgcagcggcaccaccagcccgcagatgaccagcacgccgccggaggcctcgggcgaggcggccaggcctggggcacgggttgggggagggggagggggaatggtcgaagagcatgtcgccgcatgagcgtgtatgttcacccagtaccccgagcagccgccgccatgcgcgtccgagccagcccactgtcgggccgcgacagtgacgacatcccatcacaaactctgaccccgccccctctcctcaccggcgaggcccgtggagcgggccagggccacgccggcgcgcagcgtgcgcagcgtggcggcgtcgggctgatcgacataggcctccagcgcctgcgctgcggtccactgcagggcggggtgaggctcggcgtcctcggaggccttgtccacccacttcggccagtgtctcttgaacgcgagctggacctgcacagggggtggcgaagtttggaaggtgatatgcagggcgctcagccagggccagtggcggcccgagtgtggactgacggtgtgtctcactgtgcaaccgacatccctgcgtcaagctttctacctcgaacccccctcagcctcatacagactgagctctgttcaggttccagccctcccgcgggggcccaagtggtgcnnnnnnnnnnggcgtcaagctttctgcctcgaacccccctcagtctcatacagactgagctctgttcaggtcccagccctcccgcgggggcccaagtggtgcccgactgcactcgcaggacctcctcccacgcacaccaccgaccagatcccccacacgcaacaacccaatcccacctgcttccaggcggctgcctcgtcgccggactgaaagtcgactccagccaggcttgcgaggaaggcgagggcggggtcgggccccagggtggcgtgcacacccaggaacaggcgcgcgaccctggcccccgcttcgtccccggctccatttctgacgagcggcaccaggcccaggcgcaggggccagccctggagcagcaccacgcgcgcggcctcgcccaggtcggcggccgaatcgctggccggatcgaacagcaggacggcggtgagcaggttgcgccgcaggcccggcaggcgccccgagaaggagggcaccagcagcgactccaggcgcgctggccagcgtgcatagcgcgcgtcggactccaggtcgttcagccgggcgacggcgcgcccggaggccaggcgcagccggggcccggcctcagcgccgcgcggcgcgcctgcgccccgcgtggtgcgcgccagcag

SEQ ID NO: 38812 - DNA, 61 bp, Chlorella protothecoides
tgggttcgcaaccctcagcacactgaacgacaactgaattttgcaaacggataaagagcga

SEQ ID NO: 38813 - DNA, 73 bp, Chlorella protothecoides
cggccagcctgaggtgggtgggtgctgctgctgaggcctcgacattatatagaacgctgtagtcattcatcgc

SEQ ID NO: 38814 - DNA, 113 bp, Chlorella protothecoides
gtggcttgtgtcagtgatgattgtggcaacaattcttttgagcaggttgtgaatcctaccactggacccagcagaaaatgagccctgccccatggcctgcggtctctcggggc

SEQ ID NO: 38815 - DNA, 78 bp, Chlorella protothecoides
agcttgcagcatgccactccacccctccatcgcgttgtcgccaaggctatcacctgccgctgcacctcctctggttta

SEQ ID NO: 38816 - DNA, 165 bp, Chlorella protothecoides
tagcttctccctggcggccgagctctgctccaccaggtcctccactgcagggaaagtagtggttgagccatcaaccccagctgcccttctcccaggggctagccccccccggggctcccgcccctggtcacagggtagcactagtcccgggagcattctggggtc

SEQ ID NO: 38817 - DNA, 11027 bp, Chlorella protothecoides
  modified_base (693)..(702): a, c, t, g, unknown or other
  modified_base (1723)..(1732): a, c, t, g, unknown or other
  modified_base (4194)..(4203): a, c, t, g, unknown or other
  modified_base (6014)..(6023): a, c, t, g, unknown or other
  modified_base (6185)..(6277): a, c, t, g, unknown or other
  modified_base (6644)..(6653): a, c, t, g, unknown or other
  modified_base (6843)..(6852): a, c, t, g, unknown or other
  modified_base (7056)..(7065): a, c, t, g, unknown or other
  modified_base (9298)..(9307): a, c, t, g, unknown or other
cggcggcggcggctctaccatcgccgtggcgcgccccggacccccgcccaccgccgtggacggccaggcgccgggcgaggcggcgcgcctggcgctgatcctggccaccgccgagcggtgcggggagatggtggcgcagctggcgcgcgcggtggccaaccgcctggaacccccggaccttgccgcgggcctggaggcggagctggaggcaggcccgggcgcagacttcgccgcgctggtggccgcctgccacgcggcgctggtggcaggtgtggaggcgcggctggatgcggcgctggccgctgccgcgcgcctggactgggccgccatggacggcgcgggggaccagagcgaatacgtgggcacggcgcgcggcgcgctgctcgaggccggcgccgcgctggggccggtgctgccgcccaaccacctccgcttcttcgcggacaagctgctggccgccttcgcgcagcgcctggccgacaacgtcttccgcgcgcgacgctactcggagatgggcagccagcaggcgcgcctggacgtggaggtcatcaagcacgcttttgtcgacatggcgcgggaaggcgcgcttttctgttgcttttttatgtgtgtggtggtggtggggggggaggtgtctggaaattgttcttgaaggttattgcagggagccttgaaagcgtgagaatgtctggnnnnnnnnnngttttttatgtggggggtggtggttgggggggggttggtgaatattgttcttgaaggttattggagggagccttgaaagcgtgagaatgtctgggaggtgggggaggggaggggttccgtgggcacggcagctgcatgagcgtggaatgacgctgcaaagcgagacctgcacgggcgctcggttcgtggtgcagggccagccaggcagtgcgaagcaatgggctccttgagaggaaaatgtgaaaatcaccttgccgtcgcaacacactaccccctacctcccactgcaacaacaggagggatggaaagcgcggcgctggccgcctatgcccaggcggtgggcgtggagctgggcagggcgcagtccgtgctcaaggtggtgggcgcgccgcgcgaggccctggtggacaccttcttcgagctcatgcccgacgccttgccctcagagtttcagcgcatcgtggacctcaaggtttgcttgcaaggaggggtatgcattggagggtgggaggatggaggtggggtcagagggacgtgagggcgatgggaagcgctgcagacgcagcgtctgcggtgccatgcctcgagcctctgcacggcgggacgcgtgcatgtcgctgccgccatccctccgtgctgcgcacaccccccatccaacctcctccatctcaccgcagggtctgcgccgcaccgagctgcagtcggtgctggaggagttcaaccggcggctgggccgggcgcatttcccagcgccgacggaggaggccgccgcgtccgcctctgtccccgccgacaacgacggtgtcctgggcatcgcgcgccgcaccatcacctttggccagctgggcgctggcgagcgcggcgggggggccaccccgggccgaaccgcgcaggagatggccgcacgattcaagtgagtttaaatcatgcggggcgagggaaagggtcatgctctgcttagtcctcgtcagggaggggggccgttggatgtgcagcagggtcaaggcccccgccgcatccnnnnnnnnnngaatcatgcggggcgaggaaaagggtcatgctctgcttaatcctcgtcagggaagggggccgttgaatatgcagcagggtcaaggccaccgccgcatcccctggatctgtgggtacattttcgagtgcaggtcccctgccgctggcttgccgggttgtggaggtgtgaaagacatggtgtcctgagcatgacgagggatcctgattccccttcaaattccaccccccacccgccctgcatctgcaggttgaaccccaacgtgcaagcagccagggcgtcggctgccgcggcgtccgacagcatgcgtgagaccatgggcaggacgctgggggccatgaagagcctgcgcttcatgcagcgggaagggtgagaccggctgcctgtcagccgccgtgcaatccttggttgtatcatcactgcgtgcatcaggtcagaaaaggacccgcgcaagaagggttgacaatggaaagcctggtggccctgtctgcccaatgaagcgctcatatcggcgaggttctcgtcacgagggcatctgccagaaccaggccatcccggggttgaatgtgggagtcccaagggaatcgcgcgggaactccatgccgctacgtttgagttgggcagtcggctacgcgccaccctcccatgccgcatgaatgccagaccgcacacggctcggacctcatgcaggcctcgatcatgtctgtgccgacgaccgcgagcccggggtttgggacgctgggcactccagggggtctcagtccacctgtcatggaaggtgctggtcctggaaacgagcaggccacaggagccaccgctcctcaccgggagagcagcccaggcaggtcccaatgccattacaacatgttaatgacagttccagccccatgccgaggcattctcactttcgacgccttgctcccgtacaggcggggcgggtccccagaaggccttcatgtccgtgtggaaacgcttcatgaagagcaagggcctcgatgcatcggtgtgtatgtttcggcgtgccgggaccggcatcgaatgcacatccatgccctggtctttcccgcaccgtgtgggctcatgcatgtcaacaacgcggtcatggccggctcttgtccccataatcacacagcctgccatgttcaatcgaggggtcatggacgtgtacaagctcttcaggctcgtgatcgctcacggcggattccaaaaggtgtgcttagcgctaggggagttggcttgagggcatggcagcctgtccctgcctggccgtcatgatcttgagctcacccccctcgtcatcaccgcctgtgtggcaggtcagcgagggcaagctgtgggcgcgcatcgggcgagccttcaaccctccacagtgagtttgggtgaccgagctagtgctgggcctgtgatcggaaccctgctacagctctctcagccatggctgggttgcacttctcttttccccttctgcccctcaggtcgatgacagacctgagctaccaaaccaagaaggtctacatcagcaagttgtctgcctttgaggaggcttaccatgctggggaggtgagcgtcaacctggacgcagagccggagcctgatgtgcctgacgctgttccgcagcacagccagactcacaaggtatgtctgcaggcgagcagatgagggaggggtgcaggcgcatggtttggaaggatgtacacctgggaagggcagtcgatggagggtccagtcgcactgatctaccagggaggcctggcatgaagagcctatccgtcgtcgcaatccacgagcatgggaagagtagtcacagagggagagacatgacatctgcatctcgactggggcgccctcctgggtatcggacctatatcctttgcatgctctgggctgactctacccatctgcattgtttcctgttcgctcgaggtcacaagccaccctcttcctccccccctgaacattccccacagctgccatcccataaacggaaactgggggaatcatacatgactgggtactccgaggtcccggccgccaggcaggaactcatcggccgcaccatcagcgtgctgtggcacgctgaggggagccaccacgtggggaccgtggcgcagtaccacccagacctggtgagcgggtgctgaaggagattttcgttgatgcatgggtgcgccctggtctctgcccttgctctcccgccatgctttcctcctcacatcgtcacctcgcgggcgtcccctttccctgtcgtgcaggatcagtacacggtggtgtaccatggcggggaggtgcaccagacggacctcaaggcggtggagtgggtcctggtggacggccagaccgctgccacgtcgcacccacaggtgggacggggcgtgtgtggtggggtgcggggctggtcccttccactcatgggcgaggcaggtggtggggttacttggagcgatggtcggccagtcgtggcgagnnnnnnnnnntccacaggtgggacggggagtgtgtggtggggtgcgggcctggtcccttccactcatgggcgagtcaggtggtggggttatttggagcgatggtcggccagtcgtggcgagagttcactccggcctggaggggcacctgacggtagatgattcgagactctggctgatgccgccgtccccacagtcgcccccccccccctccgcaggacgcaactgcaaacggacgggaggatgccaacgacgccaccaccaaggtcggggggaagagggcgtcctgggtgcaagggtcgttgggagtgtccaccttcttgcagggaagggcagaaacactgtcatcctgaagcgaggctgccccaagaatccaccgcacagcgggtgcccagtgctcaaccccgtcgctcccggcgctctcctccctgtaggtgtacgcaagcagctcgggcctgcccggcttcgagatcttcacctcgctgcccgggatccggctggaggaggtgtgtgggggggagggggatgggcccacttcttgatagttattgtatgcctcacatcgaagcggcgggagtgcaccaggcagactctgtgacgtcatgtcggtcatgcatgacactgcaggtgggcatgtggggtcgcgggctggccgatcagctgtcccctcccacggcccccatgctgtgtgggccactgtgcagataccacagctaccagggccccactcaaccttttctcaccctccgacgctcgtccccctctcccgcacaggtgagcgttcgctgctggccagacggtaagctggtgatccagggcaagccctccacgccgggcgtccaggacatccgcgaggacctgcagctccccctgctggccggccagcgcctgctggcccactccgcgcaggccctcttcaccgacaccgggcggctgtacgtcaaggtggtgctggccccgcccaagacccccggaggggaggcgtccccgctgccgtcgggcacgcccgcgcagcaggtgccggcgcccagggcgccgctgggccaggcgtactgagtaacccctctcccctgcattctagcgttgcattgctgtacattggagaatgccctgacttgaaatgacacctgaaccatgccggtgcgtgctgtacaagccagcacaagccgagcatgacgagtagatttccaggcatgcggtcctcacgccagtccgatggtggcgccctgtcgtggaggcctggcgagggggggacaggaacccgacacctcactgcacgtcccagccccgatcgggcatggcacagatctcgactgccatgactgatcgtgtgagggctgggccaacgcagccgcgcgccatggcgatttgatgggcgagccgtagcggtccggaaccccaggcgctgcacggcatcgccgggcagagccccagaggggcatggggcgcaagccgggatcaagcgcacccagatctggggaatggcgtctcagggcctgcagtgctctgctgtacgtcgtggtcctggcccacatctggctagcccccttcaccaaggtggaggagtccttcaatgtccaggcaatgcacgacctctggaaccatggcgccgacctggaagcctatgaccaccacctgttccctggcgtggtgcccaggacctttctgggtgggtggagcggttgtttactgttgccagagagcagggacgccctgcctgtcacggcgtgctgtttgaattgctgtgcgctccagcctcagccactgacccatcgcaggtgccatgagtatcgtggccctggccagcccggccctgaccgcannnnnnnnnnttttctgggtgggtggagcggttgttcactattgccaaagagcagggacgccctgcctgtcacggcgtgctgtttgaattggtgtgcgccccagcctcagccactgacttatcgcaggtgccatgagtattgtggccctggccagcccggccctgaccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaaggctcatagaattgtatgatgaaggcacgcttggtgtccatactcagtcattagtgctatggggcgtatgctgcccactaggatgccaactgtggtcccttaaacgtccccggatgccagggagcgctgtctgtggcatccctgcattccatccagtccgcgctggctgtcaggtttgggcggctggcagctctgctcttctgcctgctcacaaccgtgcagtttcacacaccattctacgcgtcccgccccctgcccaacgtcttggcgtgtgtgctgaccaactggggcctggccgcatggctgggctctgcctctccggcgcgcgtcatcgggctctttgcggcagcagtggtggggnnnnnnnnnntgggcgtgccttcatcatacaatcctatgatccttcgcaccaaaccagaaggtggcccggatcccttagagctccacacgggcctcccgctctctgacgcaccaggcaagccctcacggcatacagctgccacagcagtggcgcctgtaggagccggagtgcggtcagggccgggctggccagggccacnnnnnnnnnntggattcttgtttgtttcaatggtgtacatggtccaccattcagcagaggtctctgttggcaggattcgacgctccctctaggagggcacgatagagtctcaagccctccagagtgcctttgtgtgaaattcatggtgctcatcaagggttgtgatcccctccacacccgccacaggtcatcttcaggtcggatgcggcgctgnnnnnnnnnngtctattggcaggatccgacgctccctcgggaaggcacgatagagtctcaagccctccagagtgcctttgtgtaaaattcatggtgctcatcaacgcttgcgatcccctccacacccaccccaggtcatcttcaggtcggatgcggcgctgctggccgcccccatcggctcgcacctgcttctctcaaagcaggtcacgttcccgcgggcagtctccttggccgccggcgcggcgctcgccagcctggcgctcaccgtcgcggtggattcgctgatgtggcgccgcctggtctggccagagggcgaagtgtttgccttcaacacctggcacaacaagtgcgcccggtttggtaggggggtctgctgccgagaccaggcatgggtgtggacaggaggtcacaggatatggcaccagtgccctgtatctagctatttgacccccttagctttcctcctcccctcctctacactcttacacaggagctctgagtggggaacgcagtcctggcactggtactgcaccagcgccctgcccagggccctgcacggcggcttccccctggccgcgctgggcgccacctgggaccggagggcgcgacccctcctggccgtgggtctggcctttgtgggcctgtactccttcctgccccacaaggaggtgggccggggaaaaggagccggcggcatcctaggggcttgcatggcgctgccatgtaccttgggaggctgcattcttggcttcctatccctggcaagcccagcccggacccacactcagcctttccccctccccctcccccatgcacaggcccgcttcctcttccctgccctgccgctgttcacggcgtgcgccgccgtggccctgcagcgcatcctgcacaatgcatggcacgcaaagcacgggtggcgcctcgccgccgcggggaccctggggatcttcctcgccggcgcaggcgttacggcactgacgacggccgtcagtcgagccaattatcccggcggggtggccatccggcggctgcacgagctgggcggcgggtccaagggcgcgggggctcacccgacgcgcgtgcacgtcgggacgctggcggccatgactggcgtctcaaggttcaccgagctgccggggggcgcttggatgtactccaaggtggacatgcaggaaggggatccgatggcatgcatggggcactctgaaggaaatgagatggaggtccatgtggggggcggggacatcaactcccaaaccatagcacacccagatacccgcctgatgacactcacggacaccatccccaggaggagggactgcctcccaaggcgctggcagggcgagggtacgactacctcctgacagaccaggcggtggtcgaggggtgcgttgcggtggaaagcgtgctgggctatgatcatctggagctggccaggccgctcctgctcacgaggctccccctgcgcattgcattggcagccaaggtttggattcagaaatgcacggctctgtgactctgacgacttatcatgaggggtaccaatgggtgaaggcgccagcatgtggtgtgatgtgctgctgcgcatgcggcccaagggactattagcgtcctaacctcaccccccgcgacagcattccctcggtgttcgcacctcccatcgtccctcccataccaaagaacgatgtgggcttgactgagactgacatcgggttgccgctgggacaagagtgacgagcgcggcggggctggtgggagccgctgtcgcaaggcgctggggtaggccctcccctttcggacgggttgcctgtgacgcctggtgtccttgatcagagtggtggcacccacactgacacccaatggatcccgacgccgtcgcagctccgctcccgagggagtcacctcccagagatgacgactcacccgacgctggagacaaggacgggaggaaacgcagacacaaggagaaacgatctcacaaacacaagagcaaggagaagaagagatcgagggagaagtccccggcactcccggagggaccctccgtaggggatggggaggatgatggggaggagggggagctccttccccatgcaagcccccttccaagcccgtctccactgaggtatgtccgtgctatgcctctcgctgcatgcgtgaggtcttgggtatgccgcaagctgtgcaacagtggctccctgctctcaccaagcccatctccaccccaggtcccccaagaagcnnnnnnnnnngtgtgcaacagtggttccctgcactcaccaagccccatctccaccccaggtcccccaagaagccccgctcgagaggtgtgtcacaggacctgcatcgccatgcagaaggcccaagctcccccctgtacccgcggtctccactgggagacaggtgaggtggctgaaaggcgtgatgaatccctcggggatatggctggaatctcctcaacaggttcatgcagtgtgagcttaagcctgaatcggttaatgcaaatggctatttctcatgtgcagggtgcggtccgccagtcgtggccgcgatgagcgacttgaggggtccaggaggaccccgcctcctgaccttcgtcgcgaggttgataagcgggatgctcacccagcgagaggcgccagccgcgacaggtactctcgcagggaggacagccgcgacaggtactctcgcagggaggacagccgcgacaggtaccctcgcagggaggacagccgcgacaggtaccctcgcagggaggacagccgcgataggtaccctcggatcgacaacagccgcgacacccgtcatgcccaggggctcgatagcagccgcgacggccgccgacggtcccctttgcccataaggcgcgacaatggcgccagccgggactcctgggcctcgtcgcggggtgccagggccggcggcggcgcgtacagggagccagggccccgccaacggagccggactcccgagcgcaacggcgcgcggccctggtcccagggcagcccgcgcatggggggcgacaggcggcgcagcaggagcccgccgcatcggccaagggacaaggtgggagctgaggccgggctctagaaggtttttggggaggaagtgactggctggggggcacgactacttcccctgggcaagtccaggcaaagcgctgtgtattttgggctggcatgctccggcacctcgcccaacctctccccttctccgagttgggaaccactgcctctaacacaagcaggagcaggaggcggacgccgaggaggaggcccgtatcgcggcccagctgagtgtggccatgggcggtgcggggcccgaggaggacgaggagcagcgcctgattgaagagcggcggcggcggagggccgagatcctggcgcgccaccgggcgcagggcgcgggcggcgcggtggcggcggagcgtcccccaaacgacgcggcgatgcgatcagtggagcagccggcggcagacgtggcacggcagcctgcggaccggcctatggcagacgcagcgccgcagtcagctggcgccgaaccagagcgcgccccccgcccccggcccgcagccgcggacccctctgacgacgaggaggcggtgctggggagcatcatgaaggagggcgacgacctcgtcctgttccgcagcgacgaggacggggatgcacgacctgacgacagcaagctggtgagcaggggcatgcgcggtctgcaacactggtggcggcaacagcgggtggctacgtttcatgcaggcttacacggccccactcaccctgcagcctcccacccgtaatcctccccacatccttgttgcaggcccgccccgcctccgcctccggcatcggggaggcccacgacgccgagctggaaaggaggctcagcgcccacgaggtggccgccggcgcgcagctggccggcatgcgcgcgggccccggcaatggcgcccccgccgcgccgccgcccgcc

SEQ ID NO: 38818 - DNA, 61 bp, Chlorella protothecoides
ggcgagtgagtcggtgttggttcgtggctgggcaagcagggagcctgaccgagcacaggca

SEQ ID NO: 38819 - DNA, 113 bp, Chlorella protothecoides
agctagatttattgtcctaggggatctgaaggaatacaactcaaagtaacgctttaaaggccgtattctgtacaggtttgggatcgcgttgcacctcttacggagcaagcccc

SEQ ID NO: 38820 - DNA, 75 bp, Chlorella protothecoides
tgtgacgaatgtggtggagccaccatggctttacaagcgcccgttgggctggagcatacaggcagagtcttgggt

SEQ ID NO: 38821 - DNA, 109 bp, Chlorella protothecoides
gcgtgcacggcatgctggggacgattctgtgccaggcaatggcttcagggccgcggagggggtgcgcggggctgccaacggcttggatcgcctgcagtgagctccggac

SEQ ID NO: 38822 - DNA, 145 bp, Chlorella protothecoides
ggtgagcagctagacggggacggcgggattttggtatgggggcactgtgacagctacttctgagtccggtactggggtagacctgagctcgggcacacctcacggccgtcacctagcgctccctccctcaagccacgtcccaccc

SEQ ID NO: 38823 - DNA, 8326 bp, Chlorella protothecoides
  modified_base (249)..(383): a, c, t, g, unknown or other
  modified_base (470)..(479): a, c, t, g, unknown or other
  modified_base (686)..(695): a, c, t, g, unknown or other
  modified_base (1397)..(1406): a, c, t, g, unknown or other
  modified_base (1602)..(1611): a, c, t, g, unknown or other
  modified_base (1747)..(1823): a, c, t, g, unknown or other
  modified_base (1993)..(2002): a, c, t, g, unknown or other
  modified_base (2254)..(2263): a, c, t, g, unknown or other
  modified_base (6585)..(6594): a, c, t, g, unknown or other
  modified_base (7153)..(7162): a, c, t, g, unknown or other
  modified_base (7702)..(7711): a, c, t, g, unknown or other
aacccccccccccccccccccccccccaccgctcaccccttcccccggcaacgcattccgggcagagccactcgccgtcccccagagacttgctggtctcccccaggcagcgcatgtggtaggtggcggggcagccgtcgcagcagatcaggttgccccccagcccgcacaagacgcaggtgtcggtgttgtggtccagtgccccggcgacctgtggcgggggggggggggggggggcccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaatgtcaggtttgaagcaggggatttagatgcagatgcacccgctcctcccactatgcagatgctcgacagcagtggcacgcctnnnnnnnnnncgaatgttgggtttgaagcagggaattcaggtgcagatgcacccgctcctcccaccatgcagatgctcgacagcagtggcacgcctgccctcaagaagaagaggaaggaagccaggggcagggcagggcgtgcagccctgcccgaacaattccccactccagaacccttggccagcctctggtccccttcctccccctgctcgccannnnnnnnnnagaaggaggccaggggcagggcagggcgtgcagccctccccgaatgattccccactccagaacccttggccagtctctggtccccttcctccccctgctcgccacccccccccaaagccaccctccgcctctcaccgtatggtgatgcagtccagcaggctgttggccagcgactccagaatcttcaccttcaccctgagcgggagcacgtagtactcggggcagtgccgcgggcgggccgggcccctaccgtggaagacggcccgcgcgccgagggcgccgcggccgcccttggtctccgtcccctccgccgtcgcttggccacctcgccctgtcctttccagccggtgggcccactccctgcgtgccagcgggctgccggacaggcgcagccagtcccagaggtacagcggccaggtcagcgcgtccaggaactgggggtccagcgcgcgctgcgcacgctccgcggccgtctcgtcaatcatcagcgcgcgcagcatgctgacgtggacctcgtccaccagatggctggcggcctccgccgccagcgccgcgcagtaggcggccagggggaagggggccaggcgcagctgccaggagaaggcgcgcagcgtctggtatgaggccgccagcgaccctgttgtttggggaagagagggggtgggccaaaagagggcgggtgggaatggatcaggaggctcnnnnnnnnnncggggaagggagggggtgggccaaaggagggcgggcggtgggccgaaggagggcgggtggtgggctggaggagggcgggtgggaatggatcaggaggctcaggattccagactacaaacacaggggatggcaccatgctgttccaagggacccatccgacaccgggcccacccacccaggaggtcggtggggatgnnnnnnnnnncggcaccatgctgttcaaagggacgcatccgacaccagcccacccacccaggaggtcggtggggatgtccaggcgttcgtcggagtcggccagggccacgccgaaggaatcggggagtgcggcctcggcgggcggnnnnnnnnnnnnnnnnnnnnnnnnnnnnnnnnnnnnnnnnnnnnnnnnnnnnnnnnnnnnnnnnnnnnnnnnnnnnntgaagccgtctgcgggcgagcaagcagtgtggtgtacgaaagggtcactttgtgtcagggaggaagaatcagctctttggcagtccctctcatccaagggccttccacagacagcaacagtctgtaccatcgggctcatagtcaagcgacagaccccttgctgggtacannnnnnnnnnatggcagtccctcccgtccaagggccttccacagacagcaacattctgtaccaacgggctcacagtcaagcgacagaccccttgctgggtacagaatttgcctggcaagccccccggtgcctcgacacaagacccagccccaccacaccccacgctcaccaacacggctgtagaaagaaagaccgaggtcctctccatcctccccctgactctccagctcctcgtactcctcctcgtactccacctcctccnnnnnnnnnncccatcctccccctgacactccagctcttcgtactcctcctcgtactccacctcctcctcctcctcctcctccagctccgagtcgctgtcaggctcgctggggtcgctctccgaggacgtgtcggagttgggcctcagcctcttccgtgcctggatggaccgcttccgcgctgacccgcgcaggcgcctcaggtcaaactgcagtggcaaaggaacaggcagggagtctggaacaagctaaggctggatggtccgccggcttgcgcatatggtggtacactggccggcaactcgaatctgtaagccgcagtgatgcgacatctgatgccaggggtagccaatctgattcccctcagcttccctggccaccacctgctggtaggctggggtcaccgcagcctttcaccacaccatctctcacctttactgcagtggcggcgcggccagacacgagtggccccgcgcctcctcctcgggagaggcggctgggagcggagacggcaccctgcgcgcccctccccctccccctgccccgcccgcggcctctctccctccctctccccctccccctgccccgcccacggccacggccgggacggagggggatcgcatcctgagatggcgtggccgggctcgcagggcgctccgcgaggcgccgagggcgaccctgcgggcagatggatcagctttctgacgaagggtcaaggtgaggaggggccggcaggtcggcagggagtgtcctgaactcatcactcacccgtgggcctgccatttcaaatgcagtcagagatgacaggcgcctgcaagtataccagggtgttgccctgctgggaagaatgcacgagatggggtgcgcatgacgaacagtcagtcatatgtgcggaatggtcgaggatcatgcagcaaggactcacctcaagtgttatgcagatcccgcgcggtccgtcgccatgaaacccgcaggttagctggctcaggaggtccgggcaacgacaaccagccccgcgagtatgcaccaggctcaaggacccctctccttcttgagcctttaattattaattcaaattgggtagattgatgctgcagtgtgtaccaggaactcctagaaggatgcaatggatgggccagagagagggagccgggaaggcgtcacaccagcgaaggacgctcggggatgcagggaggcctgcgcgggcaaaaactgtacggataaaacatatttgagatgtgccggcgagatacagttattgggcgccggtgtgtgggcggggaagggagatcacgccatgccattctcccgacgggcgcctttgggggaggtgctgccttgcgcaatcgggcaatgaacagctgcaggttatttttggagcgtttcacggtttctctgcctggcttcctgtcggctccgtggctagtgatcagaaggactcacatcaagggtcctcttggaatcgttgcagcctgttttcagtccaggacagggcagtcaggcacgagccaagccctgcagccccggccggggcatcaggctagggcatgaaagtcatccagggagatgagcttgatgcggtcttgccgccgcaccacctccctctcctcttgcgtgttgtagccccagtccacaaggtacaggttccagtgggcaagctgcggcatggctgccacctgttcgaaaaggggcagaggaaatgatggtcatatagtatatgaaaaattgctgcttcgtcaatgtccagtgtgatacagaatcacacagctacttgcttttcagtgtcatgtttaagaccagcatatgacacccatggcacacccgccctctgaggcggggcctggccacctcagtccccaatcacctcatcctcccaccacccggcctctcgtctacccccctccttccctcccctctgccaccgcgtgccttgtgtagggtcagcgccttgtcctctacaaagtggtactgggtgccggggtgcctctcctccagaaggtgcaggatctccgacttgggcgcacccgtctcggcctgggagaagatgcgctccgggggcaggtccacgcctgccaggcggtgcaggatggcctccgcgaagcgcgcctgcttggtggtcacaatgtaggcctcgtggtcggccaccagccgccgcaccgcctcagcgacgccggggtagatgtcgttcatgtcgatccaggcggccagatcctcctgcatcatctggtcacgcatgcctccaaaggcagcgagcagctgaggtgtttggggggagggaaggggggaaattgtagagaggagaataccatgggacatggaggggtgttgtcacttgctcatcagggtgcagagcccaccccccgagccttaagatcttgcacctcggagcggtccaggccccagagctgcatgtgctctccgagcagtttatgccagtctttgaggatggcctgggggtcgactcctgccagcaggcaccgcaccagcacaaggttctcgtacctgcatgcagaagcatgcaaggctgtcaggcacggtgccgctgaagctgtgaggaagagagcctgagtgccgtccgaccgcctggggaaaaggggcaagttctaggctagaatccattgtccctctcacccggtctccacgacggggcgcacgaccttgagctggtcgatgatctcctctcgcctggccaccacctctggcctggcaaacatctctggccagtactgcgcagaggcctgtggatcccaagcagggtggcaggaatggagttcaatttacaggtttaaacgaagacaacatgttgcacgaccacttgtgaagttccgcatctccccctccgccgtgcactccctcctcactcaccttccatgcagctatggccgactctcccaccgagtcacagaccacaccgtcgaaatccagggcccaaacctggcgctgcgcctgagcctgcaagcgtggcatttcccttggtgcacggtgcactctgcacagagtaacgcgcaggctggtcctgtggggtgcgagttgttgggtgcggaccctcagcagcatataccacactgagtaggtgcccaatgccgtatctcggcgccgccagcgcgcgtttgctttggtttataaatatatccacgcgaccaacgtttgtggcagttccagggcatgtgcgggttgctcctggcgcatgagggggggggtgggggtatcgtggatctcgcgcccgggacatggagtccatgtgctggtatcggcgatggtctgcagtgcagctcccccatgtcaccgtaccaaagatttgaggcacacaaactcctgagcgtccactcgtgacgagtcattctccccggggcagccttgaggctaggactgtaatgggcagccagcccatcacccaccagcccatgcattaccgtcgaagttgataaaggcattattcgtggcgataggagggtcaatatcggtcaagatgtgagtcgacactgtccctcctgctgaccactttagttcgaacatgaccgcaacgtcaccgtcggcctcgcgctgggccctgcatcgagccccttcctccccccacaagccctgcaggtgtcgtctcatggcgttttatgggatcgaccccatcctggttgcggacgtggtcctctggcctgcccgctccatcatcaaggtctgagctcgagagggagggggggttatgagtcatgcagtcccgcacagcaccctggagacgtgcttgggccccagcacgcccttctcatcggaccagtgcccctgagtaaagcccatacctcctcttcaacctcgcagcaatcttacgacgcacgggagcgcaagaacgacagcaatctgccccaccacctggggtacggcaacctcaatggcgacggcttcggcatcggctggttctccacctcgctgagtcagcgccccgactccgccaacccctgcgtcttcacctccatcacccctgcctggaacaacgagaacctcaaccgcctggccaccaagatcgagagccggctcgtgtttgcgcacgtgcgcgccgcctacccgggcatgcccgtgtcggagcagaactgccaccccttccagtggggccgcttcctcttcatgcacaacggcgtggtggcggggttcatgcaggtgcggcgccacctgctggccctcctctccgacgccgcctataacgcggtgcagtcctttcactccgactccgcggtctggtgagcggtggcctgggagcatatggggagaagtgatgggaacgggatgggcatggagctaccggggtggctgaatcctaggcacgcagggagctgcagtgagtgcnnnnnnnnnnaccagggagaagtgatgggaacgggatgggcgtggagctaccggggtggctgaaccctaggcacgcagggagctgcagtgagtgctgctgaggcaatcggcaggaagtcgctcgtgctgcgcctgcacggccgccggggttggcatggctgcgcaccgaccacccagtcccacgggccgacgcacccacggcccccccccacctcccctgtgtcccccctcagcttcgcgctcttcctgaaccagctgccggacatgcatgctgcccccaaccctgtggtcatgctcaaggcgttggaggtgggctgggatggtgcagagatgggattgggaccgtcatcccggaggggcaccgtgatgactcacctttcaatcagcacgttatcgacgcctctcccctcgacgggccccgacctttgccaaagacgtcgtcccggaaccacaccccagctcgccttgccctgtgttctgggcagaagacccttggccgatccccggaagaaggcccagacccctcctcaaacacccgccggcccacccacaggacaccatctccatcnnnnnnnnnngggccctgtgttctgggcagaagaccctcggccgaccctcggaagaaggcccagatcccacctcaaacacccaccggcccacccacaggacaccatctccatcatccaggagacgcagagccagcacggcatcgccggcaactcgctgctcaacttttgtgtgtcagacggcgccacgctggtggccacgcgctacacctccagccccgacgaggagcctgcctcgctgtactacgccgagggctgcagctacgaccgcagcaaggagggggtggaggagtcgggcatcgcctcggccgccgccgccgcctccgacccgggcgggcagcgcgacagcggcacggccaacgccagctccaaggccgttgcgggtgggcgaatgggacacttccaagaatgacagggggcaaggggacaagatctgggaggcggcagttgatcagtcctcgcgttgtacccgctgggacgcaggaatgcccatccctgcactcaggctcatcccattccggctccccactccacttccgtccactgctcgtnnnnnnnnnnaggaggcggcagttgatcagtcctcgcgtggtacccgctgggacgcaggaatgcttatccctgcactcaggctcatcccattccgactccccactccacttccgtccactgctcgtcccttgcactcacactccatgcccccccaagtcaatcgcacccatctgactcctgcctcaacccctgccccttacccaccccaggcgagggcgactaccacctgacctactcggagctgggctcgcgcgtttgcctgatcgcatcggagccagtcacctccagcgggtcggactgggtggaggtgccgcgcaacactgcgttggtggtctgccgcgagaccagtggcgtgctgtgcgtcatgcgctcgccgctggtggccggcgcggagaacccgcgccgcgcggaggtgtaccgctgcctggaggcggtgacgctggccgccggggtcaagccgggcgcgcgagagccggtgcgcgcgcctcgcgtgggtgaggggcacgaggctgtgcgcgccagcgccgcctcgctcagccgctggcccagcgaggcgacggggctggggagcgggggcgaggcgggcggcccggcctccgcgccctcggaggacgaggcggggtc

SEQ ID NO: 38824 - DNA, 1083 bp, Chlorella protothecoides
  modified_base (119)..(128): a, c, t, g, unknown or other
  modified_base (216)..(225): a, c, t, g, unknown or other
  modified_base (660)..(669): a, c, t, g, unknown or other
  modified_base (969)..(978): a, c, t, g, unknown or other
cgtgccgatcttcgcatggctcgccgacagatcgagcacatgcagatctacccccaaactcagcacccccctctttttggtcatccccaggaggcggcgcggctgcggcaggagctggnnnnnnnnnnttgggggtacggttgcatcgtggggccttgcaggcagaggggtgcgtggacgttatccgtgccgatcttcgcatggctcgccgacagnnnnnnnnnnctgggggtacggttgcatcgtggggcctcgcaggcagaggtgtgcgtggacgtcattcgtgccgatcttcgcatggctcgccgacagatggagcatttgcagatctacccccaaactcagcaaccccccctttttggtcatcccaaggaggcggcgcggctgcggcaggagctggcggcgcgggacgccgagctggcggcggtcaaggagagcgatgcattggcgtacacacagcacgccgccaagctggcctctctgcagaaggccatgaacgaatacgtgaggcggcgggcgggggaaagggaggagggggagtggagaagaacggatgggttgagtgacgcacgtaggtcgctatccaaggttgatcagaattcccaggaatgccggcggggcgacaatacatacctggcacccatccatgagatcctcccnnnnnnnnnnccgcacgtaggtcgctattcaaggttgatcagaattcctaggaatgccggcggggcaacaacatatacctggcacccatccatgagatcctccctgccctgcacaccctcgtctccgcccagcacccccgttttccccctttccaggccgccacggcggtgtgtgaggcggaggagcgcgccgcggacgcggagactcgcctgtcgcggcaggaggaggagctgcgcgaggcggcagagggcgccgaccacctctccggccgggtcgtggcgctcggcggccgcgtggccaagctggagnnnnnnnnnngctcgcctgtcacggcaggaggaggagctgcgcgaggcggcggagggtgccgaccacctctccggccgcgtcgttgcgctcggcggccgcgtggccaagctggag

SEQ ID NO: 38825 - DNA, 61 bp, Chlorella protothecoides
cgggccggcatcgaggccatccgcaaggacaccagcctgtacgactcctatgcacgtcagt

SEQ ID NO: 38826 - DNA, 104 bp, Chlorella protothecoides
aggctgcacatgtaccaatgatgagttcagtgagcgctgccttgacggtgggggaaccctcatgctgcatcactctcctctggccacccaccaaaagccctctc

SEQ ID NO: 38827 - DNA, 106 bp, Chlorella protothecoides
gccacctggcatggtctagccacccatgttcaccctcaaaaaacacacacgcgctgcaatgccccctgaccaacacccttgcaggcccaggagaaggccatgtacg

SEQ ID NO: 38828 - DNA, 100 bp, Chlorella protothecoides
gtgctccaccgcccagcgcgcgttgtcgctagcagccgacagtgagtcggtgacgctgtgcgcggcgccagccacgcggtcggccacggcctgcgccgcg

SEQ ID NO: 38829 - DNA, 61 bp, Chlorella protothecoides
acagcggggtggcaaaaggtcagccagggcatacttgcacgcgtgcatgcggaattcgaag

SEQ ID NO: 38830 - DNA, 77 bp, Chlorella protothecoides
tggctgcactgtggtctcgtgtcacgctgaacccgcaagccgttcaaccctttcttcccccacgctgtcccccccag

SEQ ID NO: 38831 - DNA, 8853 bp, Chlorella protothecoides
  modified_base (574)..(583): a, c, t, g, unknown or other
  modified_base (1524)..(1533): a, c, t, g, unknown or other
  modified_base (2101)..(2110): a, c, t, g, unknown or other
  modified_base (2169)..(2178): a, c, t, g, unknown or other
  modified_base (3485)..(3494): a, c, t, g, unknown or other
  modified_base (3887)..(3896): a, c, t, g, unknown or other
  modified_base (3987)..(4110): a, c, t, g, unknown or other
  modified_base (4932)..(4941): a, c, t, g, unknown or other
  modified_base (5054)..(5063): a, c, t, g, unknown or other
  modified_base (5225)..(5326): a, c, t, g, unknown or other
  modified_base (5415)..(5424): a, c, t, g, unknown or other
  modified_base (6210)..(6219): a, c, t, g, unknown or other
  modified_base (7063)..(7072): a, c, t, g, unknown or other
  modified_base (7314)..(7323): a, c, t, g, unknown or other
  modified_base (7892)..(7901): a, c, t, g, unknown or other
  modified_base (8080)..(8089): a, c, t, g, unknown or other
  modified_base (8365)..(8374): a, c, t, g, unknown or other
agcgctggcgcgcggcccgcgccaggcggcgagggcgacccgcccagcgccagcgcggcgccctgcccgctcgcgctgccaaaggtcaggctcggttccgagtcgatggcttccagttcgcccgcgccgccgtcggggctggccgcgcggtccagcagcgccagcgaggcgccggagccctccctgcccatgccggcctcggccggcatggggccggggccccgcccacccccgaagctcaggctggaaagcaaggaagcacctaggcgtgaggcagcagagctcatgtcctccccaaactcctggatgccgatgtgcagccgcttgctccctcggaagagcggcacgtacagggctcggcccggcgcgccctccagcccaaatgccagcggttccagcctgaagaagaggcaatggtggttggttgacaaggggtggacgggttcaacatgtgaagggtccagatcacaccacagatcagagaatcatcagcttcctgctcggccggctcatgagggcccgatgcgggccacttattccccttctcctggtcacgctttgccatcatccacannnnnnnnnnaatgcgggccagttactcccttctctcctggtcacgctttgccatcatccacaaggatacacgtgctcgtcgtcacctgtggcccacggggtcgtaggggtggtataagttgaacaaacgccggaccctgggcaagccgtcccatgtgtgtggctgcccgggggccgagcactggatgtccccggcagccagggagcccaggccccgcccctcctcggggtttatgccacgcatggccaggaagacggggagcggggagcctgtgtgtggggggggtagggagcaacgcgtgtgtcatgggacgtgcgatcgtggggcaaggaggcgcagtgcagggaactccgtgagggcgcgagtcgctctccccaccaaaccgaagaccgagagaccccctcgcccacccaagaggataaggcagtcgacgtcgaataggagggccgggaccgccactgccgtgccggcgccgtctgagccctgctggtgctgcttggagagcagggcgtgcaggcgcgccacctctttgcgcagcctgtggtggtgggaagtgggctgctgctggaatggccccacccattgtcatgggatggcgagaggcgatggaagatctctgcaagtctgcagacaacccactgcatacggtgccgtgtccagcacccgacgcactcttcaatctctgtggtggggctgggaggagtcagcaggcacgattctggcccgggggctcctgcggccgccgcttggttgcaaaggacatcgtaggagagtacgctgcccagggagtgtgccatgatggacaccttgccctgcaaggcacaggcagatgttgagctcactggcggcgcaagcatggccccttctggctccacacaagcctttcagcacccacaacagcccacagccacagtgccttcccacagtcacctcaccttgaagcccgggtnnnnnnnnnngtcactggcggcgcatgcatggccccgtctggcgccacacaggcctttcagcacccacaaaaccccacagccacagtgcctccccacagtcacctcaccttgaagcccgggttgcggtctcggaagcgggtgatctgggcgttgagggcgcggacgagggctgccaccatctgatcccggtatcctggtgtcagaaagaggaggacctccaccactgtggcgtgaagcacctgggcgaggaacgcggggcgggcgatgggcctgtcatgccaggatggcaaaaccgacagcctaagggttgcttttctcccggatcgtgctgaaatggctggccggcaacaggctgcttgaccacaggggcccctatgtcctgcctgcccgccctcggtcccagctcaacagaaggaggcacggccatcgcaccatagatgggtcgcttcccgacaaaccctcccactcaagcgcctcctcctggccccccttcctccttcccgcctgcccacctggcgcagggcggcaaggccggggggaatgagtcccctggccacctcatcgacgcgcaggtccnnnnnnnnnnccgacagcccgggggttgcttttctcctggatcgtgctgaaatggctggccggcaacannnnnnnnnntgcctgcccacctggcgcagggcggcaagaccgggggggatgagccccctggccacctcatcgacgcgcaggtccaggatgcgtcgccactgcaccggcaggacctccacgcgccccgcgacgcccacggggtagaggtccgcctcagcctcccgcacgatgctccggaaggtggaggtgtcctgtgaaagagaggagggatgatggggcgctggggtgtctgcaagtacgacagggtccgggcgatggagtggccactcgacgccgagtgacacccactcccacccagcctccagacagggctcccacccaccgtcgagatgctggcggaggagagggtctggccgatcccgtgcaccgccaggatgaggtgagagacaggggtggatgaggcggccgcgtccgctgcctccgccttaaggtccgcctccttttccaagatgccctgattttgtgccgggaggggatgagggtcggcctcggcaggcgaggagcctgggagatcagggagcagaccctcccccagggcactggcgggcagggtgcgcatgggagtcagcccgccgactgcctggctgctggactgctgcgccacccacgggcccggccccctccttgccgccaccctcaccctggcctgggtggggggcacgtagccgcgcctgagccgcatgcgcccttcgctgcccagcctcttggtgatccaggccatggtgccggaggggcacaggtacatctcccccggggcggcgtacagggcatggagccccctgtccacgcgggtgttgagttccagcttcccacctgcgcgcaggtgtgatggcgacggcgagtgccttacttgcgtcaaggggggtccttcccacccacggctcgcggccggggcaccagccaggcccagagcgcgaggccacccacccttcagagtctcctctgctgcaccagcccgggtgggatggccgccgctgacggggaccggtgaggacccgtgcttcccgctcatgcgtccgggcagccagagctgctggcggtacccctcctccagctgctccgccagcgattcctgcgagggtgcgtctcgtgatgatcatgcagtggcttgagggggggggagcaccatggtgacttcaggagggctttcgcccattccctcaggcctcatccaagcctcgggaaggattcaagagcccgccagccccccaaaccttgagcggcacccagtcgcccggcgccttctccgcaaaccaggtgccgcgcagcactcgatggcgtggcgcgggaaaataggaagacgactggaggcgggnnnnnnnnnntggacctccgacaggcctcccctcacaaggacagggttgagctggtcccccgcccagacgccctgctcatccaggtatgcctgtgtgggaagttggtaacaagtgtggtgagagaagacatgagcagagccagaagatgtgtttgtccaggactctctgcaaggcacagcattgcttggcgcgcagcatcaccgcctcgccttccagtcctgctctgtggcgatgccagagtccttgtcgcccttttgcagggctgcctcctcctcccaccaagcccggtccagggcctcagcatgtgccctaaggaggggttgcaacaagcattgcacgctgatcaccacgcagtacttgacatgtacaagtactccccattcagcacgtcgcacacgaacnnnnnnnnnnatggtgagagaagacacgagcagagccagtagatgtgtatgtccaggactctctgcaagtcacagcattgcttggcgcgcagcatcaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggttgcaacaagctttgcacgctgatgaccacgcagtacttgacaggtacaaatactccccattcagcacgtcgcacacgaacctgtacgctcgctcgagagccagggagtccagatcgttgtaccggagcacgctgccgcggtgcacgacctcggggatgctggccagacctgcacatggtgggaagcaggtcagcgatgcttacatgaactgagacgaacccaaaccataacctcttgcactcactgctggggctgtagtcggcgcgatgggaataccagcggacttgagccggctccagctcccgaaactggtgccccagcatctggtccacgaccagctggctctgcgccatgatcaggcatgcatcagcgcgatgattggcagaaataagtttgaggtgaaactggcgacccgaaaaattccgagcattgaatcgaaggtaagtcgcacaagcgcgcacaagagactacaagtgatcagatcacaagttgagatctggcgctcgagatttggaccttttacaccgcagtcaagtcttacgtccttcagcgcgcatgtgtcattataaccaagtagcacgtcataattaatgttatgtcaagcaagaggcatgccactggatgccgactagctcggtaacttggtccgtattccagctggtggccgggcaagaatggcgaagccccccggcatctcccaggatgactgggactggtgcaggagactgccaaaggtggagctgcacgcccatttgaacggatgcgccagggatagcacgctgaggtgggcatggttattagtgtgactgcgcagcnnnnnnnnnnaggaaaatgtggccttacaggtgcactctctgcacccccactcgcacgaacaccaaccgccccgtccctcccaggggggcccccaccccccctggaggcctgctttgcccagnnnnnnnnnntgacattcctgcagggctggcgcaaggatgaaatcacgtctcgctcaaaatcttcatcccagggagcttgccaccacaagcggagttccctacaccccggcatttgatgtcctgtccccagagggcggtgggtactgaatgtaccttgcgggtgttgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggtgaggagttgtctgaactgctttaaacgccttggttgtactggggagttgcgaccttgcattcatgccagctgcttgggaaagnnnnnnnnnncaaggtgaggaggtgtctgaactgctttaaaagccttagttgtactggggagttgcggccttgcattcatgccagctgcttgggaaagatgttggaaagggtgatgagacaggcaaggcccagcgcactattgtaggtcagtgggcttcttggggaccctttggggcccctccagcacaaggcaatggcagggatgtcgatttgcagagtttaaagtcgagggtccttcctgacaggtttgggggaatcatgctctatcagaacttccactctctgtcatctgcaggacaggcctgaggctggcatgggcatggagtcatatactcgggctgtgctggaaggcatggcgcggtatcgaggggatctgggcaacgccagtggcgctgttgagggcgacccctcctctgccctgcaggcaagcctgatcctgagcatcgacaggcggcatggcgcggcgtccgcctcgcgagttgtggacctcgcgattcgcctgcggcgggagggtcacccggtggtaggcatcgacctgagcggcaaccccagcctgggccggtgggaggcctggtccccagcgcttgatgcagcccgccgcgctggcctcagggtcaccctgcacgccgccgaggtgggggggggcagggtggccggcgggttgggcgtggctggaggtttctactcgccagggcgccaaggaatgtgcatagcccgcccattggccctgcggtccctcctcatgaacccaacccccaagccttccaggtgtggaacccagaggagactcgggcnnnnnnnnnntgctggaggtttccactcgccagggcgccgaggaatgtgcatggcccgcccatcggccctgcggtccctcctcatgaattcaaacccccaagcctcccaggtgtggaacccagaggagactcgggccatgctggaatggacaccagaccgcctggggcacatgtgctgcctggacgctgagctggagggcctgctggtcaggtgaggatggcatgggtccatgggctcgtgaggggcagggggctgcgcctggtttcatgtgtaaaccccgggctcgagttgcagaggctgtgatcctgcggcggagcgcttcccttctccagcccgccaaccccatgccctgcctgcccgccaaaccaacacaaaattcaggtcccacattcccctggagctgtgcctcaccagcaacgtcgtgacccgcagcgtgcccagcgtggcagatcaccactttggctcgctgcaccgtgccagccaccccatagccctctgcaccgacgactgggccgtgttcaggacgagtctcagccgggaggtggctctggccatggcaggctttggtctcagtcggaggcaggtcaagggcctgatgctcgacgcgacacgcgcggccttcctgggagaccaggagcgcgcagacctggaggccagatttcagggcctgctggatgccctcccggactgaacggcaccggtagtggtcaacaacctggactgcaccatgaaaatgtcccttgttgccacagcgagcaaggacactacatgatatttgatgcaggacatcgcgggcctatcgacacacttgtcactgagctctatgtctgaatgtagcggcatagtccagcannnnnnnnnntatcgcgggcctgtcgacacactcgtcactgagctatatgtctgaatgtagcggcatagtccagcaggtctggttgcagggatgggtttcagtgaagggccatacagtcctgcaggccgtcttacacacggtcggccagcacccgcagatggtgctcttccctcaaagccgtgggtcaggatgatcccccgggggcctgccaggcttcacattcatgcaatcttgggcaggtctgcctcttnnnnnnnnnnacccccccaagccgtgggtcaggatgatccctcgagggcctgccaggcttcttgttcatgcaatcttgggcaggtctgcctcttgtctattttacatgtttgctcatctgaaactgatccatgtcccttttcatctgcttggttgtgttggtggcatccagggaggaatgatgagacccacgggtcagcctcaagcagagtcggtccttgtcctgatggtgctaccctgacgggtcaccgttccacccttccacctgtacccttgcactgcccagcccacgccccccggcgcattctatgcaacccaattcttacactgcattcgggtgcttggatgtaacagtccaaacttggatcggatgcggcattccacgttgtggggtctcgccaggccccactacagaactgctaacagcgcttgagtggcctgcgttgcattcatctacttaggatacctcatcaccccccacctctccttcccggacgcgatctaacctcgcctctccaagggggaccaggccctttacaccctcctacaccctcctccaggctttgttctagggcatgcnnnnnnnnnncaacctcgcctctccaaggggacccaggcccttcacaccctcctaccccctcctccaggctttgttctagggcatgctccattgggatggaatcctgtcggtacctcagcatggtggtattgctgcatttagatattgattctcatgttgctcagtctccccaaaccaggccggatacnnnnnnnnnnccctgtcagtacctcagcatggtggtattgctgcaatcagatcttgattctcatgctgctcagtctccccaaaccaggccggatactactgtaatccttgtaatgaacaccaggtaattattatggccacagaggccctgctggtccagacgaccaaagacggggtcaatacctgttggcatcaccttttcagcgagactctgcacagaagcaaggagctgacaggtccagactgaaacccgattgggaagccatcaggttctgcgtttgcaaagnnnnnnnnnntcagcgagactctgcatgcacagaagcaaggagcagacaggtcccgactgaaacccgattggggaagccatcaggttctgcgtttgcaaagcatgcagcaccctttcagaatagtgtcgcaatgtttgggcagcactgcggcgttacagacgaagcgggcattgagtgctggatcagaatgggaatcaaacagtggtttaatcaaaggagggggttggggcaggggggcacgattgcaacggtgggcaaacaggggtgtacggaaccagggtgggtcggcacatcacaccacgagcaggagcaccgcagcaagggcggtggtggccgcggcgagcgcggccgaggtggcggccgcgccggaggcgggcgcctccgccgtcgtgctgacgggcgcttgcagcggagagggggagggggtggccactggagccaggatggggctgggggacgccttggggctgggggaggcggccttgggg

SEQ ID NO: 38832 - DNA, 61 bp, Chlorella protothecoides
ttccttccggcctgcatattaccggcttggtgcggcgctgaagcggatgctacctgcaaag

SEQ ID NO: 38833 - DNA, 80 bp, Chlorella protothecoides
cctgtcatggccggccagctcctaccccagcgaggtggctgcatgaaacgtaggctgtgtcttcctcagccaagcatttc

SEQ ID NO: 38834 - DNA, 189 bp, Chlorella protothecoides
tcctggcggagctgggcacatccggtgggtcccgcgccgggtggatggagagtgggcctgggaggatggtggctgcgcacaggttctgtggcccctggcggcatgccccacctgtgcgtttcgcgggtcgtggaacacggtgaccccccgcttcacgctgcaggctccctggatgggcagcagcgactg

SEQ ID NO: 38835 - DNA, 61 bp, Chlorella protothecoides
ctgccagggctgcatgcgctccagcctgaaaagaggaggaggttgggagatgggggaaggg

SEQ ID NO: 38836 - DNA, 423 bp, Chlorella protothecoides
gcgcgaggcggtgccggcctcgccgctgggcacgagggccggcacggggacccagcccgcggcgctggcgctgctggccacgctgcaggagcaggcggcggcgggcgaggcggagctgctggcgcgcctgcgcgagcaggcgtccgagctggcgtcctcacgcgcacgcgaggcggcgctggccgcccaggtggaggcgcaggctgacaccatccgcgagaacggggagctggtggaggaggggcgccagcgcgtgctgcaggtgctggacagcctgagccgcgaggggcaggcgctggagtcgcagcgcgcggcgcaggccgtggagctggagggcctgcgcgccgcgcacgccgcggcgcaggccgagctggaggcccagcgcgccacgaacgagcgcctggccgccgaggcggcggctct

SEQ ID NO: 38837 - DNA, 68 bp, Chlorella protothecoides
cttggcttccgcttccccaccggtcacctgaacagctcaccccttaagactccaatatagacccaacc

SEQ ID NO: 38838 - DNA, 61 bp, Chlorella protothecoides
cagcgcgctgtcgtacgcgcgcgcggcctcttcctcgctgtcgaacagctcgcggtaggcc

SEQ ID NO: 38839 - DNA, 64 bp, Chlorella protothecoides
gcacggcgacgcggcgcagaccaacttccctgctgccgagtacccgcgcgacgagctgcgcgcc

SEQ ID NO: 38840 - DNA, 67 bp, Chlorella protothecoides
tgctggcgctgcccgatgatggcaggcccaagtacctcctggatctgggttgcggctcgggactgag

SEQ ID NO: 38841 - DNA, 61 bp, Chlorella protothecoides
gaactcctttgatgaacaggatgtcacgtttgcgtgttcgtccaccgcggtgaacatcttg

SEQ ID NO: 38842 - DNA, 61 bp, Chlorella protothecoides
tgcgtgcccctctagagcctctggcctcttagcctgcatcctgcaccgatgtggtgcgatt

SEQ ID NO: 38843 - DNA, 72 bp, Chlorella protothecoides
ctgtgccgcctggaaccaggcccgacgaggttccccccccaatgaccccctcctcccctcccttcccttccc

SEQ ID NO: 38844 - DNA, 589 bp, Chlorella protothecoides
  modified_base (324)..(518): a, c, t, g, unknown or other
ctcggcgctggggggggaggggccgggggaagcgcagcaggcccggggggggagcactttcttgggcctactggacgctgagctagcagaggaggaggatgtttcgactggtggtgagttgatttttacgtcgtgacttctccaagggggggtatgactggggttgaagtaggtctctggtatatgtttaaagcatgtaggaacagcaatgtgacagagatacccagctctcccttgcgagcgccacccgatcctaggaagatcaggccttggcccccatcccaacacctttcgattctcctccgccctggcaggctccacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggccccccgcagcgggccctcatatctcgcatggggcgcggtcagcgggccccttccccctaccaccag

SEQ ID NO: 38845 - DNA, 10956 bp, Chlorella protothecoides
  modified_base (305)..(314): a, c, t, g, unknown or other
  modified_base (1568)..(1577): a, c, t, g, unknown or other
  modified_base (2090)..(2099): a, c, t, g, unknown or other
  modified_base (3871)..(3880): a, c, t, g, unknown or other
  modified_base (4349)..(4358): a, c, t, g, unknown or other
  modified_base (5868)..(5877): a, c, t, g, unknown or other
  modified_base (6541)..(6550): a, c, t, g, unknown or other
  modified_base (7009)..(7018): a, c, t, g, unknown or other
  modified_base (7538)..(7547): a, c, t, g, unknown or other
  modified_base (8673)..(8682): a, c, t, g, unknown or other
  modified_base (8951)..(8960): a, c, t, g, unknown or other
  modified_base (9144)..(9153): a, c, t, g, unknown or other
  modified_base (9580)..(9589): a, c, t, g, unknown or other
  modified_base (9658)..(9701): a, c, t, g, unknown or other
  modified_base (10021)..(10030): a, c, t, g, unknown or other
ctccagccccgccgtctgggccgagcataatgcggtgcgccggcgccacccgctctacccctccgtcacgctgggtgagctgggagtgggggtggggggtgggggggtgcacgggcgtatgggtggggctcttgcatgaataccttgctggctgacgcaggtttggctcaccattggagcgtcggtacactgctcagcgagacattcctcctccgctgcgatgccaccaccccgggcccagctcaccccctaacctcccaccccacgcaaaacaaaaccaacagcgctgctgacggaggtggtgnnnnnnnnnncccagctcaccccctaaccccccatcccccgcgaaacgaaaccaacagcgctgctgacggaggtggtgaactcgcgcctgttcaccacggtgcgcgacacgttgggcctgacctacgacgtctccttcgagctggccggcttcgaccgcctgcccgcgggctggttccacgtcgccgtcacctccacccctggcaagatcggggaggcagccatggccagcctgcgcgtgctgcgcacgctgcgcacccagcccatcagcgggcgcgagctgcagcgcgcgcagcgcacgctggccgcgcggcacgagactgacctcaaggacaacggctactggctggggctgatggccaacctgcaggccccgggcgtccccctgaagaccctggactgtctgcgcgacctgcgcgccatgtacgacaccgccaccgtcgacgacctgtacgacatgcaccagaaggcgagctttggttgcatgggatggagtgggggcatggagaggagtgagagggtgagggggggtgggagggccaggtaaacctgtctccaagcctggccggccattgcgcagggcggctcgagccagggcggtgcctcgcggtacagtgcccatgctgacgagcggctccaatcccccatcacacctgtacaaggttccaaactcctgccacaaaaccctcacctttacttgatgcttaacatcccacagttcaactttgacgacgatgccatcttctcctgcatcggggtgagcgggcgggaggccggcgcggtcaaggatcacccactcctggcggcgctgccggcgcagcgggaggacggcgcgggcgaggccgtggtggacgtcaaggacgcagacgccttcttctcggcggtcaaagtgttcatgcagcagatggggtctgctgggccggggggcccgcccaagccctgacgcggctgccgggtcgcggctgcactgattttccgaccccctgtaaactgctgcggcccgtgtcgtttgtcgggaagaggggcagagcggaggggtcagagccttggcttgtcagtgcgatacttgtgtcgggttgccaggtgcacactcaagctctcacagtataagaagatgtcctctgtctagcaaaataccagaggcatgctcttcccaggcaatccgctgggccggcaggctcgcaggatggcactgcccccctggagatgtgactgtactgcacgacactgagcataggaccagccttacaacaatcggagcgatnnnnnnnnnnagggcaggctcgcaggatggcaccggccccctggagatgtgactgtactgcacaacactgagcgtaggaccagccttacaacaatcggagcgatggcatgatatgggatgggtcaagtctgggttcgcaaagaggagcatgaggggtggtcggtgcagcgcgtcaaacgttttcgggggagggggcgcgggcaagaggccctccggtggtctggaaggtctccagtggccgaggcgggatccagaccatagtagcgccgaatggtaggtccaagcccaagattgccccgggttgcgggtgccggcagggatgtagggtatcgcagggaacagtttgggggggcgaggaatgggactgcgggggttggctgcgggcagcgccccgcatagcatcgcctgcccatggcccctcacatggccccccccacgaccaccctctcttccactgccctctcagcgcacggtcagaccgcggaggagacagtgttgcggtgcatgcccgggtactgcgttnnnnnnnnnnacccctcacatggctccccccacgaccacctctcttccactgccctctcagcgcgcggtcagaccgcggaggagacggtgttgcggtgcatgcccgggtactgcgttggcgtgccgggcgcctgctgcgcgacaaaggggttgctggggtccgcgccgcctgacacgggggtgttcatggaggatctgggcgaggcggcggccggcgccttgccgtgtgcacgcgccgcgcccgaaaggctgggccccgcggccacggccacctcggggatgggcaccgcctccacctgcttgctgacggaggccagcgcggcgcccagcgtgccctgcgccgcgcccaggtgcaccttgacgtaggccgcgtcgcggatgagccccaccagccgcgtgtgcagctcctcctcgaacttggcaaactccgccagcgcggcgttcagtttgtcggtcttgtgctgcagcgtgcgcaccacatcgtccagccgcgcctcctgcttggcgtcggtggcgcgctggagcttggcgcgcgccgccgcctccttcaccgtcaggtcggccacagtgcggcgccgggagtccacctccagccgcaggttctccagctcccggttcttggacaccagcgtgtcatacagactcagccactgagccaggggggccaccacgtcggcatccacgcgcgcgcccgcgtcgcggatggtgcgcaccaccgactcggtgtccagggcgccgccgaccagcacgctgtggctggcgctgggcgagctggggtcctcgtacacatgcggcaggttgctgcccagcaggcgggcgatcagggtgacgctgttctgcagaggggttcagatgtggaggggggtgggtgtggggtgttgagagggaggggatgtgcgaggggggtgggggaaattgggacaccaacatggggactgctggacgggggagcttgctgaccagaagcccatggaaccctgctccctggattgggggcacgagacacaggcgagcctcgagggacacctaggcatacactgacgatatgcggcgttcactcggcccggccacctcgatgcgtcgccgtacctcgttgctctcgcgctgcgccttgatggcctgcacgacccccttgagctgcgcggccagctcgcccgcctccttcagcatgatcgtattcctgcgggaaaggggatgcacggtcaggaggctgagcccggcgctgtgcggactgcgcatccgcacgcgtcgaggggggggcagcgaggtgacccttgtggctgtgtggaatgccccctccgctggcccccaccggagcccgacacgcccattaccttgcattgggcgttgggctgagaccgcccgacaccagtggggcgtgctgcttgagaccctccgtgaatcggcgccaacctgcccccatggcagcggaatgctgggagacagagggaggtaggggacccgggaagctacaattgatataacagggcagcgagcaataattcacacaggaccggctgctgggcgctgtcgagttcagggagtcgaggagtcaatgtcgctgtccgttgcgtgggcagcagcaggcagcgcgggagctacatcgttgattgttgggatgtttcccaaaggctgacggcaggaacaagcagtccattacgtgacccactagtatgtactgacggagaaccaaattttacagcaggagtatgtcatgggcgaggcatgtattatgaagcaggacgggatggactcccagtctcatgcatggcaggggtcatnnnnnnnnnngatgtcgctgtccgttgcgtgggcagcagtaggcagcgcgggagctacatcattgattgctgggatgtttcccataggctgacggcaggaacaagcaatccaatacgtgacccactagtatgtactaacggagaaccaaattttacagcagaagtatgtcatgggcgaggcatgtactatgaagcaggacgggatgcactcccagtctcatgcatggcaggggtcattccacctgctgggtcagggcacacaagtgtcagggcaaaagctttcgatctgaaggaagggcctcacacgtcttcaacagccttcttgggagggggtcgggtggtggagggggtgcattattatgccggcgattggaccgccgcctggtacctctaggcgggaatgttgagggacagacccttcacgccctgcgagacatactcctcctgtcccgtgtggcgcaccgcctcctcggtgccgnnnnnnnnnntgtcttccacagccttcttgagaggggtcgggtggtggagggggtgcattattatgccggcgattgggccgccgcctggtgcctctaggcggggatgttgagggacagacccttcacaccctgcgagacatactcctcctgccccgtgtggcgcaccgcctcctcggtgccgcccgggatgcagtccagcaccctggcacccgcggactcgggcgcagcctcgcggcccgagtgctcatgcctcaccggcccctccacgccagggatgtgggacagcgcctgcgcccccgtgtggtcgggcgtggtcacgtgggaaccgccggacagcgcctcgcacccgtcgccgtgctgcttgccctcgccaaagaagcgcggcgcggcaccgccggccgcgtagttgccggccgcgtagctgccctcggtgccctcgctggtgccgccgacggcgtagccggaggactcgcccgccgacagcccaccctcctcggtcaggtggcccagcggctccacgccggcgccggcggagcgcggcgtgttgtcgtcggcggaacccaccacggcgggtgcgggcacggtgccggccaccgccggcgccggggagctctccacggcggcggcggggggcgtgatggggacatcgcccacagagcctgacaccagctgggccagattgaccaggccctcgcccaggatgcgcagcgcgttggccgcgtagttgcgcaggtgcaccgtgtcctggatcagggcggtgagctcagcgtgcagcgaggcctcagcctcgttgaaccgcgccgccgtcgcgttcagcttgtcggtcttgtgcttgagcagggcggtggcctcctccagcgccgccgtgtgcttggcgtcctggtttcgctgcactgcggcctgcttggaggcctccttgactgtcaggtcagccaccgtgcggcggcgggagtccacctccaggcgcaccgcctccacctccttcttctgcgcgtgcaggcgggtgaaggcgtccagccaggcctgcagcggcagcagcacctcgttctggacggagctcagcgtcgcctgctctgcgccggtgatgcgctcgatctccaggtcggcggcgatgggcgtggcctcgctgctgggcaccagcgtggtcagcgcctcggtcttcaccaggtgcccgccgggggtggagggggtggaaggggagccgggaggtgagggagggggggcgtgcgcgatctcgtggtaaacgcgcgggatgttggagcgcagcgcctccgtggtggtcttcagcagggactgcgggggtgggcagtgttgggggctgggtgggtgaggtgaacggtggggtgatgagggtgtggagggatgaagttcaaacgcgcgtgtggaccacgagaaccagaagcagtagaaaggaggcatgtatgaagtgctgccgcaatcccctgatcatgagctgatgatcgtatgcgtgttcaccctgggcattcggatgagatcctcggatacatgcttagccggnnnnnnnnnntgggggtgggcagtgttgggggctgggtgagtggggtggatggtggggtgacgcgggtgtggagggatgaagttcagacgcgcttgtggaccacgagaaccagcagcagcagaaaagaggcatgtgtgaagtgctgccgcaatcccctgatcatgagctgatgacttgtatgtgtgttcacccttggcattcagatgagatcctcggatacatgcttagccggcacgcacgcacctcgtgagcggccgtcacggcgttgatcttcgcgataagatgcttcacgtgggactcgaagccggcggcctcgtccagcatggccttgttcctgtgtcgagatttgcagcggttaggatgagcatggccgactggaacacggaggggcgaagggccggtaccatctgcccgtcaaatctccaaaccttcccatctaacttccaagcctgacacattgtccctgcaccggtacaccatgcctcgaactcccttttacctgtcattggaggttggggagagggtcgacccgatgacggtcgtctgcttgatcgtctcggtgaagcgcctccagccggtgcccatgatgaaagagttttgactcgagttgctagcgcgacggtgacgggtttgtgctcgaggatttgtgctgcgatgacggtgtatgaatgannnnnnnnnnactcgagttgctagtgcgacggtgacgggtttgtgctcgaaaatttgtgctgcgatgacggtgtatgaatgatgtgacagcgtccgcgcatagagtacgaacaatatgtcggcgtctggaagcaatttcttgatctgtgcacacctaccctgaagcttccctaccagtcgctgtgtccccccggacgggttccgcgcagcttccttgagcccattcaccttcctatcgaccaggaatttgaatgtgctggacccctatcctcttgaagtgacgggttcacggtgcagttcttgcagtcagagtcatttgcgtttgtctgttcgatggaggttgccagcgcgatccgtcactctgtggtggggctggacgccctcctctgcagcatggtccgcccggactccagggtgccgcgcgtcagcgctgcagggatgcaaggatgctgcctgatgagtggtgggnnnnnnnnnnagttgcctgcaatggcccagtgaagcatgcagggcaggcgcatgtgggtgcagggaaggtctttgctccgcctcaccaccgagaaccccatcacaagccaaccaacctgtcagccgggagacgaagcttccgccccgcgcgctcagctcctccttggtggtgccgcccgcgctcggcgagcaggctgcgtcctgccggccgtcagcatcgccatttgctcgacctggcagggatgatgaggttagagatggggatcaggatgacacatcgcaggtagaatgagcatgctgaggtcgaggcaagttgctgcaatggcatggtgcggcagcacgcaggcgacccttccattgccaggaccgggcgcggtgccctgggccctagctccacaacactgcatctcctcccccccttccctcctcatccccgtgaactcagcaacaaagaacaccctccccacgctctcacccacaccgcacacacccgccctgtgcgtctcccgggcggcgaactcgtgatccannnnnnnnnnggaacaccctccccacgctcccacccgcaccgcacacacccgccctgcgcgtctcccgggcggcgaactcgtgatccacctcccgctggttcctctcgcggtagcgccgtatcctgtccatgggcagcccgcccacgctctcgaacgcgtcgtgcatgaggcggtcgcggtcgtgcgcatcggccgccgcgtcgcgcatggcgcgcagcagcgcccccgcgtcctcggcggccagcagcgccggctcggcgccgcgcatcagcgccagggccacgcggaagaggaccttgggcccctcgcagagcagcgcgtcccagacgcgggccgccgcctcggcgggcagcgcggtgcagaagaggcagaggaaccagtcggtggccaggatggacatgtcgcagcgcagcgccgccaggtggtcgtgcagggcgggcagcttcgtggccaccagcgcgtgcaggctgcgcatctccacgtgcgtcccgctcaggtcgcgcgcatacatgtcctggtacaggatgcctgttgtgttgttgttgttgggaggggcagggagggtggtgagtggccaggggaacgaggggtggatggtagggcacggacgacactgcaccggatgcaccattcgctccttcccttcccaccccctaaggtaccagctcaccctgcctgccgtcgatgaggctggccagcacccagaaggccgcctcctggtcgcactccagggccagcagcaacaaagcggcgatgtagttcatgccctggcagtaccccacctcgggcgagtgcatggcaaaggcacagagcacgcgcgtcagcgccgcctgaccctgctgcccctgcacccagccgttctgggggaaggtgcgcggggcgtccagctcgatctggtgcacccagggcgactcgtgccgccccagctccgccatgcccgcgtagtaggaggggtggcgcgccgcgcgccgcgcgcgggcaccgctcacctcgccccacacccaggggcgcagggaaggcgggaccccgcgccggcacagccgcttcagcgcctcgtccgctggcagggggccgccgcgagggtgggcggcccagctggcctcaacctcggccgcggcctgggtgcagcgcgccnnnnnnnnnnaccgccgcgagggtgagaggcccagctggcctccacctcggccgcggcctgggtgcagcgcgccagcgcgtcgatgtgggcctccgtcaggctgatggcgaagccgtagacgtcggaggaggtcacgcgcggctcgccgggagaggggcccagcgtcgcgtcggtgagagactccacggaacgcatgcggcggtgcaccttgcgcggcatggccagctgggggggatatgttttatggtgtgggggccgttttttttgggggggggggnnnnnnnnnnccgcgaagctattgccactgcgagcacctggttccaccacatccctggccccacaacgcgcaacactgtacactgtgaggcagttggtggccgagatacattcaaatcagacccatggccgtggcccactaaccgacacgtcggacatggttcccatgaacacgtatcacacaaccttgccacnnnnnnnnnntaggtgtgtcaccacgaagctattgcccactgtgagcgcctggttccgctacatccctggccccacaacgcacaacactgtacactgtgaggcagtttgtggccgagatacattcacatcagacccagggccgtggcccactaaacgacacgtcggacatggttccatgaacacgtatcacacaaccttgccacccaccaggcgtttgccgagccccatggtcgtgccgccgggagactcaggttccgccatcatcataccaggaaaacgactgccttcatttcatcgcgacctccagcgggcgcagacgagcagggcatcggggctgggtgatacgcaggaacgcggtggtggtgtctcgggcctctcccctgctgtgttggcacagcgcccactcgtggtgggtagatgcgtgattcagaagggnnnnnnnnnnaggagactcaggctccgccatcatcataccaggaaattgactgccttcatttcatcgcgacctccagcnnnnnnnnnnnnnnnnnnnnnnnnnnnnnnnnnnnnnnnnnnnncacgccaatccgccgaggtcggtctggggacctgcggtggttgcgggggttcacagtgcggtaccaggcgcgaacctcttcccgggcgcggtgaggaggtccaacgcgtggcaagccagtcaaccaatagacatcgcgccgggtgcatgcaccctcagcatctctactcatcttgaagttgctcagtctacctgttgtgagcgcaggcgtggctgtggagcctggagtccccggaaggcttgtgcccacgaggatcccccctgcttaacccccgcgccctcctcgaacacccgcccggcatgttcaagaagctgtttggnnnnnnnnnngggcgtggctgtggagcctggagtcccgggaaggcttgtgcccacgaggatccccccctgcttaacccctgcgccctcctcgaactcccgcccggcatgttcaagaagctgtttgggaacccacgaaatggcagcggtcccactgttagcacgacgaccaccaccaagacggtggatgccatccagaaactgtcggaggtgcggcatggtggtgctgggaccccgcatgccagcccggcgcgggcgccccctgcgggcatggtttgcctgcaggctcgaggcatcgaagtacttctccaggatatcccacggatgaggctcccccgtcagctcctcaatcaacactccccccaccccacacccacacccagacggaggacctgctgatcaagcggcaggatgtgcttgaccgcaagatcgccatggagctggagcgcgccaaggagatgacacgggccaagaacaagcgcggcgcgctcatggcactgaagaagaagaagatgtacgagcagcagctggagcagctgctgaaccaggtgcagcgcatcgcggagcagaagtcgatgctggagaaccagcgcgcggtggtggagacggtggacgcgctgcggtcgggggccacagcctccaagcatgtgatgacggagatgaagatcggggacgtggacaaggtgctggactccatcaacgagcagacggaggacatgcgcgccatccaggacgcgctggggcagcccatcggcgccgccgccgacctggacgaggacgagctgctgggcgagctggaggagctggaggcctccgagctggacgaccagctgctgcagcccgcgcccgtgcccacaacgcgcgtcccgcaggccgcagcggcgcaggccgcacgcgtggggcccgcagccgccgcgagggtgagttgtgtgtatgtg

SEQ ID NO: 38846 - DNA, 133 bp, Chlorella protothecoides
tgtggtttgaggtgaagcatcgtactgttcccccacaagggggcctgtgggacgccctcttccgctggacagcccccccacccctctcgaaggcctcccccctcctccccaccccggcccctgaccttgacgt

SEQ ID NO: 38847 - DNA, 61 bp, Chlorella protothecoides
ctctggcatctggcaccttcaagcgtgtttattggagcgggagcctgcgggagcgggagcc

SEQ ID NO: 38848 - DNA, 61 bp, Chlorella protothecoides
tgaaggccgcggactcggcgcgcgcggtggccgccctgcgcgcccgcttccaggaggccat

SEQ ID NO: 38849 - DNA, 75 bp, Chlorella protothecoides
cgcatacttctctcaggttgcaccagatcgtatgggctctaatctttcacccagctgccatccatcatttgcatg

SEQ ID NO: 38850 - DNA, 78 bp, Chlorella protothecoides
gtgctggccatcgttctgggtgacgccatttgtctttgctccaaccccgcggccccactgtcatcaagtcaacctcaa

SEQ ID NO: 38851 - DNA, 78 bp, Chlorella protothecoides
aagtcaacctcaatcccccgatcgcacctcaccaagcattgtgctagggcgatgccgctgctgcagtgggtcacgtcc

SEQ ID NO: 38852 - DNA, 104 bp, Chlorella protothecoides
gccccccgcccgacaccgtgcgccgggcgcaatgccacagtacatggaggaaagtaatgctgaaagaatagtcggggtgcggtccaccccctcacccgctgacg

SEQ ID NO: 38853 - DNA, 108 bp, Chlorella protothecoides
ccgggcacgcgcttcagccgcctgcggctccagctggggtcggcgggcggcgagcaggacggcggcgattcgtgtggcggagttggcggtggcagcggggcaggggcc

SEQ ID NO: 38854 - DNA, 61 bp, Chlorella protothecoides
gtccatcctctccatcatgtctatcagctccaggggagttggatactgccccagggattgt

SEQ ID NO: 38855 - DNA, 80 bp, Chlorella protothecoides
atgccctctgagcaggcaacgagagccagcgggcccctctgtcaataatcgcgcccgccacctcaccacctgggtgccat

SEQ ID NO: 38856 - DNA, 98 bp, Chlorella protothecoides
caggcctgccaacctggcctgccctgccccggcccctgtatgtgcaccagccttccgggagctctccagggtggtacacccgcccgcagcgtgctctt

SEQ ID NO: 38857 - DNA, 71 bp, Chlorella protothecoides
actgatggagggacccgcagctgttctggtatccttgacagtctggagcactcccaaggtctttgcaaccc

SEQ ID NO: 38858 - DNA, 92 bp, Chlorella protothecoides
gtggtgcggggtcctgaaacgagaaagggcggggtctgatgcttgtaggcaaccatgccatccccggggctgctgctgagacctttgagtac

SEQ ID NO: 38859 - DNA, 61 bp, Chlorella protothecoides
cggcccgcccccagtccatcctcactcccagctgcccccttctcgtcccacccgcacagga

SEQ ID NO: 38860 - DNA, 61 bp, Chlorella protothecoides
ttccgagtcggatcacccctattcattcctcgtaacccaagcatccaggagtgtcatctga

SEQ ID NO: 38861 - DNA, 79 bp, Chlorella protothecoides
gcagggtgcaccagagtgtacgccctcgttccgtccgtgcatggcccaggctccttcgctggcacgccccgcccgcaag

SEQ ID NO: 38862 - DNA, 116 bp, Chlorella protothecoides
cgaccccatgaaccacccgagccgcaccctcggtgccgcaaaagtccgcgtcattctccaataatggtgggaggagggtgatggcagaggcggtggcacgagagggggctgctgcc

SEQ ID NO: 38863 - DNA, 81 bp, Chlorella protothecoides
ttccttgccagcgtcggcgccggcaggctctgcgcccccggcctcgcccttcagggccagggtctgcaccagggcggcgcc

SEQ ID NO: 38864 - DNA, 130 bp, Chlorella protothecoides
gctaggcctgcatgagctggcttatgaccagagcctcacgactcgagaccgcgcaagatcgatgttcagaggggcccccttgtgcagagaatctaaccacccccatattcccaggcagtggagctccccc

SEQ ID NO: 38865 - DNA, 86 bp, Chlorella protothecoides
ccatggccccccatacatctttcgccatcttccccctcctccaccccctacacaaccacccccctccctctttccccctcaccaga

SEQ ID NO: 38866 - DNA, 9041 bp, Chlorella protothecoides
  modified_base (477)..(486): a, c, t, g, unknown or other
  modified_base (628)..(637): a, c, t, g, unknown or other
  modified_base (941)..(950): a, c, t, g, unknown or other
  modified_base (1743)..(1932): a, c, t, g, unknown or other
  modified_base (2683)..(2692): a, c, t, g, unknown or other
  modified_base (2891)..(2900): a, c, t, g, unknown or other
  modified_base (3539)..(3548): a, c, t, g, unknown or other
  modified_base (5532)..(5541): a, c, t, g, unknown or other
  modified_base (7370)..(7379): a, c, t, g, unknown or other
  modified_base (8167)..(8176): a, c, t, g, unknown or other
  modified_base (8588)..(8597): a, c, t, g, unknown or other
cctgcttggcaaacggcgccttggcctgggaagaaaggaggttgggccacatggagccctcaaaacaccaagagcttccgttcgacgggcacacacttgattcccgtcggaagaggacaggaccagtacccaagcttgcccccccccccaatgacaaagtccctcgtacattccttggcatgtcgagtctgctcccaaccccctagacatcccagcccctccccaacaagcttcccaacccacaccgtacccacccctggcctgcttcaggtcctccggcaccggcccaaactccccggtggcgcggttgtaggtgccgatgcactcaaaggacgacacggacagctcgctgcccggggggcccacggtgcacggcccctggacgtcgaccacctccacctccacctcctcggaggaagcatacacctgtgggagcgggaaaggggcggttgtttgagggcagtgtgcagcggctgnnnnnnnnnnggcatacacctgtgggagcgagtaagggacggttgtttgagggcagtgtgcagcggctggagtcgaaactggccagattctaggccgtttccacacacgagcccctgccagcgcgccatgcagggcccccatcccagctcannnnnnnnnngggggaacaacaaatggagggagtgcgctggcagggtgacatgcacgacccgagattacctgcggcagcacccccagacctgcaccacggcatgccggtctgcaggcctcttgtgcatgccctcccgccgagccagtcatcatccatgccctggtgtccctccacaacagcaggctctttgaattcgcctctcacagatcctcccccatggccgagaatcacctccttcccccccatcctcccccccagcaagagtaagtcaccttgtggaatcgggagttggagaggtactccggcagctgcnnnnnnnnnntggggaacaacaagtggagggagtgccctggcagagtgacatgcacgacccgagactacctttggcagcacccccagacctgcacgacggcatgccagtctgcaggcctcttgtgcatgccctcccaccgagccagtcctcatccatgccctggcacccctccacagcagcaggctctttgaattcgcctcttacaaatcctcccccatggccgagaaacacctcctccccccccatcctcccccccagcaagaggaagtcaccttgtggaagcgggagttggagaggtactccggcagctgcacgatgctgcgcgcgccctccacggcgtcaaacacctccggccccaggaagaggaagtcgccggggaggtagcgcacgccatccttgcggaagcccttgccctgcacctgcaccccggtctcggggatctgagggtcgggcaggcggctgccgagctggaggtcggcgggggcgtcgcggaatatgccctcctccggcacgtactgccgcctccagaagtgggtgaggggcgcgccctccgccgccgcggcggcgttggcctggcgcagctcctcgtcggcgcggaagtattcgccgcggcgcttctggtcccaggcgcgctcgagccggctggccgacaccagcgccgccacgctggccagcggcctggtggggggggggtgttgaggagtgggtggggacaagtgaggttgttgcccaaaggggtgctgcgagagacggcgactaggaaggggggatctcaggggtggtgcgtcgtggtggccagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagctcggcggtggaagcggcgtcgcccagcaccgtctcgtgtccgcgcacgagcaggcggacctgcacctccgcgtcgccgcccttccctcctttgcgctgccacagcgcctgcaccaggcccagctggggcaggcggggcgcggcgtcctgcccttcgtccccggacgccgcctcgtcctcgtcgacgggcgggcccagcgccacggcgtcacccaggcgcagctccaggtcgcccacgcgcgcgctggggtagaaggtgcacccgccctccgtgcgcagggcctcgccggtccaggcgacgacggcggcggcgggggccgcgcgtcgcgcgtgggcgccgccggccatcttcgcgacggccacggggaccgcgggcacggccgccagcgcgctctcctgcgcgtcctcctcgccctcgtctgcattctcgtcctcctccacctcccgcgccaccacccccgcctgggcctgctgctcgccggcctccacctcgccggcctcggccaccagcgcgcccgcgccggccacggtgaagtagctctgccacaccgccctcaccatggtggtggccgtggcggtcatgggcttggaccggccccccgccgcgcggtcctgtgagatgggggggggagggggtggtctgggagatccggcacgaggcggcgccagaggcggggaactgagcgacgggtgggcgtcgctgtgcaggatgctgttgccctcgggatgattcgacgcatgccttgnnnnnnnnnngtctgggaggtccggcacgagccggcgccagaggcggggaagcgagcgacgggtgggcgtcgcggtgcaggatgcttctgccctcgggatgattcgacgcatgccttggcggcccacaccaggacagccacacgcacgcacacacacaccccacccttccccccgcccaccttcatggggttgcggttgacggccgcgnnnnnnnnnnacacacaccccacccctcctcccgccaaccttcatggggttgcggttgacggccgcgcccgaccgcgccggcttggccgccgcacggtatagcttgctgtggcgcacgtcctgcatgcgcgcgcgcagcgtggtggcaaaggcgctcttgcgcaccgccgccacgggccaggccgcaaactggttgagcaggatggcgccgtgcaccagcaggtagcgctccacagcctcgggcttcttgaacagcgccagcgcggtgtccggcgaggccaccaggcgcttgaccacgtcgttgaaggagagcttggaggcgcggctctcctcgctcagccaggtcagcacgcgcgccgccaggcgcgcggtctgcagcaccggacggaaccagggcgcgtacttggccgcggggaccgacaggcggtacctgggagtgtgggggcgtggggaggagtggggggttgaggggtggagcaaaaggcttggcaggctggcgctctctgttttgtgaggagtttcatgtgctgacaagactgtcatgaatccatggcaggtggggtaggccgacgctcgggttgggaggcaggactgaagggcccctcaaaaagggtgaaagtcggagtccctgctgtccagcagccacctnnnnnnnnnngcacggcaggtggggtaggccgacgcctgggtttggaggcaggactgaagcgcccctccaaaagggtgaaggtcggagtccctgctgtccagcagccacctccgccccttcaatccccctacactcccccccttccagcagcctcaccaggcgacgtcggtgcgcagggagatgaggagcatgtcgggccccatctccacaacccagtccttgacctgagacaggcacatgcgcacgccagcggcatccccagccggcggcgcggcggaggacgacccgccagcggcatcctcggccggcggcgcggcggaggacgacccgccagcgccctcatcgaccggcgctgcgctttcctcctgcagggcctggcccccggagaagtcgccgtcgtcctcgagcaccacacccgaggcgtacagctccacgctcgggtccacgccggcccacatggggagcagctccagggaggccagccacccctcggcattgtacacgctgaagtccgtgagcaggcggcgcgggagggtctccgggtccgccccgccccccagctcctcctcgtccgccagcagcagctcgtccacctcctcctcctccttggcgtaggccaggggcgcggggtagtcgttcgcaatctcctccgccgacacctggacataggcggggccgcgcggcttagcgccgccccgcgccgcgcgcgcggcggtggcgtccatctgggcctgcaactggcgcgcaaagtcggcgtcggccagggtctgggcgtcctcgtctgccggtgccgcctcgggccgggtgtcgtccctgatgtggatgccggtggcaccagggcgctgcactcccacatacttgtagctggcggcctgttcagagaaggggggcggggtggagttgagagattgggtggtcagtggtggggtgggcgcattggccgcaagcaggggaacggaagcatagattccgtcccttcagaagtcaaggatgcccaacctaaaagtccactgacctccttcaccagcgccttcccgcactcggtcaggaggtacttgaggccctttggcccgctcacgtcatccagcttggacagctggaaaggggacacgggagggtgcatgttgctggcagcatggtgcatgcaaggccatggttgaactttgaccatgggtccaaaagggtgaagtgcaggacctgagccctcctgcgcactgccccacaccagcacctgcgccccacccctcccacctgggcgatgaccagcttggcattgatgagcagggcctcccgggcgctcgcgtagccatggtccagcttggagcgggccaggcggaggatcacttcgtccaggctggcctcaaggtcaccccccttggctggagacagcgccaggcacacctgccgggaagtgaaaggcagcgtttgatgcgtctgttcagccgagctgggcaatgggttcatctggcattgcttggtggcagtggccgcatgctacactgagttatgtaagtgagaggccggtcatacacatccctgagactcacatactgacccccacaacacacacatagccccggtacactcacctcccggacgagggctgcctgcacaaacaggttcccaaacgtcttcttgtaccccggcgccggcttgagcaggatgtactctgccagcggggtggaaagcaccacctgtgcctcaggccccgcatccacttccagtcggaagccagtcacgggaccgcacgccgccacggaggcgccggaggccttggtggtggggccggcggcggggaagaccacccctgcgcggggcaggcaaggaagggtgggtgagcaaggcatcagaggctggctcagaccatctttgaggcccaaatcccacgctctccacccctaatatttccaaaacattgtgaagcatgaccatgcgcaccggacaggatcagctccacgccattcccggcctcaatgctgagcaccggctcgtnnnnnnnnnnctccgaaacatattgaagcatgaccgtgcgcaccggacaggatcagctccacgcccatcccggcctcaatgctgagcaccggctcgtggatgcccttgggggtggccagcgtgaagtccccgatgcggcgccggggcaggccctcgccctcctccttgacatcgccacgcgtgagctccagggcctcagcctctgaggcggccttggtatactccttcaccgccaggcgctgctcgcgggcgctgggcagggcggaggcttcatccttcagtttcaggttctgagtgccggagaggtcggggaggggatgggcatcgctttattagacgccatgcgcttggcggactacatggccaaggccgcgctacaggcccccactgctgcaaaacgaccagcacccagcaagccacccccagggcacagcactcgcctgtgcagcctgacgcccagatccgacggtgacctcgggcttcacattcgcttccgatgcgtcagcccgagccttcttggcagtatctttcgcggcgaggtcgccagcccgcttgctggctccctcctttccgaggggctccgtgatacctgggaggggaggggagggtggcggagtccgaacccgactggcaacgaccaaagcatggcaatcaatcagatcgcatccacgcgccaaaccccagctgcaaacccaccggcgaccatggcttccacggagctctgcttgcccacggccaagtagcctgcgttcgaaaatgacacggtggccgatcgcgcaaggagggcgatgcagtcatacccgatgcatgtaactttattgatcgcaatacatcaaaggtgctgtacctgcaatacagtgtccacccttggctacctttggacttggagggaggcatgggggtcaagcgggagggtcggagacgactgtgcaccgcaatgcacccttggattgcaggatgacaagcaaacctgcgtattcaagtgtgtcttggcgagccgaggagccctcatgggcatccagctgtgggttgccggaaatcgaaattcaatcgagcataggcatggtttcctgcccggatccccagctcgattcccgcgccttccagctgcccgcgaggacagcgagaaaaagaatatacccttccaaaaaccactctgggagcacatgacgctcggcgccacccacgcggctcacgcgcgactcatcagcatcacgcaccggaaactatgtctgccctgttcgacttccgtgccttctgcattgtcctcctcctcgcggtctgctcctgcaccttcgtcaagaccaaaggtgcgggacacgtcatttctcaccgtcagcttctgtcgactcggccgaccagctcccagtaccgaccgtgctccccaccccctcaccttcccacaccttgcagcccccagcgtcctcagccagaagaccgggtgggtggggttcctgggagggtacggaattgtcccgccggtgtgcggtctgagccggggtatctccttgactgcgccgcactccgatcgccactctcaccctccctcgcacccctcctcctccctcccataggtttcgaggcctgttctggaaatttgcacgcgtgggagaacggctgagcccctgggtgtccctggcctgcatcggaatggcgatgtccaccctctttgtatgagcacacagagcctgacccctagcaacgccgccgcggcggccctgggccccaccgtggtggccctgccgcgcgcgcccggcggcaccaccaagttctgccaactgtcccgcctcacgccctggtgcgcccctagcctggacgacagccaggatgacgacgacnnnnnnnnnngacgccgccgcggcggccctgggccccactgtggtggccctgccgcgcgcgcccggcggcgccaccaagttctgccagctgtcccgcctcacgccctggtgcgcccccagcctggacgacagccaggatgacgacgacctgtccaacctctccgcctcctccagctccggcagcagcgtagcgccggcgacggagtgggaggaggagaccccggtcacgcgcgacgacctctccgtgccctccgagcgcgtcctcgccagcaggccttccctcctccgcgcctccatgtcctcccctgacctgggccggatgctgtcgcccctggtcagccccgccgtgcaccgcccgcggctgaaggagtcggcgctgtggcgcgggccgcgccctgacgccgaggccgtgcagtggagggacgtgaagggcgtgcgcaggctgcactccgtccacatcttcgagctcatcccggaggaggtggagctgcgcacgccccaccgccagggctgctgcgtcgtcatgtgaagcgctcgtcatgtgaagcgctcgccgtgtgaagcgctcgccgtgtgaagcgctcgccgtgtgaagcgcgcgctgcggccggcgccccagactcgaagggccatccctcggttatttatccggcccttattttattccatcatgaggcgctctcccgttcagcatgctcccatggcccctagctctctccccttttttattgatcgccgtgcacggcccgtcgctgtccctcctcttctccacgagaccatccgaaaggtggtgccttnnnnnnnnnncttttattgatcgccgtgcacggcccagcgctgtcccacctcttatccacgagaccatccgaaaggtggtgccttccacgcagcgcgccctgcggccccttgtttttggccccttgcgggcgttcaccgcttgcaggctgagcaatgtctcgccgagcggtcaggtgtgaatgtacatcgaacttgtaatgaagtactggaagctggcacgcgcgagcacagaaaatctaactgtttgcgccggcccttggcgccgcggcaagcaagggtggacgaggaaatatcggaaaaccaggcacagcgcgagggaagggcagcgaagagcggggctcccttgccctcgtcagtccgctgggccccccccccgcaccctcaacatctaaggcatcgcactgccacgagggataggaannnnnnnnnngcagaaaatttaactttttgcgctggccctctgcgccgcggtaagcaaggggggacgaggaagtattgggaaaccaggcacagcgcgaggggaggccagagggcagcaaagggcggggctcccttgccctcgtcagtccgctgcccgccccgcaccctcaacatccaaggcatcgcactgccacgagggataggaaccagtccgccggcgcctcctccccgcctcaggcgtcgggcaggagcgcgagctcgaaggcgacatcggcgtcgccgacgcgtaggctctgctcctcccgcgccagcacgccggttgcgggcacctgctccaggcgcagcgcgcggcccagcgcgtcggccacggcgtcggcctcggcgcacagcgcggcgcgcaggcgctcctcggcctcgccggcgccgcgcaggcacagcaccacctgcacggggt

SEQ ID NO: 38867 - DNA, 71 bp, Chlorella protothecoides
tggggtgagagcgggtggggtgagagcggggagcccgagcatttgggtggatacaccttgatcacagctgc

SEQ ID NO: 38868 - DNA, 77 bp, Chlorella protothecoides
cacatggtaggaggcaatgaggtgaaatattaccatgtcatgcgacttggatgctccacgcgcaatgatggaccgct

SEQ ID NO: 38869 - DNA, 79 bp, Chlorella protothecoides
gtgcaccgaaccactgattgggctgctgcatgtaatctggatgtatatcccttcgaaactcacagcaatcgtcattaca

SEQ ID NO: 38870 - DNA, 63 bp, Chlorella protothecoides
tgacttcctccgcatcccccgtgtctcagtttacccccctccacacagagacacgcccagaac

SEQ ID NO: 38871 - DNA, 102 bp, Chlorella protothecoides
tagagttacagcaggcggtcagaagtacagaagtggagttgatagctcacgcagggcccagacccgggcgatacacctgcaggcgcatgcaaccccaggtgt

SEQ ID NO: 38872 - DNA, 75 bp, Chlorella protothecoides
ttttgcaccctgacatgaagatggctattattactagtgcgatgctccgccaagtgtgtgctcccgacaatgtca

SEQ ID NO: 38873 - DNA, 61 bp, Chlorella protothecoides
gcgcatcgggctggacgtgaacacggggggtgtgaccgacacgcacgccgcctttgtctgg

SEQ ID NO: 38874 - DNA, 61 bp, Chlorella protothecoides
gccgcctgcctgcgccaggtggtggccgggcagagggggcccgtgcctctgcgctgcccgc

SEQ ID NO: 38875 - DNA, 79 bp, Chlorella protothecoides
ccagccgggcctgtacccaacaggagtggaagggggccactgccgacgtcaggctccttcaggtcgccagggagacagg

SEQ ID NO: 38876 - DNA, 148 bp, Chlorella protothecoides
ttggagagtggagcagtggggttgaggggatggaggggaggttgctttttggaagaggtggatggtggagcgagggaggggggggttgatggcattcaaggtctccctggggagtctcggcgcctcgtgacgtgcacccctcctccac

SEQ ID NO: 38877 - DNA, 61 bp, Chlorella protothecoides
agggcttgtggcgtgggcgtgccttctggctaggaggtgccaggtttgggagcagcgatat

SEQ ID NO: 38878 - DNA, 72 bp, Chlorella protothecoides
gagacctggtcaggtgagactgggcggggcgtgctggtggtaggaggaaatatcgccctgtgtggcgcacgg

SEQ ID NO: 38879 - DNA, 9333 bp, Chlorella protothecoides
  modified_base (1027)..(1036): a, c, t, g, unknown or other
  modified_base (1135)..(1144): a, c, t, g, unknown or other
  modified_base (1221)..(1230): a, c, t, g, unknown or other
  modified_base (2058)..(2067): a, c, t, g, unknown or other
  modified_base (2225)..(2234): a, c, t, g, unknown or other
  modified_base (3158)..(3167): a, c, t, g, unknown or other
  modified_base (3278)..(3288): a, c, t, g, unknown or other
  modified_base (3364)..(3373): a, c, t, g, unknown or other
  modified_base (3823)..(3832): a, c, t, g, unknown or other
  modified_base (4366)..(4375): a, c, t, g, unknown or other
  modified_base (4663)..(4672): a, c, t, g, unknown or other
  modified_base (5327)..(5336): a, c, t, g, unknown or other
  modified_base (6027)..(6036): a, c, t, g, unknown or other
  modified_base (6271)..(6280): a, c, t, g, unknown or other
  modified_base (8195)..(8204): a, c, t, g, unknown or other
caggggccggcggcgccgccgcgcccgccccccccaccctcgccccgcgcgcgggcgcccacgccgcgcactcccctcccccggcgcatgccggctgggtggaggccctgcatgacatgcgctccctgctgtccaaccgcggcttcttggccctgaccggcgcggcggccgtcaacgacgtcggctcctgggccctggtagcctggcaggggccgttctaccagcgcgtctacgacgtgggccctgaggtgtatgcccccctgctggcggtggtcatccctgtggggggcctgctgggcggcgtgggcacgggcctggccggcgactggctccagcgccgcggcctgggctccctgctcaccgtcggctccaacctggccgccgcgccggtgctggccgcctccatgctcatgcccgaccaccgctcctccatggcggtgctgctgctgggcttcgcgctctccgaggcctggcgcgcgcccgccgccgtggccttgcgcgacgtgtcgccgccggggcgtggggccgcggcctccgcgctgcacctctgcctgcgaaacctggtgggcggcgtggggccgctggcggtcgccgcgctcgccggacgcgtgggcctgcagcacgccatgctgctcgtccccggctgcttcttcacctcgggcctgggcttctgggcggtgtctcgcctgaacaaggcgcaggcggggcggtgaggtaggagggcggggctgaggcgcacggctgccggcgggcgtcggagcggccgtggcgggagctgggcgcggcagcggctggcgcgagcgcacgccgctgcaggatgcaggagggaaggacggctgcgtccgatgggtcctggaagtgtgcagggggatgcaggctggagctgggctgcgtggcgctcagcatgcctccggcacggccacccaccgcatgactcgggcaccagaatgagcagcagagagcatagatgtgatgattctaggaacctgcagggtatgtgatcaaagccttttgcaatcgatgcagnnnnnnnnnngagtgtgcagggggatgcaggctgtagctgggctgcgtggcgctcagcatacatccggcacggccacacaccgcatgactcgggcaccagaatgagcannnnnnnnnncaaggggattccccaggcgaccaggggtctcagggtcaccgatcctgaacaaggccagggaggcaacgcacccctannnnnnnnnntaaggggattctccaagcgaccaggggcctggtctcagggtcaccgttccagaacaaggccagggaggcaacgcacccctaccagggagcacgacagggaaggtactgcaggccgcatgcgctgggaacggagaggtcgagcatctcaagacgtctctgacacactccggaccgtctcctggccacaattccacacctgagaatatcacacatagtttctgatggcgaagccgaggacgcgcccccccaaggagcgcaaagtgctcgagcctctgtcggcggagggagactccaagtttgcacgggccctggggagcgtggatggccgcacgcgggaggcagggctccaggccctggcagtatggctctcacgcagacaggaagtggacaggctggacctgctcaagctgtggaaggggctgttctacaccttctggcacagcgaccagcccaccgcccaggtgtgcgagccgcgccgcgcgagggtcgcggctgtacctgcatgcatgcggcatggcatgccctgcattccatctttacactgcccgtgccagtgcctgactcccccaaacgctcgcatgctcgcagtcagctctggcggagaggctggccgacctcctcctagtcctcccacccctggtgagaaaatgtgctcacaacaaagggacaagtagttgccgaggatcgtggacgaaactcattctattcatcgcagctctggaaatgtctcatctctggtgcatgtgcatggagatcaacatcgacaggttccaccagaatatcgaagacccagcccatggtcctcagacctccatgctcatcccaacnnnnnnnnnngcgacaggtttcaccagaatatcgaagacccagcccacggtcctcagaccttcatgctcatcccaacacccgcccttccgatcaggtatctgatctcttctatgagacctttgtgcagaccatgcgccgcgaatggtttggcattgaccggctgcgcnnnnnnnnnntctacgagacctttgtgcagaccatgcgtcgcgaatggtttggcattgaccggctgcgcatggacaagttcatgatgctggtccgcaaattcctcttcggcctcctacggaggttccgccaggagcagtggtgagcatttatctcaggcactgcaggcggcagggtggctggggtctcagctgagggtcaagcctactgtccacgaatccatgacccttgcattggttgtaggcaccacgtctgcctcacccaccccctaccccacccacttgcccacccagggacccagccgtcataaggaagacaaccagcttctggctggaggagatcctgcttcccactgacacgctctccgccaccggctttgcataccatctcacggacctgctcctgccagagctgcagcgagtggtgaccagcgccgccgagcagccctccgcagccgccttggccgcgctgctagaacccttctgccaagcgctggcgcagacgggcaaccccgccctgcagttccgcctcaggtgcgaggggtggcacatgatctcactcttgggggctgaggcgctgtcaggactgagcaacttgggaattctcggggcgtcgccctgggcaacatacagggtgttgctgcctgctttgaattcatcagcgcacaacgggtgctgcttcctcccgactgccattagctttggaggaggacccttaggttgcataaactccaattcaccccaaaccgtcatggacacgcaggcacggcgtcttcctgaccatgctcaaggagatccaaaatccctcgccgcatcagcccctgcggcacctggccatcaccgactttgcggctcacatctttgatctaggtaggggtgggcagctgggatagtaggcacccaccttgcagctgggtgccctctcggatgcatgannnnnnnnnnagggcgtcgccctgggcaacatgcagggtgttgccgcctgctttgaactcatcagcgcacaatgggtgctgcttcctcctgactgccattagctttggaggaggacccttnnnnnnnnnnnataccgaggacaactatccgtgcacgccgcttccaatgggtgcctcggctgaagttcctcgcatactatccccaannnnnnnnnngtttgatctaggtaggatgggcagctgggatagtgggcacccactttgcagctgggtgccctctcggatgcatgatggtttgaatcagatgcagtgccactccatgcatttttggtgatggtgcccctgaaccgtactgaggacaactatccgtgcacaccgctcccaacgggtgccgcggctgaagttcctcgcatactatccccaaattcatcagcctgtggtgtcccagctgcggaaccaatgggttaaatacgtttggcacatctactttctgacaaccttcatatctacatgcactgctccatgtcgctgccacagcaagttctgtgacctcgaatcagattctgcccaccactcatgtttgccagctcacattcccttgatccacccacccatgcgttccccattgccatccacccaaggtgctgcggtggagacgagacgcannnnnnnnnnaaatcagatcctgcccaccactcatgtttgccagctcacgttcccttgatccacaacccatgctttccccattgccacccccccaaggtgctgcggtggagacgagacgcaagaatagggaactgtgctacgacctgagcagccgatttgagggcataacgcctggcaaacccaccgcggcccccagtgacgactcgagcaatgggagcgccggcgccgtgcttggcggctcggactcagcacctgcaagtgccaaagtcctcgccaccccgtcaagtgatgcgagtgcgaagaagaagaagaagcgggacgccgcggcggtggatgcccccaacggccacgctgctgtcacacccagcaccctcgaaaagtctgccaagaagaagaaaaaggtgcaggctgagcccgagcctgcagcagcgtcgccctcgggtccagcacctacagcagccaacggccatgccagggcttgtatgagcggcccagagccaacgggtacccccgctgcaggccctgtcgctgcgtctgcggagnnnnnnnnnnaccaacggccatgccagggcttctatgagtggcccagagccaacggatacgccagctgcaggccctgtcgctgcgtctgcggagccgagcagcgcaaccgcccccctttcttctgcaaagtccaagaagaaggcgccggcggtggcagctgctgtcacacaaaaggcagcggcgccagcgaccggaaagactacgccggcagcgccggcagcagtgtcagttaaatctatggcagcggcgtcgacggcaaaggcaggaaaggcagcgacggcgacggcatcgccgccnnnnnnnnnngtctatggcagcggcgtcggtggcaaaggcagcaaaggcagcgacggcgacggcatcgccgccacggacgcccacggtgcctgctgcgccacacgacacgcctgacaccctggcaaagaagaacgtgcgtttctcgctgcggcgtaacctggtcatgaccatcggcgagccgcccgcgcccagcgaggtcaggacgccaccctcctccaagcccaagggcccggcgctgaagaaagcatcctcgcttggcagcgcgcccgggcgcctgacaggcaagtctggcggtgcggcgcggcggctgtccatgcagggcatgggtacgtctgccagcggcgggaagccgggcaaggggaggagcagtcttgggccgcggccgcgggccgccgactttttctgaaactttctccatgactgctaagaattggttgtgacaaaacacagtgtatgttgagagtctgaagcggggagagggctgagcaggagtgcacaagtcagaggaatgcctcagaggctaggggcaaggttggggttgtatcgtacagatctggcgcacgccgcagctcgggggaaagggagggagcgctgctccggccaagagcacgtgggagaggaatgacggggggtcgctggatgtacatggtcccgtgctgctccnnnnnnnnnnaatctggcgcacgccgcagctcggggaaaagggagggagcgctgcgccggccaagagcacgtgggagaggggtgacgggggaacgctggatgtacatggtcccgtgctgctccatggcccgcgcccggcctgctctaaaacaggaggggcatgaggctcgtctggccatcgctgcaggatttgaccctggtctcccccgtcacggctcggcacatgggacagctccgctcccgctcaaaccactgcatggatgattgggggtgtcgctgtggcaggatgtgggacatgcggtgggctggtgaacgaggctgtcatccatacagtcgcgagcttggctgcgccccttggggtccacgcgatagtccccagcccctggccccctcccctcccacctctgccacgcaggcgtcgcagaagatgtggctgcacggcagcttcacggggagggtgggcggctcctggcagatcgggcacacgctccccgcctccgccacctcctccgccgagggctgcacgccgtggtcggcccggcccagctggcgcgtggccgccagcgccacggcgcccagccgccgcgcgtgcacggccttgatggcgaggtagggcaactgggcggccaaccccgcgccgcccaggtatgtcagccagagcggggcggggcccagcgtgcgcagcgcgagcgtggcgtgcnnnnnnnnnngccccgcgccgcccaggtaggccagccagagcggggcgggacccagcgtgcgcagcgcgagcgtggcgtgctccagccaggtcagcagcgcggaccggcgccgccgcgcgcgcgggtcgtcggcgaccatgctcgcgatggccgccagctggccaagagggggcggtggtaggggggtcgaggatgatgagcagggaggctatgcatgacgctgaacgcctgggcgcgccagccnnnnnnnnnnccgtcggcgaccacgcttgcgatggccgccagctggcggggagggggcggtggcagggggctcgaggatgatgagcagggaggctgtccatgacgctgaacgcctgggcgcgccagccacatgcctcgcactgcccacccctttcagtcgggccgaacggcacggcatgcacgtacgccccatgcgcgacacgggaatgagggagcccgcgtgccgcagatgcatcccctcgccgcgccgcttccagacggccggtttgcccaccaaacggtcgccgccaccccacctttgctgctgccaccaggatgcgaaagcaggtgtcggccgccacgaccagcaggagcgtggcccagaagccccggcgcgccgcctccagccgccccgctggcctcagcaggtaggcggcacagacggcggccgccagcacggcggccaggccccggcccagcagcgcgcgcgcgtccgccgcgcccttgtccgtcagggccgtggtggcggcgcggttcaggcggcgcaggagcgcggtgaggccggcccagagcgccagcacggcggcgctgcgccaggcgaagatgaggagcatgagggcgaggtagggcgcgttgatctccaccccgccccccaggtctgccaggttcaggccgatggaggtggacaggcggtggtgctccgcctcgtcggccaggttggcatcgtcgctgggggccggaagggcgccgggcagggcagagactgatggaggcccagcaggaaggggttcatccctcagcggaccagggcccgggccctggttgatcatgccttcctgggaaggcatcgcctccaggtgcccggcccgtggctggcctgtgctgaaggacacctccaggcgccgggtggaggagcccaattcctcgccaccctgccacacccgcctcagcagggagcggagggtgtgggtacccccgcccctctccaccgccggtggtgggcgtggcagagacatggaaggaaacgatgcgggcaccgggtcaagggcttggctgctgccatccgatcggtggaccaggaccgagacctgtcggacggggtcctgctcgccaccgacgggggaggccatgtccggccgatatgccagacagccaatcacagagtagatatcgtttgtgtacacatcacaggacttggtaatatcccatattcagtggatctgacatcaggaaatgtctcgacgttagatgacgagtgccacgctggcaagaggacacgggggcctagcgagggcgcagaacagggcacatgtgacagattccaggcaatttgattcacttcagaatgtattgagtgcttcataatcttgaaccaccgacgtcccggcttggaggcacggaagagggggcggtctcgtccttttggcgaccagcacgacgagcgcaggcgtggggtttgccaagctcccatctcgtcttctaggataacatattgtcgagacgctgaaacgcgtgccgccaccgaggctgcctgaacgctcagcatagggtgttccggagcaggcggacgccatggagtttgtcggcaaggtgggttggcccagggaagaggatgcgcatgtcctttactgtgtaaatacgatataaatcggtaaagcatgctctggcgccccacaggtgatctccaaccggatgcaaaagtccatcctggttgctgtggaccgcatcgtgaaaattcccaaatacaaccgggaagtacggcgaacgaccaagctcatggtgagggcagcgagatagttgtgattcttgttgcagtgggctgctgcgtgccccggcgcagacgaggggtacgtggtggagcagcaacgcccaggaaggcaaatacgcctggctgctcacccgctccggtctcaactgctttgcaggcccatgatgagaccgacacnnnnnnnnnngcgtggtggagcagcaacgctcaggagggcaaatacgcccggctgctcacccgctccggtctcaattgctttgcaggcccatgatgagaccgacacctgcaacattggcgacaccgtgaggatacacagttgcaggtacatcacagggtcttgggatcgtgttttatgattggcaaggcaaagagacacatgctccttgacttctctcctgttgagtacccctcggcgttcactctcgcagccttggagaagggctttgggtgtgagctgctcaccgtcctgttccctcccctcctctcaaccttcaggccgcgcagcaagcggaagtgctgggaggtgacggacgtgttgcagcgcaccaagatctacgacgccgaggccgccacccgcggcgcggtcaacaagctgcgggccgtcgccgaccagggttttgccgcctcggcgctccaatcccccccaccctccccgccgccctgtgcttgacgtgtgcagccaggcccatgaatgagcgtgtcctgctgagctgcgcagcctgcctcgagccgggattctcgggcatgctggggaggctggagctgacggccacccagccctcaagcatacctcgcacatcctgcagcgaggctgcttgcatccacttgtcagtgcaccgatgcgccctgcatcgcctgcaagagagcgcatgcacgcagcaacatcacgaaacaaaaagcagttccaggacatgggtttctccaagacgggtgcttgcctctgggcgggcgacgcggcgcatcgcgcactcagcgcggatcccggcgctggcctcgctcacggcgtccgcccatactctccacgccggctccggccggggctgggctgccagcgggcgggctcgccctcgccgtccgacccccctgactcgtctgccagagccgtggccgagacactgctggccagcacgctgacggaggcggtggaggcgccgagcgcgccgccgcccctgcccgaggggctggccagggagtgcggggagagcgcggcgggcaggatggtcaccgaccgcgccatggtgcgcaggggacgggcggggcgggggggccgccccgtcctgatcccgggcgtcgccgccggcccggcggggccggcc

SEQ ID NO: 38880 - DNA, 62 bp, Chlorella protothecoides
gggatccgaccatggggataggcaggacttggaatgctggtacagacggctgacaggaagac

SEQ ID NO: 38881 - DNA, 61 bp, Chlorella protothecoides
acttcatgctttagcggaaggcattacttcgtgctttagcggaaggcattacttcatgctt

SEQ ID NO: 38882 - DNA, 91 bp, Chlorella protothecoides
ggtagactgggcctgagaggggaggggggattacactttgccacagtcacacgaggatgaacaaggggaaggcacaaggacaccaccagtg

SEQ ID NO: 38883 - DNA, 61 bp, Chlorella protothecoides
acactctggtacgccgctgcttcggtttggcagtcaacaatgttgtcgatgccgggcccta

SEQ ID NO: 38884 - DNA, 19650 bp, Chlorella protothecoides
  modified_base (527)..(536): a, c, t, g, unknown or other
  modified_base (738)..(758): a, c, t, g, unknown or other
  modified_base (989)..(998): a, c, t, g, unknown or other
  modified_base (6251)..(6260): a, c, t, g, unknown or other
  modified_base (6882)..(6891): a, c, t, g, unknown or other
  modified_base (7346)..(7355): a, c, t, g, unknown or other
  modified_base (7597)..(7606): a, c, t, g, unknown or other
  modified_base (8534)..(8543): a, c, t, g, unknown or other
  modified_base (9769)..(9778): a, c, t, g, unknown or other
  modified_base (10254)..(10263): a, c, t, g, unknown or other
  modified_base (10569)..(10578): a, c, t, g, unknown or other
  modified_base (12980)..(12989): a, c, t, g, unknown or other
  modified_base (15179)..(15188): a, c, t, g, unknown or other
  modified_base (15479)..(15488): a, c, t, g, unknown or other
  modified_base (15953)..(15962): a, c, t, g, unknown or other
  modified_base (16292)..(16301): a, c, t, g, unknown or other
  modified_base (16769)..(16778): a, c, t, g, unknown or other
  modified_base (18003)..(18012): a, c, t, g, unknown or other
  modified_base (18428)..(18437): a, c, t, g, unknown or other
  modified_base (18521)..(18530): a, c, t, g, unknown or other
  modified_base (18727)..(18736): a, c, t, g, unknown or other
  modified_base (19385)..(19594): a, c, t, g, unknown or other
ccccacccagacccccctcccccccctcccatgcacacatataacaacaggccctgctgcgcgccggggacaagtgcgtggcgcggtacgaggacgggcagtggtaccgcgccagcgtggagcgggtgcacgccgccgaccccaccgccccggagtacgacgtctacttcatcgactttggcaaccgccagcgcgccaagggagcggcggtgcggcccatggacgccgcgcttgccgcggtggctccgcaggccacgccggccaccctggcattcgtcaaggtgggtggcttggtcgcgtgttggtcggagggcggtggcaggaaggggcgagcgtcgaaaccccctcgtcagagagcgtggtgccggagcccatcgtgcgctgactcggacgcagcgggcaggggaggtgtgcacccctggcctctcacgtcggagtgggtggcatgactgccgatgcacagcattcgtctccaatctattctcactgctcttggccacgtgtcgcgcccagcaacctcgtacccnnnnnnnnnncccaatctggtctcactgcccttgaccacgtgtcgcgcccagcaacctcgtacccgcgtcaccgaatttgtcctgcaacccccaaccccctcctcaggctcccgggctggatgacgagtatggcgtggacgcggcctccatgctggcggagctggtggggtcgggcgccaagctgtctgcagtcgtggagagcagggagcgnnnnnnnnnnnnnnnnnnnnngtgaacgccaagctggtggcggcgggcctggcgcgcctggctgcccccaaggtgagggttttggggtgatgggggagtggggtggggagtgcgcgtagcgcgaggctggaccagatcgaacgtgggccccaaggtgtgccgggaggtgacgtacgtgacacagcgcccgacgagcccacagggcacacatactggatgcacacgactctccatcgcagggacgaggctcgnnnnnnnnnntacgtgggccccaaggtgtgtcgggaggtgacgtacgtgatacagcgcccggcgagcccacagggcacacatactggatacgcacgactctccatcgcagggacgaggctcgtcttccccagcgctggaggaggtgcgcgccgctcaggaccaggcccgtcggagccgggtggggctgtggcggtacggcgatccggggtccgactccgaggaggagggtgggagctaccccaagctgcgcagcgcaggaccccggcgctaggaggcatggctcaccgaggcatgagcagatccacagctgtctcatgcaggaatcgggtcccgcatgtccactgcgcatcgacacaatccaaagttcccattgttgcaagcatgtccatgcctctgatctgagaggcatgactcgagggcattcgtcgtcgctggtgcggtgcaaccatgcgatccgtccatggcaggtccgtttcggcattgagccggcattgcaagcaatgccacaagtggctgcttggctgcttctcatcctggtgacaataccaccctgtttcgaggacaagcgctcccaaggggccgcggcttaatcctacgtcagcttaaagaacccccggaaattgcctgtgctgctacctggaacccagccttgccgatgcgaggaccgacatatcttgtgacacattgggccaaacccaagattgaattgtaaagagcggtgagataactgtggtgcagcctcctaacaaccctgtcgaggtgtaagtcgcgcctcggggacctgccgtcatgcggtccatgatcctcttctccgccatcgcctgtctggcgacgctgcccggcccaggtacggtgcccagggcagtgctaggcattaatctttagatttaaagggctcacacactcgctgaacccagctgatgtccacatctgacaccgacccgccgcacagggatggcacagggagacgcttgcgtcgccctcacacccgacaccactggggtggtgggtaacgatggcatcaccaacccgctgctcctcaacaccctggtggcgggcgtggatgaggcgctcgtgttcccggattctaaaaccatcgtgtgagtatccttcgggaagatcttttgaacgaagtacagcagaagctgtggagccccccctcaatcccatacacaataacccctggagcaccgatccgaagaacgaggccagcactgcagcaccctcaggctgaattcccacgcatatccatgactgttgcagggacatgccgctcaccgccccaccctcggaggtgtatgcggcatacgctgagctgggcctgcccgaccctctcaccgacatcgaggccttccagaccaatgccacgatcaacgagacgctgcaagagtttgtggccacctggttgaccgagcccggcactgacctcgccaatgtgacgggcctcgtcgggcccaaccctcctgagtggtttgaggtgcgtctgtatatgaggctgcggggatggagggcttcatagtttcctggagtgcaactagaatgcatatcgcagaaacagggagagaatgtggaacatctgtgctgattcatgcgtgccccaaggtggcatgtggcgcggccaggcagcttgtgattacaaagcttgtgaccgtgaaaccaccgcatctctcgcctccttttccttagcaccccccccctttccatccctgcacagaccatcgaggaccccaacctgaagcgctgggccgattccctttacgaggcctggaatctgctgacccgccaggtcgcgcccaatgtgtcgatggacacccagctctacacgatgctccccgttcccaacccctttgtcgtccccggcgcccgcttccgggaggtgtactactgggacagcttcttcgtcatccagggcctcctggccagcaatctgaccaccctggctgagaacatcctggacaactttgcctacctcgtccaggtgcgcatgctcggcggtaggctgcgctctgggtcgcttcgctgtgcgctgtggctggtgggggcatggcttgatctcaaaacgattccttttatcacaaggtgcttcttgaaaagcgccaggggagtgggcgttactcgatgtcggtccttagagcactgcatgtccctcttggggcatgccctctagcagtgacacatttggacgtacaatgcttcacaagtctcccacctgcccgctgtctcgcagacgtacggtcacatacccaacggcatcaggacatactacatcaaccgcaggtgaggaggtgcatgctggcggtgtggtcgatgccactgctgccggtcaggattcattcatctgcttgccccttaaggaagtgtgtcttgcacctttacatccctctccgcccatccaatcacccctctctccaattaccacccccacaatacacaacagccaacccccgctgttcagcgagatggtccgcattgtctacgaggccagcggggacgagagcgtgctggagagggccctcccagccctgctagcagagcacgcctactggaccagcgcgcccaagcaggtggaggtgctgagccccgacgggtccaccacctacaatctgagccgctactatgctgactgggatacaccgagacccgagtccttcaggtgtgtgtgtgtgtgatttggggtggggtcgggtgaatgggtgacgtgtaggtgcaagcgagcgtggccctggttcctgaggccggatgcgactccttcttccaggcatcagggatccatcacaacaaccttcttcgcatttcacgcccagggaggatcaggagacggcaaggaaggccggatttgaccccgccgcccccacggcagccacgcggcagctgtaccgcgacctggcctccggcgcggagtccggctgggactactccacgcgctggctggcggagaacagcaccgacctgtccaccatccgcaccacgcgtgtcctgccggccgacctcaacgccttcctgtaccagatggagcgcaacattgcgacctttgccgatgcgctggcctgcgccgacgtcgccgaccgctttgatgccgccgccaaggcgcggcgcgaggcgctggacgccctctcctgggacccggcggcggggcagtggtacgacctcatcatcgacgccgaggacggggatgggcttgccggccccgtgtcggtcgcgcccaacgctgtcgtcttccccagcaactggttcccgttgtacgccggcgtggcggaggccggcagcgtccaggccgccgcggccgtggccgccttcaacgcctcgggcctgctgatggagggcggtgtgcccgcctccctggtggagtctgggcagcagtgggactaccccaacgtctggccccccatccaggggctgctggtgcagggtttccgcaacgcgggcggcgccgaggccgaggccctggcccagaccatcgccgagacctacgtcaaccaggcgctgcgcacctgggaggagacgggggccaacttcgagaagttcaactccacgctcgtcggccgcccggggggcggcggcgagtacgccgtcgtcaccggctttggctggaccaacggcgtggccctgcatctcatccagcagtacgacctatgagagctcttgctggagatttgggggtcccagctaccagtacccggcatcctttgccgtagctaggagggtgtgtgtagacaattgcccttcctactgcacgatcaattttccccgaggatgccctcgctccttggatcccgccttttgcacgtctggctcagcatggtgtcacccctaaattcaaacgtgtccctctgctacatctgatgaacctaccgatgatctttcttgtcgtgcatgcaaaccttgtcccccacagtgctgcgatgcctgtaagcgaatgccacccatcgctcctgagcgaagctgcttgaatgtgatgccttggtctcaatcgagcacgcaccggccctgtacgcaagcattgacatgcactgaccgtgaccccagctggccggaccctcattccctcactcaaaatccactggaatgaattcccaagtatattacatatggttcctgtacccatggccggggagttccgcacaaggctgtcgaacttgctgccatgcagcgcactgactgtcctctttcatgaacgcgaccacacaagcacggagaggggctaggtcccgagacctacctggcggtgctcaactcgtcgcgcacgcaggacccgccgctgcgatgggcgtctgccccttgcctgccgacaagctttcaagaggccagcctgggggcggagggttggtgcaggtggacggtgatgcggtctccccaccgtcctgcctgttgttgaacaccagagcgcacaagccaccgcacccactcccccgccccgcccctaccgaacggtgacgcctggccgcgggggtgtcggcttcccggtggccccctcggagtccagaacggcccactccgccagctcacccactccgcgcagtccggcctctgctttcgcggcctcggcgtctgcagcatcgcccagggtctgcgtggatgcaacgtcctgtgtggccacagggagtgtctggcggggatgagccgagtcccgggctgggtagaggcggtgatgatgccgcggagactcggaggcggacaaggcatgcgagttctgcaagacgcaacgctggaaatggcagcacggaaccgaggctctgtgcatgtgtgcacagcagctgcagtgcagtcgtgcaaactcacagactcaaacatttgacattgcatgatctgtgcagctggtctcgtcattcccaatgcaccaacatgcacgaccctccactaccacaccgccccatccaaaaacccaccatggaggaggcctcggtggtggagcagacgttgtcagccttcccagccgccgccccgaggtccatgacgctgaggtcggaggccgcgcgccgcggcgcgtcgctcggcgccggaccccccgtctcttccgtccggctgcgcttgggggcaggctccgggacgcgcgcggacccgtctggcgccctgcgcggcggcgccatcggcggtagcccctcaccattctgaggcgctggagcatgcgcgggccggctctccagctcctcccctgcgccgctggccgcctgcgcaggacaagcctttggcgcgtccaccgcggtcccgctgttggccggcgtgggcgcctcctcggcgccctgcacggccctctcggcgccnnnnnnnnnnccctttgacgcgtccaccgcggtcctgctgttggccggcgtgggcgccgccgaggcgccctgcatggccccctcggcgtcctgcatggcctcctcggcgccctgcccagccgccaaaccacttgcgccgcccggccccgccgccctcacccattccggcagctgcttctgcaggacgtgcctcactgcgagctccatgcccggccggcgctccgcccagtccttgacccgatgcgcaaagtcgttgacaggctgggtgaggtcgacgcgcgcggcgggggcgggggcgtgcggcgcatacgcacccgtcagcgccaccgcccgcttcttggacagccccaggaagtaggagcaggccagggggtcggcgggcgggcggaggggcttgggccacggccgcacctccacaatgctgccggcggagcggatgaggagccggaggcgggaggtgacccaaccctcccacacctcaaagtccgcctcgctggccgccacaatgtccacctttgtcaggaggaggaggggtgagagaggacatgtttctgtgctgtctctgaccctggcgccccttccagccacgtgtgcatactcggctgcaggatgtcactccgtccatccttcannnnnnnnnngggggtgagagggcgcatgtttctgtgctgtctctgactctggcgccccttccagccacatgtgcacactcagctgcaggatgtcactccgtccatccttcagctctcgatcaccaccccattccccacccaaaccacagccgagcctttcggccgtgcctggaggtagtgcttgaacgcggtgaaaaaggggaagggctcgttcaggcgcgcccagtccgtcacgccgccggcgccgcccgccaggatctcgtcgcacaccgcgtcgccgcgcgcgaactcgtcgaccatggcccccagcgtgcactccgacacgttgtagctggagttcatggcggggtaggcgggggtgatgatgggcatgagatgcgagcggtcgcgagggttctcgcgagggtcccacaccggcatgcccagcgacacgtcgcgctcgatggggcgcagcaggatgggcnnnnnnnnnngtgcgagcggtcgcgagggttctcgcgcgggtcccacacaggcatgcccagcgacacatcgcgctcgatggggcgcagcaggatgggcgtgggccacttccaccctgacaaaacctgtcgttggtgaggagaggggggggagagcatgagatggtaggggcgatgaatgagggagggggccaggcctcgacttccctcgccgcaagccttttttttgtcattgaacagctccaggcctgccnnnnnnnnnncccaggcctcgactgccctcgccgcaagcctatttttgtcattgaacagctccaggcctgcccatactacttgataatcaacacagcaggtcattcccagagcacacacacagtatcactgatccccccctccccccctcccctccttacatatccccccccctgctactattccccccccactccaaccttgaagaagcgggacacgacggtgctgggcgcagcgcgtgggtagagtcggcagacgtaggccaccaggatggcccagttgacgccgcccaggtagcccgtgacgttggagtagacgccgcggcgcgcggcccagagcttgagcaggcgcagcgcggcgcggaaggctgcggggtcgggcacctcccgcagtacggtatcggtcacgcggcagccgttcaggctgcgcacgctggcgtcgtcgcagtggcgcagcaccgcggagccggagacgtccagcccggcgcgcagggcggggaccgccaggctggcatacagcaggtccacggccacgccacgcagccgaaactccagcacggggacgtaggcggccggcacggcgcgcagcgcggccaggccgggggcggaggccagcagcgtctgcagcgagtgcggggcggggccgaagaagtcggactcgcgcgttgcgtagctgggacccacacacagcgtgtcgatgtcggcgccttttgttttttggggagaggggaggggtggggagggttttagggtctgggaggggtcttgtgggtgcgagggggggtggacgtggcaacgctgagactgtgacacactggccctaccagcgtgcaggcatcgaggggctgagtgggttaggcacacagagggacctgcctgccccattccatgcacaggtgcactgtgaactgcatcacatgctcatccccgccgaccagcnnnnnnnnnngcggcacacagagggacccacctgctcattccatgcacaggtgcactgtgaaatgcatcacatgctcatccccgccgaccagcccaaagttgcgatgaccgattcaaaaggcctgctccccacagtacagcccgctcagccccaacagcagcagcacacctggtccgtgcacccccaggcggtaacttccaaaggtgtagatcacggccgtggcgtcctccaccggctggccgtggtgtgcggcaacccccttgatccactccttaaccagggtgtccagggcgcccagcacctcctcccgaagctcggcctcctcccgggactcatacagattttgggcgcgcaaatactgcggggaggacgatgggttgtactgtgattcatcgtcggtggtagcactggccctggcgccaagtcgaccagggagccatgcttccatgcacagccgatcgatggcacggcgcgccgggccatcgacaggttcagatcacactccaaccattaccatgttatccaactcacctgctcaaggtcctcggagtgcttcagatcggcacgagacggcgcagcggtgcttatgggctcaatgaagctggcggggcccattcgggccggccctggggtgggccctccaggcgtctcctgatcttactggtagcagcacatgatacaagccggctgtgagatgccgaacgagatggctgtggcaaaaactccctttgcgagctcagctccaagtctggcaacaacagagtggtgaccgggtggtgcaagtggcccagctcgcgtcccgagggttcgccgacaccacagatcgatagttatagggcatgcaagtggtaggccgtcgctgctcagcccttgtgcacgactgctggatccgcagatcggtttcagaaaggggtacgggcgaatagccgcggtaccttcgcgccctggagacgtcttgggctacaccatggcgccgctcggcgaagggcccatttcgagacgcgacatctccatgcatggctagagcgaccgtgaacgagtaaacgtgttgtctcccaggcgggtcggccatcgaaaggacatgacttggtgacggcatgaactcgagcttgcacaccaaggaggtcaccaccgccaaagtgcggtcggtaggcttcggtttcttcagtgacgatgaggtacgtattttgccatctggtttatttgagggatgtatatgtcgagctgatgggacnnnnnnnnnngttcttcagtgacgatgaggtacgtatattgccatctggtgtatgtgagggatgtatatgtcgagctgatgggacgtgtcgaggagttgggtacactgctactgcctttggcctggccatgtgcgccaaagtttccgtgagtggcgctctccttcacgcctatactttttctcacgtgcaatcgctcagataagaaaggtcagcgtgaagaagatcatctcgcccatcatattcgacaacagcaagacacctgtggagggtggcctgtatgacactgccctgggtcccttggaccctcgagagaggtgagcatgcgtggattgtggagtcccacgactccagatgggcattatgatcgaaaaaggtaccttacaagcctctgcagcgctttgatccccactgtcccaccaatgcctgtctgcttccaggtgcacaacatgcggcttgaccgcggattgcccgggccactttggtcnnnnnnnnnnccgagagaggtgagcatgcgtgggttgtggagtctcacgactctagatgggcattatgaccgaaaattgtacctttcaggcctctgcaacgctttgatctccactgtcccaccgatgcctgtccgcttccaggtgcacaacatgcggcctgaccgcggattgcccgggccactttggtcatgtagaactggcggtgccagtgtacaacccccttgtctttgggtgagataaggagtttggtctggggtttgatgggcagcaaaagtatgtgtagatcctatcatcgcgctgtgctgcagaagcacnnnnnnnnnngaaggggtttggttcggggtttgatgggcagcaatagtatgtgtaggtcctatcatcgcgctgtgctgcagaagcactcatgaggatggagcagtgactgcgccttgcactgccactcgctcgttacacacacctctgtccccccaactcgccccagaaccgaccttcaccctccaccctctatcctccaccctccaaccctcccctttcccgcccacacaggaccctgtacaagctgctgaggtgcgcctgcctgcactgctttaagatgcggatggccagcaaggaggtgcagcgatatgttgctcgtctcagcctcctgctggagggccggttggccgaggcccagggcatcaacgtgggggcgtccagctcagcgaggaaggcagctggaaaggagggcatggagctggacgaagggtccggaggggagggctccccaacctccgtcgttaagggtgaggctttattggagctgtgggcgtgagtgcctgtgtctgccaaccggtctgaacggctaccatctgttgtgagaggtgccccctatacatggcatgcaccagcaatcagttgaggcgccttcacctagtgcaatgaccagtactggaggtcatttccttttttgtctgccggagagaatccgcaagatccccatctcaatccgctctcagaccctatgcactctccaatccctcacaggcccgctgcccagccgccgcacggtggcaatgactgggcagagtctggaggcggctatcgacaccatgtccgagatcttcaagaagcagcccccgggacgatgtgccaactgcggcgcccacagccccagcatcaagaagtaagcttggattggctttgttgtagggatttagagaatgggcggggacctaggggtggtgagggagctttcagggtgtcttgctgtgtgcccttcattgaagggaagcgtaggatgcgggcatgtttggacggctgcaggaggtgacacagcctgcagctaggcgccttgtatggccccgagtaaaagcatcccagctcaactgggttccactgtcaaaggaactgtgctgcccattcatttctcaaccctcactccacacgcactgcagggagggctacagcaagctgttcctccttcccctgacgaccaagaaggcggcggccaacaagatgcagggcacagagatcctgccctccctgagccggctgcaggccgggaatctgacgctggacgaggcggccgggctcggcagccagggttgtgaggaggaggccaaggtgcggtacggattcctgaaggaggagaaggagggcctgagcgacgaggaggtcatggccgagttcaaggagtccaagcacggcgacgagggcggcgtgtttgccgctgaactgccccgcgctgaggtcccccgtcagcccaagggggtcccagcctctgaaaaggagaatgcctccaagtgaggagggctgggtggggtgtggtgtgtcagggttgggactcagatctggcattttgtgtgtgaaacccctcatgctcctggtatggttgcccggcaggcgtttcgtgaccttgatgctggctgacagccttgccaactgtgacatttctcaagtttgcttgctgcaagtgttcctcacagtgcattgcattgcatgttctattcgagcatgctgtcgtatgctgagtctccaacccctcctcctgttcctcctctgcagcgtcagcgtcggcccgcccaaattcctgacggcggcggaggtccaggagatcctccgttgtgtatgggcggccaatgccgacattatgcagctcatctacccagcagacgtggctcagcggaagaggcgtcagggggcctcagaggctcaggccgctgcggctggcaaggctgctgcacaggtgctggatggggacgactgggtctgatggatgtgctggctgtattctgaggtagtaataagcaatagggccaggcaaggggtctgtggcggctgaacaaaaggaatatgcgagacatgttcttgaagctgactcttgattacgtatcgagatgcttctccacaccaggactgtggctcctgatttaacccctccaaccttctttcctttcccccttttcctctgtctgcaggctggcaactaccgcgagttcttcatccagacggtggccgtgacacccaacaggttcagacccatcagccatgttggagagatggtgagtggagtgcaggagagccagccgggcggcacttagtatcctacaggcaaagagcctcttacttcttgtgaaacaccgagtgtcgattggcggtagttcaaacttgttttctctctggtcatcgtgatatactgtggtcctgttctcattttcccgctttcctctgcccttcccccttcaggnnnnnnnnnngaacaccaagtgtcgactggcggtagttcatacttgctttctctctggtcatcgtggtatactgtggtcctgttctcatttccccgctttcctctgcccttcccccttcaggtgtacgagcacccccagaacacgatgctggtcaaggttctgaatgccaacctggagatccagcgccttggtgagcgtgcttgccagcctgcgacgggcttgtcagctctgatgttactgtcggtgcaggcatggctgctcaagtatgttctttaccgcgcatccctcaacaccttgacaaataaaccccatctctggtctgcagccgccgagacggaccaggatggggagcccctggacatcaccgacggccgcatgctgcgcacctggctggagatgcagaactcggtcaacgccttcatcgactccaccaccgccgagaacgagccaaacgcgatcgtacgtgtgtgagggggggcgctggaggagagcgtgcatgtggctgccttgaccttactgaatgccctctgctcagcgtcaaggtttggccaacaggagttctatgcataaagcaacctccaccctccccattcaccgtccaccctttcaacacattccacttgagcagggcatccgccagcagctggagaagaaggagggcctgttccgcaagaacatgatgggcaagcgcgtcaactttgcagcgcgctccgtcatctccccagatgtttatctgaacggtggggagatcggggtgcccccctacatcgcagcccgcctgaccttccccgagcgcgtcacgccctggaatgtggagcgactgtgcgaggctgtgatggcgggccccgggcgcaacccgggcgcggtggcggtggagaacgagaagggccgcctgctcatgctgcgagacgacgccaaggtacggcggctgacttgatggtactggctgggtaccgaggctgggaccctcattcgtcgcaccgccatatgtccatggcagccagaggctgtgatgcaagcaacccacaacatgggttgccttttcgacccggacctcaacccctcccacatgcacacaaaccacaaacacacacacactcccaccttgccctactcacagtctcgggagggcattgcaaggcagctgtacagccagatcgccgggtcgcggagggccagcggcggcgcgccggccgcgctggacgccggcgccgccgggcacccctgcctggccgagtttgggggttgcaaggtggtctaccgctccatggaggacggcgacgtgctgctgactaaccgtcagccgaccctgcacaagcctggcatgatggcgcaccgggcacgcatcatgaggggtgagcggtggggtttggtgttgataccatcacgaaatgctcgtcagcgcgccccctttgtgcgcgtggtttgcctttgcacccctcccggcatccctccggacccttggacatcccctcctgagcctgccctgcaccccaagggttcagagattcattcctcaccggtcctccccaccacccacacccacccacccaccagacgagcgcacaatccgcttccactacgccaactgcgcgaccttcaacgccgactttgacggcgacgagatcaacctgcacctgccccaggaccagctgggtcgggcggaggggtatggcatcgtctccgctgaccaccagttcttcgtgcccaccgacggcaagcccctgcgcggcctcatccaggaccacatcgtggccggcacgctgctcacgctgcgcgaccgtttcttcaccgccgcgcagtaccaccagctggtgtacgaggcggtgtgcaccgactgcagcggggcctgggaggtgtggctggacgagcctgccctggtgaagccggtgcggcgctggacgggcaagcaggtgctgaccgcggtgctcatgcactacacgcgcgaccagctgcccttctccatgagcaccgcctcgcgcgtcccggtggaggcgtggggcaagaactcgggtgggacgggcgcggtttggtgggtgccgtgggggggtgggatgacccgagtgtttgtggagttggggtgatgtgttgcgtccacggggtatggggcaagcaacgcgaccagccactgagcgccgcagggtcaccagcagcaaagccattgagcgccctgcacaggccgcgccctgtcgtgttccnnnnnnnnnngaggggtacggggcaagtaacgcgacgagccactgagcgccgcggggttacaagcagcaaagccaatgagcaccctgcacaggccgcgccctgtcgtgttccccgttcccacacgcaaacctccctgctgttttcaggcgaaggcaagctgctcatccagcacaaccacgtgctggcggggtgtgtggacaagaactgctttggaaagcacggcctcctccacttcttccacgtgcgcacccttttcggggaggggttggtccctgatgcatgatggcactgtgcaggctnnnnnnnnnncccctattccgggaggggttgctccctgatgcatgatggcactgtgcaggctgtgaccgcggcggtgctgggacgctgggtgtgggaggcgcatgagaatggccctgcgtgctcgaggcctggctgaggggatgggacccggtgcatgcgtgctccgctcaaagcccgcccaacacaccactccctcccatgccccccaggagctgtacggcgccgagcgcacctcgctgctcacggcctccctgtcgcgcctgctgaccggcttcctccagaagcacggcttcacgtgcggcatgtcggacgtgctgctggtgcaggtgagcgtgcatggctcggccgggcagcgctgtgcggaggggggtgccggcacgtcggatgaggagcggcgatgggatggagggtcggtggagctgccatgccgccccccgacacctacgaggcctcccctcccactcaccttcctcnnnnnnnnnncgccggcacgtcgcatgaggagcggcgatgggatggagggtcggcggagctgccatgccggcccccgacacccacgaggcctcccctcccactcaccttcctcgcgtcatcttcacgcacccaggacgctgaggaggaaaggaagaaattgctgacgagcgctgacgtgcgctgcctggatgccgccgccagcctgtttgggccctcccgggcgggacccctggccgagcagggcatgtcctatgtgagcgctgaggggtggggcactggcacactggtggttggctgcccgccgagtgcccagcatgcttggcagtgctggcagcatgnnnnnnnnnngtgtctggatgctgccgccagcctgtttgggccctcccgggcaggacccctggccgagcagggcatgtcctatgtgagtgctgaggggtgggacactggcacactggtggttggctgcccaccgagtacccagcatgcttggcagtgctggcagcatgatgacggtgccgctcctggtccactcctgcacgtctcgcctcctccctggcttacaggaggaggccttccgcagcgcggagccagatgtgagggagcagctgcgcgacaggttccgctccaaccaggagactggtgctctgctggacatgaagtcctccagtgagtctgggtacagtggtctgggaaggagctgggcctggggcagtgaaggctgtatgagcgcgtgctgggcatcagctcggcagacatgcaagcgtgcgagagctgcccctttcctgcaagatcccgcttgccagatcatcccaaccnnnnnnnnnncctgctggacatgaagtcctccagtgcgtctgggtacagtggtctgggaaggatctggggctggggcagcgaaggctgtatgagcgcgtgctaggcatcagctcggcagagatgcaggcgtgcgagagctgcccctttcctacaagatcccgcttgccagatcatcccaacccccccttttcaaccttcccacccccaccatttcaggcgcgatgcacccgctatccagcgacgtggtccgggcgtgcctgcccggcggccaggaaaaggccttccggcacaacatgatggcgctgatgacggtgacaggggccaaaggctccctggtcaacttctcccagatctcctgcctgctgggccagcaggaactggaggggcggcgagtgccacgcatggcctcaggcaagacgctgccctgcttcgcgccatttgacgttggcgcgcgctccggcggctacgtgggcgaccgcttcctgtcgggtctgcgcccgcaggagtactacttccactgcatggcagggcgggaggggctggtggacaccacggtgaagacctcccgctcgggctacatccagcgctgcctggtgaagaacctggagccgctgcgtgtggcctacgactccaccgtccgcgacgacaccgactcctccatcgtccaggtgtgtttctgactgaggggagtggaaaaggggactgtgtgggcgtttgtgcctgtccagggggaggagcgatggctggtgtggtgccttgatcagcctgcatgccactctatcgaggtgcagggaggcaaggcgtgtgtgtgagagcctggcgccgacccggcatgtgaccagcacaacaacaacaccccctcccgcaccccaccgcgcccgcagttccactacggcgaggacggcatcgacaccacgcggacggggtgcctgcgcacgctgcccttcttctacggcaacatgccgcagctgggcaagatcctgggcgccgccacggccctgagcgggccggggctggtgggcaacccctccaaggagcaaggagaggcgacaggcgtggtccggtatgttgtttgttggggattttggggttgggaagcgaagcttgtgagtgtgcgtgcgatgcatccatgtaggagggaggtttgggtgggaccggaatgaatggctcgggattagctccacacgagtcaggatcatgcacgtccctgcatccaaaggagatgcctgggatnnnnnnnnnnggacctccacacgagtcaggatcatgcatgtccctgcatccaaaggagatgcctgggatcgccagccatagcacctgctctgggctggaaacccacaaacacaatctcaaccatccaggtcgtggagcaaggcgttgctggcgggcaagtccaagacgatggcaaagtgcctgcctgcggactcactggtttcccacgacaccctgggcatcacctccgaggggttccagggggcccttgccgaggccatgtacggcggcggcctgcgtccgcccgtcggccccgagcccctgggcaaggactacaagcgcgcggggaagaaggaggcgcgctgcctgtccaagaacaagccatggagcttcacgcccctggaccccatgggtgggttgttttttttttggggggggggggggggnnnnnnnnnncacgggccccagcgcgttgcccgtgctggcgcggcggatctccgccttgaccgcggcctggaagcgcgggacgaagacgtcgcnnnnnnnnnntttggggtggtcttgaggaatacctgttctgtcgtttatccctgttgtgcgccggcattgcaccgagttaccctggctgtcgagcacacgaccaaccctcgatagccccaccgggcattcccaagccttgtcaccacaaagattatccgaatctcttcaacccctctggccccctccccccaaccccacccatgcannnnnnnnnncgtggggggggtggaagcgcagcgtcacgcgcgccacgcgcgcgcgcccgccgtccaccgcgctgctgcgcgccagcgcgtcctcctccacctccagcgcacgcagggcctcgcccaggcgtacgcggcgcaggcgggcggccagcgccgccgcgccggcggcgggggcgctggggcgcagcggcagcgtcatcaccggcgtggccaggttgggcgaggcggtcatcaggatctcgcgcaggcgcgggatgcccagggtcacattggcctcgccccgccccgccatgtggaaagtgttgagcgtcatctgggtggagggctcgcccaccgactgcgcggccagcacacccaccgcctcgccgggggcggcctggcactgctggaagcgcagctgcattagccgcgtgaagtctgtgcatgggtggggttggggggagggggccacaggggttatggagattcggataatctttgtggtaacaaggcttgagaatgcccggtggggctgtcgagggtgggtcgtgtggtcgacagccagggtaactcggtgcaatgccggcgcacaacagggataaacaacagaacagatattcctcaacaccaccccagaacaggttgcccccctcccccccccccaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccagggtgtcgtgggagaccaccgagtccgcaggcaggcactttgccatcgtc

SEQ ID NO: 38885 - DNA, 73 bp, Chlorella protothecoides
tcctgcgaggagggcctgcttcaagggctcttgcggtcaaccctcgaccgctcctcgacatcctggcccacgg

SEQ ID NO: 38886 - DNA, 76 bp, Chlorella protothecoides
gggctgcagggccccggtgccttgaggtagttgtgtcatgattgacccaggtgcaccccgccccttcccccgcagt

SEQ ID NO: 38887 - DNA, 77 bp, Chlorella protothecoides
gcagcccctgggctggttgcggggagctgacccacgacgcatgtcatccgctacgtcgcaagagcgcccagtgtgcc

SEQ ID NO: 38888 - DNA, 79 bp, Chlorella protothecoides
tcaggcggagcgcatcgggccgattgctgggtcccatggtgcccccgtttcctcccctcccgtcttggagcgcccgctc

SEQ ID NO: 38889 - DNA, 73 bp, Chlorella protothecoides
gtggacagaaaaactccagaccccaaaggaaatggaggcatcacagcctccgatctatcgctacagggctagg

SEQ ID NO: 38890 - DNA, 62 bp, Chlorella protothecoides
cccctcaccacccccaccaagcccctcacctccacccccatcggcacccgcaactgccacac

SEQ ID NO: 38891 - DNA, 115 bp, Chlorella protothecoides
cgtggatgggtccattgtcacctcgtgagccgggggccttgttgcagagtgtcatgagatggaaggctgtggcatggaatgtggctgcgagggaggtggagggggttgcagggag

SEQ ID NO: 38892 - DNA, 61 bp, Chlorella protothecoides
tctctgagcggctgctcctgaagcgttggggcgtccaccacactgcaaaggacctcttatg

SEQ ID NO: 38893 - DNA, 168 bp, Chlorella protothecoides
ggatgggaagagcagcatgcttttacctacgatgcagtcctcccacactcagatccctattgtgaggtggtctttaagaccatttggtgccccttaagcccttccatccactatctctactccaggcactgctggccgggggagagtgcgtacctggatatgctcaac

SEQ ID NO: 38894 - DNA, 496 bp, Chlorella protothecoides
  modified_base (142)..(334): a, c, t, g, unknown or other
tcaaacaggatcacaaaggctttgctgcgcaatgcgaggatgatggggttgggtggccgggatgtgcacagggtgcattggtgtgtcgggagcggcaccatgcgtgggtcagtgtggcaccccccctcccagcaaggaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtggcagggggtgtcggggttgagccctggccacgaaagcgcaatcaatggcattgtgcacctaatggtggccgatgtccgagacatgccgcacacatcggcatcactcccaaccaaacctacttgtcttgaccctctccgtgcactatgatcaggcgct

SEQ ID NO: 38895 - DNA, 71 bp, Chlorella protothecoides
gggcgcctggctgtggccatggtaaccatggcgatggtcggatgtgagctgaatccccccagcagtcgctg

SEQ ID NO: 38896 - DNA, 74 bp, Chlorella protothecoides
cgggctgtgcactcagtattgtcccgggagcgtcgggctggggactccctctgcctgcgaagtgactcagaaag

SEQ ID NO: 38897 - DNA, 78 bp, Chlorella protothecoides
gagcaatcagcttgatgtgtgggacctcaaactcggggaggctttggacccagtcctccgctgcatggttggcggggt

SEQ ID NO: 38898 - DNA, 2838 bp, Chlorella protothecoides
  modified_base (126)..(283): a, c, t, g, unknown or other
  modified_base (356)..(365): a, c, t, g, unknown or other
  modified_base (821)..(830): a, c, t, g, unknown or other
  modified_base (2214)..(2223): a, c, t, g, unknown or other
cccccgtccaagtccagcagggccacgaggtggagcagctcggggtccacaccgtgctccctggaaatgtcggccaggccgcgacgcagcggcagcaggtgaccatcgcgaaggaggcgcggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagactgggagggaggggcccgcacatttggtggtcagcaatgaagaatcagaggggtccaggagggacgnnnnnnnnnnatgcccggctgcagtagcggggcagcagtgggttggaggtgccgtcctcggcgccgccggggcccttctgggcttttgcgggcatcatgggctccaggcaggcatggcacacgtggctagcagtcctgtgtggaggggataccggggggggaggagagtgggaggggggggcccgcacatttggtggtcagcgatgaagaatcagaggggtccaggagggacggcactgggcttgtataggaggggggacttccttgcgtgatcacatgcgcagtaaacagcgaacagaaggcaagatggaccatgtggtcgtacagctgcctcgtgtcttgatcatcgatctgtgtgccaccatgtgtgagagcaccctggagcccaagcttgccatccatgcgccccaggcagccatgaggccatcaccaggggcccctccaaaaccacatctgcatcgcaccnnnnnnnnnnacctcaggcagccacgaggccatcaccaggtgcccctccaaaaccacatctgcatcgcaccctgagcgtgggatcagcagcaaggccctttcctgcatgacgaggcagcctgcagggaggtcggtgtcggcgacggctgtgcgccccacggcacgtccaccatgcccgggagtccagggcagggcatcctggacagcggccacggagggcagggtctgctgctgcttggacgcctggtgcggggtttggtgggggcggtcatggccatcaggtttgtagagacccgggagaagcccggtgcgtgatcagcagcaggtttggatggctcgttagaatccgccaaatgtctcaaagcaagtcaatcggtttctttggaggaatcgcgcatgtgtcttgtgttgtttgctggagttcattacatccccgtcccgctcaggagtgagtcaccagccggccgggactccaccttggatttcgccgggctctttgggtttggcgatgaggtgcggaccatgctgcctgtgtcagtcggaatacggggttcaatgtgttgaactttggtatccacgagaattgatgacagggcgattctccgtgctggccctcgtgccggggtgcagtcagtaatccttcggcctgccacgccaccgacccgcacctgtgccgtacccagatccccagagacggaatctagaatttcaatatcggcgcagtatgatttcgataggagagcttccacatcctcctcgtgagaaggctttgctttctgtacgaattgtgtgatgacgtggccgactcggcaactgtggaccgcccagcatggttcatcgcgcgctggccatgatgcgcccaaaacccctgccccagccggcgcctggcctcacactgctgagtacccctgcctgttgtagctcaggataaagaatctgcatgcgcgacgccggctcgcgctgcacgacggacggggtttgtcccaccaggtctcgcaacccccgtcaagcatggtcctgatcgcggcatgtcgccctgcctctcggccgcacgacttcccagcctgagacccttgccagcctgcaccagggcgggaccaggggctttgccgagccccgtcccgagcatgagggtgatctttgttaccacagaggtggcgccctggagcaaggttgggggcctggcggacgtcatgggggcgctgcccccggcccttgcagccaggtgggatggcgtgggtggcctgggtcgggctggtcaccctggcaagtctcgggacccctggcttgggccggtgccggagtgcttgtgggtcagcggcaggacggccaccgccgttccgtcgcgcttgcctgacccccctaccctccacacccccgtgcaggggccaccnnnnnnnnnnagcccttgcagccaggtgggatggagtgggtggcctggttcgggctggccatcctggcaagtctcaggaaccctggcttgggccagtgccggagtgcttgtggttcagcggcagggcggccaccgccggtccatcgcgctttcctgaccccccttaccctccacacccccgtgcaggggccaccaggtgatgaccgtgtccccgcggtatcaggcagcggaggatgtgctgcccaccgacctcagcgtcccgctggacctccccgcccccgaggagcgtggccccgacgagggcgatgaggaggccgatgaggccctggatacaacggcgcgcctgttcctggcccggcaggacggcgtggaccacgtcttcgtggaccacccgctcttcctggccggcggcgacatctacagctgcggcccctccctgggggtgaccacctacatggaggcggggcagggcgcggccgccgcgtccctggacctgcggtacagtgtgctgtgtcaggccgccctcgccgccccgctcctgctctgggcggcgggcgtgcgcgaggcggcggccgccgcggccgtcggcgcggcgatgggcgctgcgctggacgcggcggctgcc

SEQ ID NO: 38899 - DNA, 122 bp, Chlorella protothecoides
cttgactccctttggggtttgtgctctcctgctgtgtggtgtcctctcgccccaggcctctgcactgcctcagtctcctccccttccccccctcccacacagtccatcaccaccgccgcgcg

SEQ ID NO: 38900 - DNA, 61 bp, Chlorella protothecoides
gagcaggccagagtcatggaaggcgaagcaaatgatctgcgccacgcggcctatgatgtca

SEQ ID NO: 38901 - DNA, 137 bp, Chlorella protothecoides
ccttcaagaacagcgacaggccgcctggcgtaggggttcgcgcgagggtagggacgtctgcgatccgacccctcgttcccgtccagcaggcttggacaacccagccccggtgtccagcacaccatgctcccctcccc

SEQ ID NO: 38902 - DNA, 61 bp, Chlorella protothecoides
acatcaccgctcctcatggggattggatggtgcgggcccttggctgcaccacagcagcaag

SEQ ID NO: 38903 - DNA, 89 bp, Chlorella protothecoides
gacgcggcgctgcaaggtggtggagtggaagaaggggtgaatgaagggaaaggggaactaactgccgacctttgcgctcacattggtgg

SEQ ID NO: 38904 - DNA, 61 bp, Chlorella protothecoides
tcgcggagcctgggcgacgccgcggcgcacgcgctgggcgtctgtgcgacgccgcgcctga

SEQ ID NO: 38905 - DNA, 61 bp, Chlorella protothecoides
tcgtcgccgctgtcgtcctcgcctcgcgtcaaggcatcggccttcctgggacgaggcttgc

SEQ ID NO: 38906 - DNA, 101 bp, Chlorella protothecoides
gtttgcgccggctcggaggctggggtgaaagaaaagtgatcggcatggctgcctcatccgacagagtgtgattgctttggtctccactcagctccccagca

SEQ ID NO: 38907 - DNA, 61 bp, Chlorella protothecoides
tgatattgcacctgccaagaacaagatactaagggatgccacggcactcacctgcacagga

SEQ ID NO: 38908 - DNA, 72 bp, Chlorella protothecoides
acttgccacaatggcatgcatgcatgcatgcatgcatgcgtgtgtgctgggccatttctgtcctcctgaacc

SEQ ID NO: 38909 - DNA, 61 bp, Chlorella protothecoides
tggaagtagcgaccgacatcgaatctaccctccagccactctgcaatcgggtttggcatgg

SEQ ID NO: 38910 - DNA, 72 bp, Chlorella protothecoides
gcccagctccagtccagtcgcaagccaggcatctgctgtgcacactgggtgcaaggccagccaatgcaacgg

SEQ ID NO: 38911 - DNA, 76 bp, Chlorella protothecoides
aacgcctcccccatcaatccccgcccatcctcgacccatgcagacgatgctggacgaggcggtggccatcgtgatg

SEQ ID NO: 38912 - DNA, 80 bp, Chlorella protothecoides
atctccttcctccgccccaaggtccgctgggaacaggttgtggggggattcctggagtcgcagcggcacagggcaccgtc

SEQ ID NO: 38913 - DNA, 13761 bp, Chlorella protothecoides
  modified_base (1245)..(1254): a, c, t, g, unknown or other
  modified_base (2419)..(2428): a, c, t, g, unknown or other
  modified_base (4014)..(4023): a, c, t, g, unknown or other
  modified_base (4339)..(4348): a, c, t, g, unknown or other
  modified_base (5412)..(5421): a, c, t, g, unknown or other
  modified_base (5826)..(5835): a, c, t, g, unknown or other
  modified_base (6113)..(6122): a, c, t, g, unknown or other
  modified_base (6279)..(6288): a, c, t, g, unknown or other
  modified_base (7129)..(7138): a, c, t, g, unknown or other
  modified_base (7597)..(7606): a, c, t, g, unknown or other
  modified_base (8047)..(8056): a, c, t, g, unknown or other
  modified_base (8775)..(8784): a, c, t, g, unknown or other
  modified_base (8865)..(8874): a, c, t, g, unknown or other
  modified_base (10582)..(10591): a, c, t, g, unknown or other
  modified_base (10701)..(10710): a, c, t, g, unknown or other
  modified_base (10831)..(10840): a, c, t, g, unknown or other
  modified_base (11031)..(11057): a, c, t, g, unknown or other
  modified_base (11270)..(11279): a, c, t, g, unknown or other
  modified_base (11359)..(11368): a, c, t, g, unknown or other
  modified_base (11447)..(11625): a, c, t, g, unknown or other
  modified_base (12984)..(12993): a, c, t, g, unknown or other
cccccgcccccgcccccgccccgcccgccgcatcagcgaacagcgcggcgaccagggggtcgcaggactcggcggccagggccgagtgctccgccaccacgaagtcgcggttcttgtccagcaggccctcgctggcgtaggccacctcccctgcgtagtgctcgacggcgaagcccgtgggcgcgcgcttgggcgcccggaagcagggatgtgcggacaggcgggagcgcagcgcgcgcgccaggtcggcgtcgcccgcgccggggacgcggcaggcctcgtcaatcagggggaagacgccggggagggcggggccggcgccctccagcaggtccaggcagtcctggttgtccacgaagtcgacgtaggaccaggcgatgccctccgccgcgtactctgcctgctcgccctgtggtcatggggcgtttggtttgggaggttgaggcagggctgggggggggcactcagggtggcatggtgcggcgcgtatgaggggcgtggcgcggacgggccaaggcctttgcttgcgctgctccgtcccacccgattcacacagcagccattgtgtcgtcagtccggcccctgaataccagcccgacaaaccttgaagacgtggccattgaagtgctgctggaggcgctcgttggccaggttgatgcagagctgctcgaaggagttggtgtcgaaggactcgaaaccgtagatgtccaggatgccgatggagcgcgcgcccgcgccgcccgcgcccaggctgccgatctttcggttcacggccgccaccagccagtcgaagaggcgcgcgtacaaagctttggccagcgcgtcgcgcgactcggccgccgcctcggcgcccagcgccttgacgatgcgctcgccgcgcgtctccagcacccgccgcgtcagcgcggccagcagtgcctcgggtgccacgcccagcaggcgcgccgcaatctccaccgcgtcctccgccgccacgtcggccagcaccgcgtcgtcgcagtcgtcctcggtggcaaaggccacgttgcccaggtgcagcacggcggccacgcaggaaagcacggagcgcaccgccccggcgtccagcccgatgatgcgcagcgcgtccagcgtgtgcctgtttttggatgagggagggggaggtgagggaggggggtggaggcagggtgggagatgtggtgagctggcgcccggcatgcaagcacacaatcctgaagggtgaggggacgaggctaccgagtgacnnnnnnnnnnatccagcccgatgatgtgcagcgcgtccagcgtgtgcctgtttttgggtgagggagggggaggtgagggagggggtgggaggcagggtgggagatgtggtgagcttgcgcccggcatgcaagcacacaatcctcaagggtgaggggacgaggctaccgagtgacgcgaggccgcggcgcatgctctccacctccagagcagtcgacccgaaacacggatggcctcacccaaactcctcggcgtcgtccacgtgctgcagcaggaccgcgtcggactgcgccaggtaccggaagctggacacgccaccctccaggccaaactcgcggcgctgctctcgcgaggcgccggccaccagctggtagaagatgtggtagctgcgctcgggggactttatgctgaccacccgggacctgcagtgtaaaggaggagggggggagggtcttgattgcatgtgctttgaggggtgcggtgtgataaggggaaggggtggtgcgcgcgcagactcagtgatggggcccccagctggtgggtcagccgaggacactcctcacgtgccgcggcccggaatccctgtgccgcctggccagcagctgccaaacaccctcctccacacacgaccccatgtaggtccctgctcccacattcgacatgctgccacccctcccccagcaccatgcacgaaccccccgccccaccccctcccttcccatcaacaacgtaccgctccaggaggtaggtggagatggaggcgcccaccacccgccccaccgcatcaaagtctatctgcacgaacttcccgaaccgggaagagttgtcgttgcgcgaggtcttggcgttgccaaacgcctccagcagcgggttggactccagcacctgctcctccacgggcgcggcgccggaggatgccccgcgcgcatccgcgcccgcctcgccgccgccgtttgcggcgcgcccgccgccggctcggtgcgcaaggtactgcatgaccagcttggcgctctcggtcttgcccgcgccactctcgccggagatgaggatggcctggcgctgctcgtccaccatcatggcgctgtaggcctgtggatcggggagggggtgggaggaggggtgaggggcgaggcgagcaggtcggggtccctgggatctgtgcagggcctgtgagagnnnnnnnnnntgatgggcgaggcgagcaggtcgggttccctgggatctgtgcagggcctgtgagagcaccacgcgccacgctgatcatctgaacccagtgccccaagcaccccgccaccctggatcacacctgctccgcgatggcgtagacgtggggcgacagctcgccgagcgccgcgccgcggtactgcgccatcatgcgcgggccgtagaggccgcggaccctcttgtgggggttcacggcgatcaggatggagccggagtaggtgtagatggagtccagcccgtaccgaacgtgcagggtgtgcaggatgctgtgcggcaaagggcggagtgggtgatctggtgagccggtgggggagggaaaccaaagggaacccatgcatgcagtgggaggtaggagaagcatgcaggtggcgatgcgtctgaggcccgggcggcgggtcgatggagggccgccctcgacgggcaggattcaggagcgtctccctgttcgtcaactccctccactttccggcacacaccctggctcgtgcaggaagtcggacttgaccaggtcatcgatcacgtcatccctctcattctgcgcggatgggggaacgggttcggaggtgagacccacaggacacgaccaccccctctccacggccccgggcacagccctgctcccgcgcggcagctcagacttgcctgaaggtggacgctggtggccgtgatctgcacgacatcgccgctggtcagccgaaccttgaggtcgacggcatctcctttccgctcggcggcctgggggtgtggtgggagaccaggcgctcagtggacaggagaggacacagtcgtgcttgccaggtcgtgcaactgggcaaggtgccacgggaacataatactgcaggtatgccagagtgtagaaagaccaagctcgtgagtgacctccaactcccaaccgaccgcctcacctgcacaatgcctgccagccagtgagtgacacgcttcctgctgccgtctgccgcagcggacagcaaaacctcgactcgtggggcccatactgccgtgccttgggggtagacctgcggggtggggatctggccgtcgccacccattgggaaagacgacggggtggagggaacgcgagacaacaggggcgctcaggcagcccgagccccttcctgcctgtgatagaccccgctccagtgggatagaagctttacggcccagagagggcattgttcgcccccccaaagggtgagcgcggtggacggttcgttggcagggatgcccaggacgacgacagtggtacacggggatgtgggaggctcagccaggtgtggggcaatcccatcaactcattcttgcagctctgaggtatagttcggggtggatcgtcgtgtcctgcatcaaggcttactgccagatcacttggatcgcgcgcgagcttggcgcgttgttgaatccggagcagcaaggttgaaacaggatggctcagaggtgtggagccatgatgtccaatctttgcttcattgccttctcaactgggattgttatatctgagcaaggctgcatggaccttgagcgaacctctcgaatggccagcacatgacnnnnnnnnnnattgaaacaggatggctcagaggtgtggagcgattatgtccaatctttggttcatggccttctcaactgggattgttatatctgatcaaggctgcatgtacctttagcgaacctctcgaatggccagcacatgacaaagccaactttctatgttttctcactgctgcactccagctgtggtgtgtctaatcttggatgacagaatatgcttgatatgtaagcagcatgtcgcttggaccatttgaatggtgtagtgggactctttcatatgctccacgagcatcccttgtagaatactttgacggattctgacgannnnnnnnnntgctttgactgtttgaatgatgtagtgggactctttcacatgctccacgagcatcacttgtagaatactttgacggattctgacgatcatgctccacaacaatgcgtaaagagatccccaattatggtgcggatacaccaactctatcaaataaggtagtcagcgagttctgaccaatcaatgggcaggcatgtcgtcatagaacagatcaccctagggacgcttacgtaaggctcaaacctcttccctccctttcatagggcttcacacccacaccgaatcgctgctcaacgactgacgaatatttcagtaatagcaggtcgaccggtaccctttgattgtgagtgcgctgactgggcggtgtcatctgctccgccgaccagtctagggcttcggcccaacacatcgccaggtccaaatcgatgagatgtcgagagccagagcccttgtgaatactacagtactagcatgctgcatacttgtttgttttggcaaagcgccgtgcctcgacaccctccctatcggggtttggaggaccgtgctccatgaggtgagggtgggaggaatgctggcaagcactgcgagtggtattcttggagaatgtgggtgccgcaaggaacactcaacactcgacccgaatgtacaggagccaaacatcatgctacagaagctgggagcggtgagctgggttctctgaagctatgcactgggactgggtgtgggtcagtgtgcgccggcatacgtttctccaggacctctcagcccctcgctcctcactcactccatcaaccaaaaccacgaggcaggtgtcagacgacccagcggtgctcacccgcacctacctcagccctgcgcatcgccaggccgcccagctggtcaggctgtgttggaggtggctggcgggatgttccgtgctgcatcatgcctggcttttggacccctccacacctctatgtcattggatttcggcgctgacagcttgaatatgcagaacagcaattggcacccaacccccacacgatgactgcccacttccctcccctctcacccgcccagctcaaggnnnnnnnnnnctcacccccctatgtcattgcatttcagcgctgacagcttgaatatgcaaaacagcaattggcacccaacccccgcacgatgactgcccacgtccctcccctctcacccgcccagctcaaggcctggatgcaggcggccggcatggacagctgggtggacgccatcgggaacgtgcacggccgcgtggagggctccctccccggccccgccaccttcaccggctcccactacgacacggtggtggatggcgggaagtacgacggcgcgctgggcatcatcgccggcattgcggccgtgaaggcccttgtgctggaggtttgtgtgtgtgtatgttgcgggtttgggggggggagcaggggagcgggcttcctcctgtgctgcctggttcggcaagctcagagtgnnnnnnnnnnttgtgtatgttgggggttgggggggtggagcaggggagcgggctttcttgtgtgctgcctggttcggcaagctcagagtgcatcacggcggctgctccccgctgatgcccctgggtcggaggcaccaggggactgcgtgggagggcagcgccggcgccttgcctggtccacccccctgaccaacaccccttcttcatgccccatccaggccgcggtggcgcggggcgcgctcacgcgggaagaagctgctcggttgcccgtggaccctgctctgggcnnnnnnnnnnaccaggccgcggtggcacggggcgcgctcacacgggaagaagccgctcggttgcccgtggaccctgctctgggcacgacggcgctgcctaccaccttaaatgccagcgcgcttctccgtcgcagcttgcgcgtcgtgggcttcgcggacgaggaggnnnnnnnnnngaatgccagcgcactcctccgtcgcagcgtgcgcgtcgtgggcttcgcggacgaggagggcgtgcgcttccagtccacctacctgggctcgcgcgcgctggcgggcagcctggcggcctcgggcgcgctggacgcgcgcgacggcgcgggtgtcacgctgcgggaggcgctggcggccgaaggcgcgggcgacgaggccgcgctgcgcgcgctgggcgtcgtgccgagcgccgctcgggcctacgtggaggtgcacatggagcaggggccggtgctggaggctgccaactcacgcctggcagccgtgtcgggcatcgcaggccaggcgcggctgggcgtgcgcctcgctggaagccagggtcacgcggggacggtgcccatggccctgcgccgcgacccgctcccgggcgcggccgaggtggtgctggcgctggagcgcctctgtgcgccgggggggggaggcggagccggcacgggcctggtgtgcacggtcggcacgctggcgctctggccgggagccagcaacgtcatcccggggcgagttttggaggggtgtgtgaagggggtgggaagagggcagaggaaggggtgtttgccagaggaggcttgacatattgtttctaggagttggcaggtgattcttcagcattcctacgtcgctggcctggcgtctgagcaacaatcccaactcgcaagcagcttacccgtcacgagtagcctcgaatgggcgcggggtgaagcgcccactcttgccttcccccccccgtgaccatgcggcgcaccctcgtcttcccagcccccacccctctccggcatccagatccgtccagctcagcatggnnnnnnnnnncacgtcgctgacctgaggcctgagcaacaatcccaactctcgagcagcttacccgttacgagcagcctcgagtgggcgcggggtgaagcgcccacccttgccttcacccccgtgacgatgcggcgtaccctcgtcttcccagcccccacccctcttcggcatccagatccgtccagctcagcatggacatccggagccggtccgactcggagcgcgaggccaaggtgcgcgagtcggtggcggcgctggagggcgtctgcgcccgccgccggctggactgcgagtgggagctgcggcaccaggcccccgccgtgctggccgacgagggcgtgacccaggtgggtgctcggtagcggtgggaggggggtgggaggggggcgagtcgtggagggggggagcgagagaagttggctgctgggcttgaaccatgtcgctgaaaaggggatccagtggggtcgnnnnnnnnnnacggtgggaggggggttggagggggcgagtcgtggagggggggggagagggaagttggctgctgggcttgaaccgtgtcgctgaaaaggggatccagtggggtcgctggaccgagagagtatgatcgacggatgccactggatggcatcccatcccctcccatgcctgatctgcaaccaacctacctgagtatcttccctcccccgccctttcctccctcactccaaggccctgatggccgccgtggcggccagcgccggcctgacggacgccatcctggctgaaggtctcgcaccaaacacaccggcaaacgcagacggcgagggtgccggcgaggagcccagccacgggtcgcccccggccggccacgctccagccgccggcggcggcgcagccgtcgctgccgccgcggccggcccgctggtcagtggagcagggcannnnnnnnnnatgaggagctcagccacaggtcgcccccggccgcccacgctccagccgacggcggcggcgcagccttcgctgccgccgtggccggcccgctggtcagtggagcagggcacgacgccgcggagatggcacgcctgacgcgcatgggcatgctgttcgtgcggtgccgcgccggggtgagtcatagcccgctggagtacgtcgcgccggacgacgtggccgccgcgacggcggcgctgcatgcctacctggccggcgaggaggccgcgtgatgggcagctggcatcggatgcaggggaacgctgcatgcggcacatacagcgtccgctgctgttacagcgccgacgaactgatctggggcaggacaagggtcacaagtcgagggagcacggtccaagacatccagcgccgcgcgccagctcgcgccgcgcgcctcatcaccggcccgcgctccttggggtgcctatgctcaggcagccagccacccccgaaacacacacacacgcgccacctacacggcgtacaccagctccctccagacaggccccaccgcctcagcccagacacccagattgtccagcagccgatggatggcggggagggcgtcgcggcgcaccgccgccaccagctgcctgcagaggtcgggaggaagacgcggcgggaagtgtgtaaaactgttggcagatgggcgtggtcggacgctgttggatgccctctgaccnnnnnnnnnntccgcgccaggcacctgaggaggatgacttggcggggggaaccgcctgccggctggctgcttggggtcaggcagatgtgcnnnnnnnnnngagtgtgtgaaactggtggcagatgggcatggtcggacgctgttggatgccctctgaccaaacagggcacgcaccatcttccagtcacagaaagcatggtacgagcaatgtaaagcccaggacatgggaccgccacagccgcgccatgcacctaaggaggatgacttggcggggggaaccgccggcaggctggctgcttggggtcaggcagatgtgctgggagtccaggagctcccgcttgctaggctgcagatgggtggtacgggtcgaagatgccagcatcgatacgtcggtcgaaggtcaaggacccagttctgtgcacaagcaaacatactgccatcgcagggcacatcacaggcacgcattgggagccggaccatcaactgcgcaggccgcgtcgcggttactcacccgcaccggcggcaccatggggctgccgtcctgcaccaagtggtctctgccaaggccctccagagcgcccggccttgcacacaggtttggcatgtccggctgagaggatgggggtgagtgggagtcttgggctgcaggttattccttgaactcagcagggctgtctcatcacaagccagtgggccggtgaaccttcaggaacggtgagcatggggtgtggtctgccaggatgcgagccaagccattcaggcagccagcactatcagcagtcctcccccttgcccccaagggacccaccgactccagaacaggtgcagccttgctaaagggaacccagcactgattgatgggacacagcaggtctgatggctggtactccgcctgcagtgccgaggggcagatcaggtggcggcatgtcactagtgtcaagcaaggtccagcaccgttaaccgcttgaagagctgcacatgccatccagtgagagtgcttggcaagaacccataccacatgcgagccgtttcgcacccccgcatgcgctcatccagtgggtgccagcaccttgtagcgcatgcggtggcaggtgtggaggtagaagccgaggtagtagtagcgcagagaggggcacacgagacgggcctgctggatccactcgatctccagcaggctggacaccttgccaagcgaaagatgggccaggtctgtggagtgcagatcagcatgaaaccgtgtaaggattgaagggcacagattgaagcattgcaccccacataaagggtcaacaccagtgcaggcacccaatgtcaacatccagttttggagtcaaagagcaaccaaggtacatcagcgagattatgaaagaatccagcccattaaaaaccgttcccaccctatgacctgggtcccagaaaaagtacttgctggagatgcaggagggcaggatgtcaatcacgctgacggcagccagccggcctgcacagagatgcattttgggtgagtttgctactcctatcctgaacttctgccttcggcagggacctgggtgcctaatctcagccctagacctgctctctgttcaagcatgtgcggtgaacagctccccctgtccacattttgctcaccatccaaccagtattgctgatggaaggagccaaacccctgttccaggcatgaccccggcggggcacctctgaagggttccggtgtgagcggggaggagcagagaaagtgcgcaaatgtcttgcgggtgacaccctcctctgcttccttgtgatgatggacctgggaggtggcatgagannnnnnnnnngtcggcagggacctgggggcctaatctcaaccctagacctgctctctgtttaagcatgtgcggtgaacagctccccctatccacattttgctcaccatccaaccagtatnnnnnnnnnncgagggaaacgttctcgttcgcaatcagggaggcggagtgagccagcctcaaatgtgcactgcagagtggcaaggagatagctgatactaatcgatcatcatgtgggcatagcaagggcgnnnnnnnnnnagagggaaaggttcgacttcgtgatcagggaggcagagtgagccagcctcaaatgtgcactccagagtggcaaggagatagctgttactcatcgatcatcatgtgggcatagcaagggcgagggcaccaaactatctggccaagttacatcagcgtcctggcaccttggcaaagccgcccttggaaacacnnnnnnnnnnnnnnnnnnnnnnnnnnncgtcgctcaaaggagtgggccaggccggcatggatgtgggtgatgggttccacggcacccacctgcaaatccagagggacaggcatgagctacgatccgtcttcagagcctccagggctcattagaatggcacagctcgacaaagctcaccaacaaggtgccactttcttcctggccacatgccaggcccaccacctccatgcccgtcttgcnnnnnnnnnncggcactgagcatacctggtactttttgaagagctcaaactccgtttcaggcaggctgggatcgtcatgggggagaagcnnnnnnnnnnggcactgttcatacctggtacttcctgaagagctcaaactccgtttccggcaggctgggatcgtcatgggggagaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctcaccaacaaggtgccactctcgccctggccacatcccaggcccaccacctccatgcccgtcttgcctgtgactctgtgcctgaggcacatgcaccctgtcggcgctcccatgggaaattgaggtgccccttggccacctctacctccgcccccaatggcagtcgctgcaatagggttcgcagcgcctgagcgacctccctcgcctcgacgccggtgcgcccctgccgcctcagccaggcagccagcacgaaggcgtgggcagaggtgaggccaaggatgccctgcgccttgcccttgccacacctctgcgtgaatcttgccgggggaggggccggcacagcggggtgggaggcagccaggtacctggcagttgcgccatccagtgcctcctgcagtgcctgaatggcatcctggagatccgaacctcctctcgtcgtggcacctgctgccggcccaggcactgtggcatgcgtcgcttgacttgtcgaggcgtcgccgtgccgacaagcagcgctgccttcggccgtcgacatggtgcccccctgcaggtagcgcctccactgcgccagcaccttgcgctgagccttgctgggcctgaattgggccgcctcgaggcggatggtgagcagctggcagcaggtctgcaggtggcagggcttgtacagccacgtgcctgatcgccgccaccccctatacggagtgggggaggtcgctgggtcgctactttatgtgaaagaaggaagagcaggatcagctctactgagaccagcacagggtttctgaccattcttaggcctgattggagtcttgaggaagagtgtagagcagcgagccggttacaaggcccccctaggttgcctgtttccatcccctcccaccaccccacagctcaacctgtccagcagggcattgtatgtctgcacactcatgtcctcggcggtcatgccgtgcgcggaggaggcatcattcttcccgcagtaggcacaatgcgtcaggtgctggccgtaatcccgcaccagcgctccctccatggcgcaagaggtggggcccttgagcctcccgacacaggtcagggggctcaccgactcgccctgcacatgcccgatccctcgagcgatggcatggatgaaacaatttgaacttaaaagtagattgtagaacaagactccctctcctatcgctctctttggtcctcggtcgcattcctgtatcatggtccgtccctcggcatcaaggttacccagattctcagccttcgctgaacgccggagaggagtgcctgcatacgtctccaaaacccccgtactcgatgccctaccgtcagtgcatcggtcagagtgtgccttattgtttnnnnnnnnnnggtgcctgcatatgtctccaaaacccccgtactcgatgcccttccgtccgtgcatcggtcagagtgtgccttattgtttacagatcccgtcaacttgctctggcattggcttccaaggggttccatgagaagcacggatgcacacgtcactcaccatgcccgccgcctccccgcccgacgtcctcacgcccgcgacaggcacaccctgcgcaggatgtcggtcagcgtgatgacccccaccggcctcaggtcgttgtcgcacacgtacagccggtgcagcccgttcttgaccagcttggccacaacagactccagcgtggacgaggcgctgcacatcaggggattgtacggtcggaaggcggggcgcagggagatcatgatgtgccctcaaatgccgcatgctagccgagctcggttgcacggcgcatgggggcctcccgggcatgcatcagggcatggcaccgctcagctcttcccccccattccccccgtaaacacccaccgacctcccatttggtcacctgcacgtcaccagctcctgcccgacatccgcccccggcctggctggccggcctgcaaggaaagcgtgcctgggaccatccccctgcacagtgaagcaggtgttgttaccttgtcggtttgtctgtcaactggggcggccgtgccattcttgagcatccctctcacacattccacagagaataccgtccgtccttggccccccaccaccaccaccatatacaaatcacccccaccccccacccccat

SEQ ID NO: 38914 - DNA, 61 bp, Chlorella protothecoides
gcgtggcgtgagtgattgcggcaggggagggtggggggccgcatgccgagcgatgagcagg

SEQ ID NO: 38915 - DNA, 78 bp, Chlorella protothecoides
agcggcggaggcaagcacccttgaggaaagatatggggaagggggtgcctcttaaagaggggggccccccccttggtc

SEQ ID NO: 38916 - DNA, 80 bp, Chlorella protothecoides
cacctcttccttatggacccgggtgctgtggagtttggggactcggtgcatggactgtgcctctgacactcgccacactc

SEQ ID NO: 38917 - DNA, 110 bp, Chlorella protothecoides
atactccctggcaaggttgtctgccccccaaacccacccccccaatagcattcaaccccgtctcacccggcacaacttgggtggggaaggccacggccatggtggagtca

SEQ ID NO: 38918 - DNA, 61 bp, Chlorella protothecoides
ggggatacactccctattccatcacttgcaacctgtactcaaatgtcttcttcaaactcgc

SEQ ID NO: 38919 - DNA, 171 bp, Chlorella protothecoides
cccttctggcatgatttacatgttgctataggcttgcttccccttctggccccacgcctgaatcgtgggggtgctccctgggaccagcttgaccccattactcccgctccttgaccgatctggtgccccccttccccacactgcctgaaatttgcgatgttcttatcgagt

SEQ ID NO: 38920 - DNA, 78 bp, Chlorella protothecoides
atagccgctgatgtgctagatcggcacagggcacctggcagtgcccggactggggcgagggcaagtcgcacatggtcc

SEQ ID NO: 38921 - DNA, 68 bp, Chlorella protothecoides
catgggcggagccgcggccccggacgtcgatgcctgcacgccgcgcgcggccaagcgcgcccggccca

SEQ ID NO: 38922 - DNA, 20178 bp, Chlorella protothecoides
  modified_base (4859)..(5048): a, c, t, g, unknown or other
  modified_base (6189)..(6198): a, c, t, g, unknown or other
  modified_base (6286)..(6548): a, c, t, g, unknown or other
  modified_base (7337)..(7346): a, c, t, g, unknown or other
  modified_base (7478)..(7487): a, c, t, g, unknown or other
  modified_base (12199)..(12208): a, c, t, g, unknown or other
  modified_base (12452)..(12534): a, c, t, g, unknown or other
  modified_base (12804)..(12813): a, c, t, g, unknown or other
  modified_base (13029)..(13038): a, c, t, g, unknown or other
  modified_base (13303)..(13312): a, c, t, g, unknown or other
  modified_base (13682)..(13691): a, c, t, g, unknown or other
  modified_base (13928)..(13937): a, c, t, g, unknown or other
  modified_base (14654)..(14663): a, c, t, g, unknown or other
  modified_base (15652)..(15661): a, c, t, g, unknown or other
  modified_base (15738)..(15747): a, c, t, g, unknown or other
  modified_base (15824)..(15939): a, c, t, g, unknown or other
  modified_base (16956)..(17103): a, c, t, g, unknown or other
  modified_base (18494)..(18519): a, c, t, g, unknown or other
  modified_base (19875)..(20114): a, c, t, g, unknown or other
gggggggagggggagaaaggggtctggggttggaaggtggggttccgtgagggtcatggaaagttgagagggcgggacggtggtgggacggcgaagcgagtgaggagggactttgcaacatacgtggccatcccgccctcacatttgtgcctgctgagcatgctcctgcccgacacccctcccccacccccgccttgcgcaccccaggcctgggagcacggcttccaccgcctcttcgaccttccccgggatggcgagaggtctgcggagtacgaggagtacacccgggccctgcccaccatcactgtgggcaacatcgtgccagaggtgaaccctcgcctgggcgcgacacacatgaccattgcgtgagtgggagtgactgggaggtggtgagctcgactggttcgggcctgctatgcagatgcgctgcgcatgtgcacatcgtgagtgctgcgagagtcgaccaccccctaccaggagtatcatcgtgaaggctgccatgcagcccgctggcgattccctcagagcctcctcccgcgaggccatgcaaactgagcagcgccatcctgcaggaaccttgcgtgcctctgccctggggcccccaccccaccctcaccctgcccacatactccccgcccacacaggttacagcagaggccagagcggaacacgacgatcaccatcagcccggctgagccttggctcgtgagcgtgagcccccgttccatcagtttcactaccgacaactggagcgagagccagcagattgccatcaccgcacgtacgcatctctgagtcttggtggcaggagggggtccagcaggctgtgcggcatgcagcgctgcctgctgcacaccgttttggtctcatgcagtcctcaccctcatctgttcttcgccacgccgccgcacaggtcccgaccgacccgagacgagtgcgacgctccagttccaactcaacctgacctggccggttgtggacgaggccgggaggtggtctgagcgtatcaagtcgatatcgtgagcgtgaggcgttggaaaagtgcatgcctgctgtagaggctacatggggagatgtgctgaggagtgtggcatctccatcgcaccccaatctcccacacatctccccacgtcccagcggtgtcgtgtgggccgagcgcaagggtaccagcttcttcaatccccaggaggtccaggcccccttccgtcatgtggccgatctggaggtgtgaggggccaggggtgggcagtggcatcacgtcacctgagttggatcagatgtcctgcttggcagcacggtatgcggcccgaagggaacagctgaagcacctcttgacgtgcccaaactcaccatgggctccaccagcaccctcctcgtcggtcaccccgcagaggttcaaccctcaagtccccctgatcgctcaacacattggcccctttgtccctgcccaatacttttcctacaaggcaggggagtctgaggtgagcaagctgttacgcctgtccgtgtctcattgctgttttctgaccggcttgatccaggcaacggcgcatgggcaggactgcatgcccagctctgccccacgcccggcacccatggcagggcatcgtcattgagacatgcccccatacgagggacccaaacgcccacaacatgaccgcgaccatcttcgacagcctatgggctatcaacaaggccataccgtgagtgcgggctgagtgcggtatcaatgatggcagaggagctggggacgagtttcattggggctgtggcatcagaagacaagcacaccatgctgacataccccactggcgcacctcctgtccagacaacgtaccaaggctgtcagcattcctcgaacgggatgcacccaggtgctggcagggttgcccggcggacagagtgagctgggtgtgcctgggaggggttatgccgtgtggtagagaactggggtccagggagtgcttgacacagcagtaaaaagacaagggcggccgtcgcagagtgtgctttcatgtcagaccatgtatggaggatcacccctccaattcacgttgctggaccccaactgcagcatattacattgtgatgtaccccaagtcacctttcacggtgcctgggggcgccaagcacctgaatcagaaagcctccatcaccattgagagggttccactccctcaggtagggcctcctcatggtcaccagggtgaaggcctaacacaatggccatcagctgcaaccagtctgcctagatctgtgagacattgattggctctgacatgctcctgggttaagccaatctgctaacactcccccaggtcctggaccagctggagaaggagggcgatgtgtccatgatcactagtctgcccgccagggaaattgtcgaggtggggaggggccgggaatgggcggttgcacctgtgagggaccacttcagaccgtgtgagaagatgaccacctctcagctcggttcctttgcaacgcaacacctctgcaggccagtacgaccccaaccacctactttttccgtcctgaggcggacctcacggtgaacatcaccacctgctcggaggagacaacggtagggagtgggctggaggtcctagacgatcacctcaggattatccggtgagacgggtgggcgaagagcttgctgaggagcaacgaagaaggatcgtgaccgtggagcttgcctgccgtggagaacacctggtcattgatcgccccagctatgcgctggaaagcatagcagtgatcctcattatcggaacctgtggcatgcagacaaagtggggcccccacaggcgacagctgcgccacactgagtgcactgaagctggagggaggtcgactgtacctcatacagggctccaatgtgaactttgaggtgagccttgggggtgcagaacctgccaccaaagactcgcatctcgtcaagcacgtccatcagacctgaggcgtcgatgatacttctgactcgactcatgtactcttgcattgcaggagtccatgagcagaggtactcgtcaatttgcattggtgctgacgaaggagtgacagtattgccaataacgcctcctgcagctggtttccgcccagtgatcactctgcaagtcaagtaagcaagctccatcgaaatacactgtggtgggctaccagcatcactagtcaaacttgaacaggcccatactatgaatctgtgcctatggaactgttcgtaggcgtcaatccgctgcccgaggtttgacaagtggtgtccggacgcatgatgcccgtcccacgcggcagatccgcaaaccagtccatgacatttttagctcttgctgcaaagctccatggctctgaccctaaggagaagcttgttgagacgcaccatgtaggctggagaagcatcgcgtcggctcacacaccgagcttgtcgagccgcagggcagcctggaagccactcccctcctcagcaacacggcgatagttgtaacgcagaacacacctggcaccacacagcccctttcatcccagcatgttgaaatgatccaatttggttggatcagaggatccctgaccccgcaggtgccctctctctatcttttgtgtgctgatgccgcctcgcccgcgccctaattgcatccctcgaaggccgggccccgtattggagattgcgcctgcagatgaatactaaggcggtcaaccctacataaacctaatatccctgtagccccggcctctgcaatctgtagccgtggccttatccggctctgcggatgtcatccggagtcgaccgctttccctgacatgcggaggtgtcccccagggactcaggggactctgcccctcaacgggtataatatgagcacattagaaccttaggaagaaattacttatgataattctgggctgcggttcggatcgtatgaggaaaaccctttaaggcttgagaggatacaaggtacactgcgcgcgtgcgcctcaactcattccccgaatcttcatggggcaagcaacgtgtcaggccggtccgcgtctaactgtgacggtattgctttgtcttcttgtttcgctgaagaatgtaagctttagtaacacttggtgaacgttcttccttgggcagggctgcacgccgcggtatgccgcttcaatggaccgagtcccacgctcctcgtggggagggggtgcctccccgtccaaagcctgaagagcaggcgggccctctcccatgcaggtgtcatgcaagacccaaagcttctttggatcccctctggaattaaatgctcactcaggtgggtggtggccaccccgctatgtcctcctcccgtctctatcgaccttacatggtgtaggtgtgaggctctgacaagattcaagcgtttgcatcctcccccaccctcagaaaacgcgctgatcgtgagctcgctcttctcttccgatgactgcaatgtggatgccacctgtgacacctcttcgctgccactccagcgatctgtagtccagctgacgcaccccttggcacgtaacttctgctcaggtatggacctaaaggctcgcatgccctggacatgacatatcccgtcgacccatggctgtaccctgcccgcaatgcattccctcaccctctcctccaggtaccctcataaaggggcctggagacaaggtctacgtcctctccgcacgtcactgcattgccacatttagtgttaacttcgtgtacccctggagctcctacggcgtgctcttcaacttcaggctgccatgtggcgcgtcgcgagtggacaatatcaccgcgaccttcagcgatttcctgcaggtgggccatgagccaggtgtctcttgcatgcactcacgcagatcacatgccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagctgctgcaggacatccccccagagtggaatgtcatgctggcaggtgaatttgcatgtctgtgtgccgtaaattttgcatgggctgatgggatggaggttgcccagtaggatcaggaacgatggcggccccagccctgaacagcattgcgtcagcgtccaggtgaaccaatcatgtttccttagccgtgtgccctctccccttgtcagggtgggacgcctccaatgttctgaataacttcacatggacggatgtttcccatccggctggagactcgcagaagatcacaactggcatgtgcgtggagagcgtgagcacattggtggtggggtgcgtcaccaggacaggcatccttgtcagggctttccttgcagactgccctgcctcgacaagcagctgtgttttcaatggggtgggtgccgcttcctgccacctaccgatggtgtgcagcagcagagcgcctctccttgcctcgagagcatccttgccccaactctccttgtcacccccccccttcagggtcgaccgtattgcagcctcctctacattcgcagcagacaggtctgtggacgtgtcaaacgacaccggctgcacctcaccacactgcggatactttgattccatcctgtacagcgggtctattcaggcgggatccagcggcagcggcctcgtgcacgacggtgagtgggtggggagccgaggtgcctcgctgcacactctgaatctggtgcgacactcgtgctcggacctcgccctggatgaatccctcagatccagcacgcacatgtgcatgacctgcatctcaggagctcctcccccttcgtgaccaagtgcttttgcgcagacctgcacagggtcgtaggtgttctctccagcgaagaaggcgaggactgtgcccaccctgaggatccttacagccacgaggggcctgtggccacatacggacgcctggctagggtaagctggtcccactccaggcatcccctgtgcatctcacgcccccctcccctccgcagtggctgcggctgcatgaactgggacgctggcccgaaagacgaaaggccctggcgcccccacctccacattgcctctgtttaccaggcctgggtcagtgggctgtaccacctgtttgatggcgnnnnnnnnnntgagctgctgcaggacatcccgccagagtggaatgtcatgctggcaggtgtgctctcatgcagggccactccttcattgtgcaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgctgcccgccgctgcacccgacactcagtggtgcctgccacaaggagttggctcgttcccagcaccagagcgatgctctgctacgacatgctgccttgtcctaccttgaaagcatccttgcccccaccttgcccccatccccctccagggtctacgggacattcctgtacgaagtatttggcgaggacaaatccgtggaatggtcagacgacacaaactgcgcatcgccacggtgcgggtacttcaaaagcgtcctgtacagcgggactctccaggaaggatccagcggcagcggcctcgtgcacgacggtgagtgggtggggttggggactgaggtaccttgcccctggcgctctgcctgtgaggcgacccaactcccgagatcttgcatcaatgagtccctcagggccggcatgtgcatgtgcattgcccccacttccccagcccccctcacgtcctggcctgtcacctgcgcgcagccctgcaaaggattgtggccgttctctccagcgggggcggggggccctgcgccacccccgaggatccttttggcgaagactcccccctctcgtccttcggacgcttggcaagggtgagcagttcccgggccttgggaggcatgcgctgcttgatactccgcctctaccgggtgccgtggtgggaacttgaagtacggcctgaggggcagatggccctgacacccccatcttcacactgccctctcccaggcctgggtcagtgggttgtaccacctttttgatggcgccaccgtggaccagccaggcnnnnnnnnnngtggcatgcggaggaggggggagtgtgagggtatgagacttggccaggccctgaaactgacccatgtgcccgtggcaaaggctgcccatagtgcctgtgccgcaggcctgccgaccacccacccccaagcannnnnnnnnngaccaccccaccccaagcgacaactccatgcaattcactttcctccttcccttccacaggctgcagcaggccccacagcacacgaccacggtggagatcgcctcaatggacaagaccttgatcagcgtctcgccctcatctgtgaccttcaccgccagcaactggagcacgccgcagtatgtcaacctgactgccggtaaggacagtgtgttggtggcgaggacagacgtcctgtggggaattggttttggaagggctaggtgcagtgactggcggcaccccaggcaggggaggtgcagaatgagagttatgtaagggtctgcaacacccgagctgagatgttgatacgcaatgctgacgtgtgtccctcgtcctccccccgacctccagtggacactgttcttccttccgagtcagccgcatcctttgagctgagccttacctggcccacagtgacatccagcggagtgcatggatcaaggaacaagatgatcacgtgagctggtggcagggcacaaaacccggctttgatgtcctgggtgccaggccttgtcctgattgcctgagcagctcaggactgggaggggccatggatgcacgcgctttgattcgccccccccacacacttgattgcttctacctgaccgcaccttgactcatctcctctccattgcatgcgtgctcacaggggtgttgtgcggagcagcatgcatggaaccagctttttcaacccggtggtggtggccagtgttccctacaaggcccacggcagcatctcggtgagtggatccagagatgaaagcacatggcataccagggtgatggtgcaattgtgcgccttggcgcgggccggtgacattgcatgcattgacggcacagtcccacgctggctctccccgccattggctcatacccctgctccccattccttgccgcagaagttcaacccccaggcacccttcatcacatttgccaatgggcccttcatccccggcgtcttcttctcctacgcaccctctgtagctgaggtgagtgggctgttctcggtgtgccgccctgtgctcataggcgtcggcgctcagtgtgcgatccagaccacccctgcccctggcgcacaccgcctcctcatccggtcgcacagcatcccaccccatgcttcctggcttgaccctctacccctctgtgaaaaactcgtccgcccacagggtctctccattgtggtgtgccccctcaccgagcccctggcccagggctccctcactgccaccatctacgattccaactggactgcctacgaattgctcccgtgagccaggctggtgtgggcatggggtgatgcgggaccaggcaccttgcgtgttgatgccgatctggccccacaggttctgtgtggggtttggctccgatgtgttcttgttccggaccacagcgtgtacccctccagggagtcaggtgaagtgggcagcagtcccatcaggtttccagcccccgacctgtactccctgcaggcaagtcgcagaatcaataccagaggtcgggcatgggtgcaccaaggttgtggccgctctccctgggaacgacagtgcgttgggacccttggatggggcggagggaggctggggatcggtggtgtgcccctgtcctgcctgtctttgtgcaagggagtgtggctgaggctttgcagccccgttgctgcgcaatgcagcgccccattctcctggtgcatccagtcggacgtcctaatgtgcacccggcacagctccctgcccctccactcccattccacagcctactatatcgtcgtgtacccggccgcctcgtttgtcgtgcccggcacctctgaccacttccagggcgacttttcggtggagatgaaaccccttcccgtcgaaaaggtgggatgcatccctgccaccgcactgcggacgggcggggcgtcgcccacagccagcctgggcacatgatgtgcctatgcacaggtggctgccagcatcacatcccttgcctgtcccctcccaccacccccagtttttggtgttttcccctccgggtccccacaggtcatggctgcgctcgatagaagtgcacaggtccctagtatcaacagcatcccgtacgaggcatatggttccccaagccccactggccagatgtactacttcagtcccccgctgagcactcgagtggacatcagcacctgcttcaacgccaccacggtcgccacagccgtgtccctcctggatggggataccctcctgcccatcaggtgcttgatgcatggcttggtgggggggcagtccactgcagtgggccagtccatcaacaccaccctctggccccttggacgacacacgcacatgcgcatgcaagaactcactcgcttacttcatacagctggacccactgcgcctattgccatctcacccagagaaccatccacccacgcagcgacagcggtgaggggtgcggcaccctcctggaccagcctgtcgagcggggcaaggcatacctggtcctggtcacaaccccgcccacctccgtgtccctcagccgcaagccctccatgatcttgatgaacctggacatctccccgggggctcccggggcgggcatgggctttggcgcggtggacgacgccgacatcaccaccgttgcaaacctgaaggtccatgacgtcggtgatgggcctgcactcaagctggccctggctcctcccaagccctgatggctgcacaagtccgtgggccccgcagcatggccaggacgcctcccgagcgcaaccctccacccatcggtggcctggaggcgcagtagtctggcggcacggagagctggttgcctgtcaatacgctggcgagcaggtctgggcggtggtattgggcggcaccatcgcagcattgaaagtacatggtgagaaactgacatgcccttgcttgcaatgtgcatatgacctggagaccctttttccaatcaatcaccgaccaccacctacatcctggagctttgcggtgtcatgcattgggaggctttccagaaggcaccctccaggccccccccccgcttgaataggaatgcctctgtattctgaacgatcgagataccgagatctctcgcctgttcaagtcattcagcttcgtgcaactttataccgcccaaaggtttcggttccgctttctgcagcgacaccgcgaaccggctgagagatgcccggggactcagtgaatcgggttccagacctatactgaacgcgcaccccgtccgtgcatgtgcttaaagctcgtgtcaacccactcagagcctgtcgatccagagggccgcccgagagccagccccttcgtctctgaaagaaggattgtctcgtgctatacaggactccggcgctaggatagcctctcacgttctatgctttgacgaccttggaagcttgcctatcgcagaaaagctatcgcccgccgctcccccttccatcgtgtgcacacattgtgattgttgacaagaccgcggaggggaaggtggcgtacggggctccctgccctgaaaaactctcctagaaccagtctgtggccttcatctggtcagtaagggaccagcccactggaatacggacggttcattgttacaacggcgctcagggcagagaggccgctgtcacagggccacgtatttgctcggagggggaggacgggcgtccgcagcggaatctcagggacgagccggaggaggccacgcccggtacaggcagttgcaaaagcaactggggccatttgggttgggagagcaaaacattggaccccaagtgtgagtgctgtgcacaacgcaacatcccgctagagggcctccttcaccagggcagactttgtgacccctaccccggcagcaattcggtgagaatatccgtcaaaccctaccttagaccatatgttgatgccagcattgcgattctcaacatcccatgtcggatgagcctctcctttcttaacccgtcctatggcatgacttttgaacgacggcgcttcctacaaacccatcctagagatgcgaagttgttgccctcgaactgaagggcatctttccctcgctgggtagtcctgaatactgatggaatggctgaatgcaccttaagctgagcggaaagtcgggttacttactggggcaccagtacgacccttcgagccgcgtaaggagttccgcgccaagtcgccgtgtaagccactaccctttccctcttcccccctgcgtctcctgccacattctccatgacgaggccggcgagtcgtgctgactcgcaacggagagtggtggccatcttgtttacccttgcttcgctcagatatgtgagatcgggcccatgggaaactgccctccctctctcaagatgctctacaaggggtggcggtcagttatacccagtattgtttggtccctgccgccattgaatttgtgccgagcgtgcgccatttcaccctagccctcagctttctcctggtatcccgccatgcaggtgtcttgccagacccacagcttctttacatctccctttgcgctcagtgtattctcaggtcagcctggagaacaagcctgctaacgcttttatgtttgcctgacttcctagctgctcttgtaaacgcgtcgtacatgttcccagcgtttggctgcatccccgtcctcagagaacaggctgattgtgggctcgctcttctcgtctgccgatnnnnnnnnnntcgagaggcggtttgagctacagcacatcccctcgtacccctgggcctcacgtcacgttctccgtgatgaagccggcgagtcgtgctgctttgcagcagactgccgcaacactcttgtgtctcctaatgccgctccagattgtgagatcggccacagggacggctgccttccctcaagatgctgtgtcgggcttggcggtctgcagagttcaaaattggccagaccctacctttaaacccgttnnnnnnnnnnnnnnnnnnnnnnnnnnnnnnnnnnnnnnnnnnnnnnnnnnnnnnnnnnnnnnnnnnnnnnnnnnnnnnnnnnncccggtagcttcttcaattcccccctcgcactgagcaccgcttcaggtcgggctggaggtcacccgtgcccgtcattccatgctcccttgatctggcaaccagatcatgtagcacacccggacaaagttaaggcgtccaatcccacatccataccccagagaacgcgctcattgtgggctcgctcttctcgtctgccgattgcaatgtggacgccacctgcgacccagcctcgctgccacagcagctgtcggtggtgcagctgacgcacnnnnnnnnnntgggcatttccattccctttgcctcaggtaccctcatcaagggtcctggtgacagaatctacatcctctcggcccgtcactgcatcaccgctctcagctccagctttgtttacccctggagctcctacggagttcttttcaacttcaagctgccgtgcggcgcgtcgcgtgtggacaatatcactgcgacattcagcgatttcctgcaggtagggnnnnnnnnnnctgggcattaccattccctctgcctcaggtaccctcatcaaggggcctgggaacaagatttacatcctctcggcccgtcactgcatcaccactcttagcccggcctttgcgtacccctggagctccttcggcgtcctgttcaattttaagctgccatgtggcgcgtcgcgagtggaaaacatcaccgagacctttagcgatttcctgcaggtggagcatgagccaggtgtctcctgcatgcactcacgcagatcacatgccctgnnnnnnnnnngcaatttttgtaccggtatggagcaggcggcttgcatgcatcgagtgcggcatgaactccttacggatggctctcaaattcccactggggtacccctttcaccttgctgcaggtacccttatcaagggtcctggggataagatctatatcctctcggcccgccactgcctcaccagctttgacaccagctttgtgtacccctggagctcctacggcgtactcttcaacttcaggctgccatgtggcgcgtcgcgagtggacaacatcaccgcgacctttagcgatttcctgcaggtagggcatgagccaggtgtctcctgcatgcattcacgcagatcgcatgccctgcagagcgggggtgaccggggtnnnnnnnnnngcttctggacagctcacctccctgcattttgacatgatggccatggagagccctggtccgtcctgtgtcttcctagaggtgaaggctccttacccattcgagatttcccctctcgtcccactccaccaggctgggacgcatccaatgtgctgaacaacttcacgtggacggatgtcgcccagccatacggggactcgcagaagatcgccacaggcttgtgcgttgggagcagaacannnnnnnnnncggcttgtatccatcagatgcaccgcaagccctcatgaatggctatgcattttcgtcaagctcttcccttcaccttcctccaggtaccctcatcaaggggcctggggacaagatttacatcctctcggcacggcattgcgttgtccttcccgactctggctttgtatatccctggagctcctatggcgttctattcaatttcaggctgccatgcggtgcatcgcgtgtggaaaacatcaccgcgacattcagcgactttctgcaggtcggccgcgaaccatgtttcctatggatatgcggatgcaggtcgcttacactgcagggcgtggttgaccagaggaagacttcccagtactacttgaaagagaacaggatccagggttcatgcactgagcgctggacatgccacaacaacccctggtgccccacttctgtgtctgcagggcctctcggtggtgttccaggatgtgaacagcgatgtggcgatgttcgagctgctgcaggacatcccaccagaatggaatatcatgctggcaggtgtgctctcatgcaagcacgctctgtattcatgcattgggctctgagtcagcaatccccttttatagtagggatgttgccggctggcccttcgtgcttcctggggtgacaaatttcggtccacatacactctccccctacaccccccatccaccaggctgggacgcatccaatgtgctnnnnnnnnnntttcacgtggacagatgttgcccagccatacggggactcacagaagattgccacaggcttgtgcgttgggagcagaacacgctgagagggggtttccttgagggtatgaattgggtgccttgctttgcttgctgcccgccactgcactgcaccaatctccccgctacacttgcaacatgagacttgcgtattcccaacaccaaactgaggcatgctaccacaaggtatttttctccgctttcacagcatcctcttactcatgtaccccaaccttctccagggtcttcgatacgttttcgcacgaaacgttctacggaaatggaacagtcgattggtcctatgactcggagtgtgcctcaccacgatgcgggtacttcaaaaccatcttgaacagcggggctctacaggagggagccagcggcagcggcattgtacccgacggtgagttggaagggcccttggggtcatgctcggtgctcttcagatatggcgtcattttctccccagaacgtgccttgacaagacccccaagctggcgtgggctcgcttagagtctcacgagctgatatcacgaaatggccccctgtttctgcatagacctgcacaaggttgtgggggtgctctccaccggggctggccaggactgtgccaaccccgaggatccctttggtcaagactcacccctcatgacatttggacgcttggcaagggtgagctggtcctgggcctgactaccttgccctgctcgatgctcggtccatggttggtgccgcgcggggaggctgaagtatggctcccaaagcagtaggcactgacaatccccaccttcacaccgacatctgtctaccaggcctggatcagtgggctgtaccacctgtttgatggcgccaccgtagaccagccaggcagtgccgactacacgacttactccccccctctgcccacgctgagcatcgggaacatcgtcccggaggtgaaccccaccctgnnnnnnnnnncgctgactacacgacctactcgccccccctgcccacgctgagcattgggaacattgtgccggaggtgaaccccaccnnnnnnnnnncgattacacgacttactcgccccctctgcccacgctgagcatcggcaacatcgtcccggaggtgaaccccaccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaactgacccgcatgctcgtggcagaggctgctcatagtgcctgggccgcaggatcgccaaccacccacagccaagcgacaactcagtgcaattcactgtccttcccttctcccacaggctgcagcaggcaccacagtacacgaccacggtggagatcgcctcgatggacaagtccttgatcagcgtttcgccctcatctgtgaccttcactgccaacaactggagcacaccgcagtatatcaacctgactgccggtaagcaccgtgtgttgataatgggggaggagggcccaggggtggagttttggtgtggcaggattttgcgacgagctgtactccaaccaggggatagcgacgttgagaccgatgcaacagtctgcacaaccccaactgacatgccgatgagtgacacttacacgtatgtcttggacctcccaaatctgcagtggacggagtcccaccaacggagtcagccgcctcctttgagctgagccttaactggcccacagtgacatccagtggagtgcgtgggtcgcggaacaagacaatcacgtgagctggtggctgagcacgagaacctgccatttcaacctggatgccaggacggccaagcccctaggtgcatcaacccccagcaaggattaggggttaggcgccccagcctgagctgccctgtgcagctgccgtggtgctcggtcgcacttgtgctccaccccttatccatgcccatgtgccccacaggggcattgtgcggagcgacctggaagggaccagcttcttcaatccgataattgtggacggcctcccattcacagccgacggtagcatatcggtgagggaacccggagaggaaagcacggcgttgcaaggtcggggtgcaattctgcttgcgtgagcaggggcgggggcggtgctcgcaacggtgccatggagccccactcagggcgaccgcgccttcgactcataccacgccttccatcttcctgtgccccagagcttcaacccccaggcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatgctcgcacaccagagcgcgcctgcccccggcgaacgccatgttgggggtcaagcatgtcggcccggactcctccctccattgccccttttccctgccagacccatgcacaacatctttctgtgcgcagggcgtggcggtgtcggtgtgccccaccaccaagcctctgtcccagggctccctcaccgccaccatctacaattccaactggaccacccaggccctgatcccgtgagcgaggttgggggtggaacgtggtctctgcaggagtgggaacctggcatgttcctctccttctggccccggcagagcttagcaggaatccagagcacctgttgtgtttccatctgatgacacagtgcaccagcttcccagagggtccgacctagccagggattgcccccccgcatgctcttgggtatatccttccaaccgtgctgcgtgcaggcaatttgtgcagcgcagtccggagcttggagaagggtgcacccaggtcgtggccgcactgcccggggacgagagtgagttgggaattgtaggccaaggtgtgggcctggggttctgctggttgccctgccctatcttcctctgtgcatgacaagagtatggccatggctagaccgccatgaccctacgcggtggagggagtcccctccccgctgccctcactccgacacctggcgatgcacccagtccagctccctgccccgctgctcccgccgcgcagcctactacattgtcgtgtacccggtcacctcgtttgctgtgcctggcacctccgacaagtttgagggcgatctggcggtgggcatcgatgccctgtccatcaaaaaggtggggtgctttccggcgactccgtgacaggctcgcatgggagggtgagcccacagccagcccgcctgcatgctgtgcttgtgcctgatcagcagctggacccgcgatctcacaccagctgctcccacccgacagccacacccttgtatatcctcccggcgtcccacaggtcatggctgtgttcgacgacagcaagctggttcccagcgtccgcagcatcccctttgaatccttcggaacccccagtcccgtgggccagctgtactacttcagtcccccactgagcactcgggtggacatcagcacctgcttcaatgccaccacggtccccacatccgtgtccctcctggacggggacaccctcaagcccatcaggtgccggccgggactgcatgcatggcttggtggggttgtggtcctcctgcaaccagccagtagattgtgaccacctccttgacctccagcacactcggccactcacatgcatgcaaggagctactcgcgtgaacatcttcgcttgccaacccccccccccccccccccccccctccccnnnnnnnnnnnnnnnnnnnnnnnnnnatatcaatcatatacccgcagggtgagcgagagcggcgaggtgtgcggcgacctcctggaccagcccgtgaaaaagggcaaggcgtacctgatcctgttgaccacgccacgcacctccgtgtccttcagccgcaccccctccaaggtcctcctggcgctggacatctccgcgggggccccaggggcgggcaggggctttggctcggtagacgatgcggacatctctggcgatgcgcacctgaccagccaccaggtgggcgacgggccggtggtccagcgggcccgggtccccttcgagcagtgaaggcctggcaggtcctgagcgctgcagtacggcccagaaccacccctggcgcgatgaggctcccccgtcgggacctggaggcgcagcaccctggcggcgaggggtgctggtgcctcattgagtcgtcgagcagcgtctggcagggctgcaggctgaatatactgcagtgacatgttcccatgcgcagccaacgagtcaggtttgaacaactgcaccgcagcagtgttcttttgttgatcgacaaccgcccatcaccgatatcctatgagatttaatcccacccatgcatcatccagaccgcagctctcacccggggtcaatgatgtgaaaatccggagacatgcgagatctgttgcctctcgcaaaaggttagggcttcccctttaataaaatcaccgcgaatcgaccaatggccagttgcagtttcgatacacaggacacaacgcacggcctttatatcagagagtgtgtccacttcaagcatatgcaaacaattcgcatgtcggcacacagtgagcctatcgagccacaggggccgaacgaatgtccgaaccttctctgtgatcgaaatcacctaatgcacagctgtataacactagctcaccccttataatccagtgttcgatctacttcgaaagctgcccgtcgcgggatccctcgaccccgccggtccgtctttctatgtctgcaatccggagccgcctttattaaccgtacacctcgtcctccccaaaggcccggggatccgtcaacggccactcatacctcgaaccacccgatggaggctgcaccgcgcgggagcaggccagcacctgctgctcctgcatacttccctttcagccgcggccccctccggcgcatcttccgccgtccgcatacggcagcggctcctttcttttaggtagcaatcttcagccggggaatgagggtctttgccccctcgcgggcactatataagcactcgggaacgcgttccatccacgtttatctcgacagagattatattacgctcaaggtcgacctagaacggccctcccatccccgcgtgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaggcaagcgcaacctcctgatctcatataagcctcgtattccctcgccttgcaggtgtcat

SEQ ID NO: 38923 - DNA, 61 bp, Chlorella protothecoides
ggccgactcctacctggactgcataaacaatgtctcccacgtgggccactgccatccccag

SEQ ID NO: 38924 - DNA, 61 bp, Chlorella protothecoides
ctcatggtgcgcagggacaagggggggggggggggggggaatggtggtggaattcaagcag

SEQ ID NO: 38925 - DNA, 79 bp, Chlorella protothecoides
acagttctgtctggcgtagataacggcgagtgaagggctcactgagtatggtcggccgcacggaggcattgcctcacac

SEQ ID NO: 38926 - DNA, 163 bp, Chlorella protothecoides
gcgcaaggccttcgtggacaactacaaggtcgggggggggagagggtgtattggtgcttgttgggggaccatgggtgccaatctgcagagccgctggcattcgagctggcgctttggaggctgatgcttcgggtgaggctggcgaggagcgctgccctcacgc

SEQ ID NO: 38927 - DNA, 61 bp, Chlorella protothecoides
gcgccacctggtccacaaacgtcctgcaggcgtatcgaggtgagggggaggcggggagggt

SEQ ID NO: 38928 - DNA, 61 bp, Chlorella protothecoides
tattcgcttgaagtgtgtgaccttggacccgacgtagatctccctgattgaggccatactg

SEQ ID NO: 38929 - DNA, 240 bp, Chlorella protothecoides
tgcaaccatcgaggtacgaggtgtctgtacattcactcattttcctcggcatatgagcattctgggaggcccaggatcctggggaatgggctgggactggtggactgccgctcataaccctccgccgcctcccccaccccgccacacacttccaccccgccgaacacccctggagtgcctgccatggaagccggcactgggtcatggtcacaggtcattttcctgcggctttcagcccat

SEQ ID NO: 38930 - DNA, 128 bp, Chlorella protothecoides
tgagctttggggggacaccctgggacaccaactcctcccccagcgccagggctcgtttcccatcgccggccatggcagccagccgtgccagtgccgtgaagctgaggatggatttcaagaaggggggg

SEQ ID NO: 38931 - DNA, 74 bp, Chlorella protothecoides
ggcatggggtcatcccatgcccacaggacaccacgcacaaacgtcccgattcgcaccctggtcgggggtgatga

SEQ ID NO: 38932 - DNA, 12321 bp, Chlorella protothecoides
  modified_base (106)..(115): a, c, t, g, unknown or other
  modified_base (935)..(944): a, c, t, g, unknown or other
  modified_base (1181)..(1190): a, c, t, g, unknown or other
  modified_base (1243)..(1464): a, c, t, g, unknown or other
  modified_base (2870)..(2879): a, c, t, g, unknown or other
  modified_base (4458)..(4467): a, c, t, g, unknown or other
  modified_base (7699)..(7708): a, c, t, g, unknown or other
  modified_base (7930)..(7939): a, c, t, g, unknown or other
  modified_base (8084)..(8093): a, c, t, g, unknown or other
  modified_base (9067)..(9274): a, c, t, g, unknown or other
  modified_base (9347)..(9356): a, c, t, g, unknown or other
  modified_base (11764)..(11773): a, c, t, g, unknown or other
  modified_base (11922)..(11931): a, c, t, g, unknown or other
  modified_base (11986)..(11995): a, c, t, g, unknown or other
  modified_base (12116)..(12189): a, c, t, g, unknown or other
ttaaaagagctcaacatttgagtctctgctcccttctgcaggtaattccaatgtgggcaatgccaactggggaagtaacaacgagggtaccggccaccattgcttnnnnnnnnnnacaggtaattccaatgtgggcagtgcctattgggggaataataatgagggtaccggccaccattgcttcaacatgtctgggagccgcaagaatctgaagggttgcagcctgctcgagttccggaagtatgcatgggtccttgggtttccaccgccccccgccaagaagtctccgccgccgcccgccaagaagtctccaccgcccgcggccaagaagtctccgccgccgcccgccaggaaatccccaccaccgccctcgaggaagtcaccaccaccgcccgccaggaaatccccgcccccacccgccaagacgtctccaccgccgccatccagacagtctccaccgccgccatccagacagtctccaatcccacccgccaagacgtctcctcctcctccttcaaagaagtctcccccgccaccatctttaccgtcaccaccaccaactccctctcctccccctccacctcaaagggccactatcgagttcagcaaccccgtggatgggaaagttgctgtcaaagtggtgctcaccacagacgggtatgttccatacacaatcactgctgatctctactcagccagctttgataacctccttgagcttaccagtgagcacaactctgaggaggtcacgaccttgagcaaagaggacgtggatcaaacagtggcagcacgatactcattctgcatccttgcgatccaaccaactgattggggtattctcgatatcgtgtatgcccgggtgactctaatcaatccatatccccccccaagcgggccgtctcctccaccgccagcacttggatccatcagcgggnnnnnnnnnntaatcgtcaaaaggcgattcagtttaaaatatccattgtgggctataagcccaagggacttcgcatcgttatcttcgacccagttggcattgcgctcgaaatgcattccgtagattatacaggcccaacgatggactggtatcaagagataaacggaatttcgcgagtacttcagccaccgacctctgcccaagtattggcataccaaaccaatggcgccacttcacctgttctcannnnnnnnnngtttggtgaaatggagattcattttaaaatatccattgtgggctataagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcaccattatggatttttcagctgatggtcactttacacaagggagaagggaaattgatcatgtacgcgcggcaagcttgtacctcctgacaaggtcacctttaagcgctcaattgtcttcaaaaacccacgtagatctcccactcctgcatgcagcttcaggtgtaacacaaggccacaaatcgcgttcggtgctgtggtgtcctcatcacgcatgcaattatctctacggagcgcatgggaagacttcctgcaaggcgagggctgcagctccaggatttcgtatgtcacccagagcacctatcgctccatcaaggcccgcacatgaactcccatccaactcagatatcgtcgccgcactcactcaagctcctcaacacacgcaggactggatcttggtaagaagttatgcgcgtggtggtcgtggccctgccatttctgagtgggcggagggagacgccttgagaggttgtagaggctgaacgcgccatgcaagccaagatcgaggtatggcacagcatgtgcccagaacttgcagcagggtttgttaaatttcgcaagactgtagaggaataccagagtccttcgcgattcccaagggcgtcttgtaccgccggaaatatctggctgacgtcagatttcttggtttcagcccctcagaaacaagggcagaaagcttgctgtggtgccaggtgctttccatcaatttaattcattgcttggtttgaagcatctcaaggtcgtattccaggctgaaaccactcaccgttgacctacatcgtattactcctcccacccatccagtgtgccctaggatttgctcatgatcttttcccagcccccggtgatcatccacctgtgggcagccagacagcgtctggccctcaccccatcacgcacgaggcctggctgggttccccggaccatgggactacagcacgacctcaatgttacagagctgccgttgagcatcctgggctatggccgcccccacgcggaacctgtgccagtgtcctggccaagtccaagctcaagtgggcaaagatgggcagggatcactcggccagcagcttcctccaaagcgggttgggttgaggcggaatgatgccacggtccttgagtgcctgggcgtggtcacacagtttcttcactacaatctcccccagccgcgacttggcctcccccggggcgggcagccagtactgcttgtaggcctcccgcgccagtgcggcctgcttggcagccaggacctttggcggcagtgcgcgcagcgcgtccaccacctcgtccagggtgtcgacatgcagcatttctccgggcggtaggtcggtgtccaggtaccaagccgtcagcacgctggggtgattgtcggccctggccagcgaggtgttggccaccacccannnnnnnnnncacgtgtaacatggcgccgggcggcagctcggtgtccaggtaccagtcggccagcaccttagggtggctctcaggtctgccctgcgatgcgttggcaaccacccaagtcacacggcgcacagtgatgaagacgctggaggcagcgtggtcgatgtcgtcggccagggccacggtgtgccagggcggcccgacaaacacagggacgcagccggagagcgccgcctcggtgccgcggcggctggaagccttgtccccggccagcaccaggcagtagcgggaggcgcgcatgcgcgccagcacctgcgagtggggcagggcgccggggcagatgtcgcagccgcaccgcacgtccacatcggtggcgttggacgtctgggctgcgttcaccagggcgcggcgcagcagcttcctggtggcagcgtgagcgggaggggagaaagggttagggaggggacagcaaacttgccgggcagctcatttcagggcccactgggcgtgcaagctcccctcgcggagtggaggagggccctagtgtttgcatgcctacgccccgccgccccttgctcctgggctcacccggatgcaaagcgtcccgaattagggctggggggtggaggggcacacccgccccgatagaagagcagggtatcgcgggtggcagcaagggggtcgaacccctcctggtgggtgtctgcgaggggtggcaggggccagggtcggagatgacagaagagcaaggcacatcacacatctgagccaggcacaaaacatcgcccaggaagggaggggctgcatgccagaacggcgtgcaccatgtccagctcaactgcagggcgcacagcattgttgaccctgcaaaccccagccgtgactgcgcccaaggactgatcttgcaaacctgtcacatagggaaggagcagtccttgctgggcatgtgcctccagcttctgctcgcagaacagggtgtgttcagaggcgatgacaaagggggacgagctgcgtaaggttgggagggaggggagagggggccgaggggcctatggagggcttatcagatgggtgggcgggtggatcccaggcatgttccacgcaatctgccgagcggcagacctcggcctggtcacgtcagggaaggattggcaggagggtgggaggcggtgggcacggtgggcattgtccgagcctgtttatctctttgaagttggtggtctcgctcaagggacccacaggcccaagcttcgtaccacaagacttgcaaccctcttacgcacaggggctctgtgcgcactgggggttttgcccttctcgatgaagacaacctcagacacatgtattaacaagcctctgcacctcacccacctgcaaggcctcagcgcatccagggtactcctgggaagtgccgggttgtagggcgccacgacaaatctggagccgttgctctgcctccactggggccaggacctgagggcattcatcgtctgctgccggtagagttctgggtcaactccgtccttcacgccctccttgaaaacctgccaccacttccccgccctccaaatctcatagcaatgcatgttgnnnnnnnnnnatatatctgggaacatggggggatggcgagggtggagggttcggtgagggccctgtcaatcagagggctccccggaagaagaagataaattactggcaggttcacgccagtgattctgtttaaagactgcttgccggccatgtcctgaacgcttcctgtgcaccttgacagtcctgcaccagatcccagtcccacctgccccattacccaccagatctgcgctggccagcctgtcagtctgagcattgttgtcgatgatgacctgctccagccagaagtggaccgcctgctggtactcccagtgttggaggggctcgctgcccccaaggaggccggttttcttgagggcatgtggccagattgcggaatccgcatagttgcatgcaggcattccaaggtcacgtgcagggtccaggacgtagatggagcaggatgcctgctccgcgacttgaccagagctgatgatcatagatctcgaggagagcgagacaaggcggttcggccagatcctctgccctgccaagccaacaagagaggtaaggacgaacccttcacaagggggaggggggggagggagaggcggggctaaggcgccgcggctcgtgagagcaaaacctcggtcatttcgtcgaaaattggcgagcgccaaagactttacctgccacaagcagcaggatctggagtgatcgctgcatttggcacccgcgagtgtacgggttacttaagcagtctcgcgggcctgttggggatcttacgaccggtcagcctcgaaacttggcagagttgtcttttagatatctacctcttcatgatttgttcttgcaacgtagcatgcgacgggtatgtgctgaatgtggcatctgacgtatgccgaaataggtcgaaaagcgagaacactggaaagtgcgaactgcgtcggttgctatcgagaatctgctattattgggaaacctggttgcttggaccaaaggagtactgatcctcctggtccatgcaaggggcctgattactccgacctcaccctcctgcgcacacacattgtctgccggaaagctttactagttctagataagaaatgggtcacagagcaggtccaaagtcaccctggccttcaattcgttgcggtagcagcatatcgtctattgcaatacccccgctcaagtttggaacgaacggggcgtgttctgccctctatttgcttctcataggggtcgtcactgttggccaaggggggatcaatggcgggtcaacttccattacgagcttgcagagtgctgcgccatcctccagtgttcccttgtccgtgatatgggtgagctattccgaaacctcttgtgctcctcgtcgaactcaggattgccgtctgatggcggcaccgggttgcctgggtcgcacagcggtggcgttgatgtgcaacttcagtctactaggtgtagggcgatgacattacctggtccctgagtgtcaggggctgcaggagaggccccaaagtggcaaggctggcaccgactccttgatgcgcctccttgtggtgctggacttggatgctgcgatgagcgctgtgccagtgcgtggattgtaagttgcttcagcggctttgtttgggtgagaggggttggagtgcttgcatgacactggggtaaagcatggagggcactctgcgggaatagcaacaccatgcacatcccacagctcacatctggtttctaaactgtccttgtccccccgcacagctgccggcatgtggtcgagaccaccttcaaaagaatgccattgcacccaaggtagcaaatgagatggtggtcggcaggatctggacacagcatgcgccagaccttgatgatgtgtttccatggcttgtccatgcaggaattgaagcaggagcagccatccaccacacgggggtccaccctgtaagtatctgacccagattgggtctgagacctgactcgccaaaggattgagctggggatgcttgggccaatgacgtcctcatcagatatcccagccgctgacctgcagcgggtctgcacgtcatgccaagcattcatgactccaaccggccagtgagggcctgggagacccgtccagcatccatgctgtctagcctgcggaagatgtcacgtaccagatcccggcgccgccctcggagagttgggctcaagttcttgagtgcacgcttgatcgtgctgttgtacacctcggctcgcaagggggtgtggtgccgcagagtcttacgagtccacaagccctgcatccatgcatctgtgcaggtctgaaggggtccaaattgtgaggaacttcgtggtgatggcaaggtgtagtgcatggaagaagctgccagaggaccttgagaaggcttcccgcaccccacgctacacacccatatccactgcactgttccccatctacaggaaactttggtaacccgtagcgttgaaagtattcagccattcttgctggcgcaaagagatctgtcaggatcaccaccatgttggcctttgctgcctatagagccgcctccttgtccgcccagcttgggttcttctggatttaaaagagcatggtttgcagctatacaaaggctgctcttttagagccactgcaaaggcggtgagccattgatgccacggccttgaactggtgtacactgcaggatgggacgagcgagcgattgaacatgcctccctgtgcatggggagagtgcagtgtcctcaggctgcgctgctcacgtcaaatgtgcggcggtatgtgcagcggcaccgtgcaccctcctgatggtggcatgctttgcaggacttgtgtcgatgaaaacacaggtaggtctttggtttgggcccattgcgaccaggcaatcgttggaggttggcaaagatccttctgcggaggacggggggcgacacccaaccctctcaagtcagcgacatggtgagttaccctgcagactgtgggtattgcttggcgatgaggccgggggtggcctgaggtgtgatcatggccaagggtggggcagggtgtcatgtgggcggggggatccggcacacagaacaccatcatggcgtcgcactgatacgagggtggctcaacagctacccaaacccatctgacgcaggaactggcacgcttcccagcccacttgtgggctgcagagtgcatttcagctgatctgtggatggtcgtttagacctgagctgcaagctatgatgcagccggtcccatcgccggcagttcnnnnnnnnnngccgcctccacccagcccccctctctcgccgcctccacccattgatgcgtgcacgggtgcacccttggtgtccgacagcgacggctcatgcgatggcggcctttacccgcagatatgcgtacgagatagtgtgcccaccgccttctgtattgcaacacaaccaacaggtgtctcgggatgccaccctccttacgctaccactacgcacggtgtttgcaaggnnnnnnnnnnctggaactgctgagcagtctttggttaaggctccggtggggtggtggaagctggaggagcgtgggacctcgcggccgcccccaagtgatccatgtgacaggaaccagacaatattgcaagcttacaccaaaggggtgccctacannnnnnnnnngagccatgtaccctaccctagtcatctgcaaatcaggcttgacaggttactatgccaagtgctacaagaatgatgatgattcttgagctggactccggttaaggctccggcggggtggtggaagctggacgagcgtgggacctcgcggccgcccccaagtgttccatgtgacaggagcaagacaatactgcaagcttacaccaaaggggtgccctacaccatccaacagcgtgacaagcgacataagcctagcaccaagcaggaaagtgaacttgggaggcgttccttctcccatgaagcatcatcgcaaggcgattgggcctctgccaaggttgcagatccacttgggctacgcaattgttgcatcagtctgcagcggaagggtggaggacggaagtcttaggccccttgatctgccatcttgagacaggatgagctactcttttggataatcttgccagccatactgccctgccagaacgatccattccctcagcccctctcaggactacaaaaacgcacatcgcctgatcttcagtggccactcgggaaacttgtcatgccagtatgccactccatagctgcattaaaatgaatggtcggacaggctgaaattgtatgactacatggtcttgcagggtccaatgctgactgtgcataccaaatcacactgcccttcctcaagccaccgtactgtgcgagagtgcgctgggcgtcgtccaagttcttcccggcaaaggacagcttctggagggcggggatgatgccagccttgtcctggagtaggagaaccacatggaatgatcaatgcctaccagggcagagacgctgaaaacagcaccccaaagtgttctgcacttatcatgcgcagagatgagtgactgccaccttggccctgctgaccccacccaacagcctgggtgtcatctaggcactacccaaaaccagcccatcccccagcccccctaccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaccccgccctcaagcagctggaagccaccatgccatgcccctcaccagctcgctgatgagcggtatggnnnnnnnnnncatccatataccctaccctggtcatctgcaaagcaggcttgacagggtactatgccaagtgctttacgaatgatgattcttgagctggactccacgaaggttgtgttacacagactgttataggaactcctgcatcacctttgccatgtttttcattcctctttgatcgccgcctatgctggtgtgtgggcgtactgattcccatggccctgtcttgtggcggctggctagaccccacaacgtggactgatgtatatgacctggagtagggatgctgcacgtaagatcccgatcacggagaggggcttcggtttcaggccctgcgccaggcagtgctggcacgacgttgggcacggatgctggatgcaggggaaagagtccggagaaggtcccccctacagcatcctgcctgcgcctgcacttcctgtctctcaccatctcactggaagcatccagtgacatctagacaagagctgcatgtcccaaatcacggctgggtgatcctatacgctaccttgcttcccgccgattccagccatgctcttggtaagacggacaatgaagcctaagcatactcaacaggtgggtagaaaggtagaggtcacaaaaatgcaggcattgcagggtgtccgccaatcgatatccatgtctcacgcctctggcatcccagcacagcataggtggggtgtcatgtgcgttcgcgtccgcatgtgcagaatcattgcagttggatcaccaccacccccagcagctcccactccatttccccctacctcgccgccatctccttccctccctcttttgccgctgttccctcctcaccccttgtgaggtaaccctcaccgggctccttgacccttcccacctggacgcgtgcgttacgtcgtggccatgccgcccggcgcagactatgaaacccaattcccacactacattcggcgatgggaatgtaacacttggacaaaacccagcagtccaccctgcgcagacttgccaacccccacaacagacttccgtgtcccatcctgatttctaggtcccatcccagacagcaacagaatgcacattaagagctcctggcacgcagtgtcaatgtggcccatttcccgggacatattagtggtggacgacagtgtggactgtaatcgagaaacggcacctgtgacggtcttgggttcagacccactaccggcacgcatcttcggagtgagctaccttcaccctgcttgggaccatacaccgggcttccgttgcagaatgctccgagacgtaccagggatctggggcgcacctggctgtcacagtatgctggttgctggcctgggccccttgtaattctgacattactgggcaggtgtaggtgattgcggatctatttatttgcatggcgcgagcgcttccggatgccagatcgctcaaaggctggcggcacgatggtcatgtgccatctgacgctgatccctccctgcacctgcgcgggccaggcgtgtgggtcggcagagctgtctgccctaggatgccatagctaaatttctgatcatgaaaatcgccctttgatgtccatccacaatcgcgtgggacttgatgagccagctaaatgaggaactggccttggtgcggcgcgggttgatggcgagttcgattgccaaactggtcttggacgagcacccccgggcgggctatgggggaatgtccggcgccagatcggaccgcccccacccggccatcgccggaagagcgatccaccttgaagtgtaacactgactgcctggtgcatccgttgggtgaggcaagcgcaaagcaccttcaggctcatgcgtgattattccaccagctgctcagtggcaatgaagtcgacgtgacgtttactggacggagcttaggtaaaccactgaggctcgcgattacaattatttgcaggcgatatagcatgattcgaagttcaatcaatttcctatgtacggtcatgctccgcatgtctgacgagagacgttgcacgaggatgccggagggtcgtccggatgcggagctgttgctcctgaggctgaggcggcgatgagggggccagaatttgccatcctcgatggatgatttgtccgagatccaagaaataacgaggctggatgtatattctagtcgaggattgatgcttgggtttgcgtcccgtacgacgtggacttcttgtgttcgatgcccccgccactatgcatcgttttaccatggggaccggcagggtctctccggattcccgcgaggagcatcaaaggcgccgctcatattcccctgcacccataaatgctgcgagcgcagggggccagcatattaatttcaacagttgcagcttgaaattcgaccgatttccagcgaagaaaaggcctaccgacgcaaggcaacgcatctcatcctgnnnnnnnnnntcagcccatcagtcgaacgttgaatagcgaagtaaaggtgcactcacacaacggcatcacaccctaccccgataagaaaagccagcagggcggaacagaaacagcgccgcggggtgctggatgtcgccgcccgctaaaacccctgtatnnnnnnnnnngggggcgggatgccaccgaccgtgaggaaccctaccttcctgactggcctcgtcnnnnnnnnnncggtgagttggagcgctcgctggtccatgtcgaccccacgtcagctccccttcgcgagtgccccatttttgctcactctccccgctttcgcgcaggccacatgcagctccactttcgtctnnnnnnnnnnnnnnnnnnnnnnnnnnnnnnnnnnnnnnnnnnnnnnnnnnnnnnnnnnnnnnnnnnnnnnnnnnccacccttgccgtcaccgttcccacaaagccctcgcgcacatcactccggtcgagccaggggtacctatgcagctctgtctagggccgacagacctgctgcttcagtcacgcacgtatagattgcacctgag

SEQ ID NO: 38933 - DNA, 70 bp, Chlorella protothecoides
gagggcctcagagcggtgcagtagctgcattttctttcactcatcctgggcagcaggcttgtctgacgag

SEQ ID NO: 38934 - DNA, 78 bp, Chlorella protothecoides
agagattcgaggatccctcacccagacccctaccccccaaaatcaccatgcagactactccaccaagtacaggtattg

SEQ ID NO: 38935 - DNA, 62 bp, Chlorella protothecoides
tgcagaggtggcaccattgtatgaacgataggtcataatccaggggcagcagcggccgtgag

SEQ ID NO: 38936 - DNA, 61 bp, Chlorella protothecoides
ctggtggccagcgtgatcgctacgctcgacaggcccgagcaattcgccctgctggcggggt

SEQ ID NO: 38937 - DNA, 68 bp, Chlorella protothecoides
tgaaatcggcggccacggcgcccaggtggacgcgcccgtcgtatggcccgacggccagcgccatgacc

SEQ ID NO: 38938 - DNA, 75 bp, Chlorella protothecoides
gttccctcttccggtcattggcattcacatacccgctcctgccgccccattcacgacaggtgctgatctcgcggg

SEQ ID NO: 38939 - DNA, 80 bp, Chlorella protothecoides
tttggagctttttgtggaggggaaaggggagggggggggggaccgtgacacgaggaccaggaggaggacagggggacacg

SEQ ID NO: 38940 - DNA, 61 bp, Chlorella protothecoides
cacagcgccagccagcggcggtgcgtcaggggcgcgccgctggcctccccgccggcgaaga

SEQ ID NO: 38941 - DNA, 88 bp, Chlorella protothecoides
ggcagccgaggcgcgcgccggggcgggcaccccccggcctgcccccccaagctgggacggtccggcgtcgcccgggcgcgagggggtg

SEQ ID NO: 38942 - DNA, 73 bp, Chlorella protothecoides
ctgggtttggcgcctgctgtgccaccatccagctcggagaagctgccgcagggctccaccttgaaacctgcac

SEQ ID NO: 38943 - DNA, 75 bp, Chlorella protothecoides
attgaattccccctttccacccagcccctttgggcccacccacccctcgtcggccacccgggcctggattgcctc

SEQ ID NO: 38944 - DNA, 132 bp, Chlorella protothecoides
aggccgcgtcagcggtgagtgtggggtggggttgggggcggggaggggggcatgtggatgcagtcagcctgtgcgctcaagcggatgggctgtcgaggggagagcctgatgtgcagaccgggcccgcgggtg

SEQ ID NO: 38945 - DNA, 121 bp, Chlorella protothecoides
cttggcccgcacgtcaagcagcgactggactacgggcacggagcgcgaggcgtctagcacatagaccacggggcccgagtactgcggctctatcttcaccgccgtgtgcatcttggaggtg

SEQ ID NO: 38946 - DNA, 1197 bp, Chlorella protothecoides
  modified_base (414)..(423): a, c, t, g, unknown or other
gcagcgccggcggcgcgtcgcccaggcgcgccggggtgtaggccagccagcgcagcagcgccgccacccccgccaggtcgtcctcgaccacgtggtggctgacgccgttggcgcccataacgcgcggcccgcccagctgctgctggctggtgtacacctcgcgccccagcagcttgttcagcgcggcgtagccggtgaggatgatgggctgctcccggcgctgcacgcagcgccgccccaggcgcgccaggtaggcgccgatgcccacgctgcgccccgacaccagggtcagggtccagccctcgcggaaggcgcgtgcgtaggcccccgcgatggcccccgacccagacaggcactccacgcccagcccatcctccagcccgacgacgtcgcgcaggacgtggcgccggccgnnnnnnnnnncgcgtaggcccccgcgatggcccccgacccggacagacactccacgcccagcccgtcctccagcccaacgacgtcgcgcaggacgtggcgccggccgccggggtggtccagcggcatggacgcaagggggggcgcgtcggggggcgcgcgcgccagcaggtcggcgtggtcggcctcgtccaggtacaggtacttgaagccgcgggtgggctcccccgtaacgttccactccaccctgaggcaccgcttgacctcctcggccaggcccacgcgcgcgccggagttggcggccaggtacaccaggggcaggcgctcctccagcgcgaactcggtggcggccttgaagaaggcgtcctcgcgcggcccgaacgaccccgagttgaaggtgatgtcgttggccacggccaccagctggcgcccgcgcgggcactcgggcgtgcgcagtgtcagcagccaggccacgacgccgacgtcgttgcgcgagggcgggcgctggaccagcgagatcctcccggagccaccctcgtacccgttcagctcggcgtccggcaccagctcctcggcggtgaccaggcggccatcgggccccggccccgcggcctcgcccgccgcggcgcgctccagccaggccatgcgcagcgcgttctcgaacacggcggggaagtcgtaggcgtaggtggtgcggtgccggcgcgcggtcaggcggcgctgctgcagcgcctccagcggcgcgtgcggctccagcacgcgcgcgccgtccagggcgccgggcgc

SEQ ID NO: 38947 - DNA, 61 bp, Chlorella protothecoides
cagccccgaaagagcaccaccgttccattaccgtcccctcaccgagcttcctgtgggccca

SEQ ID NO: 38948 - DNA, 65 bp, Chlorella protothecoides
tcccctcaccgagcttcctgtgggcccacgtggcgctgggcgcacgctgggctatcccagcgcac

SEQ ID NO: 38949 - DNA, 61 bp, Chlorella protothecoides
ccagcagtgggagttgtcatggtcgtggatgtgggagccctggcctggctgccagcacacc

SEQ ID NO: 38950 - DNA, 75 bp, Chlorella protothecoides
tccgggttgtcccggaacgcctgcgcgggggggagggggacgcagtctcgctctctgaagctgacagcggcccgg

SEQ ID NO: 38951 - DNA, 61 bp, Chlorella protothecoides
gttgaggcccttcttctgagcccccccccccctcagcgtgggactgttgcgctgcacagcc

SEQ ID NO: 38952 - DNA, 61 bp, Chlorella protothecoides
caccttcctgggcggggaggactttgacaacgcgctgctgagccacatcgtggaggagttc

SEQ ID NO: 38953 - DNA, 61 bp, Chlorella protothecoides
cctgagggatgtggcagagctgtgtcggggtgtgcagcacccaacccggggtctattcctg

SEQ ID NO: 38954 - DNA, 78 bp, Chlorella protothecoides
acttcctgccctgaggcagctgggctcaagacttgacgcgatcctctttggcgctcatgcctgcgggagcgccgggcc

SEQ ID NO: 38955 - DNA, 61 bp, Chlorella protothecoides
atcctttccggcgcctgccgctgcggcaggggtacattccacgatcgggcatccgttttgt

SEQ ID NO: 38956 - DNA, 67 bp, Chlorella protothecoides
cctccaccccccctccagccacacacacacacaccctcccttcaaaacccgaagtctcccccccttc

SEQ ID NO: 38957 - DNA, 61 bp, Chlorella protothecoides
aaagaggtcctcatgatctgactgattttgggcgcgcgcgccgctctcaatgccgagttca

SEQ ID NO: 38958 - DNA, 80 bp, Chlorella protothecoides
aaggacgtaaggaccaagcactacaaaaatgcgcccagcaccctaaattttgccgccacacatagctctcccttccgata

SEQ ID NO: 38959 - DNA, 31653 bp, Chlorella protothecoides
  modified_base (208)..(217): a, c, t, g, unknown or other
  modified_base (504)..(513): a, c, t, g, unknown or other
  modified_base (1146)..(1155): a, c, t, g, unknown or other
  modified_base (1332)..(1341): a, c, t, g, unknown or other
  modified_base (1517)..(1526): a, c, t, g, unknown or other
  modified_base (3113)..(3122): a, c, t, g, unknown or other
  modified_base (4646)..(4655): a, c, t, g, unknown or other
  modified_base (5210)..(5219): a, c, t, g, unknown or other
  modified_base (6154)..(6163): a, c, t, g, unknown or other
  modified_base (7049)..(7058): a, c, t, g, unknown or other
  modified_base (7891)..(7900): a, c, t, g, unknown or other
  modified_base (10438)..(10447): a, c, t, g, unknown or other
  modified_base (12436)..(12445): a, c, t, g, unknown or other
  modified_base (12777)..(12786): a, c, t, g, unknown or other
  modified_base (13341)..(13350): a, c, t, g, unknown or other
  modified_base (13782)..(13791): a, c, t, g, unknown or other
  modified_base (15169)..(15178): a, c, t, g, unknown or other
  modified_base (15857)..(15866): a, c, t, g, unknown or other
  modified_base (16004)..(16013): a, c, t, g, unknown or other
  modified_base (16392)..(16401): a, c, t, g, unknown or other
  modified_base (16612)..(16621): a, c, t, g, unknown or other
  modified_base (16702)..(16711): a, c, t, g, unknown or other
  modified_base (17364)..(17373): a, c, t, g, unknown or other
  modified_base (17743)..(17752): a, c, t, g, unknown or other
  modified_base (18868)..(18877): a, c, t, g, unknown or other
  modified_base (19609)..(19618): a, c, t, g, unknown or other
  modified_base (19944)..(19953): a, c, t, g, unknown or other
  modified_base (20087)..(20096): a, c, t, g, unknown or other
  modified_base (20167)..(20176): a, c, t, g, unknown or other
  modified_base (20884)..(20987): a, c, t, g, unknown or other
  modified_base (21097)..(21106): a, c, t, g, unknown or other
  modified_base (21378)..(21387): a, c, t, g, unknown or other
  modified_base (21801)..(21810): a, c, t, g, unknown or other
  modified_base (22164)..(22173): a, c, t, g, unknown or other
  modified_base (24806)..(24815): a, c, t, g, unknown or other
  modified_base (25057)..(25200): a, c, t, g, unknown or other
  modified_base (25276)..(25285): a, c, t, g, unknown or other
  modified_base (25542)..(25551): a, c, t, g, unknown or other
  modified_base (27411)..(27420): a, c, t, g, unknown or other
  modified_base (29167)..(29176): a, c, t, g, unknown or other
  modified_base (30185)..(30194): a, c, t, g, unknown or other
  modified_base (30425)..(30434): a, c, t, g, unknown or other
  modified_base (30815)..(30824): a, c, t, g, unknown or other
  modified_base (31334)..(31343): a, c, t, g, unknown or other
ccgccggcggccggcagcaggcgccgggcagcgggtcgtcggcggggggccggggcggcgcgccgcagtacagcggactggtcctgcagcgcagcgcgcactgaaaggggccatggtccgcggctcgtgccattgttttcctgggcccttgaccaatgtgccgccaggcatgtgtaaatgcaggacgcgaggcgtcgaggtgtcaacnnnnnnnnnnggggcccatggtccgcggctcgtgccactgttttcctgggcccttgaccgatgtgccgccagggatgtgtatatgcaggacgcgaggcgtcgaggtgtcaacctctgcgctcggcaggggagctgagctccgcagggagccgatctactgagcgctgccttgccaccacctcccatgaggcctcagcatgcgaggagcacgcatggagcgcgcagcagcctcgtgctgtcgtgcaccgcagaatcggacaggcttcctccgtgcatagcctcgtcaaatcaccaccnnnnnnnnnnggcagggagccgatctagtgaccgctgccctgccaccacctcccacgaggcctcagcatgcgaggagcacgcatggagcgtgcagcagcctcgtgctgtcgtgcaacgcaaaatcggacatgcttgctccgtgcatagcctcgtcaaatcaccaccaccttcacgcctgaaaccagccaacagcttgggtcgcagtcccaaagtcgtgtactctgggcgaccaagctcacggggcaggggcagcgaccctggtcaggcctgcccggctcgctctcgtgtccccggggcccccgggggcgggaggggaaggcgcaggaccagcgcgtccccgccgtcggcgtagtacccgcgccgccggcccacctccaccgcaccctgggcggcgtagaaggcgcgcgcgccgcggttgcctgccgccacctccagcaccgcgcgccggcggcgggggtgccggtcggccagggcgtgcaggagcgccgtggcgacgcccctccgccgcgccgcagcgtgcacgctgagcatcatcaggtccagctgcccctccgccgcgatgtcccaggcgcacacccagcccaggacgggcgtcggtgggtgggggggtgcgggggcggcaggcaccgccacgagcagggnnnnnnnnnnaggctgcaccgtctcggcctgcggccacgggaagggggagggctggggggtttgaggagggggggaggcaggaggggtggcggtacaggagagcaggaagtaaaatgaggctgaataactggggtttcagcggtccgagacagaggggggagtactgcagcatgagatttacatggnnnnnnnnnnataaattggggctgaataactggagtttcagcggtccgacacacatggggagtactgcagcatgagatttacatggacatccaagcggggctcacacagtgggttgaggaactcccctcccccacccgctcacgtagatggagtcggccgtccaagtcgcgccgccgccatccatnnnnnnnnnnagggctcacacagtgggatgagggactcccccccccacccgctcacgtagatggagttggccgtccaagtcgcgccgccgccatccatggcagccatggcgcccacatcctcacgcccggcgcgccggatcacaaactccaagggcggggccttgcgcgaggaaagaggaaggaggagccagtgagggggctgtgggattgaggtgacgtcgtctgcagcacagtgttgcaactgccatacgcctgcatgcctgggcctgactcccttgtaatggacgaaggtaagcatcatgcggcacctttatgagcctcgtcctcacctctgcagatgcacagacggcatggcataccacacgccttgcccgatgatgtacggggagatgaacattcaaacgactggcatttgcctgaaaagggtgcaatccccggcatgcgtgcatggggggtgcgacggtccggtaagccgtcgtctgagtcttctgctaggcgatcacagcatgtcagtcgaattcagaacacatgggagccttttcatggtcatgcgatggctcggcaaagacactgaaaccctgtttcagactggccacgaatgtttccaagcaggctgcgggttcggagatggaatccagtcggacgcacatggcaaagattgtgccacttggtaccctcagtgacacagaccctgagtatgcattcactcctgaggtaatgtccccttgtgcgctctatgcaatgcgatacaatgaggagccgacatcgcattcacggtgttattccgactggcacgcagcaacataatctgcagggcccctggtccacagcgtggcaaccgtgtctgtctcaaaggtctctatgtcaacgatataatacaatatgaagttcacaccctcaaacgacaactgcagctcaagctgtctgaatactcagtcatcggaagtctgccagtcaatgacacacggcatgcagatgatgcccagcgggtatcgcaccgggtcccacctacgcgtgcgttgtaggagagggcgtgtaagggtataaccataagcacgttgggccacaacacgtgatgttgtgacattaaccacagatgagtagggtgtcccaattcacattatgatcagaggctgtgagacaaccagcagccccccaccatcttcggaatggtatgtttgatgtgggcaccatgcggcaattgagtcccaagggtgcgggaagcaaatgcttgacgtagtgcccgatctgcgtgcagaatgcaggaatagtgcaagggcaggcccaaataccttgtttcgacgctcctctcctcgagatggtcaagctgtggcccttcagccgctctcacaacaattttatttcagtaacttaccatcctcggctgcatcggctcagccatagactggcaaaggaccgccggccaccagcatgccccggccgctcatggcatccaatccgactgttgagcttgcatgaacttacagtgttcatatcaccagtatcggaatgcatcggcatcagtccggtggccatcgtagcgcctgcgcagcaaataggtgtgcaccaggccctgcaacagcgcacatcgtggtnnnnnnnnnntggcatcagtccggtggccatcgtggcgcctgcgcaggaaataggtgtgtaccaggccctgcaacagcgcacatcgtggtagaaatcaggaccgggacgtttacaccaccgcgcgcgccagagaccacatacgggagaatgttcttcattgcagcgtcaatcgatcgcgtggacgtgcctacacacgttgataacaccctttgtattataacaagcaccatcggtatcttttccaccctcaatgcgcgatccttggtctgctctgggcctatcgcggggtgcctctcgacagcaggtgacgtgcggatcgtgcgggcatgctgtggactgggacgttgaaataaatcgatgggaatgtcgtgcctttcatgactgaatcgtacccacattggttcactccagatcaaagaggcgtaccgggccctcgccaaaagacaccaccccgacctgtgcgaggccagtgctcgcagcgaggccgaacgacagttcaagctgataaatgaagcgcgcacccagttgctggcttcttctagcggtgagctgttacgcatttgcgtggacgctgaggaatacgtgtgccagctcgcatgcggtctctcctgtgccacattcacactgcaaccctgcaacggcatccttgacccaatcccccctccttgtcctggtgcagggtcatcctccacacggcactatgccggctaccagtcggcggcgcacggatctgccaggagcagcgaggcccagtttagcaacggtttcgtggccgccatcatttccatgcccctcatcctgacgggcatgtggatgagccggacgatgcccgacaccctgtcctccacctggcgcatgaacgggctgatgcagtcccccgtgaacccctggctccgggaggatctcaagcccaggacccggagccggtggtctggcggcggcaaggaggtcgagggctgagggagcgacgcttggcaggcatcgctcgggccgcagacatgtgtactctcccgccctgtacttttgtatcaaacgctgatctgttttcctccctttttcagcactgactctcgtcattgaggttgtatgtgaatgttaccctccaggtgcggtctgtcagcgagtcagtcggtcaatggaggagcactgaggggtgggggtcgggtggtattctcggggtgtggagccggacggtgctggggctctggcctgggcgcaggctgccgagtgcttgctttggtaggggggggcgccctctggctgctgggtccaccaaagcacatgcctgactgcctccgggggcggatgccaggatgcaccaggctttggcagagggtacgaccgcccatggcgatggcaagacgcagcacgcactgggctgcccgtcctgattctgcgcccagactcaggctcggcccgcgacgagcctggagctggtgcgcagaccgcggccgacgcgctcgacggccggcgcggccttcccggtgccccccgctctcttccccgcgccgggcttgcccgccgcaatcatgnnnnnnnnnngcggccggcgcggccttcccagtggcccccgctctcttgcccgcgccgggcttgcccgccgcaatcatgccgccggtcttcacgaccgcacccagcacatcgctccgcagcgtgctctgccggcgcgcgccgcgccgccggccggtcggggcctcccccgcctcttcaccgctcgggcgagctggggaggggctggcgctcgcctcctcctcacccggcgcctgcggacgctgggcggcccggtcctgcgccgcctcgccagacgcgcagggcgtggcggggccggcgggcgaggcggacctgcgatcgcaccccgccgcctccctttctagctcggcgcgcgtggcgtcggccagctccttgggcatcaggggcagggccgcgctcctcgcctccggggccagattgttgaggaccaggtagtgcgccaccgacacaaagcctgcgggtgggagggggggaggttgtgcacgggtagtgcgcgagccacacgccgctcgaccagaggagatccaccctgccatcacaggccgcatagaacacctctgccgcccnnnnnnnnnnaggtgggaggggggggaggttgtgcacgcgcagtgcgcgagccacatgccgctcgaccagaggagatcccccctgccggcacaggccgcatagaacacctctgccgccccaccttcggcgacggcacggcggtagagcgtgcccgtcggcgcccagccccgccgcgagcggtggaaggagcagttgcagaggtcgcggcagccggggcacttccactcgctatcctgcagcgcctcctccacgttctcgccgtaccgcatgaagaggcagtcgccgcagaacaccccctgcatggtggaaagggggcagaatggtgtggtgagcgcgccgtgcatgtgaagcacggggctgtgatgtggtgctgcatgggagtcactacacacattgtggtgcctgggcaacactaaatggcagccaacgcagccggcctgctcacgtggagggactggcactctgagcaatgggttcgcagccccagggtcttctggcggcactggtggcacgtctgacccgacaccttgtcgtagatgcggttgccgctcttgtcgtacccatcctcgaacagggtcctgggaccaatggtggtgggcggaagactggttagcgcagcaagacagggatttatgcggacaagagcagggctgatgcttcctgcacacgcgcatgcacatcatgtctccggttcctggcagctgttgccaggtgggccaacaaggaggcagagatgaccaaatgccgcatcactcaccactccttggtgtgattgcccagagcggtgaggtgctggacgccgtacacttcctctcggatgttttctgggacagtggggtgaatgggctcgtgaagaccggcggaaggtgtgtttagcatggaggcactgactcgtctcaggtgcttagaaatgcagccaaaaggagatgatgccggtacagcgnnnnnnnnnncttatcatggagccactgactcgtctcaggtgctctgaaatacagccaaaaggagatgatgccggtacagcgtcgttgtgaagtctaagaactgccataggacactgcctgtccagagcctcgaccaaacacaatgagggtggcacctttgagcaggcgccggtcgtgcttggtacgctcctcctcggccaaccctgcccttgccaggtcgctctcgttgtacaccactgcagggttgcccgcaacacgcgccgacctgcatgggtgtgggggtcagtactcgggctggcgggcctgcagcgctgcgccgggttgacattccaagctgggggcttgcgatgctcaatgcaaaggcttttccgtacagaagcacacaccatttcgactcacttcgattcccaaccccgtgtcaagcctgcatgcatcacccacccagctcacctcctggaggactgtggcctctcgcggggagcagctttgcagccagcagcgggaggggcccgaatgcggcgaggagctgtcagcatctgaatctgggatgtggcctgcacatgaggaagccgcaatgggtaggagctgaagtgtgcggtttcgaggtgtggaacgccatggctaggccggtctcggctagcagaatacggtgtccgttgggcaccgcagcatggatcaatgacacctgtgcagaccacatgccgcgctcatcccacctctttgagacccaagacgtccatccgggctttgtttgctgcgatgcgagcctggcgctggagttcatactcggagagcattgcgcgcaaaaaggggccgggggcctggagaatgtgcaggggctgtgacctgagcaggacgtctggcgagccgattgcgatataattattcgattgannnnnnnnnntggcctagagaatgtgcagggcctgtgacctgagcgggacgtctggcgagccgattgcgatataactattcgattgaggacaagttgaaattatgtagcagtgttgagacttgcgcatgttaagacactgtcactgcgatccgtcgcgaaccccggtgggtgttggtagatttcaaatttcgaaaggaacacccacgtgctccagcaggacccagcatccgttggggcaagagtcccgcttcttcaaggctcctgtacagctggtcccgaccatgctgctgcgactgaacacacgcacactcatccgcggttcacagagaagggcggccaccctggacaggttggcgaaacggacgggcatgctgatgggcgacggatcgccagccgttccctcctcgggacacccatcaaccggcgtgcgcttcctgtggcgccgtgctcttccgccgcttgcttccagtgggcggcgaaggggtcttggcagagcctgcccttccactcgctggccgagcaagcgtggactgcacggcagccgtgcggaagctccgcaacctgccctcctcggcaaatgtggccgcccgcaagcgctgcagcgccatcatcttggccaggttggccgggtgcattagtctcccccccgagctcgtggcggccgcctcgcggatccaggccagcgtccgctgcgccttctgggtccgcagccgcggcaggctgttcaccgtgctctgcacctgaaaggtccaagggggggggatccggtgacagtctcaggggacaaagagggcaaggaacaggtgtataatcagtgacagttcgagtattgaagggtccannnnnnnnnncaggggacaaaaagggcaaggaacaagtgtatactcagtgacagttcgagtattgaagggtccaagcagccccaactggctgatggacggcaggcgctctgccttgaggcggcctgcagggggctggccccgcaagtccccttgtcctcgctgcatcccgtcacctccctccactcacctcctcccagctgtggcagcagtacccctctggggagatgaacagggggtacccatacatgtccagcctgaagctccagcctggggcctgggcgaggtccggccagccctgcaggcccgcggccgggaagttttgcaggacggggccctgcatgggcggcggctggcactctgcctgctcggggacggtcctttcggcggcggccggcggacccgtcgccgtgctctcccgggccgccggaggctcgcctgcctcgacacgagcgccgctcgccgggaacccctgggtcacccgaggcgcggccccgcgggcgtggcccggcatgcttgagggcgccgccccggccccgctgctgccggacgggcctgagctgggtgaggcccccgtgtcctggggcagacccaggctgctgggcgccctgctccttcgtccggccgggccaagggtgctggcgcggactggtttggcaggcctggcagccggcgtgcgcacaggcctggggcgtgtctccgcaatgaggtcctcctccttgacgctgtgtggtgattcccggcccgatggctgccgcttgggaggggggttgatcctggtgtcctggtaggccctcgaggtgagggagtagaccaggccacggggcatgggcgtgacgaagcttccctcagccagccaccggcgggcctccttggcctctcggtcgccgaccgcaccgctcaggatttcatcaaacgtcacaacttggtgtgtgggttggggcagagcactggcgagcatggtggccatgtttgcgacccgctgcgtggggaggtgttaccctgaaccccctctcaccagctcccgatggcaagctccaggttgagtggtgtcaacacaaaaatttgagatgtgcaccgcatcatggcatcgattaggtggaggcgcaattgacttttcaagcgaggtgccggccacattgccattctccgtcatgatcggcaccacggagaatattggaatggcccccatggtggtcctgagtcggctgacaccaaaaccacagacggtggcatcctccttacgagagcagcctctagctcctgtactttccagagcaggtgtacacaccgagatacaccttcctgatgcaagtacacatgatgcatgcgtcccgtctgcatcagtccccccgcagagccagctggatggcctgcctcactttctccatcgcagcctgccgctccgcatggacctcgaacaggcgggcacgctgggcctcgctcacctctcccggcgcagcagaatcagcggcggccatggctcgctccaggtccgcctggccggcggctgccacgctcagcacatcctgggactcggccacaaaggctgcccggtccaccaggctctcggcaatgtagtcgctggcggacgcctcggctgccggcgtgggggagggtgggtggtttgagggtcagggaggtcaggttcccacacgagacgtgcatcctgggagcagggcgacctcgattgcatgctcccagcacttggattggttgacgaccaacagccggcgcatcccaatcagccatgggggctgcactgcaaaccaggagcagtggacagctgcagagcctcccacaggcgaccccctgctgtgcttccgagccagcagagcccgcatcgccgcccacctttggccaggcgcctcgccaggtcgatgagatccgaccccggcccggccgtcgccgaaaacgcagcggccaggcgggccgacgccgcggcctccctttccttggggccccttccgtccgcgccggactcgtcgggggtgagcaagcgcatcacgtcatccaggagtcgcagggcgggcgtggagtgctggcggtggaactcggcctgcagcctgcatgaaggagcggcctggcagcggtgagggtggccggcaactttgcgcggcacagaattctgtgagacgcctggacgtcacagcgaggagccccaagatgccacaggtttggaagctgtagaccaaggaagcgggcacagcaggctgtcgggttttctccagggacaaaacttgcctttgatgcaagattgtgaggccctccaaagcgccattctcttctgggctgtcgcgtgcaagctcgatgcgccgctccagcatctgcaacgaggaggagaaggcacggtcgggaatttgcacagagctgggaactcatccagacaggaacaccatcgcataggtaaacgggtttggaagaatccaatatagtattttttcttggcatgacctgactgggataaaacgctgtcccaatggccagatattcttgctgaccctcaatggacaacgtgatttacacaaccctggacccacatccaatgtnnnnnnnnnngtatagtattttttcttggcatgacctgacctggattaaaacgctgtcccaatggccagatgttcttgctgaccctcaatggacaacttggtttacacaaccctggacccacatccaatgtgcatccagaaccacccgcgcaaatcgactgacctccagcatctccacatcgatctccgcagagtactgcgagatgacatcctccaccttctcccctgcacgagcaatctccagcagaatgctgccacgcctgcaggagatggtgacggaaggatgatgagaagtgacggttgccaagtgttcaacgatagatcttccagccagtcaggctccacaggtagcatcttgatcagtccctcgctcactctatcacgagcagacagagatctgggcctcagcccaggcttgctccaacgcctgcttcatagctgcacgctccccgcccttgccatgaccagtctccacccccccacaccgcacctgacctcctcagggtccacctggacgccctgtctgccgcgctccgcgttcagccggcgagcatagtctgggtccagcgtctcggggtcctcgatggacatgacgtcgtccagcacctctggatccaggaccgtgggcggtggcgtaccgggtcccccttcctccccaggctgctgccttggtggcgcccggcccgtcctgaagccggtccggcgggccgcagtgccgcccgcggaggaggttgacacctggttcatcgcatcctcctcgtcgtcgctggcctcctcaacgtgcaggcctggcccctcggatgggtccggttgtcgctggggggggcatgaccagggaggagtggggtacgtctgacattagggttgccagcaacaccctgcaggctcttttttccaccacgacacggcagaggcaggtcacttcacatacagaagatcgctggcatgtctcgcagctcaccagtgtgctgggatcaacgggccgagggggggccctcggccggctctcctgtcgcagccgtctggaccgccgctgacccggtgtgccggccatgcacgccactgttcttccccgagggccatgcatgcatactgctgttctaaaaggataacatattcgtgctccaacggagaaagatgggcctgcatgggccatcgtggaggattgcaggccgtgcgacgggcttcaccgatgggacgccgacccagtccttgcgccaggtatcgccacgagaagtccgaggggttatgttatactgaggagcatgtacaagtcctgcccactcgggccgacggttcctctggtccagaaggtaacatgcccccacgcagcgcgcgtgaatgaatgcgggtttgcatgcgcactccggtaccccaaacttcttaccggtatcctctgaatctgatatcagcgtgcccagcattcattctacagcaggtcatactctacagcattccaaggcaggaggggtggcgccaggagtggcagacggtgtcctcagacccctcaccagcctgccttcaccaggatgatctcgtcagtccagccccccaaggtgctcaccgctaccgcgtcagaggctgactgcggccagcagcaccgacgccgcgatgctgccgtacagcaggcccctgctgctggccgtcacggcggggacctccagcggcgaggtcttgtccacctggatgccgtacttgtactcgtcccagtacaggtggcgcacgccgccgccgtagtggtacagcaggggccaggcgatcagcgccttggcggggtacagcaggagcggggcggcggtgagggcctccacggcccccgaaagggcgcctgtgagggcaaggtacccggtgagcccggaacctgtggattgcatgagttggcgggtcgtgttgggtgagtagtcgggaagaactgtacgccatgtcggtggtggctcagtacccaagcggagatatgcccgtcgtacagtcacccatgcatctgggacccccactcctnnnnnnnnnncgtggttgctgagtactcaagcggagatatgcacgtcttacgtcacccatgcatctgggacccccactcctaccagctcttcctccatccaagaaagaaccacaatgggcagtgctcaccgagggacagcatgacaccagtggcacggttggtgatggaggagatggcacccgggggcatcttgtagtgcagctgcttgtggtcaatctccatgacgtcgggggacagggggcgctttgccaccaactgtgcatgcgtgggggtgggggggggaacatcacagaaaagcatccggaagtcgatttgcagatgggatcgccacacacctccannnnnnnnnntgtgtgtggggcgacatcacagaaaagcatccggaaaacaatttgcagatgggatcgccacacacctccatgcccctccgagcccataaaatgccacacgcaggcccgcacacgctcatggtctcacgtccagatgattctttggggttccgaggaagtcggtgcctgggtggtaggtggactcgcggccccaaaactctggcacgctcgcgtactccctatgtgagttgcgtgaggacacgcagggtgagacaaccccccggaagttccggccatagacagccgtgagagggcggcgacaccaaacccgtcacacctggcatgctgcatgcctatggctgcgagtccctggccctgctggcgcatctgcgcagagcagaggccctgcaggctcctgaaggcctgcacgcgggacatggctcaggtctcgtgtggaaaatggtggcgatgcttctacgtggctgcgaaaatagctcgcgatctcgacggaggtatcctccacaaagattgtctgagaaaatcgcggggtccattcggtgttagtcacaattctgnnnnnnnnnnttcgacggaggtatcctccacaaagatcggctgagaaactcgtggggtccattcggtgttagtcacaattctgccctcacaagaaagaggttgcggtccacgtcacgccaacgaggcggtggcgacccgagcagcagcaggccctcgggtcccagcgtcgctgcggccccgccctttgagattctcggactcatgcccaggagatgaggctgcaaccttcagagcgaacatcgccttgtccccaaggctgctgctccccctttattcgctgggttgcacatagggagggacataggagccttgaaacacatttacaagccagtcgcataagagtgagtagattctggcctcgccctaggtatcagcattggtgagcgtaacgcgcatgcccgctcgcctcatatgcaacctcgttcgtcctgccgcgcagtnnnnnnnnnnaccctaggtgtcagcattggtgagcataacgcgcatgcccgctcgcctcgtatgcaacctcgttcgtcctgccgcgcagtgccgccgaagaagaaggaggagccaaaggagaagcccattctgggtcgcttccgcaccaacttgaaggcaagtggtatattacgatccatgatgatgcacctcgatgcctgtagcctgcattctgcgatctctcagtttgcatgccttagatcgggcgcttctgtccgcctgcatggcataggtcggaatcgtgggcctccccaatgtgggcaagagcaccctgttcaacaccctcaccaagatgggcatcccggccgagaacttccccttctgcaccatcgaccccaactcggtgaggagctggatcagtgcagcaggggatgaggccatgcccgtgtcccgctgccaagcatgcatgtccgctggcctccagcggagagcgcaccagtcatcgaacggccagccctgggtaccggcggcgccaggttttgcaaggccaagcccagcaatgcatcttgtgtccaaaaataccctcgtaccttccctccacaggcccgtgtgaacattccggatgagcgcttcacctggctggtggacctgtacaagcccaaggccaccttccccgctttcctggagatcgtggacatcgcggggctggtcaagggagcggcgcagggcgagggcctgggcaacgctttcctgtcgcacatcatggtgagggaggatgtgggtttcctccgcttcagtgacggcgacggcggctggggggaaagcagggcgggaccagggggctatgcagtggcatgtgtgccgacatcagccctcccctcccaacgcgtggttggatcagcctgtcccctgggctctggcccaaaaatccccccacggcaccctcccaggccgtcgacggcatcttccatgtgtgccgcgcctttgatgacgcggacgttgtgcatgtggaagaccgcgtggaccccgtggagggtgagcgggcatggcaattggtgtgggatcccaagtatgcatgcctgccaggtcatgcagcagcagccggcgccttggaccccgccgggtgcggatgggtatcgcgatgccgtagccacctttctcccactcccgcagaccttgagatcgtgcacagcgagctgcgtgccaaggacattgagcgtatccagggcgtgatcgagtccctgaagaagcttatcccaaggtgagggctagaggagctctgatcatgtacgagggttgcttgtttggcgaggagattcggggtccctttgcgaaggctgggtgcctgctgcaggttagggtccccgaccgggcccaaatgagtgtgcgggtcaggagcgtggcctgnnnnnnnnnncttgcgaaggctgggtgcctgctgcagatcaggctccccgaccgggcctgaatgagtgtgcgggtcaggagcgtggcctgggagtagggccaggagcctgagcttgcaagagaagatgcattgcccatgctccgacggacagcccggctcttggcgggtgatcaagactgcagcactgccctctctcatcataccccataccaatttcatcccctttccaggggcctgaccaaggagcagaaggaggagatggcggccgccgagaaggtgctggcctgggtgcaggagggcaaggacatccgcagcggcgactggacggcaatcgaggtggagttcctgaacaaccaccagttcatctcggccaagcccgtgatctacctagtgaacctgtcggagaaggactacatccgcaagaagaacaagtggctgcccaagctgtttgagtggatccaggcgcacggcggtgcgcagctcatccccttctctggcgccctggaggccaagctgttcgacatgcccgatgacgagaaggaggcctactgcaaggaggtgcgtcgattgggaaggggaggggagattgcgagggaaggtgactcaccatgcatcggagatacgtttgggtttgtgcaaaggcgacccctatgtggcgccccagctgcacgaccctcggcagcaccgnnnnnnnnnngtgggtttgtgcaaaggggacccatacgtggtgccccagctgcacgaccctcggcagcaccgccccctgatgcaaccccggctcctgccttcctgccttcccttgcctcatccccccccccccccccccccccccccnnnnnnnnnntgcacagcatgggtgcacctcggccctgcccaagatcatcgtcgctggcttcaaggcggttcacctcatctacttcttcacgtgtggccccggcgaggtgcgatgctggcaaatcaggaagaactccaaggcgccgcaggtgtgcgggctggtcagctgtggcagtggttgttgagttttgggtgtgggtggcccaatgcacacaggcggggggcaacgtgcaggctggaaacgcacaagctggatgacgggtgtgctgcgcgcgctgcgctgcggggtgtctggagcacagcgcgtggcccggctgcaggtcgaaggcacacagggacgtgcaggaactgagtaaggtcgtgtgtcccgcctgggtgctctgaacagnnnnnnnnnngttgggtgtgggtggcccactgcacacaggcgggggcaatgtgcaggttgcaaacgcacaagctcgatgacgggtgtgatgcgtgcgctgcgctgcggggtgactggagcgtagcgcgcggcccgccttcaggtcgaaggcacacaggggcgtgcaggagctgaatgtggctgaatgagatcgtgtgtcccgcctgggtgctctgaacagnnnnnnnnnnctgtccatgcaggggaggcaaggtcggctcaccagagcatgatcttcttcagagcctcaaccctgcataccctcgacctgnnnnnnnnnncacactgaagcagtcccccacgtgtcaaaccccccacactcacaaacacctccccgacaccacaggcggcgggagcaatccacagcgactttgagcgcggcttcatctgtgctgaggtcatgcactacgacgagctgaaggagctgggcaatgagaatggtgtgtcctggggcggggacgatgtggtgcatggttgtccaggcaggggaggcaacgtcggctcaccagagcatgatcttctttagagcctcaaccctgcataccctcgacctggttcctccctcaccgcagccgtcaaggcggctgggaagtaccgccaggagggcaagacctatgtcatgcaggtgcgtgggaggcagggaggacatctgtgaggggcccaaatgctccacgccgtggttttccgagctgatgggtgtgcttgctgcgatggcagagtttctgtgcacgaggccaaagacaaacacggcaacatcaccttcccacaccccaggacggcgacatctgccatttcaagttcaacgtgacggcggaaaagaagaagtgaggtcattggcggggcttcagctcaacagtctatgttgcggtgtcagtgcttgccatttgtcagcatgccactgcctggtcatgctgtacaaggagagcactggcannnnnnnnnngaagaagaagtgaggtcattggcgggcttcagctcgacagtctacgctgaggtgtcagtgcttgccaatggtcagcatgccactgcatggtcatgctgtacaaggagagcactggcaacagacactgtcccagtggatctgcaccaggtagggagcataaaattatcgtttcaagtctgtgcgtcgtgaggctacatgctgccatgaaaagcatgatgcattgcagcgggattttacatcgtacggtggggttgacattgcatcgtattgcaacagggagagcagggctaccagtggccgacaaggtatgaattctgactcctatggtactacctcgtgaggaccatggtgcaccacttcatcatagtannnnnnnnnngcggactactagtgaccgacaaggtatgatttctgactccgatggtactacctcgtaaggaccatggtgcaccacttcatcatagtaagacagcttaggagtctaaatgcgtatgatctctcagcatccagcccggtgaaaccccttcatgatgccccaagctccgacctattgaaactccgatagggctgcctgggggcgagggcaatgcgtcacacgctgatcgcccgtgtctgagcatataaagcagatacatgaatatgtctgcttggcggactcggcctgcacgcatgcacgtccccaggccgacgcacttcctcgccctcccactaaaccatgtgcctggcctgcaagccgctgtgagggcaatccagaccgacctggtcggctgtgtgccgtcactggcgcccacccttgtcgatcctgccagtttgcacatcacgcttggagtgctgagtctccagggagaagaggcctgcaggtaaactctcgcgctcacactggcaggtccgggcagggatggcaacccgcccgctgcgctgtagccttgagaacctcccccattggaggacacaaactgcagggaggtagccgatgttgcccatgccgtcctgcacgccgcaacgcctccagccccgtccatcaccctgacagggctgagtgatttcaaccaccgggtgcgcagctggggtgcacatttcgggcggtgagagaacggtgcagacagcttcacacaacagagcaaagatcatgcactgactcctagcctgagctgtgccaggttctgtattgggacctcgtgcctgacgcaggcaggcggagcctggtcaggctggcagacttgctggagcaagggcttgtgcagcggggcctgatgcagccatctcggcggcccttcactcctcatctcaccctggccaaggtgccaccagcatcgccccgattgaggcaggcacagggtgagcgtgaggtggcggtctggtggggaagaggtgcaggggacctggttggtgtgggttgcgcctcagcgaccgacgccgacatcttagatgctgccgccttcaccagaagtccaggcaagactcggacgcttacgtataccaaccacagaaatannnnnnnnnnattgcgcctcggcgaccgacgccgacatctttgatgctgctgccttcaccagaagtccaggaaaaacttggacgcttacgtataccaaccacagaaataatcaaatctgttcatcattccatgcagccctcagggacatctctgccgaggcatactctgccaacatgggtgcaacatatggccctattctgctgtcccaactacaactctgtgccatgcgtggacggctcccagggtgctactacccgactctgtttgagctcagcttggatggagcatgagaagcgcataatttgggcattccatcgttcgtcagtgtcccactctgacgtgaccagtgtgtccatcaatttaaagccaccgcaacatgcatgcagacctatcacacatacagaagacgggtatggcctacgctccgtattcctgtgcagttaacaaaggatcgacaatgagagggatggtggatggttgcatcacattcaacaagttgaaagcaacaaggtgtctactccaggtgcatgcgcgtgggcaacagggagcacacgcacaatttggcacccaagcatattaatctgggcgcaactaaatacaggcagctcagagtcgtaactagctgactgggagtgtgtgcgtccaatagaactctatccatcttgcaaccccgtactctcactgctcaccctgtgaaagcgagaaggaagagcagtcacctttcactatgttgtggtccannnnnnnnnncaatctgggcgcaactaaatacagacagctcagagtcgtaactagctgtctgggagtgtgtgcgtccaatggaactgtatccctcttgcaaccccgcactcccactgctcaccctgtgggagcgagaaggaacagcagtcacctttcactatgttgtggtccagaataccagtctaagcaatgatacaaagccgtggatggcattccttactctttcctgaatgtctgcgcggcggtaccgcggcgtagccaatgacccgaagaatgtggtaacacatggttccggaagtcgcggtatgatcatatgtttgtcaaatgatgatcannnnnnnnnnacagtctaagcaatgatacaaggccgtgggtggcaattcctgaatgtctgcgcggcggtaccgcgtaatgacccccaagaatatggtaacacaaaggttccgatatgatcatatgtttgtcaaatgatgatcannnnnnnnnngttgatttcttgcgagggcagaaacacaagtgccccaaaggtggacttcaatccacgccctccgccatggnnnnnnnnnngaacgggagtcgttgcgtccaaatccatcacaagtgcgatctgcactctccgaccgtgcattgttcacgtcggcatttatcgaccgaagtccggtattgatttcttgcaagggcagaaacacaagtgccctaagagtggacttcaatccacgccctccgccatggctgattcagatgtggatgaatatcaaaaacgttgggaggcaagctggaatgcaggtctcaagcccggcgaggtgagcgtgtgcgactcatgcctgcaccacccgctttgctccctgtgctgtggtctggatctcatgcgatgctgcacagtgcgaccccccccctctttcgatcaatacttcgcaccacagagattcgatgcatgtcaatcatcgcctgcactactcgacctgctgaaaaggggaaccgtggctgtggaggggaagagggtcttcgtgccgggctgtggcagagggtacgaccccgtgaccttcatcaaggctggcgccaaggaggccatcggcctggagcttgccccttcggcagtgagtgactcgagggtgcagtgtgagccgtgtgcagtgttggccgagtgcgcggttgatgcggaaacacactgagcgtggaatggctccacacgaggaccattggtccacgtgacccatccacccacgctgcagacccctgcagccaacgagtacattgcagcgcagtcggtggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggttcatgagcgtgaggaggtagggcgtgtatcccctgcatggctgtctctcacacagaggatggtggagtgaccaggcgccatgatgcatctgtgcccagactgtnnnnnnnnnntcttcaagtggaaggaccctgctggctttgacgtcggctatgactagtgaggaagggttcatgagcgtgaggaggaagggcgtgtatcccctgcatggccgtctctcacacagaggatggtggagtgaccgggcgccatgatgcatctgtgcccagactgttgtgccctcccaaacttcaattccgccatgcaccttccggttgttcgagccactcaaacgcctttttcatctcccgcagtaccttcttgtgcgccatgcatccgaccatgnnnnnnnnnngaattccgccatgcaccttccagttgttcgacccactcaaacgccttttcaatctcccgcagcaccttcttgtgcgccatgcatccgaccatgcgcgaggactgggccaaggcctggcatgggcatctgtcgccaggaggcaagctcatcaccctcatctttcccatcaaccctgcggcagaccctggaccgccctggtacattcacccagacatgtgcaaggagctgctcatccccgcaggcacggcagtggatgttgtgaccaagggaggggggtgggggagggggttgctgccgtgcgacggcaagtgtggcatggcaagttcaatgcactgtaggcgactgccaaccaagccaatcacccctcgcaatcccaggctttgagcttgaaaccctggaaaaggtcccggacgnnnnnnnnnnaggggggtggggctgtgcgacggcaagtgtggcatggcgggttcaatgcactgcaggcgactgccaaccaagccactcgcccctcgcaatcccaggctttcagcttgaaaccctggaaaaggtcccggacgagctcagtcacaagggccgcgagggcatggagatgatggctgtgtggcggcggatctgagcgcagaggagctggtgatttcatcacagctcatccttccctggtgcactgtgatgacactctggatcgcctgtaatctagctggccacttgaaatgaaccaatgaaatgggagggtgtgctcaccgtcgatgtccggtgtgggagaccttggcgtggcatcgnnnnnnnnnntctgggaatgaaccaatgaaatgggagggtgggctcaccgtcgatatccggtgtgggagaccttggcgtggcatcgaagccggtgcgcagcatgggacccgcacatgggtgcatgccggccaggccctgcaggttgagcccttttcagacgacatgcgatccccttcacatttgtcgcactgctagcatggagcgcacattgcattcctgcacaagtgcacggccccatgtggcctctcgcgtcggagggcaggctctcgggatcctgacgccgtgttcccatgttccacatgccgggctcggcacggtgcggcagccccggaggacgccaatgacaccatgcatggctgtcaaggacaagaagggcccccagagattagagtttaggtaccagcagtgtcagtgatggggccacatggggtggccccatcatgcatggtccatccctgtctcatgaaagccgatgctgcgtcccatccctcccacccgcgcaggcccataacagacaaggaggccagtctccgagtcgaggtggagtcgcccttccggagtctgaggatcatagtactggggttctgcatcgccagcgctggcatcggatccctcttcagcctcgtctacatcctcaaagacggggtgcgatgagggcgtgggcgcccctcgcccctccacgtggagctgcttgtccaatcctggtgtgtgcgtttccacccctgctccgccagcgtgacgcccagtcgccttgatgagccccctcgccacccttccctcccatccctccaagcagcctgatgcctggaagaacctggggatcaatgcgggtgtggtggccgtggccgcctggctcctgcgccgcgatctcaaggcgcggggcactgctgtcaaccgcgtgatgcgggagggccagctgggggcgtgcgaggtccagctccagaacgggaggaggctccgcctcgccgacctccggtgggccgggcgggatggagtgtgcttggttccaaaacacatccgagagtgggtcttttgcctgtgacacgtgcagggcgtctccaaggcctgtggatggatctctcagtgaccagtttctcccaaacagctttgcctggccactcccccccgccccttcccgcacacacagggggtcagcacgggtggtgatcatggtcgggacgcgggagcaggtggatgccgcggtgggggccgcagagcccttccgggagagactgcaggcagcgggggtgctgctggtgccggctgccatctacgaccagggcagtggcacctctgacgcggccgcaccccaggcctccgccgcggacctcaagtgcgctccggcggagggggatgctgttggcgtcgactcatgctgggtttttggcttggggtctgctgcagggtggtggaggtgcccccatgctggcacggcgcctgagcctccatgttcagcctccagcattcgacccagccctgcgcccggcccccgccgcaaccccccactccacccgtccctttgcaacccaaccccctgtcccaggtgggtcgcccagccggtgcggctcgctgagtggcggacctggttcgagcagcagaccaagtcgcagggcacgcccaccgccgggggcctgtacatcagcctgcgcctggatgggcgcatccgcgccagcgggcggggctcgcccccctgggagcagctggccgcccagctgccgtctgtcagcgggttctttgggggcttcctggacggcatggacggcagggtctgagctgaacctggggcgagcctgtcactgttcagagtgctctgtcggcatgtggctcgggcggtttgagatgctcacgagtaacgtcagccatgcccctgcgcatgcatgtggggcaggtcaaggtacaagccgacgttggaaagggctaggcaagggcacgatgtgtaaatatcatgagaggcccgggcggtgtgacaggggctggacagtgagccgaccacgaagcgtgtggcttgggcgtttgaagcgcccagtgccaggcagctcagcccgccgccgcccgcgcctgctcagcatgaaagtaggcaaacacctgcttcagcatgcccctggtcgggcgggcggcggggctggccgccgccacgacgcccaggtacctctgcacatccgtcttgctgacggcgggggtcccggtgcccggcccgccctccctcggacggagcccgccggcggcgtcgatggagtagagcgccgccaggacggcgacggccgcgccggcgagcgcgtcgccgccggcgtcgcccagcatgcccacgcgtcgcccgccccgcagcgcggggcagaccgcgtccaggacggcggggaggcgccggagcaggcccgccttgtcgcgcttgcagggcggcacgggcaaggccagcatgcccagcctggccgctgtggcgcctggcgcagcgccacagtcctcgcccgtcgccgtccgcaggtccagcaccagatccacgaggagggcaagcctgtcctggtcggcgtccagcgccaggaagaggtttgtcccgggcacgacaacaggccgcctgctcgaacccgccgccggggcctgggccccggccccagcacccagccccgccggcagcgggtggtgctggnnnnnnnnnnagcctgggccccgaccccgggccccagccccgccggcagcgggtggtgctggtccgtgcaggttcctgcgccacgtctgcggccctgtcggggcaacaggccgcctgggcctggcctgccggccatgagccgggccgcaagcgcctcggcgcccgctgggccggcctccagcagctgcctgtggtgctgccacatgacctcaggggacaggcccccggcccatgtctcctcatcgtccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcataacgagacagcacaccgagaagcttcgcatccgccctgcccccctcaccgccgtcagccgtcggaccgnnnnnnnnnntgcacgcgcctcggcgcccgctggaccggcctccagcagctgccggtggtgctgccacatgacctcaggggacagccccccggcccatgtctcctcatcgtccccggcccccgggacgtagtcatacggaagttgcagggcgtctggggtgtgcggggatgggggtgatgcgggtgccgaggggtgagggcaagggttgggtgccaggccctgttgtgaggccagggtacagggtgtgtgcattcaggagcaggagnnnnnnnnnntggaagttgcagggcgtctgaggtgtgcggggatggtgatgcgggtgccgaggggcgagggcaagggctgggtgccaggccctgttgtgaggccagagtacagggtgtgtgcattcaggagcaggagcgcgaggggaggggcccgcaggaaaacataacgagacagcacagcgagaagcttcgcatccgccctgcaccgccctgccccccctcaccgccgtcagccgtcggaccgagctccagacatcgccgctggcgcccggaggagagggaagccgacacgagtatcaggggtgtgaatgccaggtcagccagggaaccgtccatcgcatcaccccacgtccggctgtcaggcgcgagccacatgcaccgcagcggtttcaggagggtgccggcgaggccgtggaggtcgggacaaacgtgcaagaggtctgccgcccagccgtccaaccggaggccgatctggtgtgcttcgctgtccggcacccaggcagggaggtggagggctgcatcccagtctgactcctcaaccgtcgtgccccggatctgggccactgcacgatttacaacggccgcccagatgggaagggtcttggagaaggcgtcctgtgtgaacaggacagatgcttttgaaagcccggcttggaatcgggacggtccctggcaccttgcacggcaaaagtttcccgcagctgtcttgggtgtgcgtgaagagggtactgattctcccaagctattcttggcctgcgtggcaccccacctccaccacactcacggggaagcgcttcccacggcgtgtggcatctactatgatgcagcccccatgccttgcagacagctgcgcgacgttgagattcaggcgggtcgtggagaaggaccagttgccagagtgcccatcggtgctcttgaacgcgcaggtgtgggtggggtcgggcacgtaccacccaccacaccgcagattgggaaggaccggcacgcccgggtaccgggctgtcacatcctctacgaactcatggtcatgcactatggatgcgatgcagttgtaaaggccgtgctccgcgcgtttgagggctctcaggacgtgcgtgagggtgggaacctcgttgcgcggaagatactccatatgcctgggtagacctccgagccatcaccctacacccgtttgcatgcatccttactaatcttgatgccctgcagttcgcagtgcggatgcacgaacgcgctgcagcatcgagtcccctcgcaagtgatgacgacagcgggggccacaacgcagacctgttgtcatattgccgcgtgtgcattaccatggggtggacttgaaaccccccttcaccaacctgcgagccaaaaaaatgacatattatatattgaagtatatactacatgcatggttatcgcctctgctgcaggctccttgaaactatggaacaacgtgcctgagcattatttactttccctacgtcgagactccattacaacagcccaacagcaagggtagtcccctgatctgggcgaggagccggcgttcgccatgctcgcaatcagcaaggccttctcccgggcgttgggcgggcgagggatcgaaactctgggggtacgtgcctatgccaaggcactcggcgatcagagcaccctccccctgtccaccggtcggccccggttagtcatcctgggcaccgggtggggcggggcgcgtctggcccgcgacatcgatcccaagaagtttgacatcacggtgattgacgtggagacgggggatctgggtgatccaggggccccctgcgctgagggaatgtgggcataaggggcatggtggttgattgccacccgcggcagctgcatcaagccttggcagcnnnnnnnnnnaatatgagggcataaggggcatggtggttgattgccccccgcggcagctgcatcaagccttggcagctgcatcaagccttggcacccactccgtgggctcccgtcccctcttgcacggtctccagcgccaaccggcggcatcgttgcccccctttcccccctcccccagatcatctcgccacgtaaccacatggtgttcactcctctcatcgcttccagctgtgtgggcaccctggagccccggtctgtgacggtgcccatcaccgacatccagcctgctctgcgtcttccccagaacaacttcctggtgcggcttgggttggtgcagtaagaggggctggggatcgatggtcatgctgcgctggggcttgttgcggctcctccatcccccatgtcgcctgtttggagaatgctcgccccggctgccatgcctgcttgctcactcacgatcttcccccctctaccttccatccatccgccagctggcagagtgcgacgcggtgcacacccaggaccggctggtggagtgcagcagcacgcacgatgggctcaagttctttgtgcagtacgatgtgctggccatcgccactggctcccagggcagtacctttgggatcccgggggtcaccgaatacaccatgccgctgcgggacgccgcaaactccaccgacatccgcacgcgccttatccagaactggggcgagtccagcatcccgggtgggtggcggggcgctgggtgcggggcggcgcggtgctcgggactggggcatcgtgttggcaatgggcctgactggcacgcggtgggacggcgtgcacccgcgacatacgatacccagggcaagacaccccgcacacacacaccttcgcaacacatccctcccccacccctcctcctctctccctccaggccgcagcccggcggagcgggcgcgcctgctgcacgtctgcgtcgtggggggcggccccaccggcgtcgagtttgccggggagctggccgactttgtgcgcaaggacttggccaagctggaccccaaccgcgcgcgggacatgcgcatcacgctgatcgaggccgaccagctgctcagcagcttcgacgcgcggctgagggagtatgccgcgctcaagctgacgcgcgcgggggtgcacctggtcaagggcatcgtgaaggaggtgtgtgtgcttcaagacagtggtggactgtcttcgtgccggggggggggcctgggaaggggacaaaggtctgccgggcatttcacggcggatgttttgccggacccctgcgtgcctccctccctgcaccctgcccctcagcctgcgccctctccacaaacggccttcccaggccccctgtttctcttttgtcacccctgcatctcccacttcctcctcccccaaacccaggtgcgcaaggacgagttggagctgaagaacggggccgtgattccctacggcctctgcgtctggtccacgggcgtgggccccacctccttctccctgtccctgccctttgagaagacgatgcgcggccgcctggccgtggatgaccgcctgcgggtgctggcgcggcacgccgatgggcggggccccacttcgctggaggatgtgggtggaggtttttatcttgggcggtaggctgtgatatcgatgaggttgaggtgcgagtgtcccgggtgccactgacgtcgccaagcctcaggggagcagggggctgcctgccagggcctggagaacacagacctttgagctnnnnnnnnnntgggtgccactgacgtcgccaagcctcagaggagcaggtggctgcctgtcagggcctggagaacacagacctttgagctacctggagctcagatgcatccctccccccatgatctgatatctcccccccccggccccccaccccactacaggtgagcatgatccaggaggagcgtgcggcggcggggcagcccacgggccgccccatcccctgtatctttgggctgggggacgtggcggccacgcaggagacgccactgcccgcgctggcccaggtggcggagcagcaggggcggtacctggcccgcgcgctgaacgaggcggcggggcagccgggcggactggcgggcgggctggagggcgcgccgcccttccagtaccaccacctgggcagcatggccagcgtggggggcaccagcgccgtcatcgagctgggcgggagcgggcagcaacatgtgcgctggagcgggttcacctcctggatcgcgtggcgctccgcctacctcacccgcctgggcaccatgaagcaccgcctgtacgtcatgagcgactggaccatgtccctcatcttcggacggtgagcgtggttggggggtgtgtacgtgtgtgcgatggtcttcctgtgctgccggggcggaacagggcggggagtcgcgctagtatggtgggtgggtggatcagtgttgccggcacgcagtcgacagtacgggatggcaggcgtcaaggtgcggcccctgcgctgctcgagcccggatacctggcttgcaacccaaaccttgccggcccacgatcgctgcagggatgtgtccaagtggtgagcgtttgacctctcagacctagaacttccgacctcttccccccatgtggagcagaaacctgccatgcccgcatcctgtgaacctctcaagattggaaccgtaaactcgtagcctgacactgacgcaatgaggagtgtgcaaatgccccattctgcatgcctgcctgctcctggggaatccaagattcagcannnnnnnnnnaaatgaggagtgggcacatgccccgtactgcatgcccgcctgctcctggggaatccaagattcagcacctggtgcttggcagcggcgcgagcctcaggcacgcgcctccaactcccggggacgagtggattcgcaatagaatcaacattcctcgcgtacccagcattaatgaatctcgatatggcttttaagtctgcaaggggccgcgcagcgctcctggatgggcccgtnnnnnnnnnnccgcctccaacccttagggacgagtggattcgcgacagaatcaacattccccacgtacccagaattaatgaaccttggtatggcttttaagtcagcaacgggccgcgcagcgctcctggatgggcccgtctcattcctgtcctcgtttcggccccatcagagaccctccttggaggcacgcacgagtcctcgggcccgttccgttgggcttacaagacaactactatgattttttgatcgcctcaccgttcaccacgggtgtgcgttgctccatccctgctcgtggccgttgggctccggggcggcgctacggccccatggtgtagactccagcctggctccctcctccacctcggtgtctcaaatggatgacataccgtnnnnnnnnnntcacgggtgtgcgctgctccatccctgctcgtggccgtcgggctccggggcggcgctacggtgcccccgggtgtggactccagcctggctccctcctccccctcggtgtctcaaatggatgacataccgtgttgatgctgttcaattcaagcatgaaggagtcacagcaggctgtttgccagactatctctcttcctaccagtctctgggtgagagccaagccggcgggcactacccctggtgtgcccctcacgagggagtgtctcggccgaccatcttggcagcacaggcaacgttgctgcgtcccatgcgtggatcggcgcgtcaagccctgcctccgaccccttctccacgaccaaagttgccctgtagaacccagccagcaggaattcgaacttcgctgccctctcatcctgatagtcgctgcggccatcctcggcggccggcggcagcgttccgcagccgctgtcctccagccgcaggccaaggtcagtctcctcctccaggggnnnnnnnnnnttttgccctgtcgaacccagccagcaggaattcgaacctcgctgccctctcatcctgagcgtcgctgcggccatcctcggcggtcggcggcagcgttacgcagccgctgtcccccaggcacaggccaaggtcagtctcctcctccaggggctggggttggatggcagctagctctgcacctgcgatggtctcggctgacgaggctgcggccactgcgcccggcctctgccgcctcttgcgggtgcccggtcttcgattcggaggaagcactgtgtggatgcgttggcaaggttgggtgagccaaaggaag

SEQ ID NO: 38960 - DNA, 61 bp, Chlorella protothecoides
cgtgggcaactggtcggcccaggaccggggaggcatcatgcgggggactccgcctgggccc

SEQ ID NO: 38961 - DNA, 61 bp, Chlorella protothecoides
ctgcctccaagaggccagctgctgcctgctacctcgccgtcaacgccacctagccatggtc

SEQ ID NO: 38962 - DNA, 864 bp, Chlorella protothecoides
  modified_base (247)..(318): a, c, t, g, unknown or other
  modified_base (578)..(746): a, c, t, g, unknown or other
gagctggcggtgctgggcgacgcggcgcccggggccacccccgccgcgcgcggcgcgctgcttctgaccctgctggacgcctacgcgcgccgcttccgcgagacgctggacggcgggtcggacgcgctgcccaccgacgagctggcgggcggcgcgcgcctgcgccacgtcttccgcgaggtgctgggccccgggctggacgcgctggaccccaccgcggagctgagcgacgccgacgtgcgcaccnnnnnnnnnnnnnnnnnnnnnnnnnnnnnnnnnnnnnnnnnnnnnnnnnnnnnnnnnnnnnnnnnnnnnnnnactccggcggtgtgcgcggtgcgctgctcatccccgaggcgcccttcgagctgctcacgcgccgcgcggtggagcgcctgctggcgccctgcctgcagtgcaaggagtacgtgcacgccgagctgctgcgcgccgccgccgccgccgcgccgccggacgtcgcgcgcttcccggcgctgcgcgccgtgctggccgaggcggtggaggcgtacgtggagcagggcgcggcgccggccgaggccatgatccgcaacctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcggaggccggggcggggaggagcgcgggggggaacccaggggaggtggcgagcaggggcgccgcagcggtggaccccggcgcgcgcgcccgcgccgagcgggcgccgcagccgg

SEQ ID NO: 38963 - DNA, 65 bp, Chlorella protothecoides
cagctcccgccgcagcacgcgcttgcctattaagtggggggcagggtgccgatactgaaaggatt

SEQ ID NO: 38964 - DNA, 80 bp, Chlorella protothecoides
ggcgccgcacgcgcgtccgaggccctcctgcgcctgccccgcctgcgatccctggaggccccgctgcacgaggtggggcc

SEQ ID NO: 38965 - DNA, 481 bp, Chlorella protothecoides
  modified_base (198)..(404): a, c, t, g, unknown or other
aggcccgcgctgccccagccctcctcactccatccctcacatcgaccaccgcacctcgacagaatcatgcaccgccagccccccgccccaccgctcgatgcacgcgccatgcccatctcacacccacccgcccgcgccccagaaccctggccccccgtccaccacgtacccagccctggcggccgtcggaggccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaattcatccgcgagctgcgcggcaggccgcgcctttggcggggcaggcaaaacacagacgcaaggaaaggtcttg

SEQ ID NO: 38966 - DNA, 67 bp, Chlorella protothecoides
acgctggacacagtattgagcagtccccttcaccccaagtccccagacagaacacacagctccattt

SEQ ID NO: 38967 - DNA, 132 bp, Chlorella protothecoides
tgcgtgaatgagcatgctgtcgattgaatgcagggctcatgcacagttgagtttttgaacttattattgaagtggctgcgtgaacttgacgtcagcatgatgtgtcccagttgcccgccaggcacgtcccca

SEQ ID NO: 38968 - DNA, 181 bp, Chlorella protothecoides
ttcgggtacgcagaagtgggggagcaggggccgatgctcgcggggacggagggacggcagccggtggcagcagcaggggggaggtgtggagggccatgcatcctggcacgagatcatcgctgggatgcagggctgcccgctgtgctttcttcctggctggcacatggttcagtcccgtctt

SEQ ID NO: 38969 - DNA, 78 bp, Chlorella protothecoides
gtcgtctgtggtgtgaggtgaagtgtaagagatacgcacgaaggcttagcccacaacacctgtcccaccgaaaatcgg

SEQ ID NO: 38970 - DNA, 71 bp, Chlorella protothecoides
cacagccggcgacagcttagaccaagacccgtctgtcaatatctcgctgtcggcccttgccggctgccgac

SEQ ID NO: 38971 - DNA, 76 bp, Chlorella protothecoides
gcgcccgtcagcctgggcgaaggggccccgtacgatgtccggtagtagaggccagtctgccctgccagcttgtctt

SEQ ID NO: 38972 - DNA, 147 bp, Chlorella protothecoides
ggtgtggtggcatgggtgcgcggggtgatgtcgcgaggggatagcaagtattaataccataatggggcaagaatacctcatgcccacttccgctcgacacgagttgtggcaggtgcgtaccccgccggacaggacgatggggagacg

SEQ ID NO: 38973 - DNA, 73 bp, Chlorella protothecoides
agcatgccccatcagccatgcacacccaggcagccaccggcgccgcctacctgccggcatcaaacatgaagag

SEQ ID NO: 38974 - DNA, 70 bp, Chlorella protothecoides
tcctcgccttgcagcctggctactggcacggcatcgtgagttgtgcagccctgagcctcccttcattcca

SEQ ID NO: 38975 - DNA, 359 bp, Chlorella protothecoides
  modified_base (106)..(269): a, c, t, g, unknown or other
ctcgggcgacgccacctcggcgctgcgcaacggtaattcagaggggatgagcgtgttgtgaaggtctgacgcatcccatcaggagcatgagcgactggcatggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcagacatccaccttgatgctcagaccatcacacggaccccccatcacagcagcgcgcctgtagtgcagtggccggagcgaggcga

SEQ ID NO: 38976 - DNA, 69 bp, Chlorella protothecoides
gccgcgattcaaatctgctctcacttcttagcgcctcgcactggcctccaagacccctcccatccctac

SEQ ID NO: 38977 - DNA, 66 bp, Chlorella protothecoides
ttccctgccgccgcctccctgccatccgatttccccccccccgtccaacggcaccctgcccagcag

SEQ ID NO: 38978 - DNA, 64 bp, Chlorella protothecoides
cattgttatagggtgagtgggtcgcgagtgccttgttgccccggccatgcatggccgacgtccg

SEQ ID NO: 38979 - DNA, 65 bp, Chlorella protothecoides
gcttcactcagacttacccatccctcaaccatcccagcgcgctgcgggagtgcgaggacctgagg

SEQ ID NO: 38980 - DNA, 163 bp, Chlorella protothecoides
gcaagcatgtcctgtccctggcatgtgtggtgcagtcgcacagcccacccctccgaccacacctgtggtcgtctgactgggtttcgcaggattctcaccatcctgcacttcatgatcctcccccccccacccccccctcacacaaactcacatacacacctgt

SEQ ID NO: 38981 - DNA, 14399 bp, Chlorella protothecoides
  modified_base (142)..(348): a, c, t, g, unknown or other
  modified_base (786)..(795): a, c, t, g, unknown or other
  modified_base (1053)..(1062): a, c, t, g, unknown or other
  modified_base (1467)..(1476): a, c, t, g, unknown or other
  modified_base (1763)..(1919): a, c, t, g, unknown or other
  modified_base (3031)..(3040): a, c, t, g, unknown or other
  modified_base (3753)..(3793): a, c, t, g, unknown or other
  modified_base (3846)..(3855): a, c, t, g, unknown or other
  modified_base (4465)..(4474): a, c, t, g, unknown or other
  modified_base (4765)..(4774): a, c, t, g, unknown or other
  modified_base (5245)..(5254): a, c, t, g, unknown or other
  modified_base (5587)..(5596): a, c, t, g, unknown or other
  modified_base (5888)..(5897): a, c, t, g, unknown or other
  modified_base (5997)..(6006): a, c, t, g, unknown or other
  modified_base (6708)..(6717): a, c, t, g, unknown or other
  modified_base (7491)..(7500): a, c, t, g, unknown or other
  modified_base (8717)..(8726): a, c, t, g, unknown or other
  modified_base (9855)..(9864): a, c, t, g, unknown or other
  modified_base (10261)..(10270): a, c, t, g, unknown or other
  modified_base (10505)..(10514): a, c, t, g, unknown or other
  modified_base (10567)..(10576): a, c, t, g, unknown or other
  modified_base (10650)..(10659): a, c, t, g, unknown or other
  modified_base (10929)..(10938): a, c, t, g, unknown or other
  modified_base (11458)..(11467): a, c, t, g, unknown or other
  modified_base (11595)..(11604): a, c, t, g, unknown or other
  modified_base (12490)..(12499): a, c, t, g, unknown or other
  modified_base (14011)..(14020): a, c, t, g, unknown or other
cgctggttgtgaagtgatggttcgcctccttgtcggaaatcatcgaaagtcctctaccaggagtgtcactgcgcacttcatacgtatccagtagtggtattgtgctggttgatgcaaatgagcacctgcccagggctgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgacgccacggccggcgacggcgccggagccaagcggcggagggtgcgtttgatcgagacaaaggaatttcaagagtctggggaagttacagcgttggccttgctcaaatatttagctgcgagatgacctgcatctcattcctgacgccaccacaccctcccttttcacacaggcccccactgccgcctcggtgctggaggtggagaccgcgggcctgtatcgcccccgcaccgaggagacgcgcatggcctacgaggccctgctctccgtcgtggtggacctgctgggcgggcaggaggaaagcgtgctgcagggcgccgctgacgaggtcctggccgtgctcaagaacgaccggctgcgtgtgagctggtgttctgggttggccgggacggcagctgcgccgattggcgagggagcgtggggagggaccctgcnnnnnnnnnngcgccgccagcgcctccagcagctcgtcggcggtgcgctgtgccgcagcgggctccagcgcgggcagcgcgcccgccacgcggcgctgcagccagtagccgtcgatgtcctgcacggggatgcccgacgcgcgctcctcctcaccggcgtccacgtcgacgccgccggtgcgcacgccggcgcgcgacccgccggcctcatcctcggcatccccgccctcctcctcgtcgtcatccagcacgtccaccagctcctcgnnnnnnnnnncgccaccggcctcctcctcggcatccccgccctcctcctcctcgtcatccagcacgtccaccagctcctcgccctcgtcctcgtcagactcgtcgtcaaactccacggccacgccctcctcgtccagcgcggcctcgccgctgcccgccgccagcgcggccgactcgggcgcccagtcgttcatgcgcttgcccagctccaccagcagcgcaaagcgctcgtcgctgacggggctgtccagcagcgtgcccagctccttctggcgctccgggtcctgttgtgttatttggggagggggaggggtttggcgcggaggggaaggttgggtgggaggcaggtttgaacatgatggtggagtccggcccgcattcgatgcacacccctggcgattgacatgggaactgnnnnnnnnnnttgttattttttgggggaaaggggattggcgcagaggggaaggtcaggtgggaggcaggtttgaacataatggtggagtccggcccgctttcgaggcacacccctggcgattgacatgggaactgcgtccggcaccctggcccagcgcccctgggcaggccccttccatgtgtaatgcatgagcagggtccctccccacgctccctcgccaaccggcgcagctgccgtcccggccaatccagaacaccaactcacccgcagccggtcgttcttgagcacggccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgtgaggaatgagatgcaggtcatctcgcagcgaaatatttgggcaaggccaaagctggaacttcccaagactctgaaattcccttgtctcgatccaacgcaccctccgccgcttggctccggcgccatcgccggccgtggcgtcacgcttggccttggccttgcgctctgcgaggccctcggggaggctgcgctgcaccttgtcccccatcttgccccgcatgttgccccacagggtctctgcggatccatccggctcatgaccgacggtggtgcgctgctcggctgtcaggaccaagttggagttctgtggcatatagggggggtggggacggggttgaggtgccgaagggcagccctgggcaggtgctcatttgcataaaccaacacgataccactactggacacgtatgaagtgcgcattgacactcctggtagaggactctcgatgatttccgacgaggaggcgaaccatcacttcacaaccagcggcaccgtcctttccctgcacaagttccttgaacccaccgctttgtaatcatattgtttactgcgtgccacatcctcagcacggcggggctggacacccgccatgggcgcaggcgcaggctcacgctagcaatgtgcgaaaggtttcagcaactcatccctgacaggctccagatgtggcaacgcactcccaccagcttcactggtcagcaatctatatatgatctcgagcgaccgtctcctcctgtgaggaatcggggccaggctctcaacgagctgggtgtttggcgaagccattccgatcgagccttgcctcccgccaaaacgacccctgtgagctcccacttggtgcaagattgccttgagagacaaaccatcacgtggaagttattagtgttttgggccaaatgctgattctacgtattgaaatctgccgagtcgtggtggtaacctctccttgctgcatggagtgatgcatttcatcctttaagagtgtgctgcacatgaatccctgcatcatgggtacgcaaagatttgagaactcgtagccatcttccatgaccagaagtgtaccatgtcagctcatagtcgtttcaagtcgtatacttcatgagtagcannnnnnnnnnagaaacaaaccatcccgtggaagttattagtgttttgggccaaatactggattctacgtattgtaatctgccgagtcgtggtgggaacctcgtccttgctgcatggagtgatgcatttcattctttaagagtgtgctgcacatgagtcccttcatcatggggactcaaagatttgagaactcgtagccattttccatgaccagaagtgtaacatgtcagctcataggcgtttcaagtcgtatacttcatgagtagcacatgaggtcaagcactcgtcccagcgaactcctcgaataaccccaccaaaaccacctgcatgccattggatctggcctgttcctggttgcaatatgctaaccggcagtgagcggctcatccttgctgcaggctgaagactcatgcattgatctctgtgagggtcacctccacagcaagaccatgccgatcggtctacctgcgcaccaccttccgccttcagcatttaagctccccctcaatgatgggtgctggcgccaaacagaaggccggggtactcacactatgataagtgtttcttacaacataatcgcacatcccatctttttgagtgcttcgaccggcctcgaagccagcgaacgctcctcatcctgagtgcacgatcatcatgaacgcgcaagcctcgctcacgaggccatcggcaagcctgcgaatggcatcatgtcccaccggcgggnnnnnnnnnnnnnnnnnnnnnnnnnnnnnnnnnnnnnnnnnatcacccctagactgctccccccacctgtgcagcattcccaagggttacaagnnnnnnnnnncaaggtagggagggagcccattcctcgctaggcactcatggaaagtggtatagcttcaaggccattgtaacaacgctggatcccgtcaatgcaccatcaaggacagaatacggatgccatggcccaatttctcacccctagactgctccccctcacctgtgcagcattcccaagggttacaagtcagagcctctgtgccacggaatccccagcagccctacaagggtgatggtgcgggaggatacccccccatctaccgaggtgagttagaggcatgccacatcatggattacatgtggcaagcagtggctgtggaccgcaactccattacagcctcatcctcaacacgtcaggccagcaagtggcgggccagcaggggcctgggcaacgagtgcccagccagcaagtgggagacattcagggacagccggccatgcctgtcagcgctgcagccaagaacgccctcgctgtgagtgattgcagagcatctgcctgtggaggatacgatccagttgccatggccactcctgcgtttcttgccccacccgaccctttcttccatcccttcagatgggaactgcgctgcgcaacatcggctggctctccttcnnnnnnnnnnttgtggaggataagatccagttgccatggccactcctgcgtctcttgcccaacccgaccctttcctccatcccttcagatgggaaccgcgctgcgcaacatcggctggctctccttctgggcacagctcaccctcacaatcgtggcctctggaattctcatcttctccactggtatcatctcccaggtgacaaagcgtcatgctgtacagcctatataatgacgggtgattttcctgtgtctgctcttcttgaaagtggcctgagccaagccggccccaccccatgatgcnnnnnnnnnnataattttcctgtgtctgctcttcttaaaactggactgagccaagccggccccaccccatgatgccctcgaccctgccattgagatgcccaggccttctctcttgttgcagaatcccacggagctgtccttcattgatgtgtgcacgctggggggcctggtgacgagtatgatctcaaccttccttgcgtggacttatattcgggcaggacgcaagcttggccagctcaaggtgtgtgtgtgtgtgagggaggtggaggggaggggatgcacagatatccagctttgttcgagctaccagggggatttcttagcaccaaagaaacacttgttgcatccgtgtctacatctcacagccactgcctcatctcccaacttgaaaaggaagtaaagcttcagggcgtcgtctcaacaattcttaccaatggagtcctgaaccttgctggcatgggggcgaccatcctcggcctgnnnnnnnnnngacgattctgaccaatggagtcctgaatctcgctggcatgggggcgaccatcctcggcctgcaggtgcctgcatggcatgggagtgtcccatggtgtttggggaaaggttcatgcctttatatcactggcagtctccttgccaggcatgttttctgtcgtttcatgccgtggccttcacacggtacccagagctctagatcttggtccaccctccctcttactccaggcatccattggtggcctggtgggcaagacactgacctccgcttctgcggctgggtatgcataccgggccccggcgccccctcccgttgcgctggatgtcttttcgnnnnnnnnnnaaggcatgtttttgtcgtttcatgccgtggtcttcacacgattcccagagctctacgtcttggtccaccctccctcttacttcaggcatccatcggtggcctggtgggcaagacactgacctccgcctctgcggctgggtatgcataccggacccccgcaccccctcccgttgcgctggatgtcttttcgatccaggtgggccatggtgtgctagagcctggactgtaatctacggtcgtgcggtgcctgccgcagcatcaatgcctcctctctacctgctaaccagggctnnnnnnnnnnaaaactcacggtatcaaatcttgcctgcttggctatctgctcattggagcccggtcccagccccaatcgatgccctccccgcaccaggttcctgaagcannnnnnnnnntggtagtgcagtgcctgccgcagcatcgatgcctcctctctacctgctaaccagggctgactcttactcctaaaatcctggctgtcctctatcccaggctagcaccaacacattgatggcccacttcgtggccattctcttcggcaactggttgctgcggacggcaaacaagtgagttgaatggctcgggagcctgttgtatccggcaacttccaatggagactaggaagatgatgaaactcactgtatcgaaatcttgcctgcttggctacctgctcattgaagcccggtcccagccccactcaatgccctccccgcaccaggttcctgaagcaggaggaggatgcggcggtgcaggactttgactcgcagtatgcgcccaccgccccacccctccccggctactaggctccgctgcatctggacacacacctgttgtgcttgatctcccatgtcgaccgctccaccttgccctgcaatcagactggccctaatcagcgcagagatatacaatatcttggaggacattgggggtgagctcccacggcatcgcggaggagtagctttgcgagagcgcattgccaccgcaataacatggccatatatgcctgggtgggcaggcaggacagtgatcagtatcaaaattacagctccatcactgcctctttgcagtgtccagctggacgagggtggtcatggcannnnnnnnnnaaccgctccaccttgccctgcaaccagactggccataatcagcgcagagatatacaataccttggaggacatggggggtgagctcccacggcatcgcagaggagtagctgtgcgagggtgcattgccaccgcaataacatggccatatatgcctgggtgggcaggcaggacagtgatcagtatcaaaattactggcagctccatcactgcctctttgctgtgtccagctggacgagggtggtcatggcattccccagctgcacgacgttcacaaactgcttcactgcgacgccgggcagcgcagccaaggcgaccagcgccaccagcgggatgcctcgtgcttcagcggagcacacgcctgtgcatggagcggggggtggtggtgggtttacaggacttggtgcacccttgatgacggaagccttgtgcaagctgtctgggtatgcgcgatgtgcgcatgctgcagggcacccaaaaccccagagagagcagggccatcgcccgaaggttcacgcccacctgcgctcccgcccagctgcaaccatgtctggggcaggggcagcactccccaggcgcggtactgcggccaggcaagtagatagaggcataggtacagcacttcacagcacacacagcagaagcccatgaacaggcgttgctggtagtagaagcggaccacccggctcctggaatttgtgtcctggaaatagagcgattgaagagggtggtgaggttgaagagagaaaccagcatgcatgagtgccccacagtatnnnnnnnnnngcatagagcgattgaagaggggggcgaggttgaagaggaaaaccagcatgcatgagtgccccacagtatatgtgtgtcccgaagatgagctcaacgggtgtgcactcggagcagggtgcacccccatgcgatgtcttttccccgctacccagcccctgtttcacagcacacttcagcccgtctccccaaggccctcccaccttgtggctgctcacgccgcaggccagcgtggagtacatctggaaccagtgtgagaagatgtccagccccaggagcaccacaaaggccaggtgccaggccgggaacagcatgcagagcgtggccagcaggcagctcgtggccactctgtgtgagagagcgggtgcgtgaaaatcagcagggccatgcctcagtagccacagggcggaaggatataagcacggcgcagacgagtgctactttgccgctgttgtatggtccgcccaacctatcatagggttctgcaaagctgcatactctggcgcccatgcacacatcctttcctcccccgcaaactcccattctgccgatcgcaactcatggtaaaaacactgtcgcacctgtctgtcaccatgtcgagaacctggcccagagtggaggtctgattcagcattcgagcgaaacggccgtccagttcatcacacacaaagctgagggcataggacaataccatggcccctggagaggtgctggccacagcgaatccatacagagcaaaggcaatgcgagcataccctgggggataggagtgagcaagggaggggggagtggggcgactgggccggagctcagacactgtgtgaccgctgaacagaggaatacccacacctataagattcgggacgtagaggtagacgttgtcatgtcgttcaaaaaatgaaggacccggggaccctgccattgccgtcccagcagcctcggcgctcgtcgaggaggccggggatttcaggttgaacaccagccagggaccactgcggcaggcctcgcgcgagcaatgacaatggcaaatttagtggcctagttccctggagcctcctctctgtgttttaccagctgctcaagcagtcaagcgagcggtgcatgaaaggagttggtaggcggaggtctgaccgcccggaggaagcgttcaattcagatccgcgcgcccagacacggaacaccgaccgagctccacatgcgaggcagatgtgcacacgatnnnnnnnnnngaggagctggtaggcggaggtctggccgcccggaggaagcgttcaattcagatctgcgcgcccagacacggaacaccgaccgacctccacatgcgaggcagatgtgcacacgatctctgtcacgactccatcatcgaagcattgaggctccaatttagcacgtacatggcggactgaggtatcatctaccggggagcaaagactgcaggccccgagcgtgtaagaccgacatctcggtcactaccccgcaagtcatccgcatacccacccattccagtgttcaaggcaacatgcggtgtttagcacgttgattctcagctccctcaaatgtggagatcatccctcgcggtgtcgctgggcactggcgtgggcaccctggtgtgtgtgggaggtgcaactctcctggtcagcagcgtcggcctccacgccgtcaaagctgtagtgaagcaccggcaggcaagttgcaggcctccacgatgtatgaaatatccagtgttcttcgcatcacctcgaactccagtacatcacccctgcaggccaagcggctcgtggcctgtcagccatgcagagcgactgggtaccgctcctgtgacatctgccacggtgaggactcatggacatggtactgacggttggtcaggactcgaactagcctgctcatgctcccctgtcgctgcgcaggcgagaagctgatgctgtgtagagcaccggtctccgcacgctcgctcaagcagcaacaggcccaaagtgccgcgacacagcccgagcctcaggtcctctgcgtctgtcccgcctgtggttccactgccaaacagcggtgcctgaactgcctgggcacaggcaaggcgctgccagaggaggctggtgtggcatctgcttgatgtgtggtgctctgggcggccatgcggcggccagggccctgccgacgccgccaattggacgtatattggtcagagtgattgtttgaatggaagagtgcaggggagtcatgcaatgacaaaacgggtcaggtctcttaatttctgtatcaagtacaggggtgagcaggatgcatgcagagggaaggcatgtgggccgcctcagctgttgcaccgatcagtccgtggtcacgagtgaggccgttgcgacnnnnnnnnnncgtgtggtgctctgggcggccctgcggcggctggggccctgccgacaccgccgatcggatgtgtattggtcagagtgattgctttaatggaagagtgcaggggagtcatgcaatgacaacacgggtcaggtctcttaatttctgtatcaggtactggggtgagcaggatgcatgcagagggaaggtatgtgggccgcctcagctgttgcaccgatttgtccgtggtcacgagtgaggccgttgcgacctgtcagccatcagcttccgagagcctaggagaccgatgcagcgcccctttgtgggtcaagcgccgcccagagtgatggcggtgcgctgcgccgtcacaaactcctccagcttccgccccagctcctgctcccactccgcatagtccgcnnnnnnnnnngcagccctctcgcgcatggcctccagacgctgctgcagggagcgcacggccgcgggggcggcggggcccatggactgcagaatgccctgcagccgggtcaggcggtccccgcccctctggatgctgaccaggatgccctgcagctgctgcggcaccaaagactgcgtggcacccgcctcggcggcgatggggtggctccgccctgggggtgtggcctgcctcggcaacggcaggnnnnnnnnnngcccagggcgctcaaaccctcgccgctgcccggcgagccagaccgcagtcccnnnnnnnnnnttgcgcggcacccgcctcggcggcgatggggttgctgccccgcgggggtgtggcctgcctcggcaacggcaggnnnnnnnnnngacgccagggcggcgtctcggcgggccaaggcctcctccagctcggccacacgcttttcccgttcccgcacccgctcctcgctccgggccgtcaccgccgaggcctgctcgagggaggcacgccgggtctccaggtcggcacgcagcaactcggccgccgtcgcctgttctcgtgcggcgcgcatctcccgctgtgcatagggttttgggtgtgagtgtgtgtgtgtgagtgtgtgtgtaggagccaggtgagcaaagagccgagcaaannnnnnnnnngcctgggggccagaatccgtggacgcccgccggccaatgtgtggcgcccctggtcctgggtgagtgtccatggaaagtcggtgaccagggctaggatggttcaccgtgtttgtgcggaggcgccctggcggcgcatcgggggcaagctgggcctccaggcgctgagtcagcgccgccacccgggcctcggccaacgccagggcggcgtctcggcgggccgcggcctcctccagctccgccacacgcttttcccgctcccgcacccgttcctcgctccgggcggtcagcgccgaggcctgctcgagggaggcgcgccgggtctccaggtcggcacgcagcgactccgccgccgtcgcctgttcccgtgcggcgcgcatctcccgctgtgcatggggtttcgggtgtgagtgtgtgcgtgagtgtgtgtagaggagccaggtgagcaaagagccgagcaaaacaggattccctccagacagggcccggccaatggcccgtcctcgcaccgaggcgagaggcnnnnnnnnnngttcctccagacggaacccggccgatggcccgtcctcgcaccgaggcgagaggctgggcctcgggtacccttgcacctcgccacccgctccccccacaaccctgcccagctcaacctgcgcccgctgnnnnnnnnnncccccttgcacctcgccacccgcttcccccaaaaccctgcccagctcaacctgcgcccgctgcatcagcgccgccgcctcccgctccgtttcgcgggaggcgtgctgggcggagcacaggagcgcgtcggcctcggcggccgccgccgtcacctgagggacagggagtttggatgtttggatcgtgtctgggactggtcattccagggcctgtaggggtgcagtatcagacactgcctgaagccaggcagcgtcggcccagcgccaaggatggacccattcaccccctcgaccaacacccacgcaggctcaccctgtcccgcgccgcgctctccgcctcccgcgccgccgacgccgcgacctgcgcctcgccctcctcgcgctcagccagccgcctctcagccgcagcaaccgccgcctccctgccctccagctcggccgcatgctgcgcgagcgagtggaggacggggaaacagggagtggtgatttgcttggagcagcactcacacgcctgccctcctgcggccccacccacaggaggccgcccatgaatcgtcccaacgaacctgctcaagcctctccagacgctgcgcctgatgcgccagggaggccctttcttcctccagttgcgtcctcaggcgatccagcccggccctctcctgcgccgccacgcggcgtgccagctcggcggcctgaatgtccgaggcggcagcctcctgagccgcctccagcgcctgggcggcttcgaagacctcccgctcccgtgcatccagctggcggtatgcctcctgtggatggggtgatggtcagacacctcccttttttggtctagactggctgtggaggcctccttggagggcaagcgtagcgacaggcctctgccttgnnnnnnnnnngcctcccttctttggtccagactggctgtggaggcctccttggggggcaagcgtagcgacaggcctctgccttgctcggtgaatgcaccatgctctgcatggggcctgtgacctccccagctcgtgtcggcaggatatcacccctccagcgcacagcacaacccagcctgcgcctccccgcacctgcagctggctgaggccttcctcggcggcctgggcgcgacgttccctggctgccgccttctcggccacgctcgcgcttgccctctcggcggcctccgcagccgcacggcgctcctccagcgccgcaagctcggccgcggcctcctgagctgcggcctggtgcgccgccttggcggtcgcggcagcggcggcggcgctcgccgcctcggcctcgattcggcgctgtcgctgctcgagctcggcgcgctgggcgcgctgggcggcgccctcccgcgccagctcctcctgctggtccgccagcctcgatgcaagtgccgccaggcgccgctcctccgcctgggcgaggtcctcgcggccacgcaggtgcttcccctccagctgcgcgttggttggtggaggggaacgtgggtgcacttccctccatagggcggttgctacagcgcatattagccttgtctttggagaaatcgtcaagggaggagctccttgttcagtgcgatgctcagcctcgtgcctgagtgccctggccatgcacagattggcggccctgccagttcccccttgtcaccaccccctgcaaagcccacctccacagccctcagctcagactcgcgtaggaccaggttccgggtcctggcctctagctcggcctgggcaagggccgagagtaggatgttgcaatcaacagggaaatgatttccagccaagcaagcaccaagaatgtcgcagcggcaagtttggggacaatagtatcttgccagtccgttctcacaagatttctgactttcgcggcgtctgacctaccctcacaccctcatcgcaagtgcatcccgttgacctcctcgccaagctttctcagccgttctaccatacctgcagcttgctgacctgctcccggctggcttccagagcaaccctatcagcctccagctcagcccttgtcgcccccgcctgccgagggcgggatgggaagattggacatgtgagcgagtgtgtccctggcatgctcgcgtcctaggccagggacacgcacgggtcatcattccgccactcaatagcctctcagctcaccgccttcagcctctgggccgccgcagctgcatcgcgctgggcgtcccccagcttatccgcagcttcacgcaccgccgtctccgcccggtcccgggcgtcccctgcctcgcaacgcatggcctccagtcccgcgctttgtcgctgcagggcccgctcccttgcctgggcgcgtatgaaaaaagaacggaatgatgcagggctccatgctctcagcatgcctccctcccttccacccctctccatctcagacactcaccnnnnnnnnnnactcccttgcctgggtgcgtatgaaaaaagaacggaatgatgcatggcaccatgctctcagcatgcctccctcctttccacccctctccatctcagacactcacctccagctcctccgtccggcgctggaggtcgacggccagacgctccgcctggacccgactcgcagccccgctggcccacgcctccctttccgcctccagctgcgcccgctcgcgctccatctcgggcagctgcgcggcgagcgccgcgacgcggccctccgcatcctccagcgccgccgctctgctcttcagacgctgcggatatgaaggggtcaagccgggggggagggggggacggaggctgtggacggctggggtggcgcatggctcgcccc

SEQ ID NO: 38982 - DNA, 69 bp, Chlorella protothecoides
tcaggctcctaggagctccactggaccatccagagagaggttcagcgggtgtacccacgctcacctctc

SEQ ID NO: 38983 - DNA, 70 bp, Chlorella protothecoides
gagcagcccggtccgtcctccacaggtgctttgcccctttggtcgtcctccagctgctctggcatcttgc

SEQ ID NO: 38984 - DNA, 73 bp, Chlorella protothecoides
cagctggctcaccctccatctcctccctaaacccccccctgggttctctccacttcccctctgccagaccgcc

SEQ ID NO: 38985 - DNA, 137 bp, Chlorella protothecoides
gagcgggcggccgacgccgcgcgcgcctgatttgggggggggggtcctgaggctgcgcagcccgcggtcctgcctgtagacacttgcgccgatgctgcggccactcagttcattcggtcctgccttgggcttggcat

SEQ ID NO: 38986 - DNA, 61 bp, Chlorella protothecoides
gttgccatgggaccttggcctggccactcgctctgtggcagatgcaccgcccagtggcatg

SEQ ID NO: 38987 - DNA, 78 bp, Chlorella protothecoides
cccccccccaatcaattgccatccttggccccctccctcccttcccgtccagagctccgcgccgctgctgcacctgcc

SEQ ID NO: 38988 - DNA, 67 bp, Chlorella protothecoides
cagtctggggtgcgttccccacatcgcccatgcacacttctggccgcacaacaggctccgccctcgc

SEQ ID NO: 38989 - DNA, 85 bp, Chlorella protothecoides
tcagcagccacatggcagcagtggcccaaagtgtcatgcgcagcgaggggtgcagcccggtgtcgggcgacggggggcagccgcg

SEQ ID NO: 38990 - DNA, 61 bp, Chlorella protothecoides
ggtggagggtagaactgctttgcgttcccaaccctgcccctgaggatgactgtgaggtctc

SEQ ID NO: 38991 - DNA, 78 bp, Chlorella protothecoides
gccctcgtgccctgtagttcccccagggcctgggtcagcgcaggctcgtcctcgcccgcggccgcgcactccagggca

SEQ ID NO: 38992 - DNA, 61 bp, Chlorella protothecoides
gcagctgagatcgctgtatcccgtggctggtgttttcctttttggcatggtgtcgcacgag

SEQ ID NO: 38993 - DNA, 61 bp, Chlorella protothecoides
cctggccggccccgggcgctggtggccctttgccctggccggccccgggcgctggtggccc

SEQ ID NO: 38994 - DNA, 80 bp, Chlorella protothecoides
cgtgaagtgtccagcagcccttgggaggcagcaattccctttgctgcacttctgcccaacatcaaaggcaagctgtgcac

SEQ ID NO: 38995 - DNA, 61 bp, Chlorella protothecoides
cgccgggctgtgcttcggcgtcttgaacccgtggaccagcaaaagtctccgcgcgctggac

SEQ ID NO: 38996 - DNA, 61 bp, Chlorella protothecoides
gcagccacccagcaccggcgagtgcaatgtcaaggatgttgctcgacctgactgtcaacca

SEQ ID NO: 38997 - DNA, 61 bp, Chlorella protothecoides
aacggagaagggcgagacggtactgtcaggtcgcagtgctttggcagaagcctacaccgca

SEQ ID NO: 38998 - DNA, 5711 bp, Chlorella protothecoides
  modified_base (347)..(356): a, c, t, g, unknown or other
  modified_base (1242)..(1251): a, c, t, g, unknown or other
  modified_base (2262)..(2271): a, c, t, g, unknown or other
  modified_base (3009)..(3018): a, c, t, g, unknown or other
  modified_base (3312)..(3321): a, c, t, g, unknown or other
  modified_base (3844)..(3968): a, c, t, g, unknown or other
  modified_base (4352)..(4441): a, c, t, g, unknown or other
  modified_base (4763)..(4772): a, c, t, g, unknown or other
  modified_base (4828)..(4837): a, c, t, g, unknown or other
  modified_base (5261)..(5270): a, c, t, g, unknown or other
ctcggcgatgcgcggcgacgcggccttcgcggcggcggtgcaggtcgcgctggcccggctcgacgcgctgccgcgggaggactggggcgccgcgcgggaggaggccgaggcgctgcgcgcgctgggcagggtgctggcgggggaggagctatgggaaggtgactcggcgacgttgcggcagcagctggcggtggtgcccacatcaggcgctgccgcagcgcccctggccttgacatgacagttcatcatggttttgagtgtacagtgcgacgcatcgagttgacaagaggatgctagtgaggggtcaaaagaatggtcgcatgcatggtgcattcacgtggaggggnnnnnnnnnncgccgcagcgcccctggccttgacatgacatttcatcatggttttgagtgtacagtgcgacacatcgagttgacaagaggatgctagggaggggtcaaaagaatgctcgcatgcatggtgcattcacgtggaggggcggggcagaagtgtacacaaagtgctgggaagggggatgcctggcaggagcgaggggtggtgggggggtgcaatgacgtcatggagcacatcagtgcccaactcatggcacgtggctgggtgggcacaggcgcaggtatttgtggatctcagggccaccgcctgacctcccgggatacacgccacaaagacaacctcggtcgccatcgagaaggccctcaccgcgcgccgaggcagcgccccgccgcggcgccgcctcgcccacgcgcgccgcgcctgccctccctccgcgcctcctccatcccgcgcaggctgtgcgccaggtggcgcgccaccggcacacccgcgccgttgacccacagccgctgaacctggatgtgctgatgcgccagcagcggcagcgcgctgtgcgcaaaccccgcgtccacgcgccgccagctcagcgtgcgcagcgcgcgcagcgtgtcctccaccagctcagtgcggtcggcatgcagcgcggcgtcgtaggcgctgcccagcgccgccgaccggtaccgcacctggtgccgaagggggcccggcagcgaggcggtttggggggaggggtgtagctcgatggctccgcagagtggcgatgggctggcgggcggcgctccggtgaagctcgtcggtgcactcttcaacatgggagggtcctcgtcgcctcgtccagagcccgttccaggcagatcgtagtcatcgtcacccagggcaccctcggtcccactcnnnnnnnnnngcgtgggagggtcctcgtcgcctcgtccagggcccgttccaggcagatcgtagtcgtcgtcacccagggcaccctcggtcccactcggcagtgtctggccccggccatacctgggcccccacgcagtctccagtgggtcggcgcgcaggacgcctgggtattcctcctttcccgaaacaccatccagctccggcagctcctccaggcggcgcagcgaggcgttggcccagcccaccaggtggtcgccgtcggtgttggcgtaggccgtgcgcgtctggaaggcggccagcgcggggaggaaggcggcgccggggccctcgtcgcgggccaggcgccagatcagcggcggcgccccggcctcccggtctcccaggaagaactgctcgccggatcgcttgaagctggcgcgcgtgaagctggccgccacggacgacaccgcgcccgccaccaccgggcccaccaccggccaggcctccatccacttcagcataggcacctgccacgtcgatgggtttggggaagggtggggtggggaaggagatggaataggggcgggactttgccctcctcattgaaggaggccatcgcagtgacacccagcagcgatgaaatgcttgcaggagaagaccctgcgtgcaaggcatgaaagaaaccgagcgacgatccctcgcccgctcacctgggcggggccgggggcggtgtcgcagcccaggtgcgggcaggccatgccgatgaagtggacggggagcagcctgccggcgatgcgccccgtctcggcgtcgtacagtcggcccatggcgtagcgcgcgatcaggccgcccatggagtggcccaggatggagatctcctccagcagggggtactgggccatgagcccatggatctcctccaccagccgctccccacacccatcgatgccctcgtaggtctgtgccaagtgaacaagaggattggggttcagaacagtaagcgagcggaggaacttgtccaggggatggcaggggctagagnnnnnnnnnnggtgaaacaaggggattggaattcagaacagtaagcgagcggagaaacttgtccaggggatggcaggggctagagcatccatacgaactgggcccttgccttttcttgccatgcccgcctacgtcactcatttccacactcacagaccccctcccaaccttacctttttgaattcattgacctcagagatgtagaataggatgccctcttcctctcgcatcgcatcacgcagctcctctgcgatcaccttccagtttgcccggctcccaaacaagccatggacctgcaggcaacgaggatgcgtgattgatactatcgaatctgcatgccaggttggctcatggagcgtccctggctgattaaagggtgagagaagcatgggagaaggctctatcaagaacgcagcaacactgccaccattagtgcattgagggagcgactgtaccagccctatcaggtgcgtgacagtgaatcagaggaaccattacaaaactttcatgtcacccaccatgcagaagaggtggcgggggtctgcgggagcaggtgctcgctcctctgctgcaagcagcacgccgtcctgaagctgctcgtactcagcggcagctgttgtcacagtgggagccatgctgggcctccctcgtgatcgaaagtcgacctttcagtttgcaagcatgtacgatatattctgtgcacctgggggttgctttcgggggaagggtcaaggtcacagtttgggannnnnnnnnnaaatgtcgacctttcaatttgcaagcatgtacgatatattttgtgcacctgggggttgcttccgggggaagggtcaaggtcacagtttgggaacagattcttaggtaaatgttattgtgctgccatgcgctccgaatggactctgagggcccaccggcaatgcgacagccctggtacacgatattggaattgtctacaaggcgacgggatgctcgagtagctggcgtggtggtcttgtcgcacttggtcgcttgtttcattatgtgtggcgggaagtctcgcgcagagctctcnnnnnnnnnngagctggcgtggtggtcttgtcgcagatggtcgcttgtttcattacgtgtggcgggaagtctcgcgcagagctctccgacgcgaaagaaagctcgccgaccagcctccaagtgcgcccaagcctggcactggcctcgcccctcaccctctttctccttcgcgactggaggcattcctttggaacccctgccagtcactccaaccccggagaagatgccgcccaagcgtgtgaagcagcaggaggagaatgtttccctggggcccgccacccggtgcgtgggagggttgcttcttgcgctgggtggaggcatagtggggatgatattgcgggttctcaatgcaatactcacccgagtcgcctccgtgaggagcctgatggatgtcacgggcgggtgcaccggtctcgaacgggcggggatgcagcgtgatgggccgggatataccgatcgcccgggtactttctctggccagggtgcgcgtcatacagtcttgacgccaatgcgatgctcccctggtcatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgtccacgtgacggatctgtccggcaaggagaccctggtccgcgtgaccggtggcatgaaggtgaaggccgaccgcgacgagtcctcgccctacgcggccatgcttgccgcacaggacgtggcggtgcgctgcaaggagctgggcgtgtcggccctgcacatcaagctgcgcgccaccggcggcaaccgcaccaagacccctgggcccggcgcccagagcgcgctgcgcgcgctggcccgcgctggcctcaagatcgggcgcatcgaggacgtgacccccatccccaccgactccacgcgccggaagggtggccgccgcggtcgccgcctgtgagcgcggaccgccgcatgccgtgcctcgcctgctgggtgtaatgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcccccagagcggagcctcggccaaaataaaagggcctctggaacactgggctcttcaatgcaagtgcagcggttacagctcgaaggaagggtgcggctcggggcagcagagcgggaggagcgggggctgcgtgaagtcatcgtcatcaagtaccaagcgaggtatctggcgagggggaagggagccgggcaagcaagcaagcaagctcagcggcgggcaaaggagtctcggcagggaaacggcaagtgggaggggcgtggccatgcttgtgcagaccaaagcatggaggcctcactacgccggcccgcactcggaaannnnnnnnnntcgcatcagagccagaggaggggaagggggtgtttggggtctcggtgtggtagctnnnnnnnnnnatctcgggcagggaaacggcaagtgggaggggggtggccatgcttgtgcagaccaaagcaggggggcctcactacgccggcccgcactcggaaaacttgcgcttggcggggtgcaccgcgcctgggggccggtgggaggggatggggtggcctggcggggagggcaggcccgccgcactccacgcccggttgggcgaggcggcaaacagccgcgcggcggccggcacatcgcgggggggtttcgcgcccctgggtgcagatacgtctaccagctttacttcctgtgcgtcacgcggctcgacttgctgtgcgtcacgtggctcgcccgcatgagggtccagtgcctcgttcgcagcaatgacatcatcctcctcgtgcagcaggctggcgtctggggatggcggccgcgcgcccaagcaggccnnnnnnnnnntggctcgacttgctgtgcgtcacgtggctggacttcctgtgcgtcacgcggctcgaccgcatgagggtccagtgcctcgtccgcagcaacgacatcctcctcctcgcgcagcagcaggctggcgtccggggatggcggccgcgcgcccaagcaggccggcgctgcgggtgtgctgagcgcgtcggcgtcgccttgagaggaggggccctccgtgaggttgtcgccggcctccccaccttcgtcgcgccaaccccccgccgcccccttggccagcagggcggggcaggactcggcgcgcgcgcccagcacgcccagcgtgcccagcgcgccgccccctgcgctgtcgggcaggactccaggcgccacgcccagcgcgcgtgccagcgaggccatgcaggcccagtgcgacgcgtgtgcgcgcgcggcgtcggccacggcggc

SEQ ID NO: 38999 - DNA, 74 bp, Chlorella protothecoides
cctgacaccctgctgaaacccctctcccgcctgcccttactctcgcccaggtggaccaagccgcgctgaccggc

SEQ ID NO: 39000 - DNA, 104 bp, Chlorella protothecoides
ggcgcgtggaccggttgtggaggtggcggttgtggtgccgcccgctggcagcgccccgcgggcgcgccccggttgagaaggcgccccctgggagcctgtcgccg

SEQ ID NO: 39001 - DNA, 70 bp, Chlorella protothecoides
cccagcatccgcgcccgctcggcattcccagccgcccagcatccatgcccgctcggcgtccccagccgcc

SEQ ID NO: 39002 - DNA, 8293 bp, Chlorella protothecoides
  modified_base (2554)..(2563): a, c, t, g, unknown or other
  modified_base (2698)..(2707): a, c, t, g, unknown or other
  modified_base (3789)..(3798): a, c, t, g, unknown or other
  modified_base (4466)..(4475): a, c, t, g, unknown or other
  modified_base (4814)..(4823): a, c, t, g, unknown or other
  modified_base (5374)..(5383): a, c, t, g, unknown or other
  modified_base (6408)..(6480): a, c, t, g, unknown or other
  modified_base (7865)..(7874): a, c, t, g, unknown or other
ggggggggatggcgggtgtgggaggggggggatgtctccgagttgtcagtgtgctgctgtaccccagcagctgtgagcatggggactccagggtgttgaagcgtgcaggggcttgcctgtggccctgccgtgtgccgttgtctgcactcccgccctccccctgcccatccacacccatctctcaccctcgatacccctagcagaggccatcctgggggctagggacatctcggtggacgagtcggagcggctgccacgcctgttcagggagttcaccgatggcgtgctggatgcagggctggggctggggaggaaagcgcgggaggacgcggacgtgagcgcgcgggaggccctgcagcacgccacgccgtccctggccaagctcaaggcgaggagggcaggaaatggggaacgtggcccgtgatgggtgctggggaaagacatgggtggtcgggtggctggagcagccatgttcaaccgttggcttccttgcctgtccttggcatcgcactcgggtccggcacctgtcaccagggcatacatgttcatcactgcagcctccttgtcgacatccccactcatgcattcctcccacaggaggtcctggagctggtggagatcaggctgaccgagatcgcggcgcggtgggaggatggcaggctcagcgccctggggctggccccgcaggaggtggcgcacctggtacgggccctgttcgaggacacgccggctcgcagggcgctcttgacggccctgggcaaggcccggtagctggggctggtggtgcagtgtgtgcacccaccaacgctgtgaccctagtgaggggggggagaaaagttgtgaaatcacaggattgtgggcatgactcattctgggaagatgttcatgagcagggatcgtggtcctatgtatcctcactgcgccccggctccggcgacagcgttgccggagcgtgggagattcgcagcgccgacgcctcgagcaggtcgctcgccccgggttaccacgctcacccctcctcgaggctatacgatgcacgcccggaatagaaatgccaccacccacttgaagagaccaccagctccggcaaaggcttcgaggaaggactgcagtcaaggaaacacatctggtccctggtcgagaccccggaaccgtcctgcaaccaccccaacaagtcccgacgcactcggcctcgcagcccccggcgcgtttccgaaaggtttgtaatgctttcatgtgggcaatttcagcaagaaggatcctccactcctcgtgctgcggccccgatcaggtcccactctccatgtccgacgccttccatgccacttgcaggggtgaccacaggcccaatgccgcccaggggaaggtgcttcctggtcacgcttctggtgctggccacagccctcggcgcacgagcctccattgccgcccccgtgatcaccaatgtcgagcccgggaaccagcaggtcaccctcacctacaagcgcatcccgaccagcgttccccccgtccggcagatgtcgatcgcgtgcaccgacacccgcatcacccccgacccacagaacgcagaacgtgagtagggcctcgtgtactgtgcgcccgggctcggtgccgtaccttgtgtgacggagaaatgcaaagggtgggtgggggtggggatcattcccagcagggccatgctgacatgtttcccaagctccgcccaccacacagagcaagtctcggtgctgcccaacgccacctccgtgaccatcaccggtctgaccaacggcatctactacacctgcacactcaaggctagggcctggacctccaacagcctgtttgcgcccgtgacccagtcccccacctccgagtcctcccccgccttcatgcccacgggtagggatagggggtcccggtggggatgagccttactagacctgctgactacttcccagacagcccgtgttatgtttccctggtctgcgctccttgcacaaggggggaaaccatgcttgacgtgcctcagcgccatccactcttctttgctgaaaagcatccctggctcaccaccaaccccccacacctcaacccacgcagcatcagcaaaggctccaccaaagacctcaccatccttcccaccccggtccctccgtgcgttgcgcctcttggatgcattgaccgtggtctacctgcatgcacctgtgccgcgccgtgccttctgctgctcatcccagtcaccgaacgatctccctcccctcccaacccacagccgcgcccatcaacatcgacctggagccgggccaagatggcacctccatcacggtcaggtttgacccgcccaaggacggcgccgccgccatctcctactacgtcgtggcctgcgccccgactgcggccaactctggcgccgtcagccccgccagccgtgagttgctgaaggacgggcaattcatgcagcgggaggggccaggccgggcgcgggcatgttcaaaggccagagagggggctggtcaacacaggcaccctgccctttcccaaagcccatgtatcatctcccctccgcccgccnnnnnnnnnntctagcagctccaccgcatcagcctccgtggtcactggcaccaccagtgcgtttccagcagggttcctgggcgtatgtcggggtgactggggccactgccctggaatacggccgtcagggtgcctccccccggcnnnnnnnnnngaaaggccagagagggggctggtcgacacaggcaccctgccctgtcccagagcccatgtatcatctcccctccgcccgccatccacccatcccaacacgcgcgtcccaccccccatccccattccaggagtggtgcccgcctccaatgccaccctggcgtctgaggtcaagggtctgaccacggccgtggagtacaagtgcggggtgcaggcgcggagttccaccgccagcagctccaccgcatcagcgtccgtggtcactggcactaccagtgcgttttcagcagggttccggggcatatgtcgggttgactggggccactgccctgcaatacggccgtcagggtgcctccccccggcgtggctggcgatgggctggggcaggcgcgcgtctgccgctcacccctttctgccgggcccgccgttgcctgctcgaccccaccgatgcattcaggagatcctacatacattccccctttcccccagacacgccgcgcatcaccgggacccgggtgactggcaactccgtcacgctgaccttcacggcgcccacaaaccccaacctgggacccgtggcctcctacgcgctctcttgcctccccgagggcagcgtgtcggcgatgagtggccccgccgacagcacagcaagtgagcgccgagggtgaagggggaggggccatcccctgcaccgtctactgccctccctgctagcagggcatctggctgccacatggagggtcaatgtgaggtgctctgtccaaaaacgcctgtgttgccacagatgttccgccaacatcgatattaagctttgccaccccactcccaccctgcaacccgctttcacagacgagctcagcggtagtgtgggctccgcatcggtgtcgggtctgaccccgggcaagtacatctgcacgctggccgccaccatgtccaacagcaagaagtactccgcctccacgagcgtcaccgtgccgtctctggcctccgccacgcccgcccctgccccgaccgagtggttggtctcccccagccccagcgcagccccctccccagcccctgtccccagcccatctcccgtatccnnnnnnnnnncaccgagtggctggtctcccccagtcccaaagcagccccctccccggcccctgtccccagcccatctcccgtatccaggcctcccccccccagccccagcccagcgcccgtgccctccccaagccctgctccatccccggccagcccagtggtgaggcaatgctggatctggggaggttgttgggggctaataactccccttcctgccacaagctcctgtgtgtcgcgacctgggcagacccctcaagctcacggctaattcacctcgccccttgctccccattcgcgcaggcaagtccgaccgtctctgccgcaagcaccagccccagccccgtcgcccccgcggcggagtcacccgccagtggggcgtatggtgtcactggagcagtggctaccctggtcatggctggcttctctgccctgctcctcatcctgtagacccccccgcccgtttatttcattcacccagtactgtcgctgcgttgtcctggaatgtaagatgtatggcaagagggaggcgggagggcggagtgctgggaccatgtcatgcaatcttgcaccaaggataatctcataatgagcctggcatggcggcgccgacatgacgcccaggtggctggggttaccccttcgtctagcttcccgaaggtgctgaactacttcgtctnnnnnnnnnnagggcgtgagggcggaatgctgggaccatgtcatgcgatcttgcaataaggataatctcataataagcctggcttggcggcgccgacgtgacgctcaggtggctgggggtacaccttcgtcttgcttcccgaaggtgctgaactacttcgtctgaagccctttccatccgggatccaatatgacacccgacctgactgggaggcagaacccgcgaccccctccaggttaagacttcgcaatcccagcgggttcggcgtcttttctcgagttcgatatctcatgaccgaacctcagaacacgtgctgcccgactgcagggcgcgcgagggtgagggacgnnnnnnnnnntactgggtggcagaacccgcgaccctctccaggtttaaacttcgcaatcccagcggtttcggcgtctcttctcgagttcgatatctcacgatcgaaccttaggacacgtgctgcgcgactgcagggcgcgcgagggtgagggacgtgtgctgcgatgcagccctcgacggatcgcccggagagggtacccctgagcacccggttgggaccatccggacgcggaccgccgaggtagcagccggaaagagtcttacgactccaggccagatccatcgggacacaatttgcatttccaaggacattgacgcaccatgagaggtgggttttgctgttgttaccgtgagagtcgaggagtgccctgatcgggttgtgggtgtggcactgggtggagacggcatattctgcagcacactttgagcacgcacagacgctgcgagaagggtgtctagccattgctttatgttcatcagggcattatattgtattacatccatgcataacatgcttattgtccccgtaatcatctcatgccccccctccgaacccttgcnnnnnnnnnnaatccatgcattacatgcttattatccccgtattcatctcatgccccccctccgaacccttgcagacaacaagccgatggccctcgcggccgccgcgatgctgctgctggccctcagtgggacggccatggcgcagcagacgggcatctccgcccccagcatcaccaccgtgaagcccctgagtggtggagcggacatttccttcacccccggcaccgccgcggacggcatcaccatcaccaactacgtcatcgactgcatccagggagccggcaccatcgaccagcagacctccacaagtgagcagggagatgcttggttgcattggagttcatgatcgaggggggagcatgctgctccatcgaagaggttagtcctgccgcctccgaaccggcatcgctccatgctcatgcgcccccatgcctttccccgcagtggtcgttcccgccagcacctccaacaaggtcaccgtgtccagcctgagcaacggccttgccaccacctgcaccctcaccgcccgcggatccaaccccagcggcggcatcctgaaccgggtggtggactcggccgagtctgctgcctccccgctgttcacccccggctccaagcagaccgtgtccgcaggtgaggtgttggccgagcaggttgtctcatcatgggggtgttttgtagttccaaaggcacgccattattacccgatgaagctggccatgctctcatacttgcttgctcgccattctcatgctcccacctcctccttgcaggcgagtcagcccccgctgagaccacccccgaggccgtcgccgtgcccgagcctgccagccccagccccagcccccaggccagccccagccccagccccagcccccgcgccagccccagccctgctgcctccgctcttgatgccccctccatcaccggagtgaaggccaccgacggcggcgcggacatcaccttcacccccggctccagcgatgccagctcctacaccattgactgcgtgcaggccgccggcaccgtcgacnnnnnnnnnnnnnnnnnnnnnnnnnnnnnnnnnnnnnnnnnnnnnnnnnnnnnnnnnnnnnnnnnnnnnnnnnagtggctgcccccagcaacggcaacaaggtctccgtcaccggccttgccaacggcctgcgcacgacctgcaccctcaccggccgcgccgccaaccccagcggcggccttttcagccgcaatgtcgagtccgcaccctccgcggcgtcccagagcttcctgcccagcgccagcgcagggtcctccactgtcgccccccaagccgccaccacggcccctgccgagatcgacgtcgcaacgagccccagccccagccccagccccagccccagccccagcccggtgcccagccccagcccggtgcccagccccagccccagccccagccctgcagtcaccagcgtgcaggcgcccaccatcaccagcgtcaaggccaccgatggcggcgcggacctgcgcttcacctccgacgccgaggatgtcgccgcttttgtcatcgactgcgtgcaggccgccggcaccgtcgaccagcaggaggtgtccctgacggttcctgcccccagcaacggcgacaaggtctccatcaccggcctcgccaacggcctgcgcacgacctgcaccctgaccgcccgcgccaccaaccccgacggcggcctgctcaaccgcttcatcgactctgcgccgtctgaggagtcccagagcttcgtccccgccgccatggcgggagagtcctccccccccgccgccgtcaccgccgtcagccccagcccggccgccgccagccccagcccggtcgccgccagccccaggcccgtcgccgccagccccagccccagccccgtcgccgcccctgccgcgagctctgtggccgcccccgtcatccgctccgtcaagcccgtcgacagcggcgccgagatcacctttgcgccctccaccaccgccggcgtcagcgcctacgtcgtggactgcatccaggctgccggcaccgtcgaccagcaggaggtgtcccagaccttcagcccctcctcctccaacaaggcggtggtcaacagcctgtccaacggcctctccaccacctgcaccatcaccgcccgcgcccctaaccccaatggcggcttcctgagccgcagcatcgactctgccccctccgctccctcccccacctttgtcccccgcgccggctcctcccaggccatcgccggcagccaggatgccgtggagcccgcctccccggccgccagccccagccccgctgcccgccccagccccgccagccccagctccagccccgccgtcagccccagccccgccgccactgccgccgccgccgccgcaaccgccctggccagccccgttgtcgcccgcctgaccaccaccgacggcggagtggatatctacgttgccacgcccgccagcgccaccattcccgccacctccgcctacgtcnnnnnnnnnntctgaccaccaccgacggcggagtggacatctacgtcgccacgcccgccagtgccaccattcccgccacctccgcctacgtcgtggactgcatccaggccgctggcaccgtgaaccagcaggaggtgtccaacaccctccctgccaccgccaacggcaagctttccatgaccggcctcgccaacggcctccccaccacctgcaccctcactgcccgcgcctccaaccccaacggcggcttcctgactccctacgtcacctccaagccctccgcctccaccccggcctttacccccggcgtcgctcgcaccatcaccggtgaggtttggggttgtctgcagggagctttggggcttgtgtcctgtcaagagtgaccggcctgctgtccaccgactgcctccctgcctggaccctcagctc

SEQ ID NO: 39003 - DNA, 168 bp, Chlorella protothecoides
cgccaggcggggcggcggtactcgaccagcgcccacgtctgacggaagtgatgaaggggtgtctggggggggggtgaccagtctccgacggaggccacattttagtcagcatgacgtgcatcggatgcggaggcggggcaccgggccaagaaacctgcagtctcccca

SEQ ID NO: 39004 - DNA, 68 bp, Chlorella protothecoides
gtctctctgcagccaagcccaccgcactgaccccccctcccccccaaggcggcacggagaagatgctg

SEQ ID NO: 39005 - DNA, 80 bp, Chlorella protothecoides
tcaagagggcgacaggcttccagaggacacctgccgtccatgtggcatgcgtcggaagggagcctggaggagggagcagg

SEQ ID NO: 39006 - DNA, 68 bp, Chlorella protothecoides
gtgaagaaaggatgaagcatttggtcacgacccccatcccacccagcagaagaggccacccagcagaa

SEQ ID NO: 39007 - DNA, 90 bp, Chlorella protothecoides
caagaattgcgctgtaacatatgcgaacgtccatggggcagttatatcccctttagcacgtgcaggtggatggcatgctggaggtagagg

SEQ ID NO: 39008 - DNA, 74 bp, Chlorella protothecoides
ccggggtgggcacgcccctgcacagtcctgtccccgcccccacaccccacccctccttcccccttcccctgagc

SEQ ID NO: 39009 - DNA, 31339 bp, Chlorella protothecoides
  modified_base (1285)..(1294): a, c, t, g, unknown or other
  modified_base (3502)..(3511): a, c, t, g, unknown or other
  modified_base (4789)..(4798): a, c, t, g, unknown or other
  modified_base (6547)..(6556): a, c, t, g, unknown or other
  modified_base (6653)..(6662): a, c, t, g, unknown or other
  modified_base (6835)..(6972): a, c, t, g, unknown or other
  modified_base (7064)..(7073): a, c, t, g, unknown or other
  modified_base (8518)..(8527): a, c, t, g, unknown or other
  modified_base (8650)..(8659): a, c, t, g, unknown or other
  modified_base (8890)..(8936): a, c, t, g, unknown or other
  modified_base (9881)..(9890): a, c, t, g, unknown or other
  modified_base (10849)..(10858): a, c, t, g, unknown or other
  modified_base (11283)..(11292): a, c, t, g, unknown or other
  modified_base (11560)..(11569): a, c, t, g, unknown or other
  modified_base (13746)..(13755): a, c, t, g, unknown or other
  modified_base (15381)..(15463): a, c, t, g, unknown or other
  modified_base (15566)..(15575): a, c, t, g, unknown or other
  modified_base (15678)..(15687): a, c, t, g, unknown or other
  modified_base (15864)..(15924): a, c, t, g, unknown or other
  modified_base (17677)..(17686): a, c, t, g, unknown or other
  modified_base (18451)..(18460): a, c, t, g, unknown or other
  modified_base (18773)..(18782): a, c, t, g, unknown or other
  modified_base (20265)..(20274): a, c, t, g, unknown or other
  modified_base (27886)..(27956): a, c, t, g, unknown or other
  modified_base (30715)..(30830): a, c, t, g, unknown or other
  modified_base (31139)..(31148): a, c, t, g, unknown or other
ccgccgcgccgccctgcccagcggccacgatcgcctccgccgcgccgtgcacaaagtccagcgccgcggcgcgggcggccgccaggcgctccagcggaaccggggacccgcgcggcgcggccagggcggcggccaggcgtgcgccgtgctcggcctcaacggcctcgaacaaggctgtgaccagggcgtggagcagggcgggcgcgcggcagggcatggcttccgccagccagccggcctcgccgcgcagcaggcccagcacctgctcgaagaattggggcagcgcggagacaaagggcgccctggcggggtccacctgctcccaggtggcgcgcagcggcggcagcaccgccgcgcagtacagccgctccaggctggcgccgtccccggcgccctccagcatgcccgccagctgctgcgcctcgccgcctgggcgaggtggagtggggtggggggttgggggtaatgagtcacgcaaccacgccacgcatcggtccaggggccccctacgcatgccccgagcgcccgctacgagccggcaccctgctcccacgccggcccaccctgccggttctgcagcgcggcgaccagcggcgcccgcactaggtcccgcagccgggcctggaaggtggccaggcgcgcggggccgtccgcaaagccggggacggagtcccctaccacgcgcagcccgcgctgcatgccggccagcgcagcggcgatggccggcaggtcctcgtcggcaaacagggagtccatgcggtggaagagggatgccaggccgctggcctcctgttgttgcagtgagggattgcggggggaaaggggggggggtgacgataaaggggaggagggtgacgataaagggggggagggtgacgataaaggggaggagggtgacgatgcaggggcggctcgggggggccacgtccatggtacaaggccgggggccatgggaagccgagtccgtctccctggcatgaccctccccgcccgccccggcgcccacctccagggtgtcggccgcggtctgcatgcgccccttcaccctttccagctggcgcagggtgtccaccgcctgggcgccgggccccacggccgaggcgtttacccgctcctggacctccgccatgctggcctgggcggaggccaggtcgctctgcagggaaggtggagctgggctccgtgggtgcacagccaagaagtacacgcaggggtaggggcaggctgtgttgtggcgctattccactggacgcaggagtgtgtgcaccgctgtcccttccccatnnnnnnnnnnaaggcaggctgtgttgtggcgctattccacgggatacgggagtgtgtgcaccgctgtcccttccccatggattttggcataaacaagcgttcaaggaaggagcatgcatgcaaggcgggccggctgcgcttggctgtcaggatacgcgaatgccttctgcgtgtttaactctactggactggcgacgtgcctgtatgtttagcagctccttcagtgcagaaggcacccggagagaggctcgggagctggcatccgccaatttcccgacgatgtcctcgcttgcgagctgcagtctgagctccagctctgtaaggtacctgaagggggaatcggtaaacggtgggtgagtatgagcttgcagatgagtgcatgctcccagccttgatgccgtcctctccagacccaccacacagtgaccctagcatacctatccatgggcgcatcctggctcttcttctgacagtagtcgttcacatacgtcacagggtcgaaatcaggtgcctcaaacgcatccagctccaccatcctgcccgaggcttacgagtgatccacccactgcacggggtgtaccaccgtatttgtcgagccgctgggctattctatgaacaaactttatgcataccaaggtgcggtatcgtttcagctttctttggtcatgttctcctgtcgtgagggagtgtcgacagtctcgcgttcatgaatccgcgtgacggagctgaacatagtgcagcactgatctgcctcgccttcctatcgccctgctgccagggcagccacgatcatggaccttggcccgcccgcgcagcccgtcttcattctgaagccagaacttaacatggtcagggagcatgcaaaagcgcatggaccatacattttaagaggggatgggtcaatgtccagggcagcacgcaacgtggggtgaggcccaaggcccacccacacagcgagcccggtccgtttcatccgtatcatggaggcagtgtgttcaggggtgggtgggtcgtactccggctgcctgcacctacttgatgggctgcaacaggctctggaaaagaccgcccttgctggccgcggtggtgttgcggatgaactcggcatcgtagttggggtcggcagcggcagaggcgggggtgacgcgcccagaatcctgcagggcagcatggggcaggaggcgatcaggcatttttgagggaaggctgcagattttgaggtggtggagaatttctgcacaatgcatgccgaaacacttgagcagtcactcttatggctcccgtccaaggaacctcggaaagaagctccccatcctaccagggtgtagaggtagctgacatcatcagagaccgcggcggtggggttgatggcatgcaggcggtgggacctgtagactggggccgtgcgcaccatgttctcgaaacctgcgatggcgtgggggggccgaagaatggtcgatgtgcgcgacgtgcttgcccagacccttgcatgcgacggtccagtcacgcaaccagggcccatgctcggcagcgatcgtgctcgcactcttgccccccccccctccatcgtgcctcgggccccacctgcggcaaaaggcaccagcttgccgtcaaaggtctccaggcccttgatgcgcggtgctttggcctcgccggcctcctgcgccttcggcatgtcctcgttctcctccacgggctccttgctggtgctgtccggggcggacctcttgctctccttggcctccgacttctgcggggtggccagagaatttccaaaatcaccagtggcccatgcggcaccgccctcgtcccctgtatccttcaggggtctggatttcgggccggggctctggttggaccctcccgtggtaaccttggtgctggtggcgctgggcatggttgagtgcttcgatctgcccggaaccctgatgtaatgcgttgctgatggcagactgtgggggagcaggcgcgggtcgggggtttgggagcggagtggagggtgagggcgtccgccaggctggcgcctgcgaccagagcttccgcacagatgatcggacggggccgtggaacaggtccacgaacctctcgacatggagattggaaaaaagagccaggatttcatctcattgcgtcaatggaacacctgaccatcatcctgccctgtccaatccaatgcttgccctctgactcccccgctgcagcttttccttttacatcnnnnnnnnnncggagattggaattaagagccagggtttcatctcattgcgtcaatggaataccttaccatcatcctgccctgtccatgccaatgcttgccctctggctcccccgctgcagcttttccttttacatcgtcgctgaacatgcaagaacaggcgcggccgtcagagggaaggggaagagggtgcaggggagggggaccctcggggcgtacggctcgccagcgtcagctaccgggactcgcacggaccgggactccccgctcggcacactccctcccgcaccacgctccgtctacttggcactggtggccaccaccttgccgagcatgacggcggtgtttccatccaggaacgcaatgcgggacaggccctcgcagttcttgaaggagtccaccaccaggggctggcagggctcgaacacgacctcggccatctcgttggccttcagggagtggggctcctccagcttcttgccaccggtctccttgcccaccttccagttgatcttggtgatgcggcaggcggagcggccacaccgcacgaagccgatgggggagtaccccgccttgacctcgccggggatgtccagggtctggatctgggcggtgaagtccttcacgggcttcatggtggagtccgacttcagcaccatcacgtcgccggtgcggggcaggttgttcttgtccaggcccttgatgttcatgcccacgttgtcgccggggcccgccttgtccacgcgcttgtggtgcatctccacggtgaacaccttgccggtgcaggggttggcggcggtgtgggtgggcatgaacaccacctcgtcaccgggcttcacgatgccctgctccacacggcccgccagcacatcgcccacgcccttgatcttgtaggcgccggagatgggcaggcgcaggggcgcgtcggccttgcgctcggggacgtccaccatgtcgttcagggcgtccagcagcgtgtgcacatgcaccttgcgcttgatgatgtccacgtccacgccagtccaccagggcatgttggtggacttggtgatcaagttgtcgcccatccacccggagatggggacgatggggacggacttctggacgaagtcgggcttccagcccacgcggatgagcatgtggcgcatctcgttggcaatctccttgtagcggtcctcctgtggcaaggaagggtgttggggagggggggtgagcctgggctgacagaaatgtgtgactagcgggtcagcgcgagtccaaaggatcaggcacatttggcgccacacaccnnnnnnnnnngtgagcctgggctgatagaagtgtgtgactagcgggtcagcgcgagtcccaaggatcaggcacatttggcgccacacaccgctggcagctgggaccctacagggtcaatattgaggtgccaggcccctgacaaacacacaatctctaccatctactcacagtgtacttggcgacatcggagtccatcttgttgacacccacgatcagctgcttgacacccagcaggttcagcaggcgagcgtgctggcgggtctggccctggatctcaccggccttgtggtcacccttctggatggcggtggtgaagtttccatcggcggggaccatcagcaggcacacatcggcctgggcagcgccggaaatcatgttcttgatgaaatccctgtggcctgcagggggtgcgggggggtgtgtggggggggggtgaacattcacggcatgaggaagcatcccaacgagagaacaggcaaagcaattgagccagggtactgcgcctgaagcatcagcaagcctgccaattcacagtctcccacacctgcaacaagctctgtccccaggatccagcatcacactcaccaggggcatcaatgatggtgtagtgccacttctccgtgaagaactccttggtggtgcaggcgatggtcacaccgcgctcgcgctcctccttctgcctgtccatgtagaaggcgaaggcgaaggaagacttgcccagggcagcggcctcctccttcagcttctccagctcacgctcggggataccgccgagctcgaagagcaggcgcccggtggtggtggacttgccggaatcgacatgtccgcactgcggtgtgattgaaggggggagcgagggggtggggcggcggcagaaaaagggacggctgcgcggcgtttgcagggaacgttcgcgacgcgggcagcagcgcccgagccgaccgtggtcaacgacccgacacatggcagtccctttcactcacgataacgatagacagatgctgcgagggggaagaggagggagttacagtgagtttcaaggcgggcggggaagaggagtttctgatgctgcccggtccaccaacgccaagctctcaccgtctttccctcggccattgtatctagttctttacgtgtccgtgcactgaacaccaggtgaaatattgaaagagggaggcgcagggccgagccacgcccggttattcctctgtgggcggccgagtcctctggggcccttctccggggtcggggagcggggggcgccccgggacaaacagcacccccccactacacttgaatcagatgaacacctttagggccaccgtgtctcccccgattgctcatgtgaagagcatacttgaatgacttgatcccatcgtacacatctttcagagaccgaggtccagaacagtcggaactccccacagctcgcaggatcagtcgcggcgctgtgccccgctcaagcaaagtgagtcggtgcaggctgtgctgtgccttgcttggtaagaatggtatcagttccaagtataccagctgcatggtgtagtcttgtgcccttgtggcctgctcaagggcacaaagttcggcgctggcataccctgtgctgcctacaaaagtgccagcgcgagcagctgcaatcccaagccaactctacaatcaaggcattatagtcaatttggacgaaatgatgggggaggtcattaggaagacaccctctctatgtggggtctggcattggctggctttgtcttggagcgnnnnnnnnnncctgtccattgtacgttttccacccaatccaccgcatgataggcagcacgcagttatggccatcttcccgtagatgctcaatgctgacaaatacagnnnnnnnnnngccaaagccaactccacaatcaaggcattatagttaatttggaggaaatgatgggcgaggtcattaggaagataccctctctatgtgggttctggcattggctggctttgtcttggagcggggctacagagggagcgcatggctgcacgctaggctcgcaatgggattgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagatccgatcagagcaggctctcttctcgtcccattcctggagttgcgcaagcatctccatggccaaagatgcgatcaagtctagctgnnnnnnnnnntctgtccattgtacgttttccacacaacccaccgcatgataggcagcgcgtggttatggccatctacccgtagatgctcaatgctgacaaatacagcacatcccagccacagcagcctcaaagcatgcgtcaggtgctgttcttccaaataagtcgagcagcatttcttcagaatcatctcagtcccatccagagaatggaaatatccgatcagagcaggctcttttctcgtcccattcctagagttgcgcaagcatcttcatggccaaagatgcgatcaagtctagctgctgagagtctgagtgacttttgaatcaagttgaaacatgtgggaatagagccacatcaggtacagctgcgtgtgcgccactgtatgggtgcgctgccaaatgtgttcctgaagatagaacacaaagagctgttactgtctccaactgagtccatgtcggcaattcatgcttcccagtatgttagacccgcgtcagtgtaccacaacgagcattgaagtggcattgtcaactgattacttggcaagtaggagtccctgccatacgaaggtcaggggggagtctcacgaatatgaacagacgctggtaggggattccccgcgctcagggtcggaaccacctgggaaggtgaatgctcctgcgtctttctgtttcagcatttgcctgacaccacgccactcaaacattgatactaaattcgaagattctcaagaatagcactcagtcccttcacttgctcaccagcacctctcaacgcgtcgagggtgactggagccctgccggtccgggccccggcaccatgaagcgcatcttcggtcgcaaggagaaggtcccgcctccctcactggatcaggccactgacaaactgaacacgcggggggacacgtgagtgtggagtggggggcattgcgacgcacagatcatgtcgaccttgcggtggctgggcccgggtgtccctgggccccgcaggcatgcagcttgcgcaagacggcctcatttccccccacccctgcacccacagcatcgatgagaagatcaggaagctggatgcggagctggtgaagcaccgggagaacatcaagcgcacacggcccgggcccgcccaggaggcggccaagcggcgggcgttgaccgtgctgaagcagaagaagctgtacgagagccagcgtgaccagctgtacaaccagcagtacaacatagagcagaccagcttcgccatccagtccatgcaggactcggtgcacacagtgcaggccatggcggtgcgcagggtcgtggcgcggggagtgatgacctggaggggcgccgcgagtggggtgggccagaagctgggtacaccttctttttacctctggcctcaaggacacacgtcgcgcattcagctcccctggagagtcgtccaacctcctcacaaacccctccacggacaggctgccnnnnnnnnnnggattgcatgctcgctggcggggaggctacggggcaccatgcatcttcgtaatgcgacatccaagtcccgccgtcgcatgctgtgccgggggaacccctcttcctgtgtctgctcaggtccannnnnnnnnnatgcgagtggggtgggccagaagctgggtacatcttctttttacctctggcctcaggggcacacgtcgcgcattcacctcccctggagaggcgtccaaccccctcacaaacccctccacggacaggctgccggcaaggagctgaaacagactatgaagcacaaggatctgcgcatcgagaacatagagtccatgcaggacagcatgcaggacctgctggtgaggcgccggnnnnnnnnnnnnnnnnnnnnnnnnnnnnnnnnnnnnnnnnnnnnnnnccactcccccaccgtgccaggacatgcaacacgagatcacggaggcacttggcgccaactacgcgaccccagacgacatcgacgagtcagagctcatgggggagctggatgcgctagaggacgagctcacaatggagagcgaggctgggggcagcgtgcctgcctacctgcaggaaccggacctcccggcagcccccactgcccaggctgcgggggccgagggcaccgacagctttgggctgccggcggtgccggccatgccccaacgaacgtgaggtgccgggtgtactacatacaaatctcgccttcccatgctatctgctgtctgccacgctggactctgtacctgactgattgtattatagttcactgaagctgaaattgtctaccaggctcttggtctgtagcacaaggaggggaaggcacagcatgtggcggtagcggccatcagtgtcatggagaaggtgcagggctgtttggcttgccaaccaaaaatgaaaagctcgctgcagagtcgcagcccatcaggagctacctttgtcagggttcccacgtgacatgggctccagatgactgagtgcaaacggattgaccactgaggcgcattcatagtcaggaatctcggttggcactctgtcagcttgaatggggaagccaccgccaactattccagcttcagccacaatgtgccacgtctttgtccatctgctgatgctctttaggggccagaagaatcaaggcctggccttcctttcctagcttgcaccagagcgtctacgaccttttcaagctgtagattactagcaggctagaaatggcaagttccagtaataattgggttctcatggtgccgttagcataaagggtgacgagcatctccatgacaggtgaacatgtgtggaattacctcagttggcgagggaggctcacaaaacgatgctgttnnnnnnnnnngtggtaagttccagtaaaatttgggttctcatggtgccgctagcatcaagggtaacaagcatctccatgacagaggggaacatgtgtggagttacctcagtaggcgagggaggctcacaaaacgatgctgtttcctgcccttcctctcatcgggccgcgaggacgcaggcttcaactagttgttccgaggcccagatgtccactctgtgcctgggcctgcagcagtctctctgggccatttggagtgtgctccaaatagtgaggtcgtgtgtgacatctcccacagacctgtctgccgtgcttgtgcagcgaagcagagccaggaggaaaggctgccgccatgaggcacccgtggtaggtatggagatgttcggttgaaattattcacttagcttggtgtctgaacgtttcaccctgtgtgcaagggagaggagtttcggttctgattttgggtgtgcttgatgggtggatgggctgccttggattggaggcaaaacctagggtctcgagtatatgctctcattgaggtgttcttcgtctctcatgttgatctcatgctcaagtgtgaagatgggacacaatccttggatagtgatgtagtgttcccagaaaactgagtagacgaccagcaaagatcagcctctgtttgccacagtgccagcaagacggaccaccattcccctagctttgcaagcatgggtgtcatccttgcatccacccccagacccacctgtcgctcccggagcagggtcttgtcggctcattagctcgagatgcggggtcggggcttgtaggggccggcgagggcctggaagacatcaatcaacgtaatttgctcttgaggacccccttctcagccgcgcactcctcttcgacagcttggccaatacaagatatgattgcaaggctaagatcagcagactgtatcatggtgtgctgaggctatccattactgacannnnnnnnnnatcctcttcgacagcttggccaatataagatatcattgcatggctaagatcagcagactctattatggtgtgctgaggctatccattactgacatttgaacaagggaaggagtgagatatctgacaaacccttgacagcaactgctccatcgctttgagtcgcaatgtggcatggcggtgtccttgacaggctgcatgactctgacatgtaagaggtcagtaagcaagcactgcacttggtagttgctgtctgggaacccactcgttgattcagctcagtgcaggacctcccaagcgaccccttggccacgcagcctccaactgtgatttccttgtaaagcacaagctgtggaatggaagcacataaaggagggagtcaatccggtcattttaacccatctgcagcaagggatcaccaccacgannnnnnnnnncctttgattcagctcagtgcaggacctccaaagcgacccctttgccacgcagcatcctactgtgatttccttgtaaagcacaagctgtggaatggaagcacattaagggagggaatcaatccggtcattttagcccatctgcagcaagggatcaccaccacgaatgtgcaatgatcttctgtttcaccttgcattaccatgcaggtgggcctcccaaccacgccagacgactcgttggagctggcgcgcaatcggtcagacctgcacnnnnnnnnnntccatgcagggggccctccccaccacgctagacgactcgtttgagctggcgcgcaatcggtcagacctgcacctccacagaggattccctgactgttcttcagcatgctcaagtctcggtccgacacccaggtgccgatgcattggtctcaccgttgctccttgcgagggtgaggttgctgtcggcctcccccctgtcctttgcgagtccctgcctgcatgcaccgagcctcagcactcgtccggacattgaagacgccaaagggtcgctctgcattctctgggtcgcgtggggccggcgtggttgcccgctccgtcctgcctacggacatggtggtgcaaacacgtcaggaccgccgggaggagctgggattcgaggcagttgtcgccaacctctgcagcgccgtggccaatgccggtgcctgccagccggtgagtcgacgattaaagggtttgatttccaaagcgagtcgtagctccggggcccgggtggggctgcgttgggttagccatgcaagtcagcaagtcacacctgtgtgcagcggtgttcatgtaccagaggcggctgcccaactcctcgagctgggccttgcctgccctgcaaaggccccaacagctgcctggctggtccgcgcccaacctacgtatccgcaacacccgccgccgcgccgcaggtgagcgcgcgccatgccgccgtcctggtcccgctgttcgaggacccggccacgcggcgcacgcacgtggtgctgacgcagcgcgcagcggggctgaggtcccacggcggcgaggtctgcttcccgggggggaagcgggaggagggcgacgccgacgacgtggccaccgccgtgcgggaggcgcaggaggagctggggctggaccccaactcggtccgcgtgctgggttgcctgggccccgtcctttccaagcacctgctgtctgtgaccccggtgctggccaccatccccgcacgccatgccttccaccccaacccggacgaggtgcaggcggtgtttgccccccccttgcacaccttcctggaggcctccgacctccactccagccgggaagccaccttcgccccggggatgccgtacaggtgcgcattgtgcaagggctgttcattctggcctggggcctgcaggcaggactggacccttggcaaaagtacactgtgtcgggcacaaaggcgggaggatgggcaagggccaccgtgggtgcaggaccagcctagcgtaggcctggcaaccggaggcgatcaagatgttgtaggtgttgcagcaagggtgctgaggcctgcgctgacgtggccagtcgcagtggccctggctctcagagttgatcccgctctccatggtccccttgttgatcctcacccattcccaccacccttgccaggctgcacttcttcgactaccaggcggccgatagggagtggtacagcgtctggggcctgacagcagccatgctcatcgacatcgcctccaaggggtttggcagggatccagactttgaggcgctgccccccgggtatgtccccatgcacgccggcatgtttgatgaccagacccagaccgggtagatggaccacccgctgccgtcgcagccgggctggcgggggcatgactgctcgatacatggagtgacacgccgcctcgcaaccctggcccgtatcctagagctatttaatgcattcccaccaccgccccaaatacatgactccatgcttgctcccttgagagctctcatcagccaggctgatgcatattcagaggccacatcaccgaaactttgccagaatgagtgcctctatagcatgatgctaaatcttatgtccctccaatttcaccgcctccctcgcatgtcaatttccctgcctcacatcactgtacaccaatgtacttgggagcatgtaacacggctctggaggtgctgcagctccctcaatcgttgaaatggacggctccagaccggaccgccacccagaatgtggcaaacatgaggccgatgatggtggtgaagctgaaggcaataaactgctcatgccgaggaggaaggggatggaggggttggagctcaaagcacatcagaggagggtactttagcctttctggtgagatacaaagtgcagagcatgcatgcagcagggtgcaactccataccatccaccgcaagcatgcnnnnnnnnnngtcagaggagagtaatttggcctttctggtgaaatacaaagtgcagagcatgcacacagcagggggcaactccataccatccaccgcaagcatgctcctctgcacacaatcagaggtgccatctctacttccctggtcccaatggcatgcctacccataactcacgatctggatgttggtgatgccctgccaccagggcttggttgagggcggctcgaggggccgcatctccagggagggctcagggcggccctggtctgagctggggcccagaaaatcgtccccgggggaataactggacggcgagaggaaggagcgggcggctgcgctgtccctcattgcagggttgggctccggcctgggctggctggagggtgctggggtgggtgtttcgccgccctccccgctttcctcctcctgggccagggaccccaggaaatcgaggtcctccagcgccgtgtccttgcggtcgcggtccagcagacgccgcacagatgcggccgtctcgtcaaaacgctctgtgtgggggcaaggtgggagcgcagagggtgagcatctcgtaggagcgtgaagtgaactgacatcgccctaggagaaaaacagagttgggaagggcgagcagacccctcagaaaaggcttcccgcagccctcttgagattggacgcgtcgaacggcgatatgtttattcctgaccaatcccagcatcaagcgccagtctcgttgctggaacgatggatgcacccagatctccaccgtgcctgcatggacgatggtccttgggcgcgggttgcatggccttgaagccagcgaaaacctagctaatcgcggcccatgtgccgcttgtgtcccgaaatagtgtcctggagccacgcatgagcgcgacacggcctgcatgccaggctgtgggaactgcgagtttgcctgttgcagaggcgataggggcaatccgtggacttgagctttactacagtccaaatgggtaaatcagcgtcagagtatcctgtggatcagtgcggtaattggatgcgggggtcgtaatgctccgtatgatcgggtcccagcagcatggggcggtcgacttggcagaccggatgggccgtgctgcgttatgttttggttatggtgccagcgacaggtaccctcgtgcatgcattcgatcaatgtagcactgcaatcggtctgcatgacgggctagtatttgcatgcagtgcgggactgctccgccaaggctcggcagcatgcacctctgctccccaacagtcggcacctcggctgcgagaccctgcccgcacgcctcggcatcagcatgcagcgcccatgggcgtgcgacacgatttaaatcagctcttggcttgacacatcgctgtgcactgcctcgcgggtgagcccgatggctgagaacatgcgacagaaaggacctggggagttgggggcaatagtccagggtgccatgcccctgcagggcgttacgccatcaggccatccgcacccagatcccatatcctgagttccggtgcattcctgcaaaagacccacccccctgctgccccgccagggccagtccattccaggcctcgcaggcgcctccccgtcaccccggcatggtgatggcgacgccgcccgannnnnnnnnnnnnnnnnnnnnnnnnnnnnnnnnnnnnnnnnnnnnnnnnnnnnnnnnnnnnnnnnnnnnnnnnnnnnnnnnnnccccaccttccgtccgcggaccaggcccctgtttccctgtggaggatcgccgcccccctggccctggccctcgccgtctgcaacatggaccgcatctgcctcnnnnnnnnnnaccccccttccgtccgcggacctggcccctgtttccctgtggaagatcgccgcccccctggccctggccctggccgtctgcaacatggaccgcatctgcctcnnnnnnnnnnagtgcattcctacaaaagacccacctccctcctgccccgccagggccagaccgttccaggcctcgcaggcgcctccccgtcgccccggcatggtgatggcgacgccgcccgagcctgggccggggatggcgccgccgctgaaccccggcacagacccaggccccgctcaggaccacnnnnnnnnnnnnnnnnnnnnnnnnnnnnnnnnnnnnnnnnnnnnnnnnnnnnnnnnnnnnntccgtggccatggtcccgctggccgccgagctgcagtgggcccctgcacgccagggtctggtgcagtccgccttcctctggggctacatggccacgcagttgctggggggctgggcggccgacaagtatggaggtaggagtgtgttctcgggaagggtgtgtcaagggggagaggtatgtgggcccctgaatgcccaatcagaaggtgtttgctgagtggcagagaatggacgaatggattcattcgagcctggtatcgcagccctcaccagtcacaccctgccttccaaatgcccacacagcatgttgcaggccggcccactcatcgtcagttgtctcgcttgtgacccaccaccacaagcttacctcccactgatccaacctttcacccccctttcatcatcaatacgcaggcaagacggtgctgggctggggcatcgcctggttctccctttccagcctgctcctccccttgctggcggtcacccccctcacccgctccctgggccttgtcctccccgccgtactcctcacccgcttcctggtgggcctgggggagggcgtggccatgcctgccatgatcagcctggtggcccaacgcgtcagccccgcccgctccagcgccgcgctgggcgccgcctataccggcttccactccggaaacctgctgggcctggtgctgtcgccctggctcatcgcgcgcggtggctggcgcgcgcccttcctcgcctttggcgcggcggggctgcccctgctggcggcctgggccatcgtcgtgccggggagggcgggcgggggcgcgcagcgcgcacggcggggggcgggagccgtgcgcggccaccgcttggcggacctgctgggcaatagctcggtgtgggccatcatcgttgccaccgtggtcaaccactggggttacttcatctacctcaactggatgcccacctacttttaccggacgctaggtgggggagtggctgggggaaagaggaacgttgtgtgagggactgggggcctggggaggtggaggagagggggcgggggatgtatgactttcttgtaatgtgtggtccccaccagaaggcagcccaaactctgctggaagaagcacgggattcaggaagaccgggtggcggggcctatccctcccaacattgtgacagggaatacagagcgtccacccaacccttcccccacgccccacccgctcccaaccctcacagggctggacctccggtccagcagcctgctgagcatgctgccatgggcggccatggccggcggcgcctccctggccggcggcctggccgagatgctcttggcgcgcggctggccccggcggcgcatgcgctgcggcatccagagcctggccttcctgggacccctggtcgcgctggcggtgctggcggggggtggcagccggctgagcatcccggtggcggtgggggcgatgaccgccgcgctaggcatcacctccctggggcaggccgggttcgtgggggcggtgggggacgtggcgccggcagccgcggggaagctgtttggcctgtgcaacacctttgggaccctggcaggggtggtcggtgtccaaggtaggggagggattttgtagaaaggcggagcgggggatgctcctgatggacaatggggccaagacactgttctggatggtgtcaatggtggggaatggtttggcatcatgtgtgctgggccagggggagtgccattgtcacctggaccctctccatcgctcccnnnnnnnnnncttggcatcatgtgtgccaggcccgggggagtgctattgtcacctggaccctctccatcgctccctctcattccccacccctccacggctccacagtggctggcatcgtggcggagaagactgggtccttcacccttgtgttccagatcacgggcgccctctacatcctgggcacgctggtgttcaacacctggctgaatcctgagcctcagtttgcttgagcagtccccgttgtgtgcggggagggcctgcaggcaccgaggttgcacatctgagatgtgctgggattcgcatgcattattatggtccgttctcactcagtccataggatctaggttcccactaatcctgacctcctctgtagcacaattggtaaatcatgctacagctttcgacccgtacagtgggaaatataggcacctaaacaggtacagcacagcaatgtcggcgttttcatcgtgaggctcgaccttgtcctgcactcctccctctgctgcctggatcctgagcaccagacgaccacattcggccccgctcataacgatgggcatcagagtctcgagcagtgatgcactcactcactggtcttgagtcacgactatactgctgggacgacggttcattccgtgcccgtgcagcatcaggacctgcacccctcatcacgagattcgcttgacgactagaagcatcatgctgttgctcccttgcagggggctgggattgagcccggctggaggggtggggagttgccctgagagggagtgnnnnnnnnnngggttcattccgtgcccaggcagcttcagcacccgcacccctcatcacgagattcgcttgactactagaagcatcatgctgttgctcccttgctgggggctgggattgagcccggctgtaggggtggggagttgccctgagagggagtgtggcagcatggtaggtggatctgtgggcggatggcatgcaaaggaacaagttatagagaacgcccatcaccccacctcataaaagcagaatggtattgtatccgccgccttagagcacccttcatacacgaagcacatccctaacctggatctgagctccttgnnnnnnnnnntaggttttagagaacgcccatcgccccacctcacaaaagcagaatggtattgtatccgccgccatagagcacccttcatacacgaaccacatccctaacctggatctgagctccttgatctctgcgtccttcctggtaatctccagcttggctgtcttgtacaggaccgagatgttgtggagtagggcgtcccgctcctgtgtcatggctgacagggcctcccccagtctgctgttctctgccttttgcgcctcaagttcatcagttgtctgtttgatacgcgccctctcctgattgaagagtataatttttatcattgagcgggctgtccgaacgggcgcatgggcggacatccctctggacaccatagtctgatcagatcaatccagtcaccaacctgggcaagctgtagtcccaagagcgtgcctcctgtgcctctttcatccaccaagtcgccatatagatcatcatttagtaagtcagggtccacttgaacggtgggcaggccaggatttaatttgggcggcgatgtgaggcccagcgcccccccgaactcctcgtcgacgtcgactggggaggtcgtggacgggtcacccatccagatgcagaatgtttcaattcatgccagaattcaacttgatgttattggacgtaattcatcagccaagctccgaatcggtcatgaatcgcctttcaggcttctgcgcgctcaggggttcctatgtttagcactgatgtcggatcgatctggaagccagtgatctgatatgcactgtgatgttgaggcatgaaggaggaagaacgcgtgccgcgggtcgcagtcacaattggcaagttcaatggcattcgcaactgagttgctcgcagcgcgcgggcgcgacaatcctcacgcctgcttccttccaagcttgctgcgccttgcccctcccagaagcttgcgtcgttgcgcaagcatgtacccatacagctgtggaaaggctgcagatgtgtggagtagggaacatggattgatgctagcatattcttgccgggagttgtcgagtccactgagttccaacatcaagaacctacctggcacgtacgcaagcacgatgatccagcagaccacagagtagtcaaaggccacattgaggcgattgggaaggctcaaagacagtagtctctgtttccggatgggtccactggcgaggtacaccattgccagctcgcttgaaacccctgcgacgtaagcagatggggacactttgaggtgagggcactataagcattgttggcgccatcctcaagaaaggttgggaccatctttccaccgcctcaaacaggggacctgtcctggccaaaaacatcctgaggaaagaagaacacggacaagccaagtcttagttataatcttcctcgactccaggccagtccaacacattcaagtccttacccaatgggtacagcacgataaagccagtgtatcgcagccagagcagggccnnnnnnnnnnatgattattgtcttcctagactccaggccagtccaacacattcatgtccttacccaatgggtacagcacgatgaagccagtgtatcgcagccagagcagggccttggactgaatgccagcctcctgtgtgggtatggtggaggattgatcaggcatgattttgcacaaggccaggacggctgtcgtgagctcgccgcctcttgggtagcagaggagcaaatggagtggccggtcatcaccatttaccccagccccaacaaagcccataccttggctgcaaagtgaccatagcgcagaacctcactcagcgcccagactgatgtgagagtggccagggacaaaccgatggcagcccctcctgtcccgggaatggagattgcggccacctggcgagctgtgacggcctctgggaccaggtgcacaataccccagaggatccacaggcgcgaggcaacctgcatgcctgcggcatgggaggtgtggcaggtgctggagctggataggaatgttctgtgttcaacaattggaggcctgcaaggaagattgcaatacatgcaatgagtccctcatactccctcaaaaccatcaagcccgggacgcagcctgcttttcagatattgattccagcccatcataagtgcatgcttgcaagccacgtcccacttgtgacaaggacgggggagcgcacgacacccagggcggcgtggatgacctcggcaatggctgccgtctgcacgatctccagggggagctccactgcctgggaatatggggttggttagattctctgcacaaggggccccctcgaacattgatcttgtgcggtctcgagtcgtgaggctgtggtcataagccagctcatgcaggcctagccaagcctgtatcccatctgtctgcatcgaaagcaaaaccatcaacgcgaaaggagcacaccggtcctttcatgggcgcacctgccagacgtccatcaggctgcccccatttgcaatagtggagagggtcaagtacaggacataggccctgcaggtgtcggcaagcaggactcagatgtcgagtaaagcacaaatgatactaggggctctgccatgccattacacagatccatctgcccatcaacgtaccatcctgcgctgagcgtggcattgtacgccagcaagtaggcgctgcgtcccgacatgggccggggaggcggtcggtcggtcgaagcacaggctcgtgtcaaagatcggagcccgcagtgccgtcgttttatccttgcatcggagagcgccgtaaggagacggtttaagaaacagctctcgctttatgagagaggtctgaaagtttgggcgccacgtcaggcacccccggccccatcaatcgatcgcggatcagagagtacacgctcaaactctgccaacacaatacttcgttgacgagcacacagtacgtccttgcaaatctaatgtggagtatagagattcgtaatatatgtagaaggtacatgccggcgctgcttccgtagctaggaggggaaggtcctgctgcggatatcacctttccaatctggaacccctctgatccaccccatgacgcagtcttgcttacgcaccgcatcgctttccttatcgcctctgagacccgcgagacggtgcatttcaggtgagcggtaggctggcacgtcttcaggtctaccctacaggggcctgctgcaaggagcgctccacagacatacacccatcgttgcacaacaccccctctgcatcacgcactccaactcggcccagttcccaactcacggatctcccagcaggcaacgcacacctgactgagggcccgggcatgcctgcgccgtccaccagccctggcgccctgctgtcctcctgggtgatgttgcgggggggcagcgtgcacagcgcgctgcacgtccgcaccagtcccaccgccgggctgggcctgggggtcagcagcgccgtgtccccgggaacgatcctggtccgcctccccctggccgcccagctgggggcgggcggcgcggcggactcagacctgcagaccctcctcgaccgggtcccggcggagctctggggcgcccgcctcggcctgcacgccctgcgagagcgcgccgtgggggagggcgccggcgccttctggccctacatcgccgcgctgcctagcgccttccccggcgtgcccctcttcttccccagggaggccgtagaggccctgcaatatccccccatcgtccagcaggttttagggggtccattgggtggggtaggggtagggagctaggacatgatggggcagagcagacgccttgtggggggttatggcctgctgcactgcactcagcgacccccatctcatgcacgctgtgggtattcggtgcccaaatttggaggggaacaagggactcattaccaaatgataaccgaacgctccagaaaccatcacagataaacaagcggtcacgctggctggtgtcctttgccagggagcacctggcggcaccgcggccggcctttgcgcacgccagcatcgacatgggcggcctggcctgggcctgggcggccgcctcctccagagcatttcgcgcccagcgcggcgccgcccccgtcctgcttcccctcatcgacctggcaaaccatacctttgatggccccaccgccaaggtggagggatcggccgatgccacctgcctggtggctgcccgccaactgcgggcgggggaggaggtgagtctgaactacggccccctctccaatgacgacctcttcctggactatggtacagtggacggttggtggtggatgcgacaactgctagcatggccggactttggcgggggggttcccatcaatgagccaactgctgcaacgccagaggccttcatgtatccctcccccccgcctcaactgcccaggtttcatcgtccccggcaaccctcatgacgacgtccagctccagttcgacctgagcctgatcgaagcggcgcgggcactggtgggcctggccgccctcgaggggctggcccccgcggcgcgcgccgcgctggaggcgctgggcctggcgggcgccccggggtcgagcgccgcggtggctgtgcggcgggccagggccggcgtccaaggaccctgcgacgcgaggctgctggcgggcctgcgggctgtgagcgcgcagcctgctgagctggaggggctcacgctgcgggcgctgggagactgggccagtcccctcagcctcgtcagcgaggtgggcgggggtccgctgtggcctgatgatgagttttggtggctggcgcagggtcgccatggcatgcgtctgatcctcagttacaaactcatcgacctcactgcttccaggattgtgtcttgaatgcgatgtggcatgccggaacatgattcaatacatgccatgccccctccccgccacaaacgagcaggccaaggcgctgcggacgctgacggggctgtgcgccatctcgctgtcccacttcccgacaaccgctgaggaggatgcagaggttctgaggaaaggaggaatgtcggggcccatggcgctggccgtgcagttccgcctggagaagaagaggatactggatgccggcatcaaagcctgcgcggcccggattcgggtgagtggctgtgttgctgcccgatgctgcctagactgatcaggttgagcagggatgcttctcacctccgtcaacctctgacaggcagggagaacccctcactcatccttcacaccctcccgacccaggaactacaaggctgacaaaattgcaggcttggtcttcccctgcctgccccaagatactatacaacaatttgctgcagcacagcagctgtggcatccttgatcgcaagttgggttaagttagggggccacaacatacagggtaggggtgcatgccttcaacaagcaacagctggcagacacttacgtaggctctgagtttgtcagcacaaacgaaatacagatcaaacaaaggcaaccgctgggtaagctgtccattcaaaattgttggtcagcgaccagaaattgtacggaggcaaaagctctgcgcatcagcttttcttggaaaagaattgtgtgatggatgcctgcttctcagagggatccggactgctaaaagcacccttccctgctggactgggcttggatttaggctgaggactggatttaggggttggctcctccaccacctcctccttctctatgggatcttgccggtcgccctgtccctttgcgtccccggccgccccaacagcatcgctgggttggggagactccttcttgatggctggagctgccgtcgcaggttgtgaccccatctgagagatctgctgggagcccctggtctcaccgacctcgtcgctgttgcgtgcgagtttccctcctggagtatcctcaagtgtgctgtcagtcttcctttttgctccactcttcttctcgaagaactgggtgatggtgggccgtttcagctcggcgcagcactcggggccctggagcttggggctgcccatttctggcgtcacggggtgccacaccaggtcctcgccaatgtagggaccacagaccgcgctccacgtcctgcaagggagattggggaggagtggtatcatggctgagagactgagccacggcatgggtgggtaacttggcgaaatacctgctctgctctcagcttgcaagatgacttcgaagaaccctcccacaggaccccagcccgcacatccatccacccacccacccagctttggggtcgccgggcccatcgagcaaccagaggtcttgagaatccttggtgtcgaggatgactggcatgcggtcgtgcagccaccccagcctgggacccgagtctgccaggtgttggtggaggagtgatggagactatgatcacaggtgtggctctgcaacccttgcccaaacatcctcactccacccaagcctgtcactcgtgcgctcatggtccacaccgctcccacctgtggtcagtatggtgtaggtgctcatgggcccctcctgtgcctgccaggtgtcccacagccccgccatgaccatgggcctgtccccctcaaagtgcacgtagtagggctgttttgcggaccgcacctccttcttccactcgtagaagcccgccacggggacgaggcagcgctgacgggagaggagcctctggaaggtgggcttctccgccagggtctcgctgcgggcattgaacatgcgccagaagtcaggcagctcgtcaggcttggtgtaggaggggaccaggccccatctgtgaagccggtaaaggtgggcagctcataaaaatagtcaatgattggggcgtggggcttgactggcatcaaggacaagctctatgcagtgattgcatgtcatgcccagacaatggtggtaaaggtagcagttcaacatgaagcacattacccagttcagtacaccaccagctgctcaccgcatggtgcatatctccctccccatcccctgtaccacgcgcaccacaggtgagcgcgtggcacctggggcggcattgtaactgggattgaaggcactctcgccggtccatcgactggtgcccgccactcgcacgatctgtgggtcagggaagggacataagggggtaattaagtcttgaaccacatcttaacgccgctccacgcttggtatgagctacatacgccttgtgtacctcgtcacgacgcagcgtggtgttggtgcgtccgcacatgcttgatcaaatcatggagcgcaacgggatgcgaacttgctgcgatgcagccctgacgacatatacgcgatcaactacaccgcacacggccttgccatggcactgaaagggacatgtgcatgcctgcttgcaacaatgtcgatctcgtggttccgtcgtggaatggcgcgctctcctttctttccattggggattgcagctctgaatccccgggattcctaagtcggcggggcggaccctgactcttgtaggcaattttcatcgcgcaatacttgctccgagacatctcactgtggaaataaagccagtcgaagagcaactgtaagccatcatgcaggacacgcgcaccccagtgaccattatcacaggcttcctgggatccgggaagaccaccctgattaaccacatcctcacgagtgagcggagtacttgcagattgtgttgggcacaaagaggttggaatctggcagggggtcgcctgcaagacgcggtggggtcctcgtgcacgtgactactcgacgcttcctccagtcccggagtgcttccggggccggtcccatccccaacatccccagagctgttcacacactctatcgtccaatcctcccccaaaggtgatcatgggaagaaaatctgcatcatcgagaatgagttcggcgaggtgaacattgacaatgcgctcgtcatcgacaccattgaggagatctttgagatgaacaatggctgcatctgctgcaacatccgcggggatctggttcgtgtgctggacaagatccgcaagcgcaagaacaagtttgatgccatcttcatagagaccacgggcctggccgacccagcacccgtcgctcacaccttcttcatggacgatggcatgaaagaggtgcgcttggggctgagtgtatgggcctggaagtcgcctgctgaaggggatcgaagggtatattcttgatacctcctacagatctgttcctccctctggatatggaaccattgccaccccttccagtatggttcacatctcctcaagtacaatagctcgttgacgtgcatagctcatttcgctattctgccattccctcgtcattgccaaacataccaagctcctccctcctcactgcagtcattccgtgtggatgccattgtcaccatggtggactgcaagcacgtgatgctggcaatcaatgacgaccggcccgtgggctgcctgaatgaagcagagcggcagcttgcctttgctgacaagctcatcctgaataaggtcgacctggcaaccaaggaggagaagaaggaggtgctggcatgcatcaaggtgggtgggtgatgggtgcatgattaggcaagtgggctcctggaaattgactggatggagctttgcctcatggatggagatcttgggactattggagcagcacacaggcacgagtcagcctcagacttgtctcaccattgctcatgctcattccacccttctcccaccaccccagggtgtgaaccctggggtggagatcctcgagtgtgagtatgcaaaggtcgatgtggagaaaattttggacgcccgtgcctttgagtttgggaagactctcaccgctgagctggaggtgagctgtcgagccgtgccggtgtcttgccgggaagcggcggggtggtaggggttctgcagtactggtgattgctgttttactgctcgaggtcaagcaagggcttgtgacagcttgacaccctagcactatctcaagtcctccccaatccccccaaattcctgctgggcaggcccgggatgccgctggcagcgggtctgacgaggaggaccacgtgcatgacacgcgcgtctcctcggtgggaatcgtgctggacggtgagctcgacaccgaaaagttccaggagtggctgagnnnnnnnnnnnnnnnnnnnnnnnnnnnnnnnnnnnnnnnnnnnnnnnnnnnnnnnnnnnnnnnnnnnnnnnttcaggagcaagggcatactcgccatgcatggcaccaacgagaagtgagttggctgttcagaggcagcggtttggcgatgcagagtcatgtgcatggggatgctgaggaggccgagccttcctggttttcggtctggaggggagaagcccatcaaggccatctagcatttcccacagattgtataaccctcctccattcccctgtgccgcaggcttgtctttcacggagtgcacagcatcttgcagtttggcagctcgaccgagggcaacgtcaaggcttgggaggtgggtggagagctcatcgtacagtcttggctccatcgttacctgcgcgcagattgccaggatgcaggccagccgccatctgctaaccaaccacctgtcacagtgcaagggcggcccacgaagagtacagtctggctaaccgctgccccaccctaccaaaacataaccccccctgtgcctcatgtaggaaggcgagccccgagtatgccgcgccgtgttcataggcaagaacctggaccgagaggctctggacaagggcttcaggtcctgcttggctgtcgtgaagcccaggagcaaggagcccaagagcaaggagcccgaagcataggcacgccaggagcgcacccagcgcagcagtcaactgctcgagtacagagttcgtgagatggcatcagagcggcatggcgccaccatcatcactattcctcagtgtacattgtcagcgcggcgccttcagacctgctaatgtgcatcccctcgcccaggctagcagaagtggaataaacatttgtggaatggcacgcatgtgtccagtctggtcgggtgcactagcgcaacctgtgggctgcccggtccggggtcaaagtggtgctgcgtgggcaagaaagaagacgtttccccaaaagcactatgaggaggatgcaagcgcacggcgatggtgtgctggggagtaaatgacggggcgccggagcagtacctctacatcgctgcggcccgccacgtcatcgccggtcctcctcagtcagagacaaagcccacgtcaccaagcatccctggcccgcggggagagcaggggctggggcgccgcagccgccagctcctgctgcacctccctgaagaacgcgagcagggcgtcctcgttcagggccgaggacggcgcgccgccccccccctccgccacgcccgctgccttgcccttgccgctcgcccggcgctggaggaaggaggtgccaccgcccggcgcagccggcgcctcgcgcccgccctctggcccgccgggcggcagcgcggccaggcgggtggccagggtgcggaaggcgtcgccctgcggcagcagcatgagcaggctgtgcaccgcgtggaggagggcggggtgctgggcaggggccagcaggcgcaggcgcagccctgcaaaggccggcgactcgagcagggacaccagctggcaggcctccaccatggtctccaggcgcagggccaccgcgggggcggccaggacctccagcatgctgcaggccaggccgtaggcctgacgagggagttgggtgagggcagggcgagggttcagggtcttaagagggcaaagagggcaaagggggcgttgggagttgggagggacagcagtgcttggggcgagggggcggcgacgctatgcatgggatgcctacacgcgccggtccccgcaccacttcctcgcttgcctgggcgaggaaggccagggacaggcaggcggcgcagctgcgggaccaggcgcggagcagggaggagaagacagaggcggcctccgggtcatacagcgcctgggccagcagcgcgcgcactcccgccaggctggggttgaccaggagcagcaggttgagcgcctgtgtggggcgtaggtgtggtgggcggggtgagaggcagtgcggtgggtcagcgtgggtctgaggctttcatctcctcatcttgagatatgttttcccccctgccctgctttcgccccgctggccacgcctttccctccaggcccttctcaccccccaccgccatgtccctcccaagctgcacccctccctttctcgcacttgcatttcctcccccccctcccctcaccccccccaaaaccaacaacctgcaccagcgcggcgccaaaagcggggtccggatcctcagccgccaggctgctgagcttgagcaggacctgcaagccccccaggcgctctgccagggtctgcacaatgagcacgccgcggcgctgcagcagcttggcccccgccggcccgcggaaggcgtcggccacgcccgccagcacgtcgtggctgtgccctgggcgcagtgccacgtcgcccagcaccgccagcgcctgcaccgccacggccgccgagctggcgcccaggctctccaccagcgcgcggaggagggcgggcagcgcaccaaacacctcgtggaaggagcggcggaggagggcggggagccactgcagcgccgcaagcttgaccgcctcggagctggactccagcgcgcccaccgtggaggcgagcagggcgggggtgtcgatggctggcggaggggttggggcccccgggtcgccgtcggcggagggcagggaggggggcggcggcgcgccagccgggctgccggcgctggaggacagcgcggcgtcgccgcccaccgacgcgccgcgcctcctcgtgcgcgtcggagcggccggcgtctcccgccccaccgcctccagcagcagctggttcagcgcacgggcggcctgtggcgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggcactgatccatgaggctccacccccacggcgagagacgaagcaatttcaggacgacccagggccccattcctatccagaccaatgcacgactgcgctgctcaccgccaggatctcggggttggcgctgcccaggctgagcaggaccgcctccagaatgaccgggtactgctggtgcagggggtgctgcgccggcggccgcccgggtgaggccgcgccattggggccggtaccgtcctcagccgccgcagctgcggcgagcgacgcgcgctctcgcagcaggaggccgtgcagccagcgcagagnnnnnnnnnncgaggccgcgccattggggccggtactgtcctcagccgccgcggctgcggcgagcgacgcgcgctcttgcagcaggaggccgtgcagccagcgcagagcggtgagcgaaaccagggtgccgctggaggccgacgcggcgcgcagcggcgcgcccagcagcaggccggcgccgccgctgccggcctgctcgc

SEQ ID NO: 39010 - DNA, 81 bp, Chlorella protothecoides
ccggctgcagctcccaggccgtcgtgcaagttgcaaggcccccgccccacaacacagatccaggcatccaccttctcgagc

SEQ ID NO: 39011 - DNA, 80 bp, Chlorella protothecoides
catgaggagggcactgaatcccgcgggtgagtcgcgctccccgtcaccgcgatgtgatcacccctctcagaccatgccgc

SEQ ID NO: 39012 - DNA, 88 bp, Chlorella protothecoides
gctgcggtgcctggctggctgggcgctcgcggacgccgcgagcggggacgagggcggaatgcgcgtgctggagttcctccaggtgcac

SEQ ID NO: 39013 - DNA, 115 bp, Chlorella protothecoides
caaccggatcaggtcgcgctcctgcattggtggatggtggtggtggtgggggggggggaatatgaggatgaagtggtggtgtcttcgggccacgggggacctgatcaatcccgag

SEQ ID NO: 39014 - DNA, 80 bp, Chlorella protothecoides
acaagagggagctcctccgccatctccagctgaactccaaactggagctcggggtgaagggaaattggccacgccactgc

SEQ ID NO: 39015 - DNA, 80 bp, Chlorella protothecoides
cgacgaaggaagaacagggtccaggggatggttatcactgggaggagtttggttcaggatacgggcgacgggaggtcgag

SEQ ID NO: 39016 - DNA, 69 bp, Chlorella protothecoides
atggcccccgcaaggccggcctcgtctgggtcagcgaattctgcagcacggagggcgccaccctggcgc

SEQ ID NO: 39017 - DNA, 80 bp, Chlorella protothecoides
acgtgacaacagatttgacccttcgttgagacagcgttcagaaccagtctcgagccgctggaggccgtcgcagtgcgccc

SEQ ID NO: 39018 - DNA, 76 bp, Chlorella protothecoides
ccagcgccgcgtggaggcgggggagggcgacaaggtgctggtcgatgaggcctctgcggctgcaaagccagcggat

SEQ ID NO: 39019 - DNA, 61 bp, Chlorella protothecoides
gtcgtgggcatggacagggaccggctgcggtctggggaccgagccaccgtgcgcttccgct

SEQ ID NO: 39020 - DNA, 11133 bp, Chlorella protothecoides
  modified_base (235)..(356): a, c, t, g, unknown or other
  modified_base (439)..(448): a, c, t, g, unknown or other
  modified_base (666)..(675): a, c, t, g, unknown or other
  modified_base (775)..(784): a, c, t, g, unknown or other
  modified_base (847)..(856): a, c, t, g, unknown or other
  modified_base (1453)..(1462): a, c, t, g, unknown or other
  modified_base (1743)..(1752): a, c, t, g, unknown or other
  modified_base (2544)..(2553): a, c, t, g, unknown or other
  modified_base (2926)..(2935): a, c, t, g, unknown or other
  modified_base (3421)..(3430): a, c, t, g, unknown or other
  modified_base (3741)..(3750): a, c, t, g, unknown or other
  modified_base (4147)..(4156): a, c, t, g, unknown or other
  modified_base (4514)..(4523): a, c, t, g, unknown or other
  modified_base (4870)..(4930): a, c, t, g, unknown or other
  modified_base (5168)..(5177): a, c, t, g, unknown or other
  modified_base (5302)..(5311): a, c, t, g, unknown or other
  modified_base (5476)..(5485): a, c, t, g, unknown or other
  modified_base (5569)..(5578): a, c, t, g, unknown or other
  modified_base (6039)..(6048): a, c, t, g, unknown or other
  modified_base (6427)..(6436): a, c, t, g, unknown or other
  modified_base (8317)..(8326): a, c, t, g, unknown or other
  modified_base (8803)..(8812): a, c, t, g, unknown or other
  modified_base (9197)..(9206): a, c, t, g, unknown or other
  modified_base (9371)..(9380): a, c, t, g, unknown or other
  modified_base (9457)..(9466): a, c, t, g, unknown or other
  modified_base (9899)..(10040): a, c, t, g, unknown or other
  modified_base (10205)..(10214): a, c, t, g, unknown or other
  modified_base (10655)..(10664): a, c, t, g, unknown or other
  modified_base (10876)..(10885): a, c, t, g, unknown or other
gcgcgccggcggcgcgcgcgtggccgtggtgggcgacggcgtgaacgacgctgccgcgctggccgccgccgacgttggcgtggccatggcgggcggggtgggcgctgccgccgacgtcgccggcgtcgtcctgctgggggacagccccgcccaggtggtggatgtggtgcgggtgggccgtgccacgctgcgcaagatcaggcagaacctggcctgggccttcggctacaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagagtatattgtgttctttggggcggggggggcggggggccgggcggggaacaaggggtttcagtccctgatggaagcnnnnnnnnnnaaagagagtattttgtgttctttggggcggggggggcgccggggggccgggggtgaacaaggggtttcagtccctgatggaagctcgtcgtggggagtggtggccttggatgccggaagacagggcgccctgaatttctggacgcaatgggattcttcatgatgcctgggagccccgccatcccatgcaaggcactcgtcgcagcgcacgttgctgcnnnnnnnnnngacagggcgccctgggtttctgaacgcaatgggattcttgatggtgccttggagccttgccatcccatacaaggcactcgtcgcagcgcacgttgctgcnnnnnnnnnnctcccagatttctatactctccttggccgattccacacctgcagattggcatccctctggcgnnnnnnnnnncgtcgcgaggcccgcaagggatcgggcatgctccaagctgttccgacagccttgtctggcagcgtgctgcagattgcggcgcagctgctcgccatgccccccacccagtcctcccagtcccagatttctatactctccatgtccgatcccacacctgcagattggcatccctctggcggcgggagccctgctgccactcaccgggctggccctgacaccctccatctccagcgccttcatgggcatcagctcgctagcggtgatgactaattctctgctcctccagccagaggtggagcgcctggcgcggcacggcgcccaagatgccggcagggagaggaccgctgttcccgatgccaaggagctgagcgccagtcagacctcggcctgatgccccgccacagtgcgtggtgggaaggcggaggactggccccctggagctgccaggcttgttccgctttgccggagcaagtgtgaagagaaggtcttcctgctggtgtctcatcctctgatgaattgctacgccgattgtctaattactatgaggtcttcatcgactgctgcgtacatccgggggaagagacaccatgctgtggnnnnnnnnnnactacgccgattgtctaataattatgagggctttcatcgactgctgcgcacatccgggggaagagacaccatgctgtggcgattgaaaggcatcgacagtcatgaagagagctcaaaccctccctggcagccacgtgccataggcacgtctcggcgccagacctgattgaagtgctcggcaaaagctatagcgaactcctcactatcccttcctcgtccgacgtcccctgatctatgccgcattcccaacctccctgggaaccgtggcagagcgcgtggannnnnnnnnncatcccttcctcgtccgacatcccctgatctatgccgcatccccaagctccctgggaaccgtggcagagcgcgtggaggggtcccagatcgcactgacagcactcaacaccgaaacctagcggaggacaattctccatgcgtgaggacgtcgctgtacttcgaagtgttcacatccttaatcttataagttgttcctgaattacccattaaaatcatgctgaggtgcctcgcgttcgcgtggattctcctcggcaccctcaccaatgccaggacgctgatcgagaccctgcggcccgatggaggccctgttgacccccagccccacaccgtgccctacgactggtccgacaccagtaagagtggcgtcatgcgaggcaccatggacatcgacgcctctgatccccggctccagcctgcagaggagggattcccagagcagatcagcctcatgtactatggatccacatccgtgaggtttgggtgggtcacaggtaggctgcaagatgggaagggggcagagggctggggagggatagattatgcaatgggcatgcactgagatgcagtgctgtgtgccgacatcacagcaacacatgtctgggctgggtgttggtgtctgcattgccgatatggatagcgtaaggttggcacgcacaagaacttttccccatctcactttcaaatttacaggaacttcaagcctcagcacaggagcagagtcaaaagagtatcgggcaagcagcgttgtcaagtatggaaagtctagcgggaagtataggcacagagcaatnnnnnnnnnnaagagggctggggagggatagatgatgcaatgggcatgcactgagatgcagttctgtgtgccgacatcacagcaacacatgtatgggctgggtgttggagtctgcattgccgatatggatagcgtaatgttggcacgcacaagaacttttccccacctcactctcaaatttacaggaacttcgagcctcagcacaggagctgagtcaaaagagcatcgggcaagcagcgttgtcaagtatggaaggtctagcgggaagtataggcacagagcaataggtatgtctgacttcagaagatcggcttttaatgttcagcagcaacctctgtatttctttaaaaaatcagatcaaaaccttgtggaacaattcaagnnnnnnnnnngcttcagaagattggcttttaatgttcagcagcaacctctgtgtttttaaaaagctcagatcaaaaccttgtggaacaattcaagccatttattaatgttgctcagctctctgcacagcatacctgtgcacccattgaaaagtcatgtgtcacacacattgccaaatgcaggtgttgtcaagcgatacacgcaggcctacaactatgagggagcgcagaactataccagccctcacatccattcggcaatagccaatggactcgaccctggaactcggtactactaccgagttggaggcgttgggaggaatctctggagcgaggtagtatgagctgctgggttgagagcttggcaatggcacatgcatttgaatgcttgtctaaccatcagggctggtgtgctccatcgcttagcatgcattgaccagttcaaaacatgtctccagctccctgtcctccttccccgcacccaggagtactcatttnnnnnnnnnnctagcatgcattgcccagttcaacacatgtctccagctgcctgttctccttccccgcacccaggagtactcatttgagacgctgccggcaggcaaaagctacccactccggctcggcctcattgctgatactgggcagacctacaactcttccaccacgtatgagcggctgaaggaggatcgtccccaggtacctggatggggccgactacaatgaactccttgaatttgttgagcagattatttgtgcagtaggtgctcaccctgatgcttacttgtcttttcagaggccatctgcgtgcagcgtccatnnnnnnnnnnatccccaggtacctggatggggccaactactatggactccttgaacttgttgagcagattatttatgcagcaggtgctcaccctgatgcttacttgtcgtttcagaggccatctgcgtgcagcgtccatgagctccgcccaggggctcccaatattgagggatctcattccctactccacatccctccccttcccaccaaggtaatcttccatatgggtgacctctcctactctgatgactacctcaccactggaaccctgttcccctgggtcctcaacgtcacgccccctgtgtggacccccccccaaacctaccagcctcgctggtgagtgggcatcgatactggattggcgatgcccgatgctatgtggtttggcaccttctcgtaccctttcnnnnnnnnnnttggtgagtgggcagcgacagtggattggcgatccacaatgccatgtggtttggcaccttctcgtaccctttcctggatcaagctgctgctgggcatgcagcggaacatgctttgtcacctgtactgagcgaccacctggccctgcagggacatgtggggaaggctggtgacacccctcgtctcacacgtgccattcctggccacgcccggcaaccatgagatagaggttcagaccgacggcacaaaattcgcatcgtacacggtgagctggggagcaataccggtcatgacaggcggcatgccgagggtgcttgatgcatgccgtgcgatggtggggttcacggggaggaggaccannnnnnnnnnggaccggtcatgacaggcggcatgccgagtgtgtttgatgcatgccgtccgatggtggggttcacggggaggaggaccactgcattgtgtggcgaagacggtgcaggatgccgctgcttgcaagcccccggcctgcatccagcatgcacccatgccagtctcgtggcatgccactccgatggtgcagacgcgctttccagccaacagcgaggcaagcggcagttcgagccccctctggcactcccacgatgtcggcccggtgcacgtggttttcctgacatcctatgcgccctatgacgagggcacagagcaggtgtgacggggggagggactgaccggtctgcagnnnnnnnnnnnnnnnnnnnnnnnnnnnnnnnnnnnnnnnnnnnnnnnnnnnnnnnnnnnnngcgtcggtcgacagggagaggacaccgtggctcattgcagcattccatgcgccatggtgggaaggacgggggccgtggagttggtcctcatgcatgtttttgacaggggctgtggcggcagtagtctgcgagtcatttgcagactctggctcgtggtgcgataaccctgcttcaagcaccctcctccttttcaccaggtacacgtcatacgccgctcattactacgaggccaactgcnnnnnnnnnncgccgaatgtacgtgcaaggtgtgatggggtcgcttggcaccagtgctttcttgggcgacatgatgactgcagaccgtacgcccgcaccccgtaactcagcatgactggctgaagagggacctgnnnnnnnnnngttggagttggtcctcgtgtatgtttttgaccggggctgtggtggcagtagtctgcaagtcatgtgcagactctggctcgtggtgcgatgaccctgcttcaagcatcctcctccttttcaccaggtacacgtcctacgccgctcattactacgaggccaactgcnnnnnnnnnnaagtcgctgtttgtatcgcggtcggtgaaagtcagggcaggttcagcacgatagtcctcacatggctcaccctgggctcccagnnnnnnnnnncaccggctcgcaaccgaggagttgctgtactcgtatggcgtcgaccttgtgctgaatggtgaggagcaggaggtgtgggccgatctgcatggggggaagaaacgcgtatcacattggacctggcatcgtggcatcgcacgatgggaagatgtaccgagtccctctcggagcgccagggcgcgcgagtcgctgtttgtatcgcggtcgatcgaaagtcagggcagtttcagcacgactgtcctcacatggctcaccctgggctcccaggtcatgtgcatgcctatgagcgatccttcccggtctttgacttcaaggtgagggtgtctggtggtgggtcaccttgcgtgcacccccgcatgggccctggggagtttgcagcgggccgtccagcaggatgcatggcccagctgcctggccgaagaccattctctgcagtgaggcacgcagcagtggggcattcnnnnnnnnnnttgcatggcccggctgcctggccgtagaccattctgtgcagtgaggcacgcagcagtggggcattccatgcagcacccgtgtccccatccctcccttctccagccccacccatcctcccacaccgcctccctggcgatgcagagggacgactgcggccctgtccacctgtccctgggggacggcggcaacatcgaaaagtatgtggcagggctggggagtgaggaggaagggtgctgactcgacatgccgccgttcatgcagacgcatgccacttgttgcgatcattcacactttccttgttggtctgctcaaataacccccactgctccgccgtcagctctttcccgccccaccctccaggctgaatgctgtctttgnnnnnnnnnncaacccccactgctccgccgtcagctcactcccaccccaccctccaggctgaatgctgtctttgctgacacgccaggtcattgcccccccatcttcgaccatggccccagctaccagccggaattttgcccccagaatgtctacaatggcagctactgctccctcatgcagccagcctggtcggccttccggtgaggggccttgccatgtgtgcatgccgggatattgcgtggcaggggtgaaaggtcaatgggcggtggactgctcgtgatgatcctttcctggtcagcgcgggcaccactctcccccgtccctccccacagagagccctcgtttgggcatgcaaccctggacatcctgaacgacacgcacgccctgttccaatggaagcgcaatgccgaccccctgtcgggtgcgggcatggaggttgaggctgcaccgaaagctggcctgatggcgtgctcgatgctgttcttctgcgtgccccagatcagaacagctcacgtgcgtggaagctgcactcgtgcatgttcaaggtccatagctgactcccagcccttcaatcattccatgcagtggtggcagacgaggtcgtcttcaggaggcgtcccgacaagtgcgccatgaggccgcgtgctgggtcgtcggcgggcatcgggttggcccaggcattaccagttggaggaggaggcgccattgcccaggcctgagtgtgcggcgtatgttcagagcaaagccatacttaacacgtgcatcacgtcaagtgtatagatagcctgcccaacgaatcgttgtccgagagaagctgtttagcttccaatgccaagagatcctgtggagattcttccccaatgatcacaggtttgatccaacgagccgaggcgctcggacgctggaaatcgagggtgccgacgcagtacagtctcagcgttcggtgggggtcacctccacatcacagatctccaagaggttagacagaattggtcgtcgagttggagcctccatgttgtaagggctgcgccttaacagataaccttgtacagcaggaatataggatcctctccacgaagctgacgcccgtacatagttccaagagtcgaatcattaccaaggatgcccttatggcacgcagccaaactgaaggtacattatggcgacttcaagcaacccaggcggacgttccgagtctcggaacgtgttgtaatgtgggaatttagcgggccatgatggtgaaagatgcccgggatcttgatcatcctgttcgaatattctacctcagcgaagcagcgatgtgcaggagctgagcccttcaagaaccgtgtctagtcggctgaatcctttgagtgaaattgggttcaaaataaaaacaaattgcatctctgaactccagcacgatgggtcgtgctggtatcatcggcgcggtgctgtgtgccattgtgctgccctttgcggcggcccgctccatgatcgagctgaccacggtagacggtggcccagtcagtctgatcccatctactgttcagtacaattggtctgacacctcgcccagcggcatcgcgagggggactcccgacatccccgcatccgaccctcgcctgcaacctgccccggagggctacccggagcaggtcagcgtcatctactacggccccacttctgttcgtttcggctgggctacaggtgagggcgtcgctgtgcccaatttctgggaagggttccggcatgtggcatagtttagtatggtggggtgcagagtccctgtcgaagggatgcggcacctggccggagcggcctgcggagtgcccacctccacctgatgcagccaaccatgggggtcgcacacaaacatgaatgggtgtggtacatgaccgctccagcgannnnnnnnnncgcggcacttggccggagcggcccgcggagtgccaacctccacctgatgcagccaaccgtgggggtcgcacacaaacataaatgggtgtggtacatgaccgctccagcgatgcatccacatgccctttacacacaggccaagctcagaccggatacggagccctggaggggttccatgacagcaccgggagcaatgtgcagctgggactctcgcccagcgcatacacggacgtactggaaggtgtggagctggtgtgtgcacgtgcacagtgtgcaaagcttgttcagacattgcagtggcgagcaagcttcggccattaggctcgacagcctccaggccctttgtgtgccccctagaattaaaactctcaccagccactgaacctgctgtacagtatgctcgccattgattgccattcccaatctaaatggctattccatcctcactgtctttgcaggaacctcatcccactacgnnnnnnnnnntgccattaggctcgacagcctccaggcgctttgtgtgtgccctagaatcaaaattctcaccagccactgaacctgccgcacagtgtgctcgtcattgattgccattcccaatctaaatgggtatcccatcctcgctgtctttgcaggaacctcatcccactacgaccagatctactacggcttctctaacgcgctcaactacacgagccccaaactgcactctgtgattgtcgaggacctcacccccaacaccacctacttctatcgtgtgggggatcttaagacccagtactggagcgaggtatctatgtgttgcatgtggaaccctgggcaggatcagtgaaaggatctggcagttgattgacccatcctatcgaggcatcannnnnnnnnntctgtggttgtcgaggacctcacccccaacaccagctacttctatcgtgtgggggatcttaagacccagtactggagcgaggtatctatgtgttgcatgtggaaccctggtcaggttcaatgaaaggatctgggagttgattgacccatcctatcgaggcatcannnnnnnnnnggatgtgggccagaccgacaactcgtccgacaccttcaaccacctggcagccagcgagccccaggtgctgcggtttnnnnnnnnnncgcctggcatgcaggagtacaacttcaccacccctccagctgggccaagctaccccctccgatttggtctcgttgctgatgtgggccagacctacaactcgtccgacaccttccaccaccttgcagccagcgagccccaggtgctgcggtttgttcagtgtttccttggggtcagctcgcgggatggtaccaaaaaccatgtgcgcatgagtgggtatgccgaatctgggtacgcatattcaagagctgtatgaattggaaacatcattacactgacagtggtgatgagggttgccacggctcccacattcatgccagccggcaactggtcccagagccaacccgaggcctagggcaagtactcacaccacgctagcttctttacaggtggtcctgttcattggcgacttgtcgtatgctgacaactatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcagttggagtgtgtgagtacacatcctggagatggagtgtacgttgccagagcatggaataggacacgccaattcttgcaatggtcagggcctcgtctagctggttctctttcgacaaaagaatgcttcctattccccacagggacaagtgggctcgcctgnnnnnnnnnnccccgaggcctcgggcaagtactcacaccaagcttgcttccttacaggtggtcctgttcatcggcgacttgtcgtatgctgacaactatgaggccaacgggaccttgtacccctggaacaataacatttcatatcctggagaggacatctggattcccttcgatgttgagtacggaaccttccaaccccgttggtgagccagtgcacttggtgtatgtgagtgctcatcctggagatggagtgtatgttgccagagcatggagtaggacacgccagttcgtgcaatagtcagagcctcgtcgagctggctctcttttgacaaggaaatgcttcccattccccacagggacaagtgggctcgcctggcagagcctgtgacctcgtcaattccattcctgttcggtcctggtaaccacgaaatggagccccagagcaatggannnnnnnnnnggagcctgtgacctcgtccgttccattcttgttcaccgttggaaaccacgaaatggagccccagagcaatggacgcaagtttgtctcttacaatgtgggtgccaaagggaatgctggatgacctggggggatgacggaaaagggggaattgtgagacgctgtgtcctcgacgtgaggggggtgatgtgcgtttgacccccaaggttgggagnnnnnnnnnngtgatggaaaaggggggagtgcgagacgctgtgtcctcgacgtgagggggttgatgtgcgtttgacccccaaggttgggagtgtctcactctcgtcggcatgccgtgctgcactgtgagtatcgagggaagatgaatcctgattttctcgacactgtgggcagctcccctccagagccttgccctatcgctgatggctgaccggtgtatcattttcaaagaccctcacagctcctgtgttccaccccc

SEQ ID NO: 39021 - DNA, 65 bp, Chlorella protothecoides
gcgacactcttgacatggcgtggcaggatggcgcaatggaggagtagggaccgagcagagcagat

SEQ ID NO: 39022 - DNA, 79 bp, Chlorella protothecoides
agcaccctctggatgccccctcccacccatgcaaccttacacgtcccacctcctcaggacattgccacctccgactcca

SEQ ID NO: 39023 - DNA, 67 bp, Chlorella protothecoides
cgcggagtacgatcgcgtgctcgccttccaacgggccacggaggcgctgcaggcagggaagccctgg

SEQ ID NO: 39024 - DNA, 4425 bp, Chlorella protothecoides
  modified_base (600)..(609): a, c, t, g, unknown or other
  modified_base (1210)..(1219): a, c, t, g, unknown or other
  modified_base (1272)..(1281): a, c, t, g, unknown or other
  modified_base (2691)..(2700): a, c, t, g, unknown or other
  modified_base (3346)..(3355): a, c, t, g, unknown or other
  modified_base (3809)..(3864): a, c, t, g, unknown or other
  modified_base (3953)..(3997): a, c, t, g, unknown or other
cccgtgcaacccacccccaccacattcccacgtggccccaccccacattcccacgtggccccaccccacatttccatgcacccactccccatgtacccccagcccactcacaccctgtacccccatccccaacagtcggagcacgagcggtacctgacggaggaggtgtacaaggcgcccatcatcgtgtacgactaccccaaggacatcaaggccttctacatgcgcctgaacgacgacgggcgcaccgtggcggccatggacgtcctggtcccgcgcgtcggcgagctgattgggggcagccagcgcgaggagcggcgcgacgtgctgcagcgcaggatccaggagtccggcatgcccctggagccctacgcgccctacctggacctgcgtacgtacggcaccgtgccccactccggcttcggcctcggcttcgagcgcctcgtcctcttcgccaccgggctggacaacatccgggaggtcatgcccttcccgcgctggccggggcacgccgagttttagggtcggggggagtccgggtgggacccctagggagggaggggggggggacgcaagggccctccgtggatgcctggcggnnnnnnnnnngccgggtgggaccctaggagggggggggttgggggaaacgcaagggccctccgtggatgcctggcggccagcgtcccagcgcatcagcggcgcctgtccaccaccacaacaggcagccggcgtgccatgcagcctgcacctctctgccccccccctctcggcaatgtaattctaggactgcgaatcggcaggctggggaactagggatcggggcgagctgcgacacagcaggggtcttacagactccgcagagggactccaccgggcgcatgtgcgcacgacacgggtccccattcagtgcaacgttgcggccgcctcctgcaggatctcccgggccgccaccttgcccgcgggggtcagcagggagtgcagcatcacgtagatgaagctgcgtgtgagtgagagggcgtcgcgggaggggctgagaagacagcggcacatgcactggcgccaggggtcaaggctgtggaggcatcagaggagccaagcaagacggctgcgctgacccaccacaaggacaccctgcagcacctgtacaggatccaggcgaagaggaagaggtagacgatgagcttggtcaccgcctgctgccggcgcggcnnnnnnnnnntacatgaagtattttattcagtgagcatgcacttgatcacgcggcaatacgcnnnnnnnnnnagtggaggcatcagaggagtcaagcaagacggctgcgcctgcccaccacatggacaccctgcagcacctgtacaagatccaggcgaagaggaagaggtagacgataagcttggtcaccgcctgctgccggcgcggcttcacctggcggtagatctcggtcacatcaatgtactggcggccaaagcgccactgcagggaatgatgcagggagcggagggaggaatgtgaagggcataagaagtattttatccagtagagcatgcacttgatcacgcggcaatacgcagatgaaagttgctgatctcacaggaccagacccccagggctgaaggcgtgccccatcatcccaaccccccaagccaagatccaccgcgcctgctggatgtggaaggccaggatggcgaggggaagcaaggcgctaaaccacttgccattcaagatcagccagatcgccaggaagccctccaggccatactcccacagctggggtggccggagcgagcaggggaagggtgttaagggtatttaatggtagtaataagctagaagtctcaagatcttattttaattcgcgtgcaacagaacaccgattcgtttacaggtaagcacccagctgcaaactctcccagtggtgtgcccctcaccactacgctgttgatggccgaggcggcgtcgtgtggattggtattgtcgttctcaagatccgtgaactggagagtgatgtgcatgttgatggccaacaccgcggcctggatcaagacggccagcagccagacgaggaactcgtaaggcatggcgctgagtccgggactacggcacaagaactgctttggtgtgctcaagggtcgataaccattttatcccagcaaacccaaaccagcgatctgtaatatctcggtggaacaaggcggggcgatgctacacgaatttagagtctagttggacagagcccagatcgaggcggtccactctttccacctgtcctccgttgcctgggattcaaactggggtgcgaccgaaaggcactcgcccgcacaactcctgcgcaaagtgacgtcccgaaggaaaaattcccactgctaggacttcgaagccatgaaacatgacaccgtcgcgtctggcgaggtagctctggtgaaggcacagccaaatacggccaagctgtttgtctaagccctgttcgacactgcgtcggtgagtcacccggccacggtagggccctctgcggcaccttttgtgagcctttagttggtatgctatcctcattgattaacaggcgataccccatcaccgatacacagctagctatcctgccatggtgacgactaggcgaagcagcattgctttccaacccgctgcggcatcgggcggactgctgtccgtggaagagtacgagtcccgtcgagatgnnnnnnnnnntgggccctctgcggcgcgttttgtgagcctttagttggtatgctgtcctcattgatcaacaggcgataccccatcaccgatacacagctagctattctgccatggtgacgaccaggcgaagcagcattgctttccaacccgcggcggcatcgggcggactgctgaccgtggaagagtacgagtcccgtcgagatgtttgcaccgaagaagaagtcggcaggtgcgttccgatgctccgacgcttgaaggggcccgcaggggttgtccgggccgatgccgcagtgaggcagggtgctcgtctatgtctggctagagtggatcctgaaggggggtgctattcttcatcaagtgtaccaggtgtctccaatccatcctcttgccccatgcagactgaaggatagcaaagagttcaaggactgggaggctgatcgccgccgcgcatcccggcacagggcattccgaggcctgcccctcgccggtgccaccctcctcctgctcaccctgtgcgcgctcgcgctgagcgggggaggcctcgatttggatctgctctccagcttgaagccggggagcagcgtccccctgggggacaaggtggcgacggatgcaggcctacaagatgcgcccctaccaatccctgccacacccnnnnnnnnnngtttggatctgctctccagcttgaagcccgggagcagcgtccccctggggaacaaggtggcgaccgatgcaggcctacatgatgcgcccctaccaatccctgccacaccctcgaccgtcccacccactgccagtccgccctctatcgttacccctgtcacgccacccaccgccgcaccatctcaagttgcaaaacgaaccgcggccaacgtcagcgcggtgctgctgcgcaaggtggccctgctggaggaaggggcggtgcgcgcggcggccgggcacgaggccgcgctgcgcgcgctgcgtggcgagctggagcgcgagcggacgctggcggcgcagagggccgacgcgctggccaggctgcagctggccgccgcggtggccagggagaatgtggccgcgcaggacgagatcgctcaggctcggctggcgggcctgcccaacgcgtcctcgcnnnnnnnnnnnnnnnnnnnnnnnnnnnnnnnnnnnnnnnnnnnnnnnnnnnnnnnnggcgccgcggccgcgcgtgccggtgctggcgcggccggcctgatcgccacgccctcgcctgcagaggctgggtcctggccgcccgctgnnnnnnnnnnnnnnnnnnnnnnnnnnnnnnnnnnnnnnnnnnnnnccaagcgtgcgtgccctgcgagaaggttggcgcgcggcaggagggggaggagcacggtgggccaccaggtgcagtgtcgggctggggcgcggccctggccgcgctggcggccgcgctggcggcggggtcgctgggctacggcgcggggcgtgcggccttcgccaccgtggtccacgtcgttgacgacgagggggccggggaggaaggagccgccgccgacgcggtcctgcccccccccgcgcgcgcatcaaacgccccgctcctggaggaggcctcctccctacggtcgcgcctggcctccgcccaggccgagctggcggagctggagcgcgcggcgcggctggccgcctcgggcgcggagactgagcgcgccacgctcctctcccgcgtggcgcagctgcagggggcgctggacgcctggcgctgcg

SEQ ID NO: 39025 - DNA, 61 bp, Chlorella protothecoides
accgtggtccacgtcgttgacgacgagggggccggggaggaaggagccgccgccgacgcgg

SEQ ID NO: 39026 - DNA, 440 bp, Chlorella protothecoides
  modified_base (121)..(361): a, c, t, g, unknown or other
atgcatccctcagccgtctgcggcagcagaggcagagattccctcaggaaacgaatgtcaagtggaagctgggggaagctcgtcctatacgctcccatcagcccatccggccggagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctagcccgctggaccaaccccagggcatcccatgatcgaaatcaacttgctggacgtccctagtcccacctgctgc

SEQ ID NO: 39027 - DNA, 61 bp, Chlorella protothecoides
cggcatcgccctggagctgcgcaagttccctaagaccctggccgtgggcctgcgcgtcgcc

SEQ ID NO: 39028 - DNA, 61 bp, Chlorella protothecoides
tccctccattgcctcttcaacccccccccccccccggcccccccctaacacggcaggagta

SEQ ID NO: 39029 - DNA, 161 bp, Chlorella protothecoides
gttgcacgatctcggccttgccctggcagacaatcgaaataaggggccacagagatgaggtggggagggggatggaaggcacccagtgggctctgtgcatgctgggcaattcacacaggacggaaagaagcggtgggggatgcagggatgccctggcacga

SEQ ID NO: 39030 - DNA, 61 bp, Chlorella protothecoides
gctggagctgttcctgtcggggcgcgagtcgctgtacctggccttcgacgacccgccctcg

SEQ ID NO: 39031 - DNA, 8114 bp, Chlorella protothecoides
  modified_base (737)..(746): a, c, t, g, unknown or other
  modified_base (1180)..(1189): a, c, t, g, unknown or other
  modified_base (1483)..(1492): a, c, t, g, unknown or other
  modified_base (1938)..(1947): a, c, t, g, unknown or other
  modified_base (3182)..(3252): a, c, t, g, unknown or other
  modified_base (3894)..(3903): a, c, t, g, unknown or other
  modified_base (5876)..(5885): a, c, t, g, unknown or other
  modified_base (5955)..(5964): a, c, t, g, unknown or other
  modified_base (6331)..(6340): a, c, t, g, unknown or other
  modified_base (6613)..(6701): a, c, t, g, unknown or other
  modified_base (6986)..(6995): a, c, t, g, unknown or other
  modified_base (7078)..(7087): a, c, t, g, unknown or other
  modified_base (7533)..(7542): a, c, t, g, unknown or other
  modified_base (7779)..(7788): a, c, t, g, unknown or other
tcctacaccttgaggacttgtgccacatctctatatcaaacttctcaccaatctcacctcttctcatctcaggcctcctgggagtttgtgagctgcggctccctcatccaggggaatccggtcctcacatcgtccgatcccaccaacatctggtggcagtccctcaccttctccaactcacgcaagcccctggcagcagtgtccttgaacgggctgcccatgaaccttcagccttgggggccttgggtgtggagcgcccaggtggggaaagactagcagtggattgtgtatgtgggatggaaggaggcccggcttgcagtgctggcaatgccatgcaacagtataaccaccggaattgctcatctgggcatgaggttgctgtacctgtatctcaggtgcatgtgctcagcgctgtgacctcctgaccacatgtgtcctcactgacctgtctgcacatgcacagggccttcccctcaacatcacgagtgcggggcagaatgccctcatcctgcaagccaccgacggagagacactggcctacacgctgtccaacctcgccgagcaggaactggacggccagttctccctcaacgctgtcagcagcccttcaccgagccctagccccagtcctgtccccaccccaacaacgtctaccagtcccagccctagtcccagccccagtccaagcccgagcccaagcccaagtccaagcccagtcgccagcccaagcccggttnnnnnnnnnncagccctagtccgagcccaagtccgagcccaaggccaagtccaagcccaagcccagtcgccagcccaagcccggtttcgagcccaagcccgcgcagcagcccaggcatgagccccagtccagctgcgagcccaagccctgctacaagcccgagcccggtttcgagcccaagcccgcgtagcagcccaggcatgagccccagtccagctgcgagcccaagccccgtcgcaagcccgagccccgtcgcaagcccaagccctgctacaagcccgagccccgccacaagcccgcgcagcagcccaggcacaagcccaagccccgtcgcaagcccaagccccgccacaagcccaagcccagccacgagcccaagtccccgcactagcccagctacaagcccaagcccgacgacgagctcctctcctccctccggggacnnnnnnnnnnaagccctgccacgagcccaagtccccgtactagcccagctacaagccccagcccaacgacgagctcctctcctccctccggggacaaggcgaattacgccaaggtacatgattgtgaggattgctgctcacagagctacagatatctgctctagcctttaccccctggcatcagagcaacttcgctcacaggtggccacaaaagctgttcccttgcaggtcctggagaactcgttcttcttctacgatgcacagcgtagcggacgcctgccagccgacaaccctgtgccctggnnnnnnnnnnacttctacgatgctcagcgcagcgggcgcctgccagccgacaaccctgtgccctggaggggcaactcccaccgtgcgtaactgggattgggtgttggaccaccctggagcgcagagagtgcatcacagcccccaagtgggttcaaggcagcctggctcgcaaggttgtccacatcagcttcatctctcccccctacccgtttcgtctgcagtgaatgaccctgtggtgggcggctactacgatgctggcgactacctgaagctcaagtgagtgcggaggagagcgtggtgaaggcctgggtgcctgatgttgtatgtctgtgtcccggaagtggagggagcgtgcaccccgcaacacgctggtcgtgcgatactgtgccgtattgccccccgccccttgccctgccagctccaacatgatgcctgctccagcctgtcactcccttnnnnnnnnnncaaggcctgggtgcctgatattgtatgtctgtgtcccgggagtggaggagcgtgcaccccgcaacacgctcgtcgtacaatattgtgccgtatcgccccccgccccttgccctgccagctccaaaatgatgcctgctccagcctgtcactcccttggtcactccattccccccacagcttcccactgggcacctccctggccttcctgggctggggcctgctggagttccccgctggctacgacgcggccggcttgaccgcgcgcgccaaggcctcgctgaaatggggcacagactacctggtggcctgccacgtggcggaggaccagtacattggccagatcggcgaccccgggatcgaccacgccttctggggccgggcggaggagcagaccggcgcccgcccggccttcacctggaccagcgccatgccggcctccgacctggcctccagcgccgcctccgcgctcgcggccgcctccctggtcttcgccagcgacaacgccacctattccgcctccctcctctcccacgcccagcgcctgttcgactttggggccaggaatgaggggttgtattcctcgtcctacaccgccgttacctacgtttactccaggtggggcagaatggaacaagggttacctttcacggaatccttggtcttcccagaccctgatgcagccgcattgcttgagcactggggggtggagttgggattccatctcaacaggtcagtttgcaaggtcagcctcctgatcccacatcctccccctcccattccccttcccccacacagcaccacctacctggacgacctggcctttgcggcggggtggctgtaccgcgccaccaagaaccccagctacctcaccgccgcgcagacctacctccagcgcgcgcagtactcccgcaactactacgtcaactgggacggcgtcttccccgccgccgacatgctgctcaagtccctgggcgtggccaactcggcgggcgtggacctcgacacccagctggccaccttccgggccacctggcagcagggccagaacggggtcaccatcacgcccaagggcctctccatcccgccctttggcggatgggggaacctgcgccacgccctcaacgccgcctttgtcaccgccatccacgccaagtacaatgcggggacgcgcgccgccgacctggcctacgccaagcggcagctggactacgcgctggggtccaggtaagaaaggnnnnnnnnnnnnnnnnnnnnnnnnnnnnnnnnnnnnnnnnnnnnnnnnnnnnnnnnnnnnnnnnnnnnnnncgtgcatccagactcctccaccccccttgctcgtctcctcccacccttccccccaaacccccatcgtccccacagcgggcggagcttcgtggtggggtatggcaccaccccgcccacccgcgcccaccaccgcggcgcgtcctgccccaatctgcccgccgcctgcggctgggaccaattcaactccgcggccgccaacccgcaggtgctgtacggcgggctggtgggcggcccggccagcagcgacactgactactccgacgtgcgcagcaactaccagggcaacgaggtggccatcgactacaacgccgggttcacggggaccctggccggcctcatccagctgctgtgagcgcggtgggggtcttccgggacctcgcttccggccgggcgcgccatcgcccgttgagtgagccggcacctctgagcgctgggtcggggcatgtgcccagcagtgcctggcgccaggcacccctgccccctccatgccagtcatccacatacatagtgcgcgctccttttcccatgccccgcccggagtgcccccgctagagatgaaaggcagggtgggcgagctcacacaccagtggccctttgtaacacatcctgccgagccgacctcaggctgcctccaggtttacnnnnnnnnnngtagtgcgcgctccttttcccatgccccggccggagtgcccccgctagagatgaagggcagggtgggtgagctcacaaaccagtggccctttgtaacacatcctgctgagccgacctcaggctgcctccaggtttacacacagtaccgcattccagagggtgcagcacaagctctctcacgcggcgccccgcttgaggcgggaggcggcacgcgggccggatttggaggctgccgccctgccctgcccagcgctgacttcctcgtcctcgtcttcactttcaagtagggtagtcctggatgtgggggaagtatgaggcatatatgagtaagatacttgtgcaaaattgccatgcatagaatccccaagctccgcccaatcacaagacccacctgcttcgcaggctgtgccgcgtgttgcgagagggcgtgtcgctgagggcagaggtctgcatgtagatggagatcgcgatgtccgtcaatagtgcgaaaccgtgttcacatgattcctctccaccttggagctggtaatcaggctggtggcccagaatcttgctggcgcccgggccgcccagccagaaacacgccgcacaaccactctagcacccctgcaacctctcccaaccgactctctcccgcccaccaaacacacctgcggcaccgccgcgcgggtggaccgccggcgtgagggggtgggcgcggccgcgcccccaggcccctcatccgctgctgcgccggatgcgtgcgcgcctcgtcgagggcctgtggagggtggtagaggtgcggtccaggcttggtgctgtgttgcatacatgtttgcctgctgggcactgcgacgccatctggctcccagccacggaactccatgaccctgacatgtaaaccctttccttcagtctccagcatcaccaccacagcccctatgatccctgatgcagagagatggaggtccctcgatcctcaacagccagaaagcatgctcccccgccaaactcacgtggcacgccgctgctcctccgccccctgctgctgctctccacctcgtcgtcggcgccatcctttccctctccgcgcagcatgctcgtcagcagcgtggacagggacgccgaggccgccgccacgaggcccgaggcttggggtgagtcctcgccggcgtcctttcttggtagtgatgcgcttggcgaggggccggccatcagcggggcctcggcgaagtccagctccgagacgcgcatctgcacccggcggcgggtgagggcggaggtgtacagcagcgtgccgaccagcagggccaacaggctgagccccgccagcagcggcgcggcccaggcctgcgccattgcagtccagtccaggggcggtaaggtgaggtgggtgcccagccactccttgaaggagcgcaacttatcccccactgtctcctcgccctcctcgccaccactcagagcttctacttgctcgtactcagcctgctctggctcgctcccagggtgctccgaattgttctgatcatcagacggtgacgggtcgccagagggggtgtcctcctctgtcttcgcaccagcatcctcgcagtgatccccgtcctccagcgaagcatcttcagggtctccctcctcagcctccttggccacctccagatcctcgccgctggctgcagcagggtgagcgtcctcctcctcagcgctcgccaggggctcctcactgtcatcttcgggggcatctgtacctgcagctgcaccaacgtccccggtgtcctctccctagggcacagggtggcaggacgcgagtggacatattgcacatgaaaccatggcccgtccatcgttgctgtctcacagtgatgcgggaacaggtgggcaggcattccactcaaaatcacagcaatgcgtctcatcagtctcgaccttcgcgcagaggtcatcggcaccagttgaggttcccgagcccgacccaactgcactcacatcagcannnnnnnnnnggggcacagggtggcaggacgtgagtggacaaattgcaaatgaaaccatggcccgtccatcgttgctgtnnnnnnnnnncgtcattggcaccagttgggattcctgagcccgacccaactgcactcacatcagcaggctgccgcccagtggccccctcctcctcccgctctgcctctggggcctgctccacagcctcctcctcctcaacacccatagggttgacctgttcggctggggaagccacattgtcgtcagggtcggcagtcgacggctgcgtcgccgtgcttggatccagcggctccacggagcgtgtggcgttcggcgcagggtcccccttggcgggggcaggcgcgctggcattgagtctgaccacgggaggtagcatgtcattgcgctgcgccgccacgctagcactggaggtgacagccgacgttgggctctcctnnnnnnnnnnaagcctcctcctccccaacccccacagggttgacctgttgggctggggaagccacattttcgacagggtcggcagtcgacggccgcgtcaccgtgcttggatccatcggctcgacggagcgtgtggcattcggcgcagggtctcccttggcgggggcaggcgcgctggcattgagtctgaccacgggaggtagcatatcattgcgctgcgccgccacgctagcgttggaggtgacagccgatgttgggctctccttggctggcgtgggtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgcagggggcagcgtagacttgttagaagctgccacactggcgttggaggtgacagccgacgttgggctctccttggctggcgtgggtacagcagtgttcaagctactcgcagggggcagcgtagtcttgttagaagctgccacaccggcgttcgaggtgacggtggtaggaggcggagttgtcgcgttcggagcagctaaactggcgttgggggtgatctccagcgacagactctccttggacggggcaggcacagccttggccggcgtgtccactttggannnnnnnnnncactggcattgggggtgatctccagtgacagagtctcctcggacggggccgacacagccttggccggcgtgtccactttggannnnnnnnnnggcgcggtgctcgcagcgcggccagcactgcagcgctgggcgctcgagcggccgcgggccgccgcgcggctcgtggcgagctgcgtgcgctgggcgcgctgcgtgctggaggacagagagcgggcctgcggccaggaggcctttggcgcatacctgcggggcgcaaagggcgccgcggagccgaggaaaccccggaacgatggcactttaggagcaggtgagcgtgtgccgccgagccagagcagcggggcaaccgatgctgccgccaagccggagaggcccgtgggcaccgaggccgcccggggggctgagagcaagagcgaggcgacgcccaaggcggaggctgcagccgtcgaagacccaccagcgtcaggggtgtcaggtgacgctggggccgggtgctgctgtgatggtcttgggctcatgtccctggtgagaggccccannnnnnnnnnagggacttccatggctgcaattggcagactcttgttggctgcgcctacgacaggagaagactctgcggctgggggtttggcaagcgcctcgtgggttgcagcaggtattttctccaggctcggcccatcactgggaggttttgtacccgctgctgcagccgccttgctgggcggatctgcttcgctgggctgggcaagaacggccgcctcggtctcaggctcggcaggcgtctcctnnnnnnnnnnccgcccaaggcggaggctgcagtcgtcgaagaccgaccagcgtcaggggtgtcaggtgacactggggccgggtgctgctgtgatggtgttgggctcatgtccctggtgagaggccccaggagagattatcgtcgttggtttacccaagtcggtctagtgctcacgtgcttgcactcacctgccaacacctcgctccacaggcggtgctgcatcctcggagggcacgcagcccctgcctcacaaggagacgcctgccgagcctgagaccgaggtggccggtcgtgcccagcccagcaaagcagatccgcccagcaaggcggctgcag

SEQ ID NO: 39032 - DNA, 61 bp, Chlorella protothecoides
catcgaagccctggccctggcgtcataaacacccccaccgtccatccagcaagccagccag

SEQ ID NO: 39033 - DNA, 264 bp, Chlorella protothecoides
ggggggttgaaccgttgaagggatgggtggccccgggctctggggtggatacacacgtttggaatgggtgcggcaagaccctgtggccacggtgctccaagcgatgcagtggggtgcgctggtcgtggtcctgtgcaagcaccagcctggtgcacacgcgtgctcggcccgcctcagctcgtctgcgtcctgcaagcacgcacgccacatgctctctttccacccccccccttcccactcttcctgcagctgagcctggaggag

SEQ ID NO: 39034 - DNA, 61 bp, Chlorella protothecoides
tatggcattggcatcggccatgtttggggtcgtgagtgctcgcgtgggcatgggccagtgc

SEQ ID NO: 39035 - DNA, 92 bp, Chlorella protothecoides
tggatgactctggcgatggcgccgcaggtccctccagcggcgccccagagcgcactcggcggcagttctcatcaccaaattcctcatgtcag

SEQ ID NO: 39036 - DNA, 61 bp, Chlorella protothecoides
gcgaaaccaatccgcggcatttagtagcgggaaagttagaccaaaccatgaaaccaacata

SEQ ID NO: 39037 - DNA, 61 bp, Chlorella protothecoides
agacaggtcctccatcctggacgccatcctgtactgacatgctttgtggtgcctctgtgct

SEQ ID NO: 39038 - DNA, 79 bp, Chlorella protothecoides
caggcgcctcgccgtctccctgcagcccagcgacattgcgatggagtggtatcccctggaaccctcacctgtacatggc

SEQ ID NO: 39039 - DNA, 75 bp, Chlorella protothecoides
ccggaccgggcatccgtcttctggacggcgaggggcgtggagatgccctgccggttggcccccaggccttcgccc

SEQ ID NO: 39040 - DNA, 61 bp, Chlorella protothecoides
gggctgattccaggaatccggcatggcggggacagtgcgagccagactttggggatgctgc

SEQ ID NO: 39041 - DNA, 78 bp, Chlorella protothecoides
cgactccccaccccatccctgtccgccgccaaccctcagtggcgcgccgctgtgacgccgggcccccacccatccact

SEQ ID NO: 39042 - DNA, 61 bp, Chlorella protothecoides
aaagaggacgtcggtgtggagggtgcgctcgtgcgcctcatccaccatcatgcagctgcag

SEQ ID NO: 39043 - DNA, 62 bp, Chlorella protothecoides
gcaggcatgcctgcccttgcttggcctttttgtgagagagcgacacaggactttcaaggtgt

SEQ ID NO: 39044 - DNA, 146 bp, Chlorella protothecoides
gacccgctgtggtctccgccttgtccagctgcgtacaatgaaggtggaaggttggggtccagtcagcatcatggataccaggcgcaggttgttctgcatcccgtctgggccccaacgggcagcatgcctcgagaatcctctccaac

SEQ ID NO: 39045 - DNA, 145 bp, Chlorella protothecoides
agagaacgcgcgtctccaggtatatggatgcgtcatggctgtctctcaggcattctgcaactccaccagtgtccattcactcttgtccacctgacgcacgcctcatcgtctcttaagcccaccaccgccgcttcccccacttgcc

SEQ ID NO: 39046 - DNA, 171 bp, Chlorella protothecoides
gcccgcaggctgatgcggcaccctgtctctgaacttggtttctgggtgcccggcgccgcatgcttgcgcctctacctgtcctgagcctccctcccttttctcacaccaactcctcgacgcacgtcctgcacactcccgcgtccccccctcagatcctcatattcgtgaaca

SEQ ID NO: 39047 - DNA, 72 bp, Chlorella protothecoides
aatgcggcccgtgcacagagcatgtacaagtataatgaagcgaggtaggctcatgataggagcagccacgat

SEQ ID NO: 39048 - DNA, 80 bp, Chlorella protothecoides
gttcctgcaccaagcgtgtcaccacaaccctcgttctgtgcacatccctcgcagccggcaaccccgctcagctcatgagc

SEQ ID NO: 39049 - DNA, 61 bp, Chlorella protothecoides
acgctgcggcgaccagccaaactccttgtcgggtgtctccttggtgtccttgaagggctgt

SEQ ID NO: 39050 - DNA, 61 bp, Chlorella protothecoides
gtccggcttgtcctggatcatcagcgccataaggtcgccgtacaggccggggtcaaagtcg

SEQ ID NO: 39051 - DNA, 125 bp, Chlorella protothecoides
gcacagcgctgcggctcctgtgtgggccgcactgcaagaggtggagccaagggcaaccggcaatgccgccaattgaagtggtgctgccagaacacgccaagcttgcctgatccttggaggtgccc

SEQ ID NO: 39052 - DNA, 61 bp, Chlorella protothecoides
ctcccacccgctggggggaggtaaggagggcggctcggcctacatccaggcggtgtacgcg

SEQ ID NO: 39053 - DNA, 428 bp, Chlorella protothecoides
  modified_base (107)..(337): a, c, t, g, unknown or other
caatacacgtacaagcatccgtaagctgttacccctcccacgcacctgcttcctgaggccctgaccgatatggggaatgcacaaggttttaaaccaccaacacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccagctcggcctaaaaattacatacgctggtcacaggccttctcagcatggtacactgtctgtcgggggctgggcgcgcgcgtcaggc

SEQ ID NO: 39054 - DNA, 113 bp, Chlorella protothecoides
gccgcattagctgtgccatgcagccgggccatttaaggtaggattacatacatggaccaattattatcggtctggactgtgttatgactgcgtatgcattctaggtctcctgt

SEQ ID NO: 39055 - DNA, 61 bp, Chlorella protothecoides
tggccgcctcggtgtgctgggcgcctggtcgtgcgtcgtctccttgtcctcagccagcccc

SEQ ID NO: 39056 - DNA, 116 bp, Chlorella protothecoides
aacacaaatcttccttggcccatcccatcccccccgctcgcctacctcaccccctctcaaccctcagctcccccccaaacaacaacttacccgtggggaagtctggcgcggggatg

SEQ ID NO: 39057 - DNA, 76 bp, Chlorella protothecoides
acaacacccaccacccccgccaccccttcatacacacactcaaaattaggtgctggcgttggagttgctgaagatc

SEQ ID NO: 39058 - DNA, 6495 bp, Chlorella protothecoides
  modified_base (654)..(703): a, c, t, g, unknown or other
  modified_base (1768)..(1777): a, c, t, g, unknown or other
  modified_base (1850)..(1859): a, c, t, g, unknown or other
  modified_base (2022)..(2072): a, c, t, g, unknown or other
  modified_base (2411)..(2420): a, c, t, g, unknown or other
  modified_base (2982)..(2991): a, c, t, g, unknown or other
  modified_base (3517)..(3526): a, c, t, g, unknown or other
  modified_base (3805)..(3814): a, c, t, g, unknown or other
  modified_base (4551)..(4671): a, c, t, g, unknown or other
  modified_base (5146)..(5155): a, c, t, g, unknown or other
ggttctcgaggcaggttccgtaagtggggctggtgctcacccaccgcttggggctggcaccctcatggtcgtccctggcaccctgcgcaggccgcaccctcccctccgtggcctgcatcgtccagccaggcagccagggcgggtaggctctggccagcagttttcttttatggctttgggcgggggagccctgcaagcaagaccgtccggcatgcttgtggcaggatcttggcgctacattgggcgtcccaggctggaaacagccagtcagtataggagtgccgtggcatggacccagcgtacccacctgtgcctctccaccggccttcaccctcccacccaggttccaaaaggtgtttttcggcgcagaggaggttgccatcccgcagtatggctccacggcggaggccgcaaaggcccatcccaaggccgacgttttcatcaacatggcttccttccgcaggtattggggtccaggaaggcggggggaaggagtggggtgctcaggcacggtgagcgttgaccggaccccaggcgccagcaacggcacattgatgtgcatggggttctttcaatgataccatgcctcccaccgcctgcgtggctcctgatttcccactcgccagtccctcctttgccccccccccccccccnnnnnnnnnnnnnnnnnnnnnnnnnnnnnnnnnnnnnnnnnnnnnnnnnnagcaaaccagcatctcacctccccccttcccaccacacccaaccagcgcgtacgagtcgacgctggaggcgctgcagctgcccaccatccgcacggtggcggtgatcgcggagggcgtgcccgagcgcgacacgaagcacctgattgccgtcgcgcggcgcgggaacaaggtggtgctgggcccggccacggtgggcggcgtgcaggcgggtgccttcaagatcgccgacgcggcgggcaccctggacaacatcctggcctgccgcctgtaccgcccggggtgcgtcggcttcgtgtccaagtccgggggaatgagcaacgagctgtacaacgtcatcgcgcgcgccgccgacggcgtgtacgagggcgtggccatcggcggcgacgccttcccggggtcgaccctctccgaccactgcctgcgctaccagaacatcccgggcgtggccatgatcgtggtgctgggcgagatcgggggccgggacgagtactcgctggtcgaggcgctggcctccggcgccatcaccaagcccgtggtggcctgggtgtcggggacctgcgcgaccctcttcgccactgaggtccagttcgggcacgcgggcgcaaagtccggcggcgacgacgagtcggcgcaggccaagaacgccgcgctggcggccgccggcgcggtcgtcccggcctcctttgaggacctggaggccaccatcgcgcgcgtgtacagggggctggtggacgccgggcgcgtgacgccggcgcgggacgacccaccgccggccgtgccagaggacctggccgccgccaagcgcgcggggcgcgtgcgcgtccccacccacgtggtcagctccatctgcgacgaccgcggggaggagcccacctacaacggcgtctctatgtcggagctcatgcagggcgacgccaccgtggccgacgccattgggtgcgggggctggtggtgggtgggtgtgggtgtgcacatggggggcgaatgcatgttgctctcgaggcgcctacctgccgacatggcaccgtaccttgcatggggggcggcgaccctgctccagtctnnnnnnnnnntcccttggatacacacacacacacacacacactcactcttctcaggctgctgtggttcaagcgtcgcctgccnnnnnnnnnngggggggcgaatgcatgctgccctcgaggcgcctacctgccggcatggcaccgtaccgggcatggggggcggcgaccctgctccagtctccgcagcctcctcagcaccatgcctgccctctgagcacctcatacgccaatactccaccccccataccccccannnnnnnnnnnnnnnnnnnnnnnnnnnnnnnnnnnnnnnnnnnnnnnnnnncgggtacgccaccaagttcatcgagatgtgcgtggtgctctgcgccgaccacggcccctgtgtgtcgggggcacacaacaccatcgtgacggcacgtgcggggaaggacctcatctcctccctcgtctcgggcctgctcaccatcgggccgcggttcgggggtgccatcgacggcgccgcacagtacttcaaggaggccgtggacgaggtgagggctgtgagggagagggggttggttgggagggtcggcctgcctatgaacaggccgggaaagagcctcattgctccaggtacatttccttgacgtcgtgcatgacactgcgattgggctggggatgnnnnnnnnnngtaggccggggaagaggctcattgctccaggtacattttcgtgactttgtgcatgacactgcgattgggctggggatgatggaccccgtgatagtctgctgcccctacatccaatgaccaacaccccacccacctccctcatgccctgacccaccacatcaatgcagggctgggagccggacgagtttgtggagaagatgaagaggcgggggatcagggtgcctggcatcgggcacaggatcaagagcaaggacaaccgcgacaagcgggtggagctgctgcagaggtggggcgtggggctcggcatgatctgggtcctgggcatggcgggcaggcctaggtctacagaagcccatgatctctgggttggacagatgctgagattgtgtgggggtgcttgggatgaaatagttgcatgtttgtctcccagcggtccatcccactctggcccggcgacgtaatgtgcggctcaggagcgcccctcctcacccaacgccccccatccgattccatgcctgtgccaggtacgcccgcacccacttcccctccacccggtacctgnnnnnnnnnnataatgtgcggcgcaggagcgcccttcctcacccaacgccccccatccgatctcatgcctgtgccaggtacgcacgcacccacttcccctccacccggtacctggactatgctgtcgaggtggaggggtataccctgcaaaaggtggggaggaaagcagggccgggccggtgtgccaggccaggcacactgcttcgtcttggctggtcatcttttctccagaaaggcaatctgggcacatcctggtgaccctcggcacgcactgccccacctagcacatcccctgccggtggtgggtcagcttcaggaccctcactgccattcccaccgcctcaccgcaggccgccaacctcgtcctgaacgtcgatggctgcattggtgcgctcttcctcgacctgctcaactctggcgagtccatggggtggaaaggcggggtggaggactgggatgggctgagggcacgaaaccccaccagattctccgttggtgtcatgatgatgccagtccgggcgcgacgccctgtgagnnnnnnnnnngggggtggaggaatgggatgggctgagggcgcgaaaccccaccagagtctccagtggtgtcatgaggatgccagtccgggcgcgacgccctgtgaggtccacttggtttgtcgctttgcgtctcctccggtgccaatgtgcaaggattcacactgagcaacctcacaggcactctccctccacgacagtcatgcatccccgcccacacccgttgacccaacctctctgccatcacctaatcagaccaccacacctcccctgaccccacagtcggtatgnnnnnnnnnnatcatgcatccccgccacacccgtcgacccaacctccctgccatcacctaatcagaccagcacacctcccctgaccccacagtcggtatgttcaccaaggtggaaatcgacagcattgtgaagattgggtacctgaatggcctgtttgtgctggccaggaccattggtctgatcgggcactgcctcgatcagaagcggctgggccagcctctgtaccgccacccctgggacgatgtcctctacaccaagtaggacagtttttcggtgctgcacgcagcactcgtggcagccaccctgggcacttccaagcaggagcctcgcgctgctccgcttgagcaaccgcgcacacagcagttcacactcgctgctgccagtgactgttccctcatcatggcatatcacacttggatctgtagcatttagatggaaaagcagatgtggacccagggatcaggtcagtgcatgtaggacgctcgacaggcaaaagaaaaaccaaatgtgtcaccatccttgaatcctggaatggcgctgggggaaagagtgagaggggggacaggaggagatgccagaaggggcatgcgcgcatctctgcaagggatgtagacgttcaaaatcggacagtggcgtgtgtgctgtgatcatggtggacatccgaagcaggtgggcatgtgcaccaccggctgccaccccagggaaggggggttgagggtagattctcggtggcaatgcagcgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcataagggatggacgcttggtttcagtgcggagtgcacacagcaaggaaaggggagaggggcgcggaacgtcatcacccctcccaaatgtacggctcgctggatttggagaaaagatcctcgtatcgcttggaaagtggtgctggtgcatgcttctccgctcgatgctcctcctctcagacaggtgtggtgggaatcgcagggcttgttttcccacctaggcgctgtggttgagcaccttgaccaaggagagcgcgcgggcgcgcaggcgggggtcgagcgtggcgtggccaaagtgcagcaggcgggcggcggcgtgcatcgagtccagggcctgcatgactcgccctgagctggccatgcagctcagcacggtcagcacggctggaaaggcgggggaagggggggattgttgatgaagggaagggttgacagtggtgggtggagtgggaagtgtgttccaaaccctgggnnnnnnnnnngattgttgattaagggaagggttgacagtggcggttggagtgggaagtgtgttccaaaccctgggatacagcaagcattgatgcaggagacattccagacactggcctcaaaaatgttcagaatcagccgatctcaaactatccaagcagctcacaagacggccctgtccaggaatcgctctcccacacccgccagctcaccttgtttccgggctgctgccacttcaggccggggcaggcaggtgagcatgcgggtcagcgtgccctccagatgggccaggggcaggatgctctcgtcaaacacacctgggtttggtgggaaaggggaagaggtggaggtgattgacatggctttcccacctggatgcatagaggccccctgcagcaacccaggcaggaccacatcatggcgaacccctgggaaaggggaacacgcccttcacgttgttgcacacgacgtttatgcactctggcaacggcatggccatggaggctctatccacggtcccggcagggctcctgtgcggcttccccacctgccaggagcgaccccaggctgaactgcgccgagtctggcagaatcaccgcgccattgaacagcacgcccaccgtgctccccagcgactctgtgtgatgcgtagggggctcagtcatggaccgacagcgtgcggcgcggtgccggctgcggcgagtggtgctctgcgtcgccgggcatgggctggtcggccggccgcgtgggacaccctggagtgcttgcctccctgatcaaacacacaggcgctgtatttcccccctcccccccgctcccccccatccccctctgcccctcacccgtgacctcctcgacactgaaggtggcgcgctggtcagagtagaaggaggcgtgcaggaggtgcaccacctgcatggcggcctggggggaggcggtgtcgtccagcacccgccccagccccagcacgtcctgcatggtgaagcccagtggcgtgtgcggcgcatccagctcccacaggaggcccacagcggcttcgcgcacgcccagcgccgccccccgcgcgtgcagcaggcggaagaggggcgccgcgccgccgcaggccaggaccacgccgcggttgggcgcgttggacaccatgagccgcagcgtgcccagcgcggcgggcagcgccgggtcggtagggtccaggccgcggatgtaggccagcagtggcgcgatggaccccgactgccccgcctgggagcccaggggggaggtgggggaggcgggaggcttgtcgcacgcgggcggcgcgcggggtgaggaaggtgcggcgggcgacggggccaggcgtgcggccgccgcgccg

SEQ ID NO: 39059 - DNA, 2108 bp, Chlorella protothecoides
  modified_base (543)..(552): a, c, t, g, unknown or other
  modified_base (995)..(1004): a, c, t, g, unknown or other
  modified_base (1787)..(1796): a, c, t, g, unknown or other
gcgacggccacgccgggcagcacccgcgtctcctccgccgcgcggctgagcccggcggccatggcccggcgcgccacgcccgcgcgctcgcacatgcgcccgatcacgatgtcggcgaggacggagccggagtcggtgacggccccggcgccagccggggcgggggggtagtagaacttgaggcgctcacggcgcacggccgcctgcagcgccgccacgcgccccggcgccaggccgcgcaggaaggccagggcggcggccagattgggcacgtgctccaccaggcccgccaccgacgggtccagggtccacacgctgcccacctgcatgtttgtgtggggggagacgaggtgagggcctgaacaggtggagggtgggtggagcgtgagcttgctgtgagtgacacaccgacacaggggctgcggcagagggatgcgcagcagtgtcgcggttccagcgagccgtggaattgccggccctctcccccccccgccccgcgcattccccgggcgctccagccgtccaccctctggaaaactcccnnnnnnnnnnaggtggagggtgggtggagcgtgagcgtgctgtgagtgacacacccacacaggggctgcggcagagggacgcgcagcgtcgtcgcggttccagcgagccgtggaatcgccggccctttcttccccctcgcctcgcgcactcccggggcactccagccgtccaccctctggaaaactcccctttccgcggcaggcagcaccaccaccatgcctcaccatggcgttctgggaccagcgcggggaggtggcatccacccaggggctgctgtcgtcgatgtggatgaagagcgccatgcccgcatagtccacctccgccgccagcggcatggtgtggaagggcgggccgacgaacacctgcccgggatgtggtggggtagcagggtgttggagggtgggttctgttgcagcgcatagagaggcgggcaccatgaaaccctgcacgtnnnnnnnnnnaacctgcccgggatgtggtggggtagcaggcgtcggagggtgggttctgttgcagcgcatggagaggcgggcaccatgaaaccctgcacgtgtctccaggctggtgagcgtccagcctggggatccctgtcaccccaagggcatggcaagcatggcacacaacctccccgccaggcggacggtctcccaggcccacgctccgaccctggtcctgaccccccctcccgcgtccgggcgctgcctgcccatgcacgaccaccctcccactccatcatcaccctttcccctgcccgatgcgcaaggccgcgacggtcccaagccctgcccaccggcatgctttggcaccactggtcgccgaacgccagccgacgccgtgcatccctccgcccatcctcttcccctgccgaccaaaacaacacccatcccctcgacccaccgggatgcagccggagaggacggcctccgacaggcgccggctggactgggcgttggaggcgatgatggggcagaagacggcgcggcgcatggccgccaggacgtccgcgtgcgggaggtgcccctcgcagatgtcgcaggcgcagcgcgcgtgcacgtcggccggggccggcgccccccccggccccggcgagcccagggcctgcaccagctcccagcgcagcatcttgcccgcgccgaagaggccgcgcacctccggcgcggggttgccgcacccgccctggaagaagaggtgcaggtcacggcgcgcgtccggtgcagcccccaggtccaggtcggtgctggcgnnnnnnnnnnaaggccgcgcacctccggcgcggggttgccacacccgccctggaagaagaggtgcaggtcgcggcgcgcgtccgcggcagcccccaggtccaggtcggtgctggcgacgtagggcaggatgagcgcattgcgtgccggcgcgccgcgcgtccacacgcacaggttggcggcctcggggacgaggtgcaggacgctggccagctcctcgcacacgtcgtcgtcggggaagaagcgctggagggcgggggtgggggaggccagcgcgaaggccgcgcccttggtcacacggaacctgccagggaggtgtgttgg

SEQ ID NO: 39060 - DNA, 65 bp, Chlorella protothecoides
aggtacatgtgctccatggcgtcatggacccagggatgaaatcagataatcgaggagggagctca

SEQ ID NO: 39061 - DNA, 178 bp, Chlorella protothecoides
caagcgtgccctggcctgctcaatctgcctgccagtatactggcaatcgccggcatggcttgctcatctgcattccgtcgtcccccccatcttgccactgctgacgctgagaagtcgccatctaacctgccatacatttgcacacggtgcgcatacatgtggaggactgcacgccttg

SEQ ID NO: 39062 - DNA, 73 bp, Chlorella protothecoides
tcatgtcagctctcgactttccccacatcccaatagccgcgtggcgatttcggcctcgcgcatcttttcgtga

SEQ ID NO: 39063 - DNA, 97 bp, Chlorella protothecoides
gccctgccagccgcatgcagtcagggccagggtggacatggccttgccagcggtaatcgtgtaggcaatgtcgatcaggaagatgttcaccagctgg

SEQ ID NO: 39064 - DNA, 80 bp, Chlorella protothecoides
agcgatttgagctggctggtcacgaccctcttctcatcaccaggctggatgaagcactgggtgccagcatccatcgagcc

SEQ ID NO: 39065 - DNA, 61 bp, Chlorella protothecoides
gcatacaatgacatgttggaatggcagggggttattataaggtgggcatggacttgttgat

SEQ ID NO: 39066 - DNA, 534 bp, Chlorella protothecoides
  modified_base (237)..(384): a, c, t, g, unknown or other
ggtgctgacgtggcgcaccaggcgggccacggcggggagtagcgcctggcggtgtaacgtttttaaacaaattgtgtgagggggattatcagtgggggtgagagtgggtgtaaagggaccactcgctccgcggtgcgagctcttgtgaccatgtcacatgagacgcccgcgccctcaggtgtcccaccccccaggccccccgtctcacaccctgcacctgaaactcttcgaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtgatgcggtcgacaaaatcaaggcctgtcttggtgcgcaatgcaaaggccaggtcaggatgtcacaccataaaacctgtcgaactccctccacaatagctctcaccgcttattccttgagccagcgcggcgcggtagaggctggag

SEQ ID NO: 39067 - DNA, 61 bp, Chlorella protothecoides
acagggcactggatcgccagagccggtgatctagcagaacctcgcaccggcagtgtggaag

SEQ ID NO: 39068 - DNA, 61 bp, Chlorella protothecoides
ctgcctgatcacgcccattcctcccacaaccggactcgtatgggacgcggcaaaggcatcc

SEQ ID NO: 39069 - DNA, 28091 bp, Chlorella protothecoides
  modified_base (500)..(509): a, c, t, g, unknown or other
  modified_base (1346)..(1409): a, c, t, g, unknown or other
  modified_base (1969)..(1978): a, c, t, g, unknown or other
  modified_base (2554)..(2563): a, c, t, g, unknown or other
  modified_base (3160)..(3169): a, c, t, g, unknown or other
  modified_base (3892)..(3901): a, c, t, g, unknown or other
  modified_base (8672)..(8716): a, c, t, g, unknown or other
  modified_base (9280)..(9289): a, c, t, g, unknown or other
  modified_base (10056)..(10121): a, c, t, g, unknown or other
  modified_base (10493)..(10526): a, c, t, g, unknown or other
  modified_base (10590)..(10599): a, c, t, g, unknown or other
  modified_base (10963)..(10972): a, c, t, g, unknown or other
  modified_base (11905)..(11914): a, c, t, g, unknown or other
  modified_base (12343)..(12352): a, c, t, g, unknown or other
  modified_base (12642)..(12651): a, c, t, g, unknown or other
  modified_base (13875)..(13884): a, c, t, g, unknown or other
  modified_base (14677)..(14686): a, c, t, g, unknown or other
  modified_base (16340)..(16349): a, c, t, g, unknown or other
  modified_base (18259)..(18268): a, c, t, g, unknown or other
  modified_base (18354)..(18363): a, c, t, g, unknown or other
  modified_base (19426)..(19435): a, c, t, g, unknown or other
  modified_base (21453)..(21462): a, c, t, g, unknown or other
  modified_base (22037)..(22046): a, c, t, g, unknown or other
  modified_base (22812)..(22821): a, c, t, g, unknown or other
  modified_base (23413)..(23422): a, c, t, g, unknown or other
  modified_base (25633)..(25642): a, c, t, g, unknown or other
  modified_base (26240)..(26249): a, c, t, g, unknown or other
  modified_base (26439)..(26448): a, c, t, g, unknown or other
  modified_base (26750)..(26759): a, c, t, g, unknown or other
  modified_base (26816)..(26825): a, c, t, g, unknown or other
  modified_base (27500)..(27509): a, c, t, g, unknown or other
ggcggagtgggggtcgctgcgcgcgccgcgcacgctgcgcacgctgcgcgctgccgacttgacgtgggaggggcccgagcgtcgctccgacggcgcgcagggtctgatggtcgcgccggcgcgggcgccggcggccgtcggcgagggcgtggcggaggcgaggcgctgcgaaggcgaggcagaggccagtcgctccaggggtgaggcgaaggcggctcgctccgagagtgcgaccttcctgcgtgcctgggacttggcgggggccgacggctgtgtgcggggggccggtggcgactcctccactgcgagaaggggatggttggggaggctgcctcacagggagcaagccaatcctcccggctgcaggcccatggaagcactggcgctctgtgtcaatgcatgtccgatgctggacgaagaaggcccacagcgggcagcatcaagaagcacgaacaaaaagcatgttttagcacaagtctggcaaggcccgaacccatccnnnnnnnnnntagctgcaggcccagggaagcaccggcgttctgtgtcaatgcatgtccgatgctggacgaaggaggcccacagcaggcagcagcatcaagaagcacgaacaaaaagcagttttttgcacaagtctggcaaggcccgaacccatccgccctgggccgctgggcacctggggctaccggcaggaccatgcccagcgcagtgacaacattctgcactcccggcgggagctccagccctgcagaaacgaggctctctgccgccctgtggcaggcggggcgcggcagggtgtgcaggtgccaccaggaagcaggacaagtgggcgtggggaggggctcaggcacaggtggtggcacaagcaccgtgcaccgaggcatggcagccgcccacatcgagcaggtcaccgccggccagccctgcgaatcagccagactcactgttgcagggcctgggcgaggcactcacagcgcagcctgagggtctccaggacctgggggagggcctccggcgtcccctgcgacccgggcgtgccgggctcaggccggctgagcacctccaccctgccatggccgtgcacggcgccgtcgtctgggggcctcggtcctgccgagggctgcgccaccgtcgtccaggaaccaagcgccccgttccaagtcgcatccacactcgccggcccagcgggtggctgcatccccgtcgacgcgacgacactcctccccttccaccctgggcagctcgcggcaatgggcatcgcaggctcaggcgtcgcggacgtcgccgggctcctggtgctctgacggcgagccgcgccgggccggcccctggccggctcctctgtgggnnnnnnnnnnnnnnnnnnnnnnnnnnnnnnnnnnnnnnnnnnnnnnnnnnnnnnnnnnnnnnnnggcgtggcttgctgcccacgggcagggcggaggtcgccggtcggacactggatgcggggccggatgcactggaggtgcgccccggcagtggggctggccatgccgcgcccgtgccagggtcaagcccgctgcgttccagctccttgagcctcatcctcgtgagtactgcagtctgtgctgcgacagcctcttgctgccgctgctcgagctggcgaagccgaggggggtgaatggatggttctgtcaagtgaaggtgaagcctgcatggtaagtccagagtctgacacctgcagagagaactggcctcctgaggaccaaccccaggtccccacccgtacctgggcccggacggcctgcagagaaccgccccctgcttccgcgaatccattctcttgtttcattttcatttgttggaaggtcgcccctgcatcgtcctccgcgcgccgagccgatttcaaagcctgcacggccagacggcctgccctccgggtgtcgagagggcggtcggacatgcactacggcctgcctggtctacacagcatgccttgagcagccatgannnnnnnnnngagtatccggagtcagatgcctgacaaaggagggatgggcatgccgcgatgcgaccacgcatgccgcgacttgtcacacggcgtgacttgccgacaacggttgctatgactgcaaggcagcttgaaagcggggcttgaaaggcatcatcactcttgagaaatctatccgcggggtcgtgatgatctcctgcccttgacacggtacgctggatctgctacttcattgtgatctcccaggttgttgggcgcactggtcgacggacctcgtgccccaaccgcgcagaggccaaacgtgggattgggcacagccttttggaatcgccctgacatgcatcgtcatttgcaacgccgcgattgcaggcggcgaaatgcagctggatcactgggccctgacagtgtgcctctgggcacgggtatcaaggcaaggcatgttctctgcagccacaggatggccaatggactccactttctgtggcgtgttgatggaccggggtcaatctgtggagttgatcacatgaagagaggcaatgtaaaccagtcctgaaagaatgcagcagggttggtacggggggcgannnnnnnnnncggcacgggtatcaaggcaaggtatggtctctgcagccactggatggccaatggactccattttctgtggcgtgttgatggaccggggtaaatctgtggagctgatcacatgaagagaggcaatgcaaaccagtcctgatagaatgcagcagggttggtacggggggcgacagaagaaaacacacacaccgtcgcttatgcaccccaactgcaaccgacgtaaagcagatgcatttcgcatttacatgggagccatctacattatatgagccttgacgtctccggtacgataatgttgggcgttacccgtcgtcaattatgagcagtacgctttcgtcagattgctggcagggccgcaaactccatatgctgaggcccagggatgacagatgcactcaactatgaaatagaaaggaacaggcgaggagtgaaagggcgaagcggtacgaggctgaatttcccctatccggggacccttcgatcaacccgatcacgatcggtgtattggagggatggcgtgcagcttcgtccgtgtgggcgacccattaagaggctgctatcaccgcgcatgcaccggaaaatacttcacctgcttgnnnnnnnnnngtccatatcctgaggcctaaggatgagagatgcacttaattatgatatagaaaggaataggcgaggagtaaaagggcgaagcggtacgaggcggacttttccctatccggggacccttcgatcaccccgatcacgatcagtgtattggagggatggcgtgcagcttctgccgtgtaggcgacccattaagaggctgctattaccgtgcatgcaccggaaaatacttcacctgcttgccgtttcctaagcaaacatagtgtgtgtatcatctctcggtacgcagcaggcattcggtatctcccagctactgccacgctgccgagtcccgctcgggtggatcgcgcagattcgaggtggctgctgcacctcacctccgagccttgtggctccgccgtcctacgaaaccaagcaaacgaggcctcacttgacatgtctgtggtagtgtgagatgttatttgccgttcgggctttggatgtgtattgaaattgaaccatttgggtgtgggtcggctgccacgcggacaccggaacgcatgggtctcggggtgtcactgccctcgccagcctccctcccagatgtggacataagccaggtacgtacattaaatgttctcgttgtagggctgtgctgagcgtggacctccgggaaggtctcgatttctcaccccatcccccactgtgccaccaggtagcatttccactcaccctgaccagcacggcgannnnnnnnnnctctcgttgcatgtatgtgctgagcgtgggcctctgggaaggtctcagtttctcaccccttcccccactgtgccaccaggtaacatttccactcaccctgaccagcacggcgacacaagtccacgagctcggcaggctagacctgtgtggtgtctggcacgttgtcggcaatcataaagtctttccctttcctattggatacaggcgagtgggtggtgcaggtgtgggcctagcccgaagcggaacgtagggcccggatacggccctcccagagccggagatccacgatacgttgcatctcctccagctgtcacgaaactgagacacactcataaattattccagggcaattcactctgcttatggcatctcctgctccctcagcatcgagctcggcatgtcggggaggccggtgttcctggtgcgcacaggagtgggagaggcatcggctgctcgacaggccacaagctggctgtggcccctgatctgctaggtgcttttccaaccctgatttgaagcacgttcccactccccatcgcgatgcgtgtgcaggtcgaggtggagggtgaggtcttcagcgggtccacccccacagccccctttgctaagtgggctctggcgcgaggacacgtggatgtcgtcagcgggctcatggtgggtctcaatgctggctgtgttggtcatgaggcgtgaaagcagtggttgagattgctcttgcgtgcatacttgatggatagaagcagggcccacaatccccccctgtcccttggactggcttgagtcgtcatcattgaccagccgttctggtcccattcaattcgccattcaccctttcaatcacccatttctcacctttcccctctccaatcgtctcccactcttgtatctcaggcttttgggttgttggaccccttcctccaggctgtgctccgagctgctgcgggcctgaggggcccaccccctgggctttcgcccctggggcccgtgccatccattgcgccgtccctggccaactggctcccattctctgccagaagtggcgctgcgatgggcacccgccagctgtctgaggacctgatgcgtggcaatccctttgctgacaaagccagaactccgctctgggtggacaccagacctgcaatcgtggccgaagcgaggccgctggcctccatgccggcaccagagaccaccaacagaggtgcgacctgcctttgcgagttgcatcgctgaaggggtggtgtgcatagcagcgctgagactcggagcatgggatctccgcacctgcagcagtggcgtcccaagaagcctttgccagctgccctcgcatcagcatggccgtctatgcctatcatccgttaggctttgatctcatggttgcagggaggggctgtcctacccgcgccccacggtctctgcgatcacacccctccgtcctttccttcgccaggccctcaagcatgggaggagcctgcctcgggctctggcgtccctggtgggggtcagcgcagccgccgtcggtccctccccttggcggtgggcaagtctggcaggggctggactgccttcaccgcatatggcatggagatgcgcgatgctgtccgggcagacaacccgcgggccactgccacggagatcgagaaggtgagtgtggagagcaggggttgggcatgctgcggaggagggtggtcacgcccgtgagtttgcgataggcctctgggccccgtgctcctctggacccgagtctcctttccacagtttgcctcgcctgcactcgcagctcgtgggccagcgctgggcacagctgagcagcgaggagaggcagcactacgtcgacatggcggctcgcgtgcgcaaatcgatgcgtgcctcccaggcagaggaggaggaggaggcgggtgcgaagcgggctcgctcggacaccgcccacctagcagacgcgggaacggagcggccacagcgcaccctgaggccaccttcccgctacacgagtgcagacctgggtgtgtgttgacttgttgggtatcggggttgatgctggaggctcagggtctgcatatttccgtgtggccacatctgcttgcatttgggggaaggggggagcgctgtggagttcagagtctgccttctctgggggctggcttttgcggcaattgatgagggtggcatgcaaagagttcccacccccgcccaccccccaccccaactcatgcgtccacagtggacgaccctgccatagcgtgcgtcgggatccagcggctgcaagccaggggagtggggccgaggttgactgcgctgcgtggctgctcagggatgatgcccctccgctcaaaggcgcccgcatgcgcatcgggcaccccctcaccccgccccgcacccgactattgcagggtcctcgtgaagcggcacgcaagcttggatgccagggcgcaccagcctgcgaggcagcgcctgcagcctgctgcgcgcgctgcgcctgtggaggatcacgaagcggatgtgctagggctgctggccgagatgcgagcagaggtgtgtacggttcccagggcaccctgagtgcacaccttgttcttgacaggctgagtgatgttggggtgttggggccattgcaatcacttggcctattagatcagagacccggtatggggccaggctgtgcagcgaaccaggccccaagccccacctcccacaacacttcacaggtgatggcatctgagtccgacagcccccccgcagtgctgctcagcatggccgatcgaaaggcacggccgccgctgtcctgactgatttctttcataccaccctgaaggtgtgcgtctggcacactcaaccatacaatgcaaatacgctccccttccccgaaatcatgcaccttgcacgaacacatactcacgtgcagtcccaggctcctacggttatgtgccgttctggagcaataaagtatcctgtgcgcaattttctcatgtcgaataccaagccccttgcatgttctttatctcttgcgaatttataatttttaaacagaaaggcatatctccacaccttcctgttgctgagccaaacgacccttgcgtgaattctgtgtgcacacatgcctgaatagccccgagttgtctctctctgcgtgcacacatgtaagttccactaggcatacttggccttgagctccgcaacctgcgatgttgacactctcagggatgctgaggtgggtgaatgggacacctacagaaaggcttcaaagtctaccatgatgtacatccaccatggcaacggggttccccctcacctttgcaatgtagtccttctgggcagtctccttgtccttgcctgcacggcgggcaagcagactgatcaaacaccaacaaatccacagactatcaatgccggtcattagggctgcctgcagcagagaactgcatggcgctcccaaaagcagtccacatatagtcttgacctcccaccctcgctgcacctttctgcttgtcccaggcgtcccacttcgccttccccttcaggtcaaacacgccggggcgggaagtgttgacgtcgcccacggtgccttgcttgaacagggcatagaggatgagctgcacgtgcagaaatgaacagttgaagagtaatggagaccgggaataggaagcacaatcgatccttgtatcgcaacagggaaattatcaccttctcatcattggtagtggcctctggaagggtcttggcctcctccgctgccttgttgaagtcctcctacgctttgagtgatatggcgcgctcggtgtcctctttgtgtcatgaggagctgctagggcaccggtgaggagtccaggggaaaagaggtagctgaatacatcacgcccgaggttcgactgctcgacattctcgccctgtaccacccacctccagacccatggtgaaaggttgtctttaagtgttgcgatgcaagatcacaagtgggaattgtttgcttccaggtattcgatcgcttgatgaatgcttggccaacgaccccatcccaagatttgcttttacgccacgtgccacgtcagcgaggtggccttctccagtccttcgatctgcacgcaaattatgcaggcgatgcatgactacgctgcgaaaagaatgcaacacacaagagatagatctgatgcttatctagagtgcatcatctgggtatacttttgaaaaggacaagcccatcaatgttgttttaagcacgcggatcgcatcccgcgtgtcggagtccgcgggacatccgaccaccgagtcatctcccggcgtggcaggccagggtaaaagcctcggcgtttgataaaacacatcgatgtgatctaatccctcgatccacacacttttgctgagcactgctgcgggacgatgctacgggcagcggtggggtccctggcccgcaaggtgtccaggtcccatctcagccacagcgctgcctgtcggatctccaccacctcatcgtgccaaaaggatgtggattacatggattttcccggcggtaaggtcccctttacggaagacctcgcctggttggggccgggcttcaccccgcgccccaccattccctgctaccgagcgctagacagccagggggcccccctcccgggcaccagcctgccccacgacatcgaccaggccctggccacgcgcatgtacgagaccatgatctcactccaggccgtggacaccatcttctacgaggcccagcggcaggtggtcaactgtactagggctggagtggggaggggagggggggggggggggggcnnnnnnnnnnnnnnnnnnnnnnnnnnnnnnnnnnnnnnnnnnnnnatgctgcatggcaggacgggagatgatacagtgcggcctgggcactcttgtctgcagttcacaaggcgatgagcgttttaagtagcactgatgccctgaatggagccgtctatccgcagcccttgttcccgtctgacaccacccatcaccccacccacaggggcgcttctcattctacatgacgagcacgggggaggagtcgaccgccgtcgcgtctgcggccgcgctgaaccccgacgacgtcgtcttcacgcagtaccgcgagcagggcgtgctgatgtggcgcgggtacaccccgctggacatggccaatcaggtgtgtgggcgatgcctgcgaattttgtgaaggggcccattgtctgcgaacccatgccccggcggggaggggccctgctgccgcacggtgcttgcgcttcgtgcctgagggacccacccccagccaagttggacaacctcagaactcccgtcccacaaacaaataacccccctgcgaccacactctccccctaactccacacgcgtagtgctacggtaacgcgcttgactcggggaagggccgccagnnnnnnnnnnggcctgagcgacccacccccagccaagttggaccaacctcagatcttccgtcccacaaacaaacaaaccccctgcgaccacactctccccctacctctaaacgcgtagtgctacggcaacgcgcttgactcggggaagggccgccagatgcctgtgcactacgggtccaaggccctaaacttccacaccatctcctcgcccctggccacgcagctgccgcaggccgtcggcgcggcctacgccctcaaggtgggtctgcgtggtgggcttcttcatttggatggacaacattggcgagagggaggggatagatgagggtggctggggggatggtgtcacctggaccccaggtccccaaccacgtgtctccactccactcttgcccccccacattcccccaaatcccagctggagggcaaggccgcggtcgcggcctgctactttggcgagggcgcggcgagcgagggcgacttccacgccgcactcaacttttcggccacgctgtcggcgccggtggtgttcatctgccgcaacaacggctgggccatctccaccccggccagcgagcagtaccgcggcgacggcatcgccggtcgcggcccctcctacggcgtgccctccctgcgtgtcgacggcggcgacgccgtggcagtctacaacgccgtggccgaggcgcggcgtgtggcgctggagcgccgcggccccgtcctcctggaggccatgagctaccgcagcgggcaccactccaccagcgacgacagcagccnnnnnnnnnnnnnnnnnnnnnnnnnnnnnnnnnnnnnnnnnnnnnnnnnnnnnnnnnnnnnnnnnnggcctggcgcgcgcgcgaccccgtcgcgcgcttcgagcgctggatggccgtgcgcgggtggtgggacgaagcgcgaggcgtgggcgcgcgaaaggcggcgcggcgcgaggccatcgccgcgctggcggctgctgccaagcagccgcggccaccgctgtcggagatgttcagcgacgtgtacgacgagccgccgccccacctcgtggcgcagcgggcagaggtggaggcttttgtgagggcgcacccggagaccctgcccgccggcatgcccctggagtgaggaacccctgggggggtgcagcgtgctggacgacagatgcaaagagccccggtgaccgatggcgacggcggctgcacaggttacatgagtcnnnnnnnnnnnnnnnnnnnnnnnnnnnnnnnnnngggtgacagtaagacaaagtagggggagacgtcccagagaaggggtgctcccggccgctcaggnnnnnnnnnncaacgaatgcccattcaccaacacccactgtgaatctcatatctttttaaacggcggcgggacgacagtcagggcgccgtagggggcgcagggggggtgtcccggcgatcgcccgccctccattcagagaggtgacagtaagacaaagtaaggggacacgttccagagaaggggtgctcccggccgctcaggggcgggatgcagtatgttcgaggtgccccacgccacatgggactccagcgagcgtccagcggctccccagactcgcacccgcacatgatgccttgccagactggtcccagacgcacgctgggcccagccagccgccccttcctccccttttcttgacactcagtaaacctcnnnnnnnnnncaccagactgttcccagacgcaggctggggccggccagccgcccctttctccccttttcttgacactcagtaaacctcgatgtgcagctgcccggcgtgcttcagcttctgctggaactcgggccagtcgatgcccttggtccccgccacccgctccaacatttccaggatgcccggcagcatgcccttgaggccgcagaagtagatgtgggcgccggaggacagcaggtcgaacacctcgtcagcatactcctcgatcttgtcctggatgtacatcttgccgcccttggagttcttctgctcgcgcgacagcgcgtagtccacgcggaactggtctgggtgggccttggccagggcctggatctcctcgtcgtacagcgtggcgtccgagttggcagcgcccatgaacagccaggccaggcctgggcggttgttggaaggggtgggggggggagagtgggggtgttgttttgggggggatatgggggtggttgatggagaaagggggggttgaagggagggtgcgcatgggatcttgggaagtgttggcgtaatggacgcaggcaaggcggtttaagggcaggcttcacacactcgaccttcacataaaccaatcatgctgacccaccaacaccgttgcccaccacccaccctcaaagttgtagccagggacgtcctcgatgaaaaagcggcgccagaaagcccggtagggggcgatgcccgtgccggtagcgaccatgatgacgggcgtcttctggtcctcgggcagcagcaggatcttgccggtaggccctgtagtgggaggggaggggtcgagtgggaaatctgtgctgcagggggaaacacatgctgctgtatgaccctagcacaaggtgccttttgctcctgccagccagagggattttggccaccgtggctgtcaccgcccgagtnnnnnnnnnncatgaccctggcacaaggtgccttttgctgctgccagccagaggggatttggccaccgtggctgtcaccgcccgagtggcctcctgctccaagctgcgccatctgtgattcgacaagcttgggccccctccattcgtagcccctcaccggtcatggtgacctcggtgccgggcttggcgtcgcagaggaagttggagcagatgcccttcttcgcgggatcctccgcccccttctcctcgtcccagtaggtggcgcggcgcacgcagagcgaggcggtcttgccatcgaagttgtcgccgtagcgagtggaggcgatggagtagaggcgggtgccgtggggcacctccttgcccttgctgttaatcttggtgccgggggggatcacgccatacgactggccctccgcaaaggggatctcgcccccggtcnnnnnnnnnnaggcacctccttgcccttgctgttaatctttgtgccgggagggatcacgccatacgactgaccctccgcaaaggggatctcgcccccggtctccagaacgatgtggcaggtctcgcctgtggccttggggcccacgatgcgctccacggagatgaccttggccttgaagggcttcttgatgttgaatgtgttcatgggcaggccgatcttctccaactcctcagccgggaccttctgcttggaggacacctgcagacgaggtggtgtgtgtgtgtggggggggggggggnnnnnnnnnngctcctcagccgggaccttctgcttcgaggacacctgcagacgtggtgggtgggggtgggggggagagcggggtttcaaacgatgccctccaccgatcgaaacggactgctttggaggtaccggcttttatataggagcttgggctgctattgggtctgtaacaggggtgcaggtgcccgagcccagagtccagggtccaggcaccccaaacccccaccgccctgctcacgtcggtgatattgatcttgcccacggtggcggtggcgctgatctgcatacggggaaactgacgaggccggtaggcgggcgccctccgcactgcaacctgcgtgccagggtgcaacgtgctccgggtgagccggtgcggagggagcggccacaggatccgacacatcgatgccgcgcgggcaccaccatgaaggcccattgtcttacccgtgggccatgcagcctctgggcagagcccagggaggtgggagcgactcctgcgagaacctgcacgagtaagggtttggggcttgggtaagtaccgagcccggccctagcctggccagatgcgccatcccctcgcacacctgtgctgccatgctgtctgtttggaagctggtatgccgatgaggctgcgggactggtacaatttagcgcgagcgtgcacactcgcctttctttctatccgctgtgtgttatcttgacgcagggcgatgcaatccatcgagcgcgcgcggttaccccacgtggtatgcaaccccccttcaagtagtggtcatggtcaaccagacgcatcatcctctggaatactcggtgaacttcgcttatacttggtggtaatggtacagattcacagcccctgcctcgctgcacgtgagacagcatgccaaggaaagaattgtgggtcccaggtcccagccagccgcgcatggcgcattccaccctttccataggacgcaggtcgcccaaggaatggtctggagaggcaaggcgcatcatacatggggcagaccggggacttcacggaatggcgatgccattgcgagctctcgcatggtgaattccacgccagccctctccctgtgcaagaagttctcgacaatgctcctgtggtgggagggatgaaggtcaagtgatcagtgtgtgggtgtccccggccaaagttgcgctgtgccgtgcactcttccctagcatcctccctgagacaacagacagtggctgcatgagagcaaagnnnnnnnnnntgccaagtgatcagtgtgtgggtgtccccagccaagttgcgctgtgccgtgcactattctctagcatcctccctgacacaacagacagtggctgcatgagagcaaagcgcatacatatacctgaagtctgggttgcagatgtagtggcacgagtgtgtcagggatggggtgtagcccctctggatcttgtgctcgccttgggctccagcctccactctctgtggagacaagagccaggcggtggaagttgcggtgagtggcgtgcggtcttaacttttggaagctggtttgggtgggtgccaggggctggctgcactacatgatcctaaggccctcgttgaatccgggcatttttccaggcggacccccctctcactcacgtcgagcccagcagcgatggcatgctcaatggcctgatagtagcagagctcaaagtggaggaacttgtgagcgtcgccaccccccagcgcaccccagttccgcccgtacagggtgtggctgccctgcatattcagcgcgccagcaatgtaccgcccgcctggggatggaggtagaagggtgtggggttgaacacgtggggagaacctactcttaacgtgcttgcacccagtcgatgcatgccatcacaagtgtgttgtcaattctgacgaggctcgtgcatacactccacgatcctcggatgttttgagacactggctgaggccggtcagggcatgatgcttgaggacatgcatgaacccgactgttgactggagaagtccttcccggcagcataccacccttccagaggaannnnnnnnnnatcaatttcgacgaggctcatgcatacactccacaatccttggatgttttaagacactggctgaggccggtcagggcacgatgcttgaggacatgcatgtacccaactgttgactggagaagtccctcccggcagcataccacccttccagaggaagaaacccctcccagccgctccctcacccaccttgctgcgccatcacgagcaccacctggtctggcatggcctcacccagccggtggaagaagtcgcgtgtgaggtagggggtgccccacttccgggacgatgtgtccaggtagaactcgtaaaatgcatcccagtggctgggacgcaggtcagcccccgtcagccggctgacatggatgccgccctcccgcgccctctttcgctcctgcaagggggggtcaggtcgtgatggtgtactgtaaggaggattcggtgcgcactgccacccagctcccagctgcgatccctccagcaaaaacttccactaaccaccccggccttgcctgccgcactgccttgcgtttggactgccggaggtcggccaggtacgcctcaaaggtgctgtagcccttgttttggaaatggtactggatccctgtccggtgcaggtactgtccgcctgctcttcccgccatgcacatgctttcctcctgccattcacagggtggtggagcatgtgtgtgtgtaggggtaggttgataatttggatcttcacatgtacacgcagcttcttgggcaggggctggtctctctctctttgtcaaaccctctgccacctcggtacccacctgggtgcagaatgtgaggtgcagggaggagacgttcatgccctctgccacctgaatggaggagggtgtggaatgacagactgtagaataagcagaacttcctcagcagcagccagacccactgggctcttcgttcccaatgcagtactttgtgcacgcggtgacacctcccacgtatccacacgaggccatccaggcccataacagtacctggtacagagtttgcatgagtgccctggtgatgttttccttgtagggccccggtttgaccagcaatcgtgggcctggcacgggcgtgaagggtacgcaactctgcggagggcagggaggaggagagggatatgaccttggagatggcacattgggaagggaggcagacctgaaaaggattctcagacccagaatttgtacctggagcttcgggtaatagcgtcccaggccaagccgctggtgtgcgtcagcccagctatggtcaaagacatactctctgcagcaagagaaataatagatgcagagattgtgctgtagcgctgttgcttctggctgtagaaatatggcgaattatcccaagtatgctcagtcattttgagagaatgtctggtcaaatcagcgcagcactaagagcccaacatacccatatgaatggcccttgaggtagaggggacagcaggccactacagagtctgcctgggcagcatcacgaagcacaaggtgctgtggcatccagcccttggagggaatctggtttacggtttcatggggagtcacggctgaagctgagagacttggtctattggtcagcagtgccgaacagtaattcgatctccagcctttgccccaggatgttcatggtcatgcannnnnnnnnnaagagactcggtctattggtcaccagtgccgaacagtaattctatctccaacctttgccccaggatgttcatggtcatgcacagactcacaacagatttagaggcctccaggcagtgcaggaagtcccactgaacaaaagggttgagctcttccgtccctcgggcgcaggcattccattctgtccggctgatctcctcgatggagtcgaccacatgggcactcagctggaggggctcagatggggggcgcaagccgggttcaccgctcgatgctgcacgtaatccagctcttggcctggtacgattttcatttggcgacgaggagatcgcacgaagttgtaatggggtcagggcagcactccgtcttgggaacaccgcatgggttgtggtcgattgggcgctgcgttgcatcccaaaccatccagtacctctattttcggttctaggtgcgcttcgggtacctctgattgctcccggtcccctttgcacgatgacctcgatcgagcaccccaagttcctgatcactttctgacgagggcgcgagcgccctgtctttcacctggcaccaacaccgtcaatacccacaacgcgcacccccttgaagccatacatgctttccctgacaccttataactaccttccagctgagaggaagtttgatccggtgtgtgcacccgtccacgcgccatggagactgatcaggagactgtggacaggttcacgggcctgctgcaatgctcagaagaagtggctcgcttctgcctggatgccagtggagggaatttcgatgccgctatcagcatgtactacggtgagtcggtatgctgtggtcgcgaggtgtgaccagcagggcccgggaaatgtaagaagtgaagttgagctcccaacacccactctggaactccccccatctcccgcagatcaagtgacgagccggccccaacagggcgctgcccacggtccggcccctggagggaccatggggccgccggtgccgctcctgctgaggctcgtcggcgctgcgctgcagctcccctttgctgcgctgagcaccgtactgcacgccgcctttgtcatcgcacgcacagggtccaggggggcggcagccgtcctcccaccccgcctggtgcacgctgtttccagtgagttccctgttccgcgacacagtgaggggacaccatggtttgggactgggactcgcggtctgcgctgcatgtatgactttcctcagctgtggaacaccgaaaggggttcaggggctagcatgaacgtcctccctgcctgcactgggctaccgcccatcctaacattccccagcccatggcctgtgcagcccgcgcctcagccctgtccacccgcctgtcgggtcctggcgaggcaaccccggcggctgcggcggcccggctcgctcgcgagctacaaacagcgtttggcagcgccatcgactggcaggcgtgtggctggcaagaggcggcgggccttgcggcagccgagggccgcttcctctttgtgtacctccatgccccacgccaccaggtgtggccctgggccggggccccatggcgtcggctgcatggagttggggactgtccctcaagccagggagcccggtgtgggaccggctggtgggttgttttcagaacgacgcacgcagatgccattgcgttgtccgctgaacgcttccaccgtgccgggtggcgatgggtgtccatttttcttcgttccaggacacgccgcgctttctgtcggacacgctgggcgaccccagcgtgacgacctacatctcccagcatttcttggcctgggcggggagtgtgcaggcgcgggaaggacacgcgctggctcacagcctgggggccgcccgcttcccctgcacagccctcctggctggctccggcgccaggtgggannnnnnnnnnctccgctgaatgcttccaccgtgccggggtggcgatgggtgtccatttttcttctttccaggacacgccgcgctttctgtcggacnnnnnnnnnnctccgggggcgagtgaggagggcagaggagcgggttctagccagtcctgcgagctttccttgtccagtgagggtgtcgttgcccatgggaaaccgggtgctgcatcaggaagcaagtgcctgagctcgacgagtgcaagctgaatcaatgtgcaggcatggtgtgctactggctgaccttggaggactcccctccctcttcccttacgcaggactcagctgcttgcatgcaccgagggcttctgcagtgccgatgagctgatgaccaccctccaggtggggacagggtggcattggctgcatcaatgagtggcgggtggggtgactgcttgatggggtagccgtgcgttgcagctcatgctaccgtctcatgcatcagatctcggcatgccatcctccgatcgcaggctgctcgtgatcgcagcgagcacatgctctggcgtgagcgcgctctcagacaagagcgggtgagccaggggggtgtcttgagtgggaagggtggtagggtgcatgccatcgagcacccttcgtgctgggtgggatgtctgttcggcgcggcatggcagacccctgtgcgatacagcgtggcaagacgtttggtcccgcacatggcgtgtccacaccctgtgcaaaacacttgcaggacctgagccggcgcctgagggaggagcaggatgcagagttcaatagcagtctggaagctgacaggtgggcttgagtaggtcatggagttctgaagttgccggcggcaaagatgttgttgcatgtcctgtgcaaggacggaagcacacgctcattcccacgccatgatcctactcccacccgcacctcgcacgtcctgagtgcaggaagcgccaggcagatgccgaagccgcggcagccaggcaggcggcagaggagcaaagaaagggggaggaggccctagcagcaaggtcggtctcgggggacaagaagtagggaccgcccaggctgtgcccctccagcctttcaggcctcgcgggacccaaaccgggcaccccactcccctcctccgtgccatctgcacaggcgcgccgaaagtgagnnnnnnnnnncagtggggaccgcccaggctgtgcccatccaacctttcacgtgtcgcgggactcaaaccgggcaccccactcccctcctccttgccatctgcacaggcgcgccgaaagtgaggcggccgcagcgcgggcggctgcagaggaggagctcaggagcaggcgagaggccaagtgcgccgcgctgccgaccgagcccgagtcgtcggcgccgcacgtcgcgacgctgcgcatcagactgccggacggcgggatgcaccagcgccgcttccgggagtcggatgacctgcaggtgtggggattgcctctttcaggaagctatgcaggacggctgcggggcctgggtgtttgggcagttgaaagttgcagcgcggccaccctgccctcacacagtcatgccatcataactccgtcacaggttgtgtacgactttgtggactcgctggactcagaggctgtacccctgcgatataccctggccaccacatttccgcggcgcgagtttgggtcgagtgacctgtcccagaccttgcatgagctggggctgacgcctcaggcagccctgcttctgcaacccctgctatgatggccttgtgggaggcatttcaggtcaggcatgtcatcatccttgacacattttcaacggctgtgcgcctgctgatgatcgcaagcggtgctccattgatggtcgcgcccagacatccggctcgcggcattcccacgagccacgccttcagttcagcacagatgcggcaaagtcaacagggaatactgcaacctaaatgcgctgaaaaagtagtgaaaagtaatggcatcgcatggcggtcatcggtagcaggcatggcccgcactgagggtacgggcttgaggagggtgctgcagtcgctgcaagcccgcatcctcagccctgagcgtactgcatggtacagcacttctcttgccgatgacatagtccctgctgaggcgctgcctcgattggctgaaagaatcaaggcacgtaggtgaagagattggagcggctggcaacattgcaatgccgtaaagtttcccaaactgattgcccgttcaggtgttgcacgttggctgccaaacgtcgcatgtaatccccgcatgcagaagaatgcagcatacggccgctccagcatggtcgccgccgatctggaggtttacctggccagaggcggcgaaatcaagtgaggtgcctgcgatgtcagtgcctcttgaagggagcacttggtgtgcgcccactgcaatcacccgtctgcccccctctgcgcaggcccgccatcctctccgccctgttcaacatgtatgcccggctgcgctcgcctgagaagggcgatgccctgtacgcccgtgtgcagtcgcaccgccagggccccatgaccccggcaaactacgcctccctgctcaatgtctatgccaaggctgagcacccgccgtacggggtgcctcgccgttgggcgattcgggctgcccaggtcgctcaggaggctctggacgctggtgtggtccccggcctggccttcatgcacagcctcatggagtgccaggtgtgtgctggccgaacagggcgctcatgcagcaggcacatggagggccatgcgtgctgcactgcattcccaggaagctgggtccatgtctgtcgctgtggctggcactgacccccctcccggaatgagtttgttggatcaggccatgatcaccctcctcatcccccggcacaccgattgacccaggcaaaggcggggcttccggaagccgcactcgccacctaccaccagctgctgaggaagggcctgcagcccaccccacgcaccttcaacatcctgctcctggcccaccggaggtcgggtacgagtcggggggccgcccacgtgtttgaagacctgctgcccaaggtgggcggagtggccgctgccagggggagctgcacgccctcagggtaataccctccccctgccttgcctccccctcaagcatcacttccccaccttcctgccatgcatcccaggcaggagtcnnnnnnnnnngtcagggtaataccctttctctgccttgccttcccctcaagcatcactccccctccttcctgccatgcatcccaggcaggagtcacccggacgctggccgtctggaactcctacctgggtgtgtacgccgtggccggcgacatcgaccgagcctaccacgtctggacccgcatgctcgcagaaggtttgctgtcgaggagacagggtctgtgttgcaggcaccctccgatcctgctctggatcagatgtgctatgagctgctgctgttagatctggctcgccgtcgactctgctgctactgtggccactcacgctgcccaactcgctcccccccaccccaccccacattccagctcttttcccgctcaacaccccccttgtggcaggcatcgtccccgaccacttcacggagcgagtgctggtccaggccttctccgcccgcccctccctggcagccgaagtcttggacgaggcccggcagctgcggacttcgtcgcatgcggccggccatcgctcctccagcgacgccggtgccccctccggggaggccgccgcgacccctgcgtcaagcgccnnnnnnnnnncgcggccggccatcgctcctccatcgacgccggagccccctccggtgaggccgccgcgacccctgcgtcaagcgccaacaacgtcgctcgacagccccccatggcgctggagcagcccagccgccgcagcctgtcaccgctgctgctgcacggccagctggggcagggtgcagaccccagcaagccgccggcgcgccagctgctctacatcgacctgcatggcgtgtcgcgcgccgcggcggccaccctcctgcaccgccgcctggagctgctggtggcggcctggcccgcgctgcgtgccgagctgggcgacggggggccgagcgacgaggccgcggcgtcacatggtgacgggacgggcgaaagtgaggcggctgaggggcccccggcggcggcaggatgtgccccgctggagtacgcgggcctgcagacgggcacgccagagcgcccgcgcgcgctgctggtggtcacgggtgtgggccacggcagccccgagtcgcagggcgtgctgcgtggcctgacgcgcgacatcctgggggcgcagggcctggagtgccacgacgccggcggcaacacgggtgagggaggggtggtgggtgggggttggtaggggcagggagccgagttgggtccgtgcgccggcagggtgtctgacaatcgggctagggcgtcgggaggcaagggggaggcggggatgcccctggcgccgctgctccagggcccacccgacccagactcgatgcactggccctgcgtggctcaatgnnnnnnnnnnagtgggggttggcaggggcagggagccgagttggatccgtgcgccggcagggtgtctgaccatcgggctagggcgtcgggacgcaagggggagtcggggatgccctggggccgctgctccagggcccacccgacccaggctcgatgcactggccctgcgtggctcaatgctgctgggcgcatggtccctgctggcttcaggggcgcagggtctcgagagcctgctcatgcttgatcatcacggcgtcaggcgacccacaccaacgtattccccccccccccccccgggggcccccacaccaaaaccccaggtcggacggtggtgccctggtccagcctggcgcccttcctgtccaggcaccacacgagggcccaagcagggtacctggcgcgcgccgcgcgcgcgcggtacgccctggttctcatggggagcatgacgctggtcggcgcggggctgctcgtcccccggctggcgccttggctggcatgatttggaggtgccgtacagcggcgaagccatgcgcaggttgtgtgaacgatgaggaggtgaagggcggtcagacgtggaatggggctgttttcgaagatcaaannnnnnnnnncctgtgaacgatgaagaggtgaagggcgatcaggcgtggaatggggctgttttcgaagatcaaatcattctcagcaaggacgggggggattcaaatccgctcatcatcgtccttggacaccggactgtcggcgacggccgctggccggaatctacagctgcaaagacccacctggaagcatgcgcggcatgttgcataaaccctcgctgacacccatgcggcttcatcaagggttcgccaccatccatttcaacccttcacaaattcatgatcagtaggaggcagaccgaagcaacccgcgagaccatccagaccggagcaccatgccgcgccccgtcctgtatgccgacatgctgagccagccatgccgagccgtggtggtcctctgtcaacagaacggcatagatgtcgagatcaagccaatcagtatcggtcggggtgagcatcgcagtgcggacttcaaggccgtcaaccccctgtgcaagcttccctaccttgtggtgagggtggtgtcagggatgggacgggctgcaagcaatgacaccctgcgccagacctggagttgcgagataccctactcattccatcgcacctcatggctgtgatgctttaggacggcgacgtgcacgttggcgacagccttgccattctgatctacctctgcactgtcaacagggtgcctgataactggtacccaggtaaggacgctggcttgctcctgagggtggccaccaatcacagacatgtccgtgcacgcctctgtatctagcagaatgtatcattgtggtgtgcacttcaatcggctcggtcccaccatgtttaccctcccccctcctgtgcacagccgatccagtgaagcaggccagagtcaacaccgtgcttggctggcatgggtcgacgctccgcaccggcagcaccgtcaccattttcaacagggttctggctcccctgcggggtacaccaagcaatgagccgctggtcaaggatttcgggctgcccaccctgcagaccgccctgcaggtaagtcgagaactttgtggtaggataaggattttcaccgcagctggtgcacccgcaagcccgttccagctacacctcgctcctgatcacagcaaaccctgcggacctggattggtgcagcgcatctcctttcacctttagaaccccaatttgcctccaccccagacgatcaacgacgtgtggctcgccaatgatgacttcgtggcaggctcagacgtcagcatcgcagacctgctgttggccacggaggtcgacatggcacagctgctcgatgctgcacgcgagggtccagcactggaggagctgctagcacctgtgcccaaggtccggtcctggctgaaccggctgtcgcagcgatgcgccccacactacgaagatgccaaggagcagctgggaaaggcgcgcatcaggttcattcaggtcctgggtggatccgatgaggacaaggcgaagctgtgaccgcccgagggccgtgggctcagcaaaaagcctgacttgtaatcatggcgccaatgggagaggccggaggggatcacgtaaattttccggggcatgaggttgtcactctgtgacctatattcagggtgctgcagagtacagcgacgtattccttattcagcgacccttccagtgctccccaaggttgatcgagtccccagttccaggaactgaagatgtcgaaacccgtcatctattattacttcttgagtccgccgagccgggccgtcaagatcttcgtggacgctgcaggtatcgatgccgaagttaaaaccatttccatcatgaagggcgaacatcgtggcgaggcgtacctggcggtgaacagcacgggaaagctccccttcctcaaggtacgtcgaacaagcctgtcgatctcatacctcctggtcggctcttgtcaagggggtgaaattaatggacggtgaagtacattattggggatctggagatgtgatgttgccgtttcagcttcacatgtaacccacaccgggtgtcgtacgatcgacaggagggcgacttcgctttgccggaagccggggccatccttgcctacctcgccgacacccagcccggcattcccgagcactggtaccccagtgagtggcaatttcctgcttcatgcatgcattaagtttgcatagctctacaactggcttaggatttgcacgccccctgctgttgctgcgaggnnnnnnnnnncgagcttgcatagctctacaactggcttaaaatttgcacgccccctgctgttgctgcgaggagtgctatgtaggtggcagggcctcacccattcccactttgtgcccacccaccgccagaggatgcgagggcacgtgcgcgggtgaactccgcactgacgtggcacgggtctacgctgcgcaatggcagcgtgacgctgctgtccacccacgtcctcgaaccggtgatgggcgcccctgcccgtgaggaggtcacccagcagcacgccctgcccaccctcaaggcggcactcaaggacctggagacctactggctggctgccacagactacgtggcgggggggcaggtgtccatcgccgacctcctgctggccacggaggtcgaggagctgcggctccaggactttggtggaaaggtgggaacaagggaggccactagggcgcggggggggttctgaaggggcacgcgcaagctctatccacttctgctcccacttgggaagcatgcttccaagccttgggaagaaggtctcactccttaacctatggtgagcccaaggtccattgggtgagcaccaccccgccagctgtcatccacnnnnnnnnnncgctcccacttgggaagcatgctttccgagccttggaagaaggtctcactcctcaacctatggtgagcccaaggtccattgagtgagcaccaccccgccagctgtcatccacatgaatcggatctgggtcgccccgcatgagtgcatttcttacgttcaatgacagcactctgctccatcacgaccctgnnnnnnnnnntgccccgcatgggtgcatttcttgcgttccatgacagcactctgctccatcacgaccctgcgtgcaggaacccggctatgagtcccttttggccgattatccgaaagtgagggcgtggctggcgcggcttgccagtgagctggggagtgcctacactcgtctgcacgatgccatccccgtggctggggcaaagatcctgaaggccatcaaggacaagaaccaaccccttgatgttgacgccatcgactctattgtgtgaagaaggaggcaatgctgtacggcgctcgtgctctcactttgcnnnnnnnnnncaacacaacccccccttcttttgtgtgtgtctttgcagactgcatgggatgttcgtnnnnnnnnnnccccctcgatgttgacgccatcgactctattgtgtgaggaatgaagcactgctgtacggcgctcgtgctctcactttgcaaccagagactcgaggtcgctgggatccatacctggcaactgcttggtcagcagccgccgcgggaaccacaacaccgcccccccccttcttttgttcgtgtctttgcagactgcatgggatgttcgtgattgggtgggaggactttgcgtcttgtagtgatcattgtgtgtgacaagcgcctgaatggagatggaagtgcagcagaattcccagcccagaggaggagagaagatgtgaaggcgtgatataggtcactcacccaacgacattgcctgagagaatgcggtgagcctgtgcagacacagagaagccctccgctcacccaggaggccatctgtgaggcctcatggaccggccgtgcaggcccctcggtgacactctttgcagctgtgactttgccgggatgaggaaccaatgcaacatgtcatgcaggaccttgtggcacccaggccaaatgcaaacatctgtagcttgttccattgcaattgtgcctgcacagccaggtggggcctggtagcatcatgctccagctccgcaggattcccagttcaacagtcggggaaagcactcgagactgtcgtgccagcgccgcgcnnnnnnnnnncagcatcatgctccagctccacaggattcccagctcaacagtcggggaggcactcgagactgtcgtgccagcgccgcgcctcactcctgcatggcatcgcccgccgcgaccaccctgctccggacgctgccccggccgcggggttggtatgtgcgggcgccgtctgtggcttggaggaaggcccggttgttgcccaccagccttccacgcgcaggctgaccggggtcgcccgtgattctgcttgccggggagggagggggaaggggggggtggaaggaggatgagagggggccgcaagggagggtcgaggtgcacgagaatagctgcttgcaacagggggtggctgccacgagcccagactgacccagtggtcacaccctcctgttttcaacatccactacaggtacctgacaccgctggagagcgtccgcgcgccgccctgcccctgacctcccgcgctctgcgggatcagctcaatctgcgacagagcgagggatcaggcatggcagtcagatgtgtcaagacctttcacgatatgcctgtacatcttcagaatacacgcgagcgcgcgcgccccccccc

SEQ ID NO: 39070 - DNA, 61 bp, Chlorella protothecoides
acgtccacgcccgtcaccgccccacactcctccagccatgccaggcagttggcgagcccgc

SEQ ID NO: 39071 - DNA, 140 bp, Chlorella protothecoides
agggctggggatgagcatgcgcagacggatgccgctggcgacgcgacgcgaggcgcctgctgtgcgcatcaaggcgactgcagcgcgatcgcccctgcagattccagcgccggggagctgcgagccgcagggtaccgctg

SEQ ID NO: 39072 - DNA, 96 bp, Chlorella protothecoides
cccacaccgccagcctctccagctctgcggcttgggagggtgggtccgggaaaggaggtggggcaaggtgggcggcgcggagcctggcaatgcaca

SEQ ID NO: 39073 - DNA, 76 bp, Chlorella protothecoides
cacaggcgacctgggccggctgcggaattgagggggaagggggggtggcccgaggcgagtgaggacctgctcaaag

SEQ ID NO: 39074 - DNA, 61 bp, Chlorella protothecoides
tcgtccttcaggctccttgtaaagctgcactcccacaattcctccccccctctctcctcta

SEQ ID NO: 39075 - DNA, 61 bp, Chlorella protothecoides
ttgaggcgtgggcaccgggtggggggggggggagcacaaagaagcacgagtctgggggagc

SEQ ID NO: 39076 - DNA, 68 bp, Chlorella protothecoides
ggggctgaacaggctggtgagcaacagcccctgcgcttccacgcaagcattcccagcccctcctcaca

SEQ ID NO: 39077 - DNA, 61 bp, Chlorella protothecoides
ccaggactttttcgtgcatcacaaccacctgtgcctggtgttcgaactgctcagcctgaac

SEQ ID NO: 39078 - DNA, 1340 bp, Chlorella protothecoides
  modified_base (263)..(272): a, c, t, g, unknown or other
  modified_base (495)..(504): a, c, t, g, unknown or other
  modified_base (671)..(680): a, c, t, g, unknown or other
  modified_base (904)..(922): a, c, t, g, unknown or other
  modified_base (985)..(994): a, c, t, g, unknown or other
gcgccgccgccgaggccagggcggcggccgccgcgtgctcggcgtccttgccgtctgcactggcagcctccagccgcgccagggcctcctccagaccctgccccgccgactgggcacgcgccagccgggctcgggccgcatgggcttccctgtcggtttcgtggggtgggccgacagcgcagagtcatggtagttcgggggagagccaagttcttggcgcccatcaccaaccacatggggccatgccaggagggcactgggannnnnnnnnngcagcgcagggtcatggtagttcgggggaaagctgagttcatggcgcccatcaccaacgacatggggccatgccaggagggcactgggatctgccgtgctgagcctttggcacatcccctgatgggtatcaccgggagccccgtccatcgcatccaactcccctccctccatcccacacctgagcagtccggcctcctccacctcggcttcctgcgctgcagnnnnnnnnnncgagcgtgaaagggcgacgagcgaccgaggagctcgggtcaagacatcaggagctcatatcgaccagccaatgacgccgagggcacgtgcgagactacatccccagtcactgcgcttcacctgcaggacgggggctagcatgtctgaccccggcgtgaagtcgaccnnnnnnnnnnagatggcggcatccagccgcgcaaggtcggtgcactcgtgcactgcccgcgtcagagcctcggccgccttctccgccgccagcctcgcccgtgcctcctgcagaagtccacgagggtgatggtgaggatgggaacaagcaccgctccgcacggcggagggagcgtgaaagggcgaagagcgatcgaggagcttgggtcaagacatcaggagctcatatcgaccnnnnnnnnnnnnnnnnnnncaggccgcgtaagtggctgggccgagggagcaaagtgtgcagacgaccccaccagtaccctcnnnnnnnnnntaggccgcgcaagtggctgggccgaggaagccaagtgtgcagacgaccccaccagtaccctcgcacacaaactcctcggccatccaagaacgctgcgtggagaccttccgtgatcaccaagtctcttgtctggcactggcaataacccccagcacccaaacacagaatgccatcctccccccccttgcgctcgccttgaggcccggggtcctaccgccgttggcgagcaccgtggccgccgccagcgcgacctctgcggccgtggcctgcgcggccagcgcgcggcccgccttcctcgcggcctcggcgtccagccccgcggcggtggccgcctcggccgcggcgg

SEQ ID NO: 39079 - DNA, 77 bp, Chlorella protothecoides
gaaatctcctcaacccatcccccccttcacgccccaccatctccctgcacgcctgcaggaacagcgagatctacaac

SEQ ID NO: 39080 - DNA, 79 bp, Chlorella protothecoides
acaaccaggacccggggcctggggtgggggtccaggcccaagcaccctccggggacccttccgcccccctgaacctgtc

SEQ ID NO: 39081 - DNA, 78 bp, Chlorella protothecoides
gccccttggtctccctcccctacaacacaaaccgtcccctctctcacccaccccccgtccctctctcaccctcgctca

SEQ ID NO: 39082 - DNA, 61 bp, Chlorella protothecoides
atgccttggctgcagccggtggtgggtttgtgatgctgaggggtctttctcgaggggctgt

SEQ ID NO: 39083 - DNA, 61 bp, Chlorella protothecoides
acagtatcgccagcctaacccgggctgttaaccccctccttgcggcgaggtcgaccaccgc

SEQ ID NO: 39084 - DNA, 61 bp, Chlorella protothecoides
cctcccccgcaaagcctgatgctggaggcagagagggaggggtcgaccatgtactgctgcg

SEQ ID NO: 39085 - DNA, 61 bp, Chlorella protothecoides
gaggttcaagaggaattcgctttataaagttggtaagaggaaggtgatggtgggcatgccg

SEQ ID NO: 39086 - DNA, 62 bp, Chlorella protothecoides
tctgcggcgcaagccgctgcaccccatccgcagcaacgtgttccagacagctgtaagcattc

SEQ ID NO: 39087 - DNA, 77 bp, Chlorella protothecoides
gattgaggcagaccccgtgtaagcaaccaggatcgtacagtcgctcaacgtcaccgaccgggacggacgggggtggg

SEQ ID NO: 39088 - DNA, 108 bp, Chlorella protothecoides
gcaacactccgagggggatctgtgtgagcgagcgtagccttacgatgggcgcgccatacggactgcacaccatcagagggcccgcgaagggcaccgtcgcaccgtaag

SEQ ID NO: 39089 - DNA, 97 bp, Chlorella protothecoides
acgcgacgccccagcaaaaaagcacttggttagcatcaggatgatggccgccccgttgttgtggggattccccttgaccgggcgctttccccacttt

SEQ ID NO: 39090 - DNA, 61 bp, Chlorella protothecoides
gaaccccggccggggtgcgcgtgcggctgcttgccggggcaggtgttccgcaggcctggcc

SEQ ID NO: 39091 - DNA, 96 bp, Chlorella protothecoides
gactgcgggctcaatgcagcacctgcccgatgcccttcccacactctgtcgccgtcctcccctgcaccaccattcccccacacccaccgagcatgg

SEQ ID NO: 39092 - DNA, 63 bp, Chlorella protothecoides
ttgcacttccagcggccccttccaccccaccagcccacaatcccagcctcaccttggtctgga

SEQ ID NO: 39093 - DNA, 61 bp, Chlorella protothecoides
atgaccgtcagattactcgccgtgcctgctgagcaggcaaaagcgatcgcgctttgctgtc

SEQ ID NO: 39094 - DNA, 77 bp, Chlorella protothecoides
gtcgcggatcaggcccaggagcctgatgccccaagtcaggggatcctcaatcagagagtgcacccgcccaccctcac

SEQ ID NO: 39095 - DNA, 98 bp, Chlorella protothecoides
cctgtgtgtgtgagtactgaaagcaacgtcacgagatggtcgccacgtaaatttttactcgtaggatgaaagcaacatggtcggaagaaggattgtgg

SEQ ID NO: 39096 - DNA, 80 bp, Chlorella protothecoides
cacagtctgggcgagagaatcgcgacgacgaggctcgacgcttcccgatgccaaacgtgagtcgcgcgagtcgacccaaa

SEQ ID NO: 39097 - DNA, 82 bp, Chlorella protothecoides
cgtccgtgcctcaggtgtgtgacgggctggcgatggcctccacatcaaggccaaagcgagggatttcactgggcggtatgcg

SEQ ID NO: 39098 - DNA, 61 bp, Chlorella protothecoides
ccgggtggcgaccgaatatggacgggggggggggggtgggggaggcatgcctggtggtgct

SEQ ID NO: 39099 - DNA, 378 bp, Chlorella protothecoides
  modified_base (91)..(224): a, c, t, g, unknown or other
accttggcggctggagatacagccgcgcattgcgctgggcgggctgatgtgggtgtgtcggcaagactttgccgctggagcgcccacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgccttgtgtcacttggctgctaacgcaaggggtcaagtttcaggcagcacgcgtcaagtttgaaggggggttctgctgggtgggggccacgtgtcgcagcagggggcatgggcacatccccaacacagcgcaagcagggtccgcagcctt

SEQ ID NO: 39100 - DNA, 1150 bp, Chlorella protothecoides
  modified_base (874)..(951): a, c, t, g, unknown or other
cgggcgtgcgcccggcgcaggcgccccggccagcccccggcacggcgctccgtcctccccgcgcctcggtcccgcgggcacgctgctgcccggcgacttcgcggcggcttccctgggcggcccctccgccgccggggacgagtgggtggtgcgccccagcagcgtcacggcgcgcgtgctggccaagcacgcgcacgacgtctcgcgccgcacgctgatggtggcggtgatcgaggcgcggggcctggagccgcggcgtggggtggtcatggccctggccgcctcggagctgcccaacccgggcgtggagctggcggtgtccagcgtggcggcgggggtggaggccggcgcgtccactgccgccatcgggcacagcctgacgccgcggtgggagggcgagcgccacgccttcccgcgcctggacccggccgacacgcggctgacggtgcgcctgctggactgccactcgggcctgcgccacaaccgcgcgctgctgggcgaggtcaccgtcgccgccgggaacgtgaagggggaggacccggtgtacgtctggctgcccctgaccccggccaagtccaaggggccgccgggcatggtgggggcgggcgtcccggagctccaggtgaggtgtgatgcgtttgcatcggtttgttgaggggaacctttccttcccgactgggccggcacaagggcttgcgagtgcggtgtcacctgccagggacccctttactgcgagcctgccaccttgtgctgcatggatggccccgcccgcctccccccaacactcgcgtgcagctgcgactcgcccccaaccccacacatccacccccccaacacccaaataggtgtgcctgcgcatgcagtggcagcgcgnnnnnnnnnnnnnnnnnnnnnnnnnnnnnnnnnnnnnnnnnnnnnnnnnnnnnnnnnnnnnnnnnnnnnnnnnnnnnngccccagcggcaaagtacggcgccgcggggacggagcgggagggcgcgctggtctccctcgagttcgtgcgctccttcgcgggggcgggcgcggagggactggagctggtggtggacagcccgcgcagtccggtggccgccgacgccgccgggctggggcccggcaccgacgccggcgtggcggacgcgtcggcggccg

SEQ ID NO: 39101 - DNA, 61 bp, Chlorella protothecoides
cagcaccaccggctgcaccgcgtccaggatttggttgtccagctgcgccttgcggatggag

SEQ ID NO: 39102 - DNA, 80 bp, Chlorella protothecoides
agggacagcacttgctccagcagtactgtgtgggaggaagggatgaggatttggattgccgagatggtgatagggaggat

SEQ ID NO: 39103 - DNA, 65 bp, Chlorella protothecoides
atgcttcaacacatacacttccataaaacgatcaaattgggactcggcatgggtgtcgcgcgatg

SEQ ID NO: 39104 - DNA, 122 bp, Chlorella protothecoides
tgcatgacctctggacacacatgcattcatcacgccatgcccccccccccctccaaatgcaaacttggcagtccccaggaccagtcaatgatacccgctcttcagaacaaccaagtgctcac

SEQ ID NO: 39105 - DNA, 61 bp, Chlorella protothecoides
tggcacgtattgcgcgggaggctctggaggccgctgccatggatggcatcgtgtacattga

SEQ ID NO: 39106 - DNA, 609 bp, Chlorella protothecoides
  modified_base (94)..(103): a, c, t, g, unknown or other
gccgccaccctccgcgccgccgtcctccgtcgccccgccggcgccgacccgcgcggtcgccgcggggaaggcgctgtgctgcgccacgcccacnnnnnnnnnnccagcgcgcgctcaccgcggccgcctgccagctggcggtgtagcaggcagtgcagcgccggctggctccctggcaggggctggaagcagggcggcggggcagacggggccggggtcgtggcggccgcgccgccaccctccgcgccgccgtcctccgttgccccgccagcgccgacccgcacggtcgccgtggggaaggcgctgtgctgcgccacgcccaccaccgacacgtccgccaggcagatgcccagcgggtaggtcccggcgtcgaaggccagctcggcctccccggggtcacgcggcacgtggactccagcgtcccgggccggccccgacccgggcgaggccatccagccggggcccggcgtggcggccgccccgtccagggcggaggggaaggccaggcgcatgccgcccggcccgtacagccaccagggcagctctgtggcggggaccgcgccgggcgtggtgcccgcgcggcgcacgcgcggcggcgggtgcgggccg

SEQ ID NO: 39107 - DNA, 80 bp, Chlorella protothecoides
gccgcggcctggcgacgagcctgtggggggcgagatgaaaagggttgttgattcacaaaagggacctgtaaggtcacacc

SEQ ID NO: 39108 - DNA, 6195 bp, Chlorella protothecoides
  modified_base (132)..(141): a, c, t, g, unknown or other
  modified_base (546)..(555): a, c, t, g, unknown or other
  modified_base (1560)..(1569): a, c, t, g, unknown or other
  modified_base (1643)..(1652): a, c, t, g, unknown or other
  modified_base (1735)..(1744): a, c, t, g, unknown or other
  modified_base (4785)..(4794): a, c, t, g, unknown or other
  modified_base (5111)..(5120): a, c, t, g, unknown or other
gtgggggggacgtgaggggagggggggggcatgggcatggtgcgccccggaggaccagggcgtgcccatcccctccccgagccaggcacaccgctcccctccctcgcacctgtgcttgccgggccagcttgnnnnnnnnnntaggcacggtgcgcccggaggaccagggcgtgcacatcccctccctgagccaggcacaccgcaccccttcctcgcacctgtgcttgccgggccagcttggctgagccgtggccgaagcgcgcgatgtagtccttcatgttggcgatctgctcctgctcccacttgtacttcttcatctggttctcctcctgctcggcccgcgtccgcacgtaggtgtcgtagtcacctgcgggggttgagcaggggggtggctgttgaggaaggggcccagggtgtggagggtgggaggagcatcagggctagccttgcgtgccgcaccctccagggtgcagtgacgcgcgcgaggaaacggggaaaccccgcacaggctctcaagggtatgcctgagacatgcgtgcagtgcannnnnnnnnncgcattgcgtgccgcaccctccaggatgcagtgacgcgcgcgacgaaacgggcaaaccccgcacaagctctcagggtatgcctgagacatgcgtgcagtgcatagaggagggaagacaacaaagagagagcatccaaagatcgtgacggatcagaagccaagcgttcataagcatgccttgttttcagtttgcgcgggcgggagtttgatcggcccccgcgtcgctcaaaggttgcggtatcatcacctccgtcacggaagggtgcaagcaggcagggtgaggaagattcgaggaaagggagggtgctccagcacagacagggctgggcagggtgtgggggttgcaccagattgcacatggcgcgagcagagagggggatggcagacaccgctcgacgcattcccacctgcgtagtacttgagctgcttgtgctgcatgaggatgatgttggtgcagacgccgttgaggaagtcctgggagtgggagacgaggagcaggatgcgcttccacttcttcagcgtctcctccagccacacgcaggcctccaggtccaggtggttggtgggctcgtccaggatcaaaaaggtgggctccacgaacagcgcgcgcgccagcgcgatgcgcatgcgccagccgccggagaagtcgcgcgtgggcttggcctgcatcttcttgtcgaaccccaggccgtgcaggatggaggccgcccgcgtctccgccatctcgctctccatggcctccagccgctcgtagatgtcctccagacgctgctccgcctcgccaccctccgcatccgccagcgactccgcctccgcctccagctgcgcgcgctcctcgtccaccgacatgacggcctggagggcggtgaggtctgaagccgcgatctcccggtccaggaagtaggtgtctatgtgggcggggatgtccagctcgcgcgcgcccagcgccttgagcagcgtcgacttgccacagccgttggggcctagcaggccgtaacgcctttnnnnnnnnnngcgctgctccgcctcaccaccctccgcgtccgccagcgattcggcctccgcctccagctgcgcgcgctcctcgnnnnnnnnnntattgagagggtctagatcgatcgtgggccaagactgtcgataggacgagctctctcgctggctatgtccccggctcctgtgnnnnnnnnnnatattgagagggtccagaccggtcgtgggccaagactgtcgataggacgagccctctcgctggctatgtccccggctcctgtgaccatcccatgcacatgggagcatcaccccaaccctctccaccccccaccccctcctttcttcacattcacctgccataattgagctcaaggtccgcatccgtcaggatctcgtgcccgtggaagaggagggtaaaggactggaagtggatgtcgcgcgactgggggtgggaggtgaggatgcccgtgcaggacctgtcgttcagttccaggtcctccacgtcccgcgccagctgtgttgtgctgccgaacgcgttctcggcatcggagctctcagaggcgagggtggcagaggatcccttgcccgcgaccttgcccttcttcagggccgcctgcttcttcttgcggtcgcttaccctgtggacaagcggtggaaggggctcggtgagcaggtggatgtaggcagcatcgatgtcagtgcatacatacaaaaagacgcacaaagtaccgccccaggccccagcttccgtgcaagtcagaacccacatgctctacaagggccgccacaagcggctggggtgggtggggtgaggcgcctggctgatgtgtgatttatgcgtactcgtagcaactatcaattcaacattggacaccgtctcctcaggtacttgagcactcggcgccgctccgcggactcggcgttgccacctcgtcgggaaaggggggggggccagcgccattcgactccgtcgggggctagggccccccgcgcttgttgagtttgggcctcactgcccaagggggttgccgggaaggctgtcggcaccgacctgcactgtggtcctgacaacctcccttcttggaggaaggggataggtgtgactcagttggggaaccctcccgaggacggcttatctcgagtcctcgggcttgacaaccgctcccgaagttttcgccccaaggcccgcgtggtgttgcccccgattcctaggatgcagcaagaccagggctaggtgtctgagccctgtagcgctacgccttcagctctggctttctgcccgtatcgacagacaagtgtgccacgatgtctcacctcgcgcacatggacattaggattgcggtaagacgagtgcttggcttggtctcaatcttcttgatcaagagatcgaaagcaggatgtccaccggaggcaaacgtctccccaactcaccggcagcaacgccctttcgccttgtgatggctgtaggggaagtaccggctcgggaggaagatcggctcggggagctttggcgacatttacataggtgcgtggcgctctctggtggcacagtcgttttggtcctcaggtgcacaggcgaagctcacaacgaatcgggaatccatgcgatgcacaggcacccacctcctcaccggcgaggaggttggcatcaagctggagtcggtgaagaccaagcacccccagctgctgtatgagtcccgcctgtacaagctcctgcagggcggaagtgagtgggcggttggagcgggaagggtttggggtgtgctcgctgtagcgttgggcttcccttgtccaagcgcaccttgccagctgtcgcccaccactcacacaacacccatcgcccctgccaccctatgcagctgggatccctaacatacgctggtttgggatggagggtgactacacagtgatggtgatcgatctgctgggacccagccttgaggatctgttcaacttttgcaaccgcaagttcagccttaagacggtcctgatgctcgcggatcagatggtaggcaggggggcgttcgttgggctggcagtgtgtgagaagcctctgcatcgtccagggttgtgtctgaggtgtggctccctgcatggtttccccctcgtctgcctcgggttggcgtcggagtactctcgcccgaggacccgctgctcaattttccatgcccatcccctccttcccagctctctcgcatcgagttcctgcacagcaagtcgttcatccaccgcgacatcaagcccgacaatttcctgatggggctggggcgccgtgcaaaccaggtgtgggggcgtggtgcctggactgggttggcgggatggggagtggcttgtggaggatcttgggtttggatgtgcatgtgacagggtattttcaccacagccctgccctttcctcttcggctgccctgcgctctgaccagccgtctcacaaggcaactcacacaccctccgacccctcacctgacacgcatgcacccccactttcccccttgcgccccccttcccaccaggtgtacatgatcgactttgggctggccaagaagtaccgcgaccccaagagccacatccacatcccgtacagggagaacaagaacctgacggggacggcgcggtacgcctccatcaacacgcacctgggcattgagcagtcgcgccgcgacgacctcgagtccctgggctacgttctcatgtacttcctgcgcggcatgctgccctggcagggcatgaaggcggccaccaagaaggccaagtacgacaagatctcggaccgcaagctggccacgcccaccgagacgctgtgccgcggcttccccaccgagttccccgtctacttccagtacgtgcgcagcctgcgcttcgacgacaagcccgactactcttacctccgcaagctgttccgggacctgtttgtgcgcgaaggtgggcgattcgaggtgttttgggggtggccaggagggagaaaggagagcgtggtgtgggagaagggtcagtctggagacctgtcgaggggatacaggtgggggttggggagcagcaaaggtgctggcgcccgccatgcctggaacgaggccaacaagtcgcggcggcctcaagtgtcgcacgcacgcgccctgcactggttggactccagccgatgggcttgcccttgcggcacccacgccgagcctgttcacgagcgtggttgtgcaccaggcacattccccccaacccccacttctcaaccaaggctcccccctnnnnnnnnnntatgcctggaacgaggccaacaagctgcggcggcctcgagcatcgcacgctcgcgccctgcgctggttggactccagccgatgggcttgcccttgcggcacccacgccgagcctgttcacgagcgtggttgcgcaccgggcacacatcccccccacccccacttctcaaccaaggctcccccctctccgtgacgcctgttccctcgcacgttccccgcaacacttgaatccacactccccccccccatcccctgcccgcgcaggcttcacgtgggactacgtctttgactggaccatcctgaagtaccagcagcagnnnnnnnnnntgtcccccgcaacaattgaatccacactccccctccatcccctgtccgcgcaggcttcacgtgggactacgtcttcgactggaccatcctgaagtaccagcagcagggcggtaccccctccaacggccgcccggtccccgccagccagctggccggcgtggcgggcgccaacatgcaggatttccccaacgccggcgccaaccaaatccctgaggcgggggcctcggggtacaacagcggctaccccgcgcgcggcgcgactggcgccgtcggccagaccgacgaggcgcgggacgccgaggcggccctgcgccgcctgggcctgcagtgagggcggtggcctgcagtggaggagggggagtgggaggaccggaatgcggcaggcggcgtgcaggcccgccggctcgggcgctgcttcccacgcctgcccccgcgcgacgagacgccggtgagcgcgctcccggtcgcgccctcatgccgatcgcccctgtacatggaccctcgtgccagcgccgcgaggcgcggggcggccgccaggccgcactgcccccccttggctcaggccggctgccccgcgagttcctgctgcgctctgtgcttcttttcaagtgtcgaccccggcgcatgcttgccatcactgtgcatgatctggtgtgagtctctttttgaagcgtgcgcagcgaggaagggggcagtggccaggtgatgatgggcagaccgggaagcagctggcagtgggcgggacggtggatgcgcacggtggatcggggcctgtgtcgggccggcagcttgacaccccgctggtcaccggcctcgccgtcgccacgcccgcccgccctcaaagcccgtcccactgcgcgccggggcggccgcgtgccagctcgtcgacgtcacgctgcgcgcgctgcgccatgctgctgacctcctgcaccagcgccgccgcgcgcgccagcgcggcctgcgccgacagcgcgtcgccccgcgcagccacgccgtcgggcgctgggcgcggggcgtgggagcggggcgtgccgccgccctcctcctcctccccgcccgcctcgtacacctcctc

SEQ ID NO: 39109 - DNA, 61 bp, Chlorella protothecoides
ggcgcagtgggacaggtcgaagtcggtcagccgcaggtgccccgactccagcagcaggatg

SEQ ID NO: 39110 - DNA, 61 bp, Chlorella protothecoides
cgtgcttgtgataaaggaggcattgtcagtcatggtagatttaggtgcagccggtcctgga

SEQ ID NO: 39111 - DNA, 63 bp, Chlorella protothecoides
accagtccatcctgagcacggttcttgcacccaccctcttcccatcatcaccatccccacccc

SEQ ID NO: 39112 - DNA, 131 bp, Chlorella protothecoides
ggttctggtctcctccaccgtccagccgggagaaggggtgaagttccatctgcgcatggagtgcgaggatggagctggaagtgaagccactcagggacacttcgaagacctgcatgccggcgctttgggcg

SEQ ID NO: 39113 - DNA, 73 bp, Chlorella protothecoides
cgtggagatcgcggcgcacaacatggaccgtatccgactggtctgggcccgcatctgggccgtgctctccgac

SEQ ID NO: 39114 - DNA, 75 bp, Chlorella protothecoides
ggggtgtgggggggaggactgcgctgcctcacaggcgcctgaatttctgcatggcagccgatgtaccgcacacgg

SEQ ID NO: 39115 - DNA, 83 bp, Chlorella protothecoides
ttcgcagatctgcgaccctgttgcctgcctggctgcctgtgccgtgagaggttgaagccagtccccttcagagcccaagccca

SEQ ID NO: 39116 - DNA, 86 bp, Chlorella protothecoides
tggtcgaggtgagagggctgatacttgacattgtacacgcgtgtcgcaatcaggctggatgggcacaggcggcacatcgtctggcc

SEQ ID NO: 39117 - DNA, 2851 bp, Chlorella protothecoides
  modified_base (460)..(490): a, c, t, g, unknown or other
  modified_base (570)..(579): a, c, t, g, unknown or other
  modified_base (714)..(723): a, c, t, g, unknown or other
  modified_base (795)..(804): a, c, t, g, unknown or other
  modified_base (1176)..(1185): a, c, t, g, unknown or other
  modified_base (1398)..(1407): a, c, t, g, unknown or other
  modified_base (1860)..(1869): a, c, t, g, unknown or other
cggcggcggcgcgcgcgcgggcgcggccctccccaccaagaccgtgggcttcctgcgccccaaggcccaccccctgctcctggacgcgcggctgaacgggcgcgagacggtggccctcaacatcttccaggccttctgcctggcggccatgaaggtgcacgtctacatccgcgctctggccacgccgcccgcccccgccctgcttgcgcgcgcggtggaggagggcatcgccttcgtggtgcgcgccgcggggccgcgtcgcgtggcgcccgtcttccccaccgcgccgcccgtgcgctgcagcagccgcacgccgcccgcccacgtccgcttcctgggcctggccgccttcaggcgggtactgggcaggaagcagagcgggtacgccgccctgctggcctggatagacgccgagatggacagcccgggcctcaggtcggccgcgcagctgctgcagccnnnnnnnnnnnnnnnnnnnnnnnnnnnnnnngcagttcgtgaggatctacttgggtatgcatttgtaatgattggtggctcagcggaagccccatatgctaaggatgtttnnnnnnnnnngccgcgctgcagccagctgcagagccatggcagcagggctgcatagttccatgagacagttcgtaaggatctgcttgggtatgcatttgtaatgattggtggcccagcggaagccccatatgctaaggatgtttnnnnnnnnnnttggcgccgctgccccaattgcctggaacattctcatcgacgcatataaacgcacgccaaccaaacacatcnnnnnnnnnntgcccctggatcttcattcgcgcatatccgactacctcagcgcgctcgcaatctcgtagcggtaagcgaatgcaaaccagcacgcaaatggcgccgctgccccaactgcctggaacattctcatcaatgcatataaacgcacgccaaccaaacacatccagctcgttccagtgccgctcctgcgagcggtgtcgcgccatgctccacacagctcgcgctccaccgtcgtcccagcaattcctcgccttcaccagccattcggtctcgagagcttcgtctcatccaaagaggagatgggtggcccggcaggtgaggaacgctgtctcagcccgcctgatcttaacacgtgccggggcctgagtcccctggccnnnnnnnnnnacaggtgagaaatgctgtctcggcccgcctgatctgaacacgtgccggggcctgagtcccctggcccaaccccaaggatcccctcccttccccggctcctaccttgcaggcgagctccgcccccccctcgctgcagtcccagcaagcgtccggggagctgtggcgacgtgactttcccatccttgaccaaagcgttcacggccaccggctggnnnnnnnnnngacaatggcgccaccagccagaagcctgagacggtcatccgggcgctggatgactactaccgctcctacaactccaacgtgcaccgcggcgtgcacgccctgagcgccagggccaccgctgcgtacgagtccgcgcgcgagaaggtggccgcctttgtcggcgccgcctcgtcgcgcgagatcgtgttcacgcgcaacgccagcgaggccatcaacctggtggcgcagacctggggcacggccacactgcggccgggggacgaaatcctgctgtcggtggcggagcaccacagcaacctggtgccctggcagatggtcgctcagcgcacgggcgccgtcctgaggtgaggggcctgggtggtgggcggcggccgttgatgcttgggattcgcccttgcctttgatgtctcctctcactagcctgcccgccagacctgtgctgtaggtcgcttnnnnnnnnnnagtggtgggcgggggctgttgatgcttggaattcgcccttgcctttgctgtctcctctcactagtttgcccgccagacctgtgctgtaggtcgcttgctgggatagtcccttgggatcgtgctcgcacaccttgatgtgtgtgccactggcaccaggcacgtgtgctgccaagttcgtcccatgccctctcaacccatgttcaaagtttctgccccgactctccctcttcccctcctccccacccccaaaaggcatgtcccgctgaccaaggacaccgaggagctggacatggccgccttccacgacctcctctccccgcggacgcgcctggtggcgctagtccacgtctccaacatgctcggctgcatcgctcccgccgccgagatctgcgaggccgcgcacgccgtgggcgcgcgggtcctcctggactgctgccagtccgtgcccaacatgcccgtggacgtcggccggctgggcgccgactggatcgtcgcctcagcgcacaagatgtgtgggcccacgggcatcggcttcctctggggcaggcaagctggttgattttgggggtgcgagcgggggacccaaggctggcggccgtcctcagcgcagcgacgcacctctttcctgtggatgcaccgagagtgggcaggcatgctcaccaggtgcctagtcctgtgtgcttgccatgcgacccagaccatcctgaacccccgcacactgtccgaccttcacccaggtacgagctgctggagtccatgccgccctggatgggcggcggcgagatgatccaggacgtgttcctggaccggtcgacgtacgctgcgccgccctcacgcttcgaggcgggcacgcccgccatcgcggaggcgattggcctgggcgcagcctgcgactacctcacaactcttggcatgcaccgcgtcgacgcctatgagcgggagctgggcgcgcacctccacgaacaggtgtgaggaggggggg

SEQ ID NO: 39118 - DNA, 61 bp, Chlorella protothecoides
cccggtgcgtcgcagtttggatctgttcttcggagggaggggttgggaggagaggctgctg

SEQ ID NO: 39119 - DNA, 61 bp, Chlorella protothecoides
tgcaaccgccgcaaggggctcaggtccgtgagtgtgtgtgtgtgtgtgtgtgtgtggtttt

SEQ ID NO: 39120 - DNA, 599 bp, Chlorella protothecoides
gggcgacggcggcggcgtgcaccccgacaccgcgcgccgcgccgtggacgcgctttcttacctggcacgacgccgcgtggaggacgtcgtgtgtgcgctggccgaagtgcgtgtgctggacctggaccgcgtgttcctgggcgagggcgtgggcgaggcggaggggagcgaggcgccggcaggcgtggacggcgaggcggcggcgggcgacgtggcgatggggatcgacgtgcccgacgccggcagcccagcccgcctcgccccctcccgcccgccgacgtgcctggaggtggtgctgcgcctgcccacactggcggcgtgccgcgccagcccgggcaacatgtcctcggccgtggacctgctcgagtcgctggccggccccgccgagctggccgccgtggagcgctgggcggtgctggaagcggaggcggagcgcgcgcgccgcgccgtcgccccgtccggcccagacggcggaggagggagggaggctggcggcggggtgcaggagagcagcggcgatgccggggccgggggagctgctgtgagtggcggggggggcgcggagaccgcgcctgcacccgccgcccccgccggccatg

SEQ ID NO: 39121 - DNA, 130 bp, Chlorella protothecoides
tgtgatggcatgctgagcagcatgggcagactgtgggaggaccaaagccaatatagacaagattgttgagttcgctgatttcctgtatgccagtgaagacgagcctgaatctatctcacagcatcaacgt

SEQ ID NO: 39122 - DNA, 61 bp, Chlorella protothecoides
tgcttaccccaagggacgcacacgcacacacgccgtctctccccaccttgatcatctccag

SEQ ID NO: 39123 - DNA, 107 bp, Chlorella protothecoides
cagggagggaagccgtatggtgtccgggtgttgtgtgcgacggcgcgagggccccagtcgcccgccctccaaacaagcccttccttccgaatgcaagcaggccgccc

SEQ ID NO: 39124 - DNA, 109 bp, Chlorella protothecoides
tctttcctgcctgtcccagcggccctgtggcgattatgggggaagaggacgtttggaaaccacggctggggcagatgctggagcatccctgagagtgcatcattcctcc

SEQ ID NO: 39125 - DNA, 76 bp, Chlorella protothecoides
aggacgatccgtgagtttgaatgtccagggagagggctttgattcaggggcgtctgtgatgcattctgcatgtatt

SEQ ID NO: 39126 - DNA, 438 bp, Chlorella protothecoides
  modified_base (119)..(329): a, c, t, g, unknown or other
cacgatgtggtcctggatgaggccgcgcagaggcttgccatcggtgggcacgaagaactggtggtcggcggagacgatgccatacccttccgcccgacccagctggtcctggggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggagggatgcgggagggatgcaaaggcaaaccacgcgcacaatgggggcgcgctgacgagcattttgtgacggtatgaacaccaaaccccaccgctcacccctcatg

SEQ ID NO: 39127 - DNA, 135 bp, Chlorella protothecoides
tactgttttaacagatctagatgttctgttacacaaatgagaaatcagtctctgttctggagacgaggcgttgtgtctatggggtgccacatctcactcggcgttggcatcataggaaagccagacgcgcccaac

SEQ ID NO: 39128 - DNA, 105 bp, Chlorella protothecoides
tcagtgacagtgctgggcaatgtctgggccggtgatggcgcccccggggcctctgttttgttgctgggtcccgcaccagatccgaggctcagacccatcagggat

SEQ ID NO: 39129 - DNA, 67 bp, Chlorella protothecoides
tgatcaccgcgcatggtggactctgcagcgcggcgctaggtgcagcaatgcctatgccctgacggtg

SEQ ID NO: 39130 - DNA, 61 bp, Chlorella protothecoides
ttgagcgactttggccagtttctgaacgcctcttgtgaaaacctattggctcaatcctcat

SEQ ID NO: 39131 - DNA, 73 bp, Chlorella protothecoides
tggacggcgctctgccgggccagcctcacccgtgcgcaatagccaaacttcccactcttaggcccacctgcag

SEQ ID NO: 39132 - DNA, 76 bp, Chlorella protothecoides
tcgcgaggcagctggcggaagggcgggcaccgacgcaagggccgcgttctcaccgctggccgactccgtcgcccgc

SEQ ID NO: 39133 - DNA, 133 bp, Chlorella protothecoides
gtcgtgatgcagtcgtgatccctgcacctggccctgttctgaaaggtgatgatggtgcatcagctgccctgaactgaagaatgaaatatacaacatgcaatgcacccaatcaggtgaatgtcatacattcaga

SEQ ID NO: 39134 - DNA, 100 bp, Chlorella protothecoides
ccccccgccagcagcagcggtggccgggtctgcaatgccgccggggtcttcgccggcgtccgcgcccccaccagcagcgcctccgccagttgcagcccct

SEQ ID NO: 39135 - DNA, 140 bp, Chlorella protothecoides
aggcacgagcatgacagagggcctggacgcggcggcggcgggggagggcctggagtccggcggctggctgggcgccggcggcagcgctggcacccactccaacgctggcgccacggcgccgggctccttcctgccctccg

SEQ ID NO: 39136 - DNA, 61 bp, Chlorella protothecoides
caccccgcgcgacatcagctccaggaacttatcctgggcctgcgccaggtagccgtgctgc

SEQ ID NO: 39137 - DNA, 75 bp, Chlorella protothecoides
gttgtgcgcccagtgcctctcggcgccctcggtcctacaccccagctcccaccctgcttgccacagctgggcggc

SEQ ID NO: 39138 - DNA, 61 bp, Chlorella protothecoides
caccggcggcaaccgcaccaagacccctggacccggcgcccagagcgcgctgcgcgcgctg

SEQ ID NO: 39139 - DNA, 137 bp, Chlorella protothecoides
tgcgcatcttggtgatcgcgagcgcggtttcactccatagcccagctaatcacccccgtcccaggggatgcatccttctggtcccgacaagcgggctggggattgggatcgtggcgggaaatgccccacgcttcctt

SEQ ID NO: 39140 - DNA, 61 bp, Chlorella protothecoides
cgacatggggtgaggaatagagtgggtggggggcacgcgctggaactcgaccgacgcccag

SEQ ID NO: 39141 - DNA, 6217 bp, Chlorella protothecoides
  modified_base (341)..(350): a, c, t, g, unknown or other
  modified_base (661)..(670): a, c, t, g, unknown or other
  modified_base (852)..(861): a, c, t, g, unknown or other
  modified_base (1550)..(1617): a, c, t, g, unknown or other
  modified_base (2025)..(2037): a, c, t, g, unknown or other
  modified_base (2137)..(2146): a, c, t, g, unknown or other
  modified_base (2513)..(2522): a, c, t, g, unknown or other
  modified_base (3304)..(3313): a, c, t, g, unknown or other
  modified_base (3943)..(3952): a, c, t, g, unknown or other
  modified_base (4161)..(4170): a, c, t, g, unknown or other
  modified_base (4327)..(4336): a, c, t, g, unknown or other
  modified_base (5056)..(5065): a, c, t, g, unknown or other
  modified_base (5906)..(5915): a, c, t, g, unknown or other
cccccccccgacctgtcctgcagggaggcggccctggcctccaggtccctcaagtggtccaggccctccgtcacccgacgctcggcgtcccggagctcagcctctgcgtcagcacacacagcctcgcgctgggccagggcggctagaccccgggcggcctcggcggcctgtgcctgcgcggccgcccgctcccgctcgacgtctgccaggtgcccccgcagctcccgcatctgggtgtccagggccttctccctggtctccagcgcagcgcgggccgcctcggctcgctgcctcctctcctccagcccggccgtcctgcttggtgtggaggaaagggatgnnnnnnnnnncgtccagcgccttctccctggtctccagcgcggcgcgggccgcctcgactcgctgcctcccctcctccagcccgaccgtcctgcttggtgtggaggaaagggatgctggtctcgataatgcagccacagcagagctgccaaagagcatggggggtacactggtctggctgcatatgtgccgttcccttccatgcaagtcaaggggccaatagacacctctgcatgtatccagagtccaaacaaaatgtccagcactgctcccacatcccccctctcaaccctcccgcaacctcactctgctttcagctgtnnnnnnnnnnttgtccagcactgctcccacatcccccttctcaactctcccgcaacctcactctgctttcagctgtgcagcctgcgcctccagagcagcccgctcccgctcctggttctcctggcgggcctgcacctcccttgtctgtgcctccagcttcttggagcgggcttccatcagagtccgctcctnnnnnnnnnnccctcctggcgggcctccacctcccttgtctgtgcctccagcttggtggagcgggcttccatcagagtccgctcctccgccagctccgcctgcgccagacggaccgcctcccgctcccgccgcacctccgcagcctggcgctccgcctccgcgcgctggctcgccagcctcttggcctcctcctgggcgtggccgctgtcccgggtcacgctgcgtgccaccgcctgcccccagagtgtgaaaaggaatgagtgtttcatcagtctcatgccgcacccagcggaaggattcatgtaagagttccgccgcaaccctcccgtcgcctacccccgtcccacacatgcatgaatcgaaagccacttgcctccagggaggcctgctgggcctgcaggcgcaacgtctcggccgcggcgctccgggctgccgcctctgcgtgttccagcttcccgctagcttcctttgcctgtgcagccacgcgttccgcgacggcggcgaggccctcccgccacccctccagtgccccctcccgctctgtcagcgctaggcgacgctacgagttttggaaagggtaacatggagccggcagagagggacggtggggtctgtggcgggcacggctgcagtgagggagtcgcagccctcggtttcatgggtcgcaacaagcacggaaacccctccaaacgatcccnnnnnnnnnnnnnnnnnnnnnnnnnnnnnnnnnnnnnnnnnnnnnnnnnnnnnnnnnnnnnnnnnnnngctcccggtcctcggcgacgcccggtgcggggaggggctccaagcccgccagctccggggcaggtggggcaatggcagcggtgggggggtcctggaggggcccagctggggcggccgccgttccaggtgtttgcgtagtcccacccaccagctcgcgctcgcgctgagtcagcaggccatccagggccagcagcgcgtggtgcgcttcgcgcgctagctcagcgtcacgctgggcgcgctgcgcggcggcctcggccttccgactggcgcgctcagaggccgccgcctgctcggccacgcgagccgcctccctggcatgcctagcgtgggggaagggggaacttgcttgggcatgccgggtgggatgtgggttggaggggtggacggaaggggtccttgcgatgtgannnnnnnnnnnnncccgtgcgtccactccctctgcaaatgccccctgctccacgcccctcccagcacccatgacaacatcgtaagcctcgcagccgcgcgcctcaccccgccnnnnnnnnnnccatactcattcaacccagtggcatgctgctgtcagagagtcccatgcagtccagccacacacagaggtccctgcgtcactccctctgcacatggccccctgctccacgcccctcccagcgctcatgacaaaatcgcaagcctcgcagccgcgcgcctcaccccgcctcgcgctgctgaagggctgcagcaccagccgccaggtcggcctccctcttggccagggcctcctcctcccgccgggcgccggccagaagctcccccgcctccttcagctgggcctggctgcggtccgaggcggccgccgccgccgcctccagctctggtgtgcggatgattgagggtgatgcatgtgcttgtgggcgacnnnnnnnnnntgcctccagctctggtgtgcggatggttgagggtgatgcatgtgcttgtgggcgacggagtgagcgtgagatcacagggcacgacactgcggtggcacagccgcacagcaccaggcacgcaccccgggtgcactctcacccacaaacctcatcatgatctccccacctgccacccgggcctcgcgcgcatccagctgctgggcaatttcctccacctgcgccagcgactgctgcacctcctgggcctccgcggcgttctgcggagtaggaacagggtgtcgcggtgacacaccgcaatgcatcggcacccccaaagtttgcaatcaagatcccatccacattcctcagcaccctcactccatcctccccacctggcgctgcgcgtgctcgacctcgcgctcgcggcgggacagctctcgctccagcccctccagcctggccctggtctgggcagcggctgcctcccgctcatccagctccgcacggcgggctttgagccgcgcctcgccctcctccacgccctcccgccgggccttcagcgcctgcagtgttgtcgtgaggggggggttcacgaggtcacagggtggtggggcccagctggatctgggcttgagatggtttgcattgtcgaaagtcatttgcgctcctgcagctaccaccgcctgacaggggatgcagcgagtcgagctggcagccgccggggcgctcagcagcccgacccaaaccgccctcacaccaacgccaccctccgcaacccacccgcgcggcctttctgtcgcggnnnnnnnnnnacactcagcagcccgacccaaactgccctcacaccaacgccaccctccacaacccacccgcgcggcctttctgtcgcgggcctcggcctccgcgacgcgctcctccagctcacgagcgttggccaggctggcacgctcgcgctccagcacgctctcctcccgcgcggcggctgccgctcgcacgtcgcgagcctcggtctccagctcccgctgctccgcctgcagccggctctgccactcctggagcaggccctcccgctcctggatctctctggtcgcgctcgcctcaaactctgcctgctgtgcctcgagcgccgcccgggcctctgccagctcttcttcttttgcctggtgaggattgtggtcgtgggagtggggaaggctggggcaggcggcgactgcaagcgtgcgcatgctttggtagacccagaaggcgacatgcatgctttacgctgcagagattgcgatcccttgtctggccgccgctggcacagcaaaggcattgcaaggtcactgaatggtgcccagcccacatgcgtaccatgccaccttgtgcagcacgaccaagaaggcatcgagacacatcacgtaccacacccaaaactctcgactccacccacccacccaccnnnnnnnnnntaccaaaaggcgacatgcgtacttaacgctgcagagattgcgatcccttgtctggccgccgcgggtacagcaaaggccttgcaaggtcactgaatggcgcccggtccacatgagtaccatgccaccatgtgcagcacgaccaaggaggcatcgagacacatcacataccacacccaaaactctcgcttccacccacccacccacccacnnnnnnnnnngttgcgccggtcggcctccagcgcctccagcgcctcccgcagcgtcttgccgtcggcctccaggcgggcctgggcggcggcgcaggccacctgctcctgcgtcaacgcggcctgttcctcttccagcgccgcgccgcgctcctcggcggcgcgccgnnnnnnnnnntggcggcgcaggccacctgctcctgcgtcagcgcggcctgctcctcctccaccgccgcgccgcgctcctcggcggcgcgccgcgcggcgcgggccgcctccaggtcggtctcctgctcccgacgcagcgcctccagctcgatgcggacggcctccagcgccgcctcgcgcgcacgcgcatcctccagccaggcggcagcctgctcctcaaactctcgtcgctcccccgccaggcgcgcgtgcgaggcgcgggtcccctccagctccctccgcgcctcctccagcgcagcctccagcgcggcccctgtgtctctgccagcctgcgtgtggtgtgtggtgtggtaggggcacgggtggacttccagctgccgtgaccacgagcggcagcgtggcccatcgctgccaccctgggagctgtattggatgccacgccgctgagcatcgggagcaaccccttctccctgttcgctgatgaccatcagggctcgacagcctttcctcctgctacatcatcacgccgacaatacccatcacagaaaatgccttccttgccagcgcacccctctcttgccaaccccccaccccaaaaagcctccatactcgcctcctcctcggcggccgcctcggagagcaaggcgtccctggcctcctccgcgccgcgcatctcctcccgcagccgcgccagcgcctgggttgcctcggcctcgccctcgcgcgccgnnnnnnnnnngcccgtgtctctgccagcctgcggggtggtgtgtggtgtgctaggggcacgggtggacttccagctgccatgacgacgagcggcagcggggcccattgccgccaccctgggagctgtatttgatgacacgcccctgagcatcgggagcaaccccttctccctgttcgctgatgaccatctgggcttgacagcccctcctcctgctacatcatcatgccgacaacatccatcacagaaaatgccttcctcgccagcgcgtccctctcttggcaaccccgcacccccaaaaaactccatactcgcctcctcggcggcggctgcctcggagagcgcggcgtccctggcctcctccgcgccgcgcgtatcctcccgcagccgcgccagcgcccgggttgcctcggcctcgccctcgcgcgccgccagcaggcggcgcgtggcctcctccgcgctccgcgccagctcctgcacctgatcccgcagggcctggtgggacgcctcgtcggaggcgcggcgcgccgcccgctcgcgctcggcctcgcgcgccgcgtcgcgcgccgcgcgctcccgcccctccagctccgcctcgcgctcggccgcggcacgctccagcgatgcccagccccgggccagggcctcctgcccctcctccagctcccggcgctggccgtcctgctccgcacgccgggcctccaggccagttcggcccgcctccagctccgcctccacctggacacgcatgggcgggcgtgaggatggcatactgaaggaaggtcgagagggggaggcatctctccccagcctcccccatcaaacccgggctggttcgatgccacacaccgcnnnnnnnnnntggatggcatgccgaaggaaggtcgaggaggggaggcatctctccccagcccccctcatcgaacccgggctggttcgatgccacacaccgcgtctcgagctaattccccccccaacagtcccagactcccgagctgaaggcacctctgccagctggcgcgcccttctttccagctcggccgcctcggcgcgcaggcgctcggcctcggcgcgctgctcggcagcacaggcctcggccccggcgacgcgcgcctcgcgctcccgcagcgcgccgctcgccgcggccacctgggcctggaagtc

SEQ ID NO: 39142 - DNA, 77 bp, Chlorella protothecoides
gtactctacacagtcggcacccctccccccaaaaaaacacctccttcacacaaccacaggtatgtggctgtgctcaa

SEQ ID NO: 39143 - DNA, 61 bp, Chlorella protothecoides
catgtccatggcagcaggcaggggaggcggtggcgcaggaggagctggcgcccaaggagct

SEQ ID NO: 39144 - DNA, 67 bp, Chlorella protothecoides
ccaagtggctgacgagaagggcgtcgccagtcagcgcgaggggcggacgagcctgtcgcgccgccgc

SEQ ID NO: 39145 - DNA, 95 bp, Chlorella protothecoides
ttcagagtcgggagcaaggcacccacatgtgatgctgactgtctcccttcctcctcccctcccacataatcctcctgcccaccttgtcgcgggag

SEQ ID NO: 39146 - DNA, 61 bp, Chlorella protothecoides
ggaaggagacactctgtttggtggcgggggtgacagcaatgctgtctgagatggggaccgc

SEQ ID NO: 39147 - DNA, 13730 bp, Chlorella protothecoides
  modified_base (805)..(814): a, c, t, g, unknown or other
  modified_base (1681)..(1690): a, c, t, g, unknown or other
  modified_base (2444)..(2453): a, c, t, g, unknown or other
  modified_base (4116)..(4125): a, c, t, g, unknown or other
  modified_base (6357)..(6366): a, c, t, g, unknown or other
  modified_base (7098)..(7107): a, c, t, g, unknown or other
  modified_base (8740)..(8785): a, c, t, g, unknown or other
  modified_base (9078)..(9087): a, c, t, g, unknown or other
  modified_base (9187)..(9196): a, c, t, g, unknown or other
  modified_base (9277)..(9338): a, c, t, g, unknown or other
  modified_base (10029)..(10038): a, c, t, g, unknown or other
  modified_base (10103)..(10112): a, c, t, g, unknown or other
  modified_base (12459)..(12468): a, c, t, g, unknown or other
gcggccgcgccgccgcagcggcgcggacgaggtgcagcaggtccgccgcgcgccccacggcggggtgcccggccagcagccgcgcgaccagcagctccggccaggaggtcgccaggcggctgctctgctccacatcgcccgccatgcaggccagcagggcgcggcagggcgcctcgtgctccccctcccacagcgatccctcccccagcaccagggcggactgcccctgccagcgcgcgcggtacgacagaaactcctccgcgcccgacagctcctggccggcgccagagtcggcggcgccgcggcgggggctgccggccgctgcgcccgcgcccgcgaggcgggggaagcagcgcagcagggaggccaccgcgtccagggacctgatgcggccggccagggcggggtgcagcgacccgccggacttccacgcagcccaggcggagtgcaggcccagcaggctcagggcgtcggccgtccagcctaggcagacgagacgctgcggcaagtttgaaagggtgtaaagggtttgggcttgtggatggagagaccaggtcaatctagctttgacatcggcattgaggttccttgatgacctccagtgctcttcccatgcgggtctctgtcaccccgggccccgacggtccggggtgtagaagtccagtcctggcgccaggccagcagtctcaagacagacccacagggtggtgacaccgaggcagcgcccgctgtcgcggcggcatgcgcgatgagcgccccagattcccattctcgcacctgaagcgtctcccagtagccttccgtnnnnnnnnnncaggcagacgaggcgctgcggcaagtttgagagggtggaaagggtttgggtgtgtggatggagagaccaggtcaagctagctttgacatcggcactggggttccttgatgacctccagtgctattcccatgcgggtctcggtcacccggaccccgacggtccggggggtggaagcacagtcccggcgccaggccagtagtctcaagacagatccacaggttggtgacaccaaggcagcgtccgctgtcgcagcagcatgcgcgacgagcgccccagatacccattctcacacctgaagcgtctcccagtagccttccgtcagctctgggtagtcggccgactcaaaggcggcgagggaggcgggggacagctgtctgccgccttccccagccaggagcacagcagcattgacctgaagccagctggccagctcctgtaggcgggaagggagagaagagtcccccatgatccaggctgagactctcgtgacagggcgtgcagtcagggcttactggacccctctggaataaagaatgctgcccggtccacaacatgcacccccagctgtaccaagcgcaccctctccatgcccttgcctcccaccctgccctgcataaacactgagtccctatatccccccccacacactggggaaggcagcgcacctgtgagatgaggcggtctgactctcccatgccgccaaagaagagggagagtattgtccagagagcacgctcctctgcgatgagctgtgcctcctcatcgaagagcctgcccaagtttgagggaccactgggatggacacactgtggccgataagcttctgggaatcactagaggagctgggtggcaggtcttgaggtgaannnnnnnnnnaacacactgtggccaatgagcttctgggaatcactcgaggagctgggtggcaggtcttgaggtgaagggcaatcaaagcagctgccttcccccccttactcttcgtcgtcagggagacttgcgtccatgatggccccgacgtcggtacagaactgctctagttgcgccggacgcagaaggggatcacccttgacctgctcacactctacatacttgacgtgcgcgtcgtagatgatgcggcgggatatgggccctgggcagtccctgcaagggtgaaggatgagatgtgtgctcgactgatccatgacgcagcgtccgaaaatgtcccttgcaaggtaagatggacgattcgctgcttccctgcgtcaatctcattgcccagagtgtacggccagcccaggtctgctcaccactgtactgccgtcgaggtgctctcctcctccccaagctgaccctcagaggagttcaccgcacagcagtaaagctctgatccgggtccccagctgaatcttaggcgctggtgggatccacaaggcactctagcgagctccgttgccatcggaaagtgtcaacactattccttggcagccccaggatcccgtctgtcacacgactttgccgggaggcggcatcagttgagaatgcaggtatggtatccggtccaggcaactttcctctaacatctcgtgaggcgcggatgaggcactttgtcttttcgtaacgcaagcggcaacagcaccaaatcgcgcgctcnnnnnnnnnncgtatggtatccggtccaggcaagtttcctttaacatctcgtgcggcgcggatgaggcactttgtcttttcgtcacacaagcggcaacagcaccacatcgcgcgctctgagattcgcatgctgggacttgtggatcaggattccccctacggaaaaccgaccctcctgttcatgctgtaggtcagagctgggaaaacgtcgagcttttcagattcgtctagaatatagcatcccaactgaggtttctgagggcgccagcaaggacgcgacgctgaattcaataggttctcagaccagggcgcacgaggccaagcacggtcgcgcacactgaacacgccctggtttgggagctgcagctcaggaggccataccgcccatggcaggatacgccaccgtgtctggcgtggccagagcatgcatgccagcatcctccctgaaaggaagagtagtgctgccccctccagtgctcgggcatatcctcccccatgggtacgagcaggaaggcgcatgcctgggagcctgatgcgaaccatggacctacctgtgcttggctgcaggccaactccgccgcctccacaatgttctgcaggcgtgccagcagaggtgtccgagccgtggagcgaagagcaagccgacccttccaggcagctcacaggacgccgagaatgacggtgaggtgggcacagggcccttacttgagtgttgcacagcaggccattcaagcagggcgcagggcctgtgcacctgactctccaccatctggcactccaggttgtccgggctgcggcggactctccagagggccattccgtacagagttcgagcgtgagctctggcatcaaattgaaaggggtaagaatacagattgaggatgttgttgcaagtgtgtgagcgagctggtgacaagatctggcgtgctgcaggattcagcatgctggggtcctgcccctccctgccccagatcaccaagactttcaagggcgagacagtcttgcatgacgtgacatgggaggtgaagaaaggtgagaaagttggtctcattggcgtcaatggcgcagggaagacgacccagctgcaggtgacctgaggggcttgcacagcggaggtgtttgggggactctgggcggggccactctcaagctgagacttttcgtgctgaatgggaatgtttaccacactgcgccctggagcacagttgccctcctcgcacagagacctgttgttttgccatggcttgctaccccccatgagccttggttcttacggttgtctgccatggacaaggagtcaacctgtgagcatcacccagacccctcccacccacacctggctcagattatcaccggcaagatcttggcggatggcggggaggtgatcaaggcgcgggccgacctgcgtgtcgccatgctgtcccaggagtttggggtgcagttggggcgcacacttcgtgaggagttcctgtcggcgttcgaggaggctgtgcaggtcggcgaatgagcgaggaactttcattccgtcatgggattggggggttggggtcgggagggcgcacaatgttttggtggctgggaaggcactcgttcctgggaggcctggggaatgcaaggcatgctggcctcacccagccagctccagggcctggccccacccgcgacatgcatgnnnnnnnnnntgaatgagtgaggaactttcatttcgttatgggattggggagttggggtcgggagggcgcaccatgttttggtggctgaaaaggcactcgttcctgggaggcctggtgaatgcaaagcatgctggtctcacccagccagcttcagggcctggccccacccgcgacatgcatgtgcaccaatcgtggcaccttcccccttctcccacacagaacgccaagcggcaggaggagatccaggctgctctggagaatgtcggggaggacatggatgccatgggcgatttgctaggtgtgtggggccggccatccaggtccagggggccgtgggaacccggagtggcctgctccctgcggaagttgggtcgctctcccctgcctccagactcccacaccctgctccgcaccgcgcagacgagctcacacacctgaccgccacggccgtggagctggacaccagcctgatcgagaagcagacccagcagatgatggccaagttggggtttagcccggacgactcggagcgcctggtggcctccttctccggtggctggcagatgcgcatgtgcctgggcaagatcctgctccaggtgtgaggggggcctgggaaggcgggcgccgggctgggcggcgggcgccgggttgagaatgggatgcaggggttggtgcgcagcacctgcgggcgaggagctgcttcctcatgcccggccagggtatggaagagccatctgcgcccggacttgagggcaccagacgcatgcaccgcctcggggttgctggccttgcgagcctctggcccgtctcaactgcccacaccctcctccatggcgcatctgccgacgcaggacccagacctgctgctgctggacgagcccaccaaccacctggacctggctgccatcgagtggctggaggggtacctgagggagcaggagatccccatggtcatcgtgagccacgacagggagttcctggaccgcctgtgcaccaagatcgtggagacggagcggggcgtcacgcagacatacaagggtgcgtctggtatggagagcctgccctgctgggggtgggtgtgaggctgtcgggcaaaggggatgggcagcccacacgatgcatggttgcacgcggcggctatgaaagaggggtgttacggcattgatgcagcacctctgcgcccggaagggtgtcagcatggaacagaccccagccgcacccccatgcctgcagggaattactcggcatatgtggcccagaaacgcgaggcacaagccctgcagtgggctgcttgggagaagcagcagaaggagatgcagcgccaggcatggtgttgctggaggactgggggactgcctggctgtgtggtggggagatctcggagttcgaatccctcacccatctttgctggccagaatcccagcgactcgtgcgaccgaattcagcctggcatgcatccctcccatgcgcgcagagcgacatcgtggcacggttgagtgccggggcgcgatctgggcgcgcctccaccgctgccaaggcgctggagaacctgaagtcggagggcgtcgtggtggcaaagccgtttgtgcccaagcgcaggtggggaggccggctgggggtgcagggaggccaggtgtgcatgcatgctggccgcaggctgggatcatgaggtggagggcacatgagtgggaggtggatcacaactctgagtgttgcccgcccccatcgtccacttgctgaggatgggggcgggcaacactcagaccccgggggggatgcccagggtctgtgtggtgctggcgtccactgtgccacgctggtgtgagcagcacaatcccactggaatcggtggctcaccgccgcccctcctgcctgccatcctgcaggcatttcaccttccccaatgtggagcagatggggctgatggccctgcaaatacagaatctgacccatgggtatgacgacaacaaactcctgtccaaggtcaatcttgtcgtggagaggggggagcgtgtggccctcatcgggccaaacggtgagctgtgtgccttgcatgtttgttggggagggggcgccctggggtgtgtcagggctcttcctttctgcatcggaggaggaaggccagagcatttccggtcgcagcctgctcctgtcctgccctcctccactcacacactgttccactcccttccccatctggtccaggcgccggcaagtccaccctcctccggctgatcctgnnnnnnnnnnccccactcccttccccacctggtccaggcgctggcaagtccaccctcctccggctgatcctggggctggagaagccctggtctggtaccgtggagctggggcagcactccatcgtgcccaactactttgagcagaaccaggccgaggccctggaccccaatctctcggtgcttgagaccctggagaggtgggctggtgcagtgaaagagggggaagaattgggtggcatacgcgcgtgcgcaggcgctgagccttgcagatggcgaggagggggaaatcgtgcagctaccatgaagttccgtcaactcatatccactcgcttgtctgccttgcagggctgcgccggacgctcgcatggatgatatcaaggcactgctgggaaggatgatgttcaccgggactgcacaggagaagacggtatgtcgtgcaaactgagcgcctctggatggggccagagaatggggatggggcctggaggagaggaaggtgcagtgagggctgggtgtgggcggccacaaggtgtgcagatgcaggtgcacggctatagagacccaataattcacacccacacctacaggtcaagtggctcagcgggggcgagaaggctcgacttgccctcgcaaagttcatgctgacaaagggaaccctcctggtgagattatggatgcatgctggagctttgggtggaaacaggaaggtgcaggaaaggtttccctgcgtgccatccctgcnnnnnnnnnncctggagctttgggtggaagtaggaaggtgtaggaaaggtttccctgcgtgccatccctgcttcatgaccagctggccaacaccatacctgatgcaggtcttggacgagcccaccaatcacctggacatcccgtccaaagagaccctggaggaggcgttgcaggcgtttcagggtgagttgtttccatttgagggtggtagggatatgaggctgtgtaagagactgagtctgcgctggaccaacccctctggcgtgtgcagcaggcaggggcagtaccaggccgcgcaacccttgtttgacagctgtagcctccctactatctcacagggagtgtggtggtcgtctcgcatgaccgctacttcctgaagaaggtcgcaactcgggtcgtcggcgtgggaggaggcaaactcactgactatcaaggggactacgaggtgcgtatttctgtcttgaggaagaacaggtcttgaagggattcgtgcatggtatgggctttgctctagagccacctgaatctgctggtatcatgcgctggacgctgaatcccggcatatatcacagtgtggcttacccataccctccatgcgcccccattgtgtgcagttcttcctgtccaagaacaaggaggaggggagcatcatgaaggcaaaggccgagcgggaccgggacctggaaaaatcccagatcaaggccaagtcaaagaagaccaaggcagaaaaggtggggcttgctgtgtttggttgggacttggtcatcttattgcttgactgacgaatgccacagcggaccacatagccacattgtgggacgagcaaaataacagtctcacaagcagcgcggcctctcctccaccttatccagatgcaagaaaagaaggccaaggctcagcagtacagcagcggcgcaaactcagccaagaaagcaaccaagaatgccaagcgttgggcgtgagtggcaggtgccccctgtggtgtttgtttcgcatcctgcccatctgtaaaatactccttgggaaggcttgagtggcacagcacaggacggcaggtgtggaccctacctgagcagtgatcaccgtgtgccgcagttgtaagtacctccgccggtccatccggaacaccgtttagagcattcctttgggacgagcacgagctggaatgtgtgctggaaaacggatgctatatgctcctcacctgccgcatggtaagcacttccatatccaaaattgtcaacgttcatcacaagttcgcgaaaggtctccggttcgaacccggacgaaagcagtgcacaaagctttcgtggtgtagttggttatcacgttcgcctcacaaaatccaggctttttgccccattgcaaaacaataccacttgtgccaggcccctgcacgagcgcgcattcttacgaggtcgcctagggggcgggagaggtagcgatttctggggccactctgtctcccggcctcgagagttttggagggaccagctctgacaatgtgcaacgtaacccacagactgtccagagcaaaggccgttacaacctcagtggatgggtattgcatccaggcaagcaggtgtcccttggtccaagtttgacatgggaataggtaacgtcgcatgatgggtggcgtgatgggnnnnnnnnnnnnnnnnnnnnnnnnnnnnnnnnnnnnnnnnnnnnnngtggacgaggaaacagggcatgacagaacgatccatcaaggaagggtagaccaacaggggtaatgctgtgcatgaccagtggagtcctttaacatgcatggtaagtcacagcaatcgcgctgccagcactggctgtcctgcagccagacacaatttgctgccaccgctcatgcgccacttgagattggtcctgaagggtgtggcgaggcaccacacacccctgtcagcccacaccatttcccgccagcgattggcaccctgggtacatcactggctacactcatggggtcagnnnnnnnnnnctcgagggacctgcgctgacaatgtgcaacgtaacctgcagactgtccagagcaaaggccgttacaacgtcagtggatgggtattgcatccaggcaagcnnnnnnnnnntacatgcatggtgtgtcacatcgatcgcgctgccagcactggccgtccttcagccagacacaatttgctgccaccgctcannnnnnnnnnnnnnnnnnnnnnnnnnnnnnnnnnnnnnnnnnnnnnnnnnnnnnnnnnnnnntgcgccagcgattggcaccccgcgtacatcactggctacactcatggggtcagtgggcagatacattggggtgcccgcgcatcaaggctgtgctgggcagagctgacagcatggcgagttcagagcgtcgcattaccaaggcaggggtggaccgacgctgcaaggttgggggccctgctatgagtgggcgcccatgtaccgtgccagggtgatgatgtcaccaaacacgcccgcggcggtgatggcaggccccgcgccggggcccctcacgatgagcgacgggttgcagtaccgggaggtggtgaaggacacgatgttctcagtgctggtcaggcccgcaaaggggtggctcttggagaatcggcgtggaccgacctgcaggcagggagcgcaagggttgggagtcggatgagggggtatcgcagggtggctgtgtgcctgaaatcgacactggatcacacaggggaggaagggttgagcacccactccggccccggggcatcgcttcatcagggatacgatgctgacaaccccccatccctgccgccaggccagacctgacacactccgctctccgcatcgtaggaacccacgtagcgcagcacctcccccgcatcgtcgacctccctcaagcgcgccgcccactcatcgtcaaactgcaggtggggggggggggggggggggggggggnnnnnnnnnngacctgctcataggctcgtaggacccccgggggagagctggtccgtgccgcaggttgatgccggnnnnnnnnnnaacctgctcattggctcgtaggaccctgggggggggagctggtccgtgccgcaggttgatgccggctgactcacccccagcctacgggcaggcgccctgcctcgacaccctgccctgccagcatgatgaggagggcggcccgacctcaagtgccccgtctgtgtcgaccagctcactccccaccttggcgagctccgtcatgaggtcccccccgtcctccagattccgcagcggttcgggcaccaggctctctgtcggcacgtcggacagctccagctcggcgccgcactcacgcgccagggtgatgattttccgagtcacgtctgtgcctgatggggtggaaggcaaggagggtgctgcgatgagtgctgcgtcgttgcgcaggaggtgatggagggagggcacatggtatggaagatgatctgtgcacctgctggtccactcgccgccatgcccaccaaggcagcagcacagggaggagcctgttcctcaccatgtcactcagtcggtgcctgaccgtggcaggcactggcagacttccaggcatgccttcatctccacacgtcgagccatccatccatcctaaatcgggggtagccccagaccaggacaaccccggccacccaccggagagatcctctcgcgcatccggctccgtatagcccctgcgcttggcactccacaccacttcgctgaatcgatcgccgggcttcattgtgttgaaaatgtacgacagcgtcccactgcgatgcgagtcgggagggggccaggtaaagtcagggtttggactggcagtgcgagcaggtctgggcatgggcggggctgggcatgcacgaggacatgatctcatggcactgaagcacgagtgccgtcacccacaagggccacactgggaggcccacgccgtcacccacccgcccccagccccgctcacctgagcaccccctcgatgcgcaggatgtcgtccccggtgtcgagcagcgtcttcagcgtggagatgatgggcagccccgcgccgaccgtgccctcatacatgtagtgtgccgcccccgccgcctgcagcgtcttgaccgctctccaggcggggtatgggcccgagttcaactttttgttgggggtgacgacgtggatgccctgcgtgaggtgggggacgcggggcgagttcaaggggtggcgagcgcacagcagccaagggtcgcgtgtggagcaggagggagaacggtgcatgtgcaccaccacctcccagccccagctgctcgtcgcagcgcagccaccaccagacccgggcaggggtgcacactcgcacctgctccatccactttgggtagaacttggggatgagcgaggaggccgtgcaatctacaatcaggcgatgcggggtttcagaggccttcaagtgctctgtcagcacccccaggctggggtccgttccctgaggcaaggtgcgggcgcgtgagagtgttgaatgagcttgcacagccggcgtcgggcgtctgacagcaggtccaggcgggggcacctcggaaaccagggttggcaaccctgccccccgctgcaccccctgtctctctcaccttctggatgacctcgtcgtcccaattggacaggtctatggagggtgtgttcttggccaggagcatctgttgggagttcaggatgctcctcacctccagcgatatcccctccctctcaagcttgggaatctatcgcgggccgaagcagggagcagggttccatgggctctgagattctcgatgcgcttgccttcgctccctgggaagtaacaatgcagcatcgcccgctgcatgccccgccccacgtgtgtcggacttcaccccacaccccggcacgcaccgcgactcgcagctgctccaggagggccttgcccacggctccggggcccaccagacccacagccagtgtcagctcagacagggctttgcggttcattggagcccgtcgacctcagccggccgctaacccccggagcctggcagaggggcctcctctgacacctgggtttggtgctattgcacgtcagggcctgcagattcttgcgataagaaaaccttgtgtgatcccgtccagaactacaaagggagatggagcaacatcgagaaatgggtctgagaggtgatcggactcgactttagttgggcagccgatgccgacgaggacatgccgagtacaaatggaggggggtccccaaacccacctcatcggaagctcagtgcttggtattacagaatgcgcatgtcaaagacaccgtcacaatttcaaggatgtttgtggtgccttgctttgcaatgcagggttggtgtagagggagttattcagaagagcgtgnnnnnnnnnnagcagccgatgccgacgaggatatgccgagtacatatggagggggtccccaaacccacctcaccggaagctcagtgcttggtgttacagaatgcacatgtcaaagacaccgtgacagtttcaaggatgtttgtgatgccttgctttgcaatgcaggctcggtgtagagggagttattcagaagagcgtgcagtagaacacgaaacgccatccaccagcttgcacgagggcgtgcgatgcagatggtcctcagagcacactcgtgccctcacgacaagctcacatctgaccctcgccgccagcctgtgccgctttgatgatcctcctgagcctctgaaaggcagggagtgacccgtggtcgacccccagctcttggatgtggcttgcaaaggcctgtaggatggagaggggtgcagggtgcctgggctgcaggtgctgtggagcgcttggcgcaatgtagagtatgaatgttgatgcgaagccagagacacagattgatgccccagcgccatgtagcagaactcgctgcagccagcagagcaatctcttccccatctccccactcccgcctacctggacatccaggtccagttgcaacaggatgagcgcctgcgtctccagtccagagcccttgctcgtatctgcaggcccggtgtgcacgaggggcggggcgcaggtcaagcacgcaggcccatttgcgaacaagggcgcaattgcgcacaaagaagacgaaaacgcacatcccagtcctggatgcgcccaagccatcgtttatggatgttggccaggcgtggagggcaggggatctcacctctgccctccatacccacaacagccaccccgaacgttgcggactcctggagccccccccacacaccagcatggctcaacctcccaccttcgccatcggccatccgctggcgcgacttgaggcggcgcagggaggactccgtcttctccagcgcggccagggtgtccgccaccagcgaggcgtaggcaccggccacgctctccgccacctccctcgccagtcgcgcggccgcgtcggcgcccagcagccccgtgtgtgcggccaggaaggcggccagcggcgccaggaggcggcccgcatagggcgacggcgcggtcggcgcgcggcgattggccatgcggaagctggccacgatgccgcgcagctgggacagcgcggcggtgcactcctccgccagcgcggccaccaggcgcgcccgcgcgccctcccccgcggccgccagggattcggcc

SEQ ID NO: 39148 - DNA, 70 bp, Chlorella protothecoides
aggatgtcacagcgtgcacccagtagcccatgcactttctacccgcaccaggtgtgttgggcgacgacac

SEQ ID NO: 39149 - DNA, 61 bp, Chlorella protothecoides
gggggtctacgaggagaacaaggcatacacgttcaagtacccgcgcccggaccggtgcgtc

SEQ ID NO: 39150 - DNA, 113 bp, Chlorella protothecoides
gggggtgggtgggagcagcctggaggagttttgattccaatgcagatcgatcatgtactcagaaagacacaaggagctgcgcgatggttgggccagcgtaccgaggttcactc

SEQ ID NO: 39151 - DNA, 78 bp, Chlorella protothecoides
ttggatctgggcagctgatcccggctgcgcagacgcaccctgtgcccagccccagctccccgtgatctcgagcctgag

SEQ ID NO: 39152 - DNA, 609 bp, Chlorella protothecoides
  modified_base (115)..(124): a, c, t, g, unknown or other
  modified_base (394)..(403): a, c, t, g, unknown or other
cccccccttccccctcccctgccttgcacctgttcccgcgcggtcagggtctcgatcaggcgctgcacggcgcgcgtgccgtgtgtgttgagcgccacctccaccagctcgccgnnnnnnnnnncctgttcccgcgcggtcagagtctcgatcagtcgctgcacggcgcgcgtgccgtgcgtgttgagcgccacctccaccagctcgccgcccccggccacgcgcttgagcaccgccaggcgctgctcctcgctgcagcggtccagcagcttctgcaccaggtagttgccgaaggggtccaccatcagctccaccaggctttccaggatctcgccaaagaccacctccaccgccgcgccgccaccctcgtcaaacttcttctgcaggaagcggnnnnnnnnnngtccaggatctcgccgaagaccacctccaccgccgcgccgccgccctcgtcaaacttcttctgcaggaagcggcagcccagctggtccttggccgtctccgccaccttccccgccacctcctccagcgtcgagtacttgaaggtgcccaccaggcgcagctcctcggggttgcccgacccgccggacccgccctggccgccgtccg

SEQ ID NO: 39153 - DNA, 78 bp, Chlorella protothecoides
ctgagctgaactgttgtgatttgcccccccatcccattgtatctcccatcgccacccctcagacagagcgcgcagaag

SEQ ID NO: 39154 - DNA, 61 bp, Chlorella protothecoides
gggtacggggcgtcatcggggtgagggccgacccggccgatgtccgtgcaagggttgctgg

SEQ ID NO: 39155 - DNA, 62 bp, Chlorella protothecoides
gcattccatcttcagccctgtcattcttccccagaatgaacttgaggatggtggtgctgtct

SEQ ID NO: 39156 - DNA, 8345 bp, Chlorella protothecoides
  modified_base (186)..(246): a, c, t, g, unknown or other
  modified_base (954)..(963): a, c, t, g, unknown or other
  modified_base (1276)..(1285): a, c, t, g, unknown or other
  modified_base (2090)..(2124): a, c, t, g, unknown or other
  modified_base (5949)..(5958): a, c, t, g, unknown or other
agggcgccggcgcggcccctgcacggcacgtggccggcgcggggggcggggctgggatcgccgccgcggccgccgcccaacccccgccgctcccggcctcgctgacggcgctgaacctgacgcagaccctgttcctggccgcgcgcgccggcgggctggacgtcgtggcggggcccctccgcccgnnnnnnnnnnnnnnnnnnnnnnnnnnnnnnnnnnnnnnnnnnnnnnnnnnnnnnnnnnnnncctgcggagcgcgagcgatgcacgaggcgatacaaccggcgatgcacaggtcggtgcagccgacggtatgcccggcagggcagccggcagcacgcccgcccaccccaacgagaccgtggcgtggctgcgcgagcgccagggcgcgtactgggcgcggcgcctggccgaggcaggcgcgcacgcgcgccgctcgccggagctgcgcctggtcccgctgtaccgcgcgctgcacaagcatgcgcgagagctggcgcacatgcgcgaccagggccaccgccgcctgttcccgctggtggagctggcgctgtgcatcatgcgcctctcctgcgaacgcttcttcacgctgctggccgtctgggcggggtacctcgccttccgggacccgcccgcgcctgcgcgccgcgccatcgtgaccgtcgcgcgcctggccgccgccttccagcgcgccgtgctcctcgccttccccgccgtctgctgggtctacgatgccggcatcgtcttctccacctttgcctccatcgttttctggagcgggtgggtgttttcttgtttgtgcatcttgttttggggggaaagagggggaagagattgtgcagtgtcgccaagtaatgggggggaggggagtgcaatgggttggagaggcatgggggttgatggaggggtcaatagtaccactcgatggccaatgcacgtcacccctggcctccnnnnnnnnnnatgtgcagtgtcgcctagtaatggggggggggagtgcaatgggttggcgaggcattggggttgatggaggggtcaatagtatcacttgatggccaatgcacgtcatccctggcctcctcatcagcttcccgcgaatctttggtcccggaaagtcaggctgcgaggaacctgttctcaccagtcatcccctctgagcctgacgagccgggaagagctgccctcgtacctcctcctcgttcatgccacgtgactcatggtcaaccccttacccccccaaaatagttccaccttggccccctccgccccgcaggcnnnnnnnnnntaaagtcaggctgcgaggaacccgttctcaccagttgtcccctctgagcctgacgagccgggaagagctgccctcatacctcctcctcgttcatgccatgtgactcagtgtcaaccccaaacccccaattccaccttggccccctccgccccgcaggcccctccgcggcgcggtggaaaaggtgcggtccaccgccgccagcgtggagccgcacggctggcgccacgccaccgctgccgaggtggagcgtatgggtggccagtgcgccgtgtgctggggcacgctggggccagaggccgcagaggtggcggaagtctctgcgccggcggccggcggggacactgccggcgccgagggcgcaaactccgagcccggctccccccccggcgacgagcgtgcctcggagcccgcgccccggccggcccgcagctggctgtcggaccggtccgcggcgctgcgccaggcggcctccgccgcactttccgggcgcgggccgctggacttgcggaccgaggaggaggtggacagcgcggagagcgcggcgcgctgggcggcggtggacgccatggcgctgccgtgcgggcacgcctaccacgccgactgcatcctacagtggctgcagcagtgcttcaggtgcccaaggaggggaaaagagggcgggggaaggggagtgggagggaaaatgaactgcctggccatttccagggcttgcctagtctggggagggcatgcttcaaccctcccagtgatgtggcgcggtatgctcgaagcatgccgctcgcccccccccccccccccccccccnnnnnnnnnnnnnnnnnnnnnnnnnnnnnnnnnnncctttgctcctcacaccatctgcagccagggtcgcgtgcccacgtgccccatgtgccaggcgaccatcgcgctacgggtgcggtatcactggcccttccgggcggtaccgcgcagccgtctgcatgatgagcctgtgcagccccagtttggcgtggagggcgacggcggcctggaccccggcatcaggggcattcggatgctcacccacgtcctcagggtgagctgagatgatcggtttgaagtgagctccctttgctgaggttatggtctgtgcaagttgttggtactggcgcagggcatcggcgactcaaaggcatacatgtttgcggtttgggattccatcccctctcgtcatcagaagacaatccctctctaacaccggacatccaccgatcatcgccgctcccccgccacatgtgcaggacgacttccggaatcggttcgaggtgttcctggcgccagaccaggcccagcagccagtcggcctggaggtcccccagcccaacgacgtgcggcaaccgttgtggggctgacaggcggggcgccattgtccccggaagccagccccacatgggcagtgccctgcgccgctctttgtgccctgtacaagaggctgacctgtgtgttttgtcaaggacttgtgtacaaatgtggtgacgatgccagcagccagggcgggagtacaacgtaatagcaacagaggaacagtggagttgaaaaaacttcaaatgctgtgggccaggcccgtcgcgccattcccagcgccagaggacccccctttcatgcgccgccagcagaggccgatggtgtagcgccacagcaggtacaccagcaggtacacaacgagaaacacctggggtgtgcagagtggtaagagcctcagcaggaggcggcctcgatggcgattgcatgtcgaaaggggctgcggtgctggtaggagacggatcgcacatgcaggtaacaccatgtgcagcccctgctgttgtcagtgggcagcccactgcacgacacagctctcctgctccgctgtttccacccgaaactcacgatgaggagcagcactcctggggcaatcactgggagctgaatgtaccagggcaggttggccacatatatccagaggttggtggtccagtggagagcaacccgctccctggcttcccacgcggcacacgggactgtgaaaggcgccggacaatcatccagatatgcgtgatatacgcgccgcatgacgggccgggtcaattccgtatgcgcctggcggtgttggggaagatttgcaggcactgagatgtggtgaaattcgaacgtgggtgcgcttgatgcaacgatccatggggcatacattgattgtctggtctgggtccacagacttctacagcactcggcaggaacccaagattgatccaacccaccctgttcaacaaggcagccgcatggtggggggtgtggcgctgaagcagcctggcaaggtgccgatgctgccgcttcaggtccgcatcggccgcaggccgggcaagctgcagcatggtgcagattgaagcaactgaggttccagcatcctctagccccgccagggagacaggcatgcatttgcacggccccattgctcgtcagattgctgcgcttgaagggcatcggcaagtaatgcgctgcaatgtgggcagtcaagcttggacctgccagcatggtatgattggcctcccaacacttgcttgtagaatggtgtagtaatcatctggtgcggccagaatgctatctgccaccgccacaggagtcagtctgggatccacggcgtggaataatgtctcggttgtcgattctcgaggtgtgattctcccaatgcatggaggatcagcgcgacttacctgtctgtcgtacgtcgcgcgctcgggaagcccgattcaaggtcaatagcgtgcatggcaggaggagggagccccatgcatgattacggtcccaggaagggggctagctctgctcccctcattgccgtatgccgagaatgaagtgatccaccagactgcgcgacaacagggtacgacgctgctgatcggccgactcactgataaatccaacgaatgccgcccgtctctcgagcaagatgtatcactcgtttcagattggcacacaaggtgtaggtgaccctgctccggtctggcctgcatgcagcgctttcttcttctcccgtgtgatgtgttgacaatctgccattggaagtggcggccaatacagaatagcatgcaaaaagttgggaacgagcaattaaagaagagaataggttgtcccatcatgaacctgaaactcgagaaaaccaagagctcgccccttcgtaacccagggcgagggaatcgatgctgcaaaagaaatgactatcgccattctacagggatcacccccaaactacggatccatgtggagtcgaacccaccgggggccaggccaagtgccgtcgttggatgactaatgcattggcaccgtaatttggtggaaactggacgtgcacgcccctgcatcgacccatctcagcgttgctgcagccgcgcaagggctgggtcaggccgtctgaaagatgttttgcagcatggcccggggcacggcgtccgaggcctcctccaggcgcccacactcctcccgtgtcagcctccaccccagcgcccccaggctgtcctggaactgggcgagactggtcgccccggggatgggaatcgtgccctggaggatggtgcgggcggtcctgatgtgtgggcgacgccagcgcacctctcccattgacatggcaatcccattgcctgggtcatccttccacagcgtacagacccaactccccgccgctccgcccacctggcagatgcaccagttgagcgcgacttgaggcaccgtcttcccgcgggcctgtgcgatctggcgcagctcctgcagcaggtccgccgcgccaggcaggatctgcttgaagagcagcgcccgagggccctgtggcagggacgcagctgcctcgccatcctccactccatactttccactcagcatgcctgagaaggagcacgtgagcgcgggacggagggctggaccatttcgctggcggtcatcgccacccacaaacccctccccatcgccacacaggcactcgtctcccgctcatgccctccgctcaccgagggcaagggggctgtaggctatgagggcgatgccccgctcctcggcctcccgccgcacgctctcctgagcgccccccctgctcagcagggagtactgcacctgggcagacgccagaggcaccccccgggcatcaagatagtcatggatgcgcgccagctgctccgcgccgtagttgctgacgcccactgcctcggccaggcccttattgattgggagagggggggaatcgatctggggacaaggtgtggcgtcagggccgccgtaccatgcattgtacagaaaggatgacagcatgtatgatggtgcaccatcgctggagagcggcacatgggacactctgccaccaatttttcttcccaagcgtggttacccacctccttgtaaatggagcacaggccgtcccacatcagccgctcctggatgggcgcatacttggcagtgctcctgggcgatgggggaagagggtggtggcagagaagtttgggggcagctgctgctgatgaccatggtgattcctgatcgatacctgtcggttgccacccccaaggcatacagctgctcttctattgactggtacctctggactctcgtcacaaaacatggaaggatgctgtgctcaccagtgcagctggatgacgggcaccctttccaggcccagccgcttnnnnnnnnnncattgactggtccctctggactctcgtcacaaaacatgaaaggatgctgtgctcaccagtgcagctggacgacgggcaccctttccaggcccagccgcttggagctggcccgggcggcggccacccactgcccaggcaggaggcgccaggggtaggcagccagcttggtggcgatcacagggcgggtttcggggctgtcacgcatgaagtcgcccagcaggcgctcgctcctcccgttgagacgcccggtgcctgtgaggccattgtttgtttttttggggggggcgggagtcagcgaaggagttcagaacaaggccagccatgctgaggtccagccctgtattccctgacgcaatcccctttggtaccgtaggagtccgcggtgtccatgaggttgatgcctgattgcagggccaggtcaaagacctgctgcagctcgctgtccatgccctcgctgtacccccacaacagcttgttaccctggacacggcagaggcggcagatcagctgtgtgtcgcacctcatgcagctcacgagtccaggctcggtagggttgagcattcgtcgccagtggtgctgaactgtgcctcaaaccagccattcccttcctgcatgcaatcgtacccaagcccaggtgcccagccccatgggcgagacgatgtgaggccccagggggacgccatcccgctcggatgctggttttcgattcagggtgggcatggagggcagctgctgccaccatgcccgcgcgacatgggtgcaggcccgggaccgggggtgcaggtggcttggaggtgcccatccaaagcagggtgcattttggacgatgtacatggccagaaaagtgaccgaaaacgagtctgtggcctgtgatcgcaagctttgtcttcataagagctccatgcatgccgaagatccgcccatctccgaaaccggcggatctgaattgtcaggcagaaggcttccgtcacatgcctctcattcggtgtaggtggccatcgcggccaacccgtatgttcagattccggcaagacatgcattgtgcatttttcgatggctccctcccgcctcattccaaagggttgcttgtgctgcagtagctacaatgaggcggctggcaacaggctccatctaaaacacaggaggatagtacggtttgagaggttaggtggtgcgaagtggagaaggcttgtgtgaagattcaaaagaatgcgcctcttgtgagtcgcttgaggtgatcgctggcctggtgagagcatgagagaggacacaaataatcaccggctcacactgagccacaaccctcagtccctgtagttgtagtcctcgtcctcgtcctccccgtcctcctcctcgtcggccatgaagtccgggaccgacacccgcatggggtccatggtgatctccggcagctggcggtctggcacgggccagccctcgttcacccctccaatgaccagggtcttgatgcccaggtggtccaggctcagcgcgcgcagcgcgttgatcaggatgtccagcgccagctcgtcggcggtgcccaggtccaccctgcgctggccgaggaggggagggtgaggtggcggcggagtgcatggagatctggggagagggtgctctatcgaaacacgagggcaagagtccgttggttgtgctctcctgtgcctccacaggcattgctgggctgctggatgatggataccaagcatgaaccatcatacagggtacttgctgtgtgccatgcccctctgaccaccccaatgtgcagcctggaggtctacgcacgtgttgaacgttccaaaccatcccgcgcacagcccacctctacctaacagacaaacaacaatcccccactccactccacagctgaccagaagcggagccagttgcccttgacctcaaggtccgccatgtctgccatggctgccggcgcggagcccaccacctcctcgtcctcctcgtcctcgccgtagcgcatgtggctcaggtcgtactgcgaggcgtacagcacgtgcatggaggaggcgttgtacgcgcccagccggcccagcaggtaccaggagttgaccacctcctgcaccatggctacggcggccggggccggcgccgtgtacagctccagccagatccagaggtcgaactggtccacgttccggaacttgacggccacggggcgtgcctcgcccgcccgccgccgctccaggatgtcgcccagggtggaggcggagggcggcgcgggcacgcctgcgcgttgcagccggcgctggatctcctcggggtcgtcctccgcgccctggatcaggctggccagctcgtcgtcctccgaggcctgctcctccacctccctgcggtggaggtgtccagtcagtcaggtgagttgggggggg

SEQ ID NO: 39157 - DNA, 74 bp, Chlorella protothecoides
atgcgctcgtactgggccttcgcggcgtgctcgtcgccgcgcgccagcgcgaccagcgccatcccgcgcagcgc

SEQ ID NO: 39158 - DNA, 61 bp, Chlorella protothecoides
gccatgcatgacctcgtagtattcctgcgcagggggggggggggggggggggcccgggggg

SEQ ID NO: 39159 - DNA, 65 bp, Chlorella protothecoides
cccgagagtttgaggtacggcaggaccacggatggatggcaccgcccaggcctcgccaccttcct

SEQ ID NO: 39160 - DNA, 89 bp, Chlorella protothecoides
gcttcgtctgcaaggtccttgagagtcaccagcaacagggtgccccccccccacaaaacaaacatgccacccgctcctcactacctccc

SEQ ID NO: 39161 - DNA, 61 bp, Chlorella protothecoides
gcctctaaaagtccaggactcaagtggcgggtgagcagctgacatcccttcttcttgccgt

SEQ ID NO: 39162 - DNA, 78 bp, Chlorella protothecoides
gaaggatgtgcagcgcatccgggacgaggtgtgggtggatggttgtgcgggggggggattgtgggtttaggagatttc

SEQ ID NO: 39163 - DNA, 875 bp, Chlorella protothecoides
gcccccgccgcgccggccgcctacccgcgcggcctcgggcacacctacccgcccgccggcacgcccgggacggtgatcgaggcggcgcagctgccgggcctgctggccgcgccgcgcgacacccaccccctggtcatccggctggagacggtgacggaggcgggcgcggcggcggggcggagcctggaggacctgcggccgggggaggagcaggcggcgtgggtgcagagccagaccacctacgccgcgctgctgcgcgaggaggacggcagctacgccgtgcgcgtgagcaagcagaagatctgggtggagggcgtgtcctacgagctgcaggagatctacgggctggagcagagcggcatggtgccgcgggcggcaggggccgaggcccgcgagtcggccgaggacgcggaggagcgcctctgcgtcatctgcctcgtcaacgaccgtgacaccaccgtactcccctgccggcacatgtgagagcgcgaggggggagggaggaggaatggggttcgggggggtgggggccccttgcgtgaatgacttgagtggcatgtgggtccgctgccgcgcatgtgccacatgtgagtcggcatgagctcgtgaagttcctggtcatcactccagagtctacttcctgatcctccacccacgccttagccaggggggcccccgcctttaactcctccatccccctcacatccaaaacaggtgcatgtgccatgagtgcgcgcaggagctgcgcaagcagacgagcaagtgccccatctgccgcaaccatgtggagtcgctgctgcacatcaagatgaccaagggcgcccggcgggcggcggcggccgcggtggcggcggcggccgcggcggcggccacgt

SEQ ID NO: 39164 - DNA, 79 bp, Chlorella protothecoides
agcgcctgcggtgtatggatgcatggtgtgtggcctcagacacagagtactggtccagtggctgtttgatgctcacgtc

SEQ ID NO: 39165 - DNA, 81 bp, Chlorella protothecoides
cacccagtgggcgacctggctcgggagggatacggacatcgtggagagggatcaagggtgggatgtcatccccgcatgccc

SEQ ID NO: 39166 - DNA, 69 bp, Chlorella protothecoides
ggcgccacgtcgccgccacgagcccttaccccaccacccccaaccatatcaccgcccccgccccggcgc

SEQ ID NO: 39167 - DNA, 63 bp, Chlorella protothecoides
tgtcgccttcccccagccccagccctgcagggccgccgcctcctatcgggtaggtgtggcccc

SEQ ID NO: 39168 - DNA, 72 bp, Chlorella protothecoides
gccaggtgcggcaggggttgggggcctctcacttctttgccctggataaaggtctcgagctcgtgggagggc

SEQ ID NO: 39169 - DNA, 61 bp, Chlorella protothecoides
tggataaaggtctcgagctcgtgggagggcacctgccaaggatgggagggaggagtagcat

SEQ ID NO: 39170 - DNA, 61 bp, Chlorella protothecoides
gactggtggctgcatggcacgggacacggggcccgtcgggcattgacgcgtctgggatacg

SEQ ID NO: 39171 - DNA, 73 bp, Chlorella protothecoides
ctccgagacgcagccacatccgcaaccatccccacacaagtttacaaaagcgcgatgaaacaacaaagcgcac

SEQ ID NO: 39172 - DNA, 61 bp, Chlorella protothecoides
gcgcctggcgctgcagcgcgagaccgtgggcgagggcgtgaccatgctgcagcccctgctc

SEQ ID NO: 39173 - DNA, 78 bp, Chlorella protothecoides
ccctgcagatgccagtgtccacaatcgttggcgccacatgtactactccatgaccgaggacatccggtgcgcctggga

SEQ ID NO: 39174 - DNA, 85 bp, Chlorella protothecoides
tgcatgcgcacagctgcactccttgaatgaggtccacccctgcatagccactattaacaaccatcataaaaagcgaagtccacat

SEQ ID NO: 39175 - DNA, 129 bp, Chlorella protothecoides
tgcccgcaatctcagcctggcccggctcccgggcctgttcgaggtgcagcccggcggcaccctggccatggtcggcctggttctcacccacccgcccagcgccgcggcctacaccgccgccttcccggc

SEQ ID NO: 39176 - DNA, 79 bp, Chlorella protothecoides
acagcccggcctctggccgcgcaatcatccggggtaggggaaggaggagccggtctagggcatacgggcctcgcagcgg

SEQ ID NO: 39177 - DNA, 122 bp, Chlorella protothecoides
cggcggccgtggccagcgtgcagtctcgcgtggtcaggccggcggccgccaggtgcagggccacaagggaggaggagcaggcggtgttggttggcacggaggggcccaccaggcccagcgcg

SEQ ID NO: 39178 - DNA, 78 bp, Chlorella protothecoides
cagcgagttcacgagcccagggtggcagatccccgaagcaaatggggtggaagggttgacccagggcgagtatgcgct

SEQ ID NO: 39179 - DNA, 61 bp, Chlorella protothecoides
gttcttgaaggagatcttgcccgtctcatcgtcgtcaaacagacggaacgccttgatgatc

SEQ ID NO: 39180 - DNA, 61 bp, Chlorella protothecoides
gcccaggggcctcccccatccttagctcttgaaggggccagataccccccttcctatacac

SEQ ID NO: 39181 - DNA, 64 bp, Chlorella protothecoides
gtcgctgcatggcatgcaagcccttgccccatttcatacaacatccaggcagccccacccatcc

SEQ ID NO: 39182 - DNA, 292 bp, Chlorella protothecoides
gacgcgccgctgcggccgggttacgaggtgatgggacacctgcacctcgaccacgccatcccctcgccacacggccagccagacgccgcgggcgccgtgggtgctggaggctcgattggccctggaggcaagggactccatgagtttgctgatgccctggaacacgacgaagaaatctccaggcggccgtcgggacattgtggttccaacacctggatgccgccgcctgcagcgctgaggcctggcgaggttccgcgcccggtcaaggagctcaggcaggacctgttccggg

SEQ ID NO: 39183 - DNA, 92 bp, Chlorella protothecoides
ggcggggtgatgggtggggtttggggggggcgattggagtgggacagggaagcacagtcttggggtgccggcgcagcaccggaatccccacc

SEQ ID NO: 39184 - DNA, 99 bp, Chlorella protothecoides
ccgccatgtatcggccaggacatagcacccgggcgtcaggcggaatgcacgggagcaccaggcccacccccagggggaacacctatgacggccatgcga

SEQ ID NO: 39185 - DNA, 74 bp, Chlorella protothecoides
ggtgtgtgcgtgtttgcgtacctgggtgggttcatgtatcaactgagtgttgggggctgggtgtccaatggctg

SEQ ID NO: 39186 - DNA, 9714 bp, Chlorella protothecoides
  modified_base (439)..(448): a, c, t, g, unknown or other
  modified_base (680)..(689): a, c, t, g, unknown or other
  modified_base (2242)..(2251): a, c, t, g, unknown or other
  modified_base (3217)..(3226): a, c, t, g, unknown or other
  modified_base (3726)..(3735): a, c, t, g, unknown or other
  modified_base (3932)..(3941): a, c, t, g, unknown or other
  modified_base (4311)..(4320): a, c, t, g, unknown or other
  modified_base (5068)..(5077): a, c, t, g, unknown or other
  modified_base (5410)..(5419): a, c, t, g, unknown or other
  modified_base (5741)..(5750): a, c, t, g, unknown or other
  modified_base (7260)..(7269): a, c, t, g, unknown or other
  modified_base (9136)..(9145): a, c, t, g, unknown or other
  modified_base (9332)..(9341): a, c, t, g, unknown or other
gtgggcctggccccgcagcgcgcgcagcgcagccagctgccgctcggaaagcgggacctgcagcggttcgggggccgcagggtgaccgtcgacgcccgcatgctcttctgccctgcgcgtgaagtaggcgcgcgcggcctcgtacccggagccctcctcgccgtcctcggcctcctcctctcgcgctgcatctgaccgtgcctcttcccaggcctgcgccacctcggccgccagcgcctcggcacccgtcctcgcctcccgcgccagcgaggcggcgccgcgcagcgcctcgcgcagcgtggataagaaggacagtgtgtgctgcggagccgcggccctcagcatgacgctcaagccctttcgagggggaagcggggggagagtgagcggggttacctcacaggataatctcatttgccatgcccagccgcccaggacnnnnnnnnnncgtgtgctgcggagccgcggcccgcagcatgacgctcaagccctttggagagggggagcggggagagagtgagcggggttacctcacaggatactctcatttgccatgcccagccgcccaggaccctcccctgcttcccagcccatttgtcaaacaggcaaagcaaaggctcactttccagtcctcccccctttccgttgattcaaaccacacacgcaaataaactcacctnnnnnnnnnnccaaaggcccactttctagtcctcccccctttccgtcggttcaaaccacacacgcaaataaactcacctgtaaagccacgcgcagcggctcggccagcaggggcagcagcatctgcggcacccccgtctgcttcagcagcgcggcgaaaagagcgggcgcacgtgggtggcgcgccggctggcgcagctggcggcacaggccgtccacgatgtagtctgcgttctgcgagaccaggtcgccggggccagccgcgtcgtaccgcccgtaccgcaccagcgctgagagcgccaggcccgccgcctccgctaccagcccgctgggcgactctgtgtttgggttagaaaaaggagggggggggggcccaagagttggaattggggttttgtgggcaggggaagagactgcctgaggcgagtgcggggcatcggcagagcagctgcaacgggtgtgtgtgtgtgtctggatgccagttgcagtccagtctcagagcctggcgcgtgccccaccatgcagagcccctttgcatgtgttcaactgcaggagctcagggcgcacagcgcccctttcataccccctcacccaggctctcaaagaggggcagcaggatggggcgcagggcggcgccgcggcgtgcaaagcgtgggccctgcaccgcggccagcaccgccaccaggtcccaggcggagcagaggcggagtgcggcgacgccagcccctcggggtagggcctcgcccaagctgccccccgcctcccagggcgccgagtcggcgagcaccagcacggcggccagggccagcgcctcgtgccgcgccgcgccttcctccccgggctgcggcgctgtgccggccaggaaggcggccgccagggtcagggcccggcacgactccgtcgcatcggcgcccgccctccgccccgcgctttccaggcacggctccagcagccgctccaggccggcccggctccggcccgcggctgaccccagggcgccgcacaggcccgccaccgcccgccaggcagcctcggtggtcacgtgcacgagtgcgggggccatgcgcacgctgaccccggcgtcgtggtgcgggctcgagcccgcgtgaggcgatgggtactccggagcctcgcccacctcgcccggcgccgtccgcgcctcgcggggttcaggcacctcactctgtgccggcaacatgctccggccctcaacagccgcggggccctccaggaggccgcggacccggccgccgcccgcggcccgagccaccagctctgccacctgcgcgtcgacctccagcacgccgtgtagcgcagcgtgcatagcggcgagatggtcgggccggctcagcaggcaccgttccatccagccctccggcgcaacctggcgaggttgtattcttgaccagggtgaatgtcggtctcaggggagccttacagccccagcaggcatgcattcgagcaccgcgcaggtgcagctgacaaacaccgacctggaggcagctggtgagcagcaggcaggcttgggtccctgggtggctgccgcggtggaaggcctcgggannnnnnnnnngacctggcggggttgtattcttgagcagggtgaatgtcggtctcaggggagccatacagccccagcaggcatgcattcgagcaccgcgcaggtacagctgacgaacaccgacctgcaggcagctggtgagcagcaagcaggcttgggtccccgggtggctgccgcggtggaaggcctcgggaagtccccgcagcaagccaaggaccttggcgaggagggggtcggggcccaagccttgcgaggcggtgcactggcctgcccatgcctgcagcgcggcgcgggcaggcgcggctacctccggccaggcgtcctgggcggcgactccaaggacgccgaggagcaggtcggccgtggcggcgcccagggtggaactgcagcatttgagaaggttcgccgcggctgtgggacaggtgagtgatgaaggaggcggtggcgagctgttgtcttctagggtggcagggcaaggtctccgaccacaaccacatgcatgcccctctgagccatgctcccccacgcccttcaatcatcaagcccccccggcggccgcacctcgcgccacggccgctcgggtggcggggctctgctgcgcagccgccagccgcggcagggtggtcgccagcaggccacccagcttcccagcggcgtcggcgcgccacgccgcggttctttccacccacaggatcgggtcttctggatcaagttgcgccggcgaggcaggggacccggggggcgggtccagagcgccttctgcgtccgatcccggctccgcatctgggaggcagggccagccttgcgcccccgccgccagcgcccgcagctgcttcagggcgctggcggccgtaggcggcgctgcacctgtccgtttgtcgcctacggtccccgacaccgctccctccccgtcccccagcgtcgcacagacgaggcgggtcagggcatccagcgcagccatgtttgccctggatccannnnnnnnnnggataccgctccctccccgtcccccagcgtcgcgcatatgaggtgggtcagggcgtccagcgcagccatgtttgccctggatccagggcctgcggaggaggggttgctgctccggccacctgcgtggggtgagcgatttgagctggctggtcacgaccctcatctcgtcgctaggctggacgaagcactgggtgccagcatccatcgagccccgtgtcgagcgccacacgagccgagcgccgcacatgcgatgccggtctgctccaccctgccccgccctgctcacccgacagcgcgttggccagccccgacgcgatgcctgggaggaagaaggcgaggacgtcggcgtcggccacccggcgtatgccgcaccccagggcctgcagcgccagtgccacgagggctcggctgccgccgctcccagcccgcagctgcgcggccaccacctgcagatgagtgggagaggagagaggttaagtgcttttcttgggggggggggnnnnnnnnnntctgcgcggccaccacctgcagattggtgggtgaggagagaggttaagtgcctttctttgggggggggggggccttggtagagagatagaactcctgtggcctctgccagcagtactcacgcccatccagccccctcccagataaccccctcgtacgtggagcagcgaggagaagaggtggcccgtcaggggtgccnnnnnnnnnngtgccagcagtactcacgcccttccagccccctcccagataaccccctcgcacgtggaggagtgaggagaagaggtggcccgtcaggggtgccgcctcccgcgacgccagcacgctggctgggccagaggtctggtccctcagtgaaagcaggatggcctcgcaggccaggcgggaggcctcctcggtgacttccggcaggccaagcactgccgcaaggcgcggcagcaccgcgccaggcgtctgcgccgaccccgccgcgccgcgcagggcggagagcacgcaggccaggcatcgctcagtggcgcgccaggaaccctggccgcgtggcgcggccccagccccgccctcctgcgccgctgcgtcgagcnnnnnnnnnncaggcgcggcagcaccgcgcctggcgtctgtgccgaccccgccgcgccgcgcagggcggacagcacgcaggccaggcatcgctcggtggcgcgccaggaaccctggccgcgtgacgcggccccggccccgccctcctgcgccgctgcgtcgagcaggatgagcagggggaagagcacgtaggccacgcaggggcccagctctgcgtcacccagggactccagcaccgcatgcaggtctgtggagacgcaggggcgtgagggtgcttggagaaggaacatcctgggcaccgggacgctcccaggggaggactgccgaccctccaatccccagcatggtacaagatgggggacaaggcgcacacagtcggcggcgtgcaagcaactaccagagtcctcggcagtcacactccgctaccttcaggaacataccttgcaggtggcctgccagggcctgagggttgctcccggcacccagcagcgcggtgcagagggggcgcagcctttggaaggcggcggagggctggtcggcaggccctggctgaccgctgccggggttgtgatccgtcacctccgcctcatctgagctccccccctcacctgcacgcgtgggaccgtcccgagcgtgagggagagcgttgtacatgcatgttctccatctcgaactccatcccaagactttgatgctggcaggcaaaggcgtggtccgcctcgttacacacacatgaggagcgaccagcgtccagccgcnnnnnnnnnnccgctggcaggcaaaggcgtggtctgcctcgttacaaacacatgaggagcgaccagcgtccagccgcggtcaggaaacaaaatacggatgtcagagcactcgggcactcgccacctcagccaagcgcttcacctgcgcaggggatggacgtgtcctcgctgtcctcagacgcggcagtcgccccttgccccgaggaggcgccagctctgttggaagaggcgggggaggcggcatcctcgtcccccgcccccgcccgcaggctcgcagctcctccccggggcgatgggggtccgccggaggcagcgtctgtcgtcaccagctcccccgcgtccnnnnnnnnnnaggcgatgggggtccgcgggagccggcgtctgtcgtcaccagctcccccgcgtcctcatccgcctgtgatgcacccatggcggcctgccactctgcgctgggcgcgaacctgggcccagggggaaagaggcgtgaggggtcagcaggctgagggcacggtgaggagggcagacggagagggttgactgcgccccgtccagtgacagtgctctcccagggtctaaacggaacccgtacgaggtcgaccatcgctcggcgagatgagacagctcgagcgcgaacagcctcacgatatgcacatgccggttgcaacaagcacagnnnnnnnnnngaacggaacccgcacgaggtcggccatcgctcggcgaggtgagacagctcgagcgagaacagcctcacaatatgcacatgccggttgcaacaagcacagcaccgaacttgtgcacctgggcctgtcctcctctattgctgccgtcagggcggccagggggtcgtcgtccaaacccgtcagcagggctgtgaagttcagcccttgtgcgttgccgagggaggaaggcagccaggccgggcccgtcgcaacgttgccattaccctcgtcctccgcctccgccgcatcccagtccccgtgcaaggcctggccggcacccaggtcaccgagactacctcctcgccactcgggctcgtcccactcgccgctcatgctctccaaggcccgcgccagcgcttccaccgcctcgctggtcgaggcaggcacgtcgtcgccgggcgtcggcagcggctgcggcatcaggtgctcagcgtgcacagcgtggcgccgcagcacaccagggccaccccaagggccgtgaggcgtcggcgggagggctctcccagcagggtctccacacaggccgtgaccgccagagtcacgcctgtacgtttgagagggtgcgggaaactggattccattgcaggatcatgcattgcggctgtggatcttgagaatgtgcagaggcggctgccaccatgaacaggctgggctgcggcactgaagcgcagacatgccagacttccgattctgagacggagagtccttacccaccgttggaaatggggccagcagtggagatggagcagaaccggaggctgcttgcaaaaatcactccgcccagcagattgaggccctgaggaatgatcagggctggagtgctcagggagtgaatgcccgagtccagccacgccacgcctgcgccaagaagtggaagttgggattcgggatcttgggtgtggaaaacatatgttcgagtgggaaagctgcaggtgtactggagggatccattttaatcctcccccacctgtccgggcagtcggcgcttgtttgttggcagcgatcacaccttgcctgatgaatggatttgttactcctgtgatgcaatgggtggatgaatgagctggcactcaaacgatgtgatctggtcgcgcctgccgcaaggcgggccttgagagtgagacccacacggactccccacacaccccaaaggcagccgacgatgatgggcaggagacttccgataaaaccaagctgatgcgacatcgcttctggactcggactgtctccactggggccagggtcactcgccttaagcgccatgcattccaaaattcaacgcgcgcccgatctgagcgcttgagcttgatcacccaccccgttcgggaggtggtgtacaggtgcgcagccccagtgtatcccctcagagacgccccaccaggcttgtgtggcggcctgtaactctcctgagtatctcaacacccgcccgtactctcttccctgggccccagcccctggcgccaccttgcacggnnnnnnnnnnggtgtatcccatcagagacgccccatcaggcttgtgtggcggtctgtaactctcctggttatctcaatacccgcccgtactctcttccctaggccccagcccctggcgccaccttgcacggcagtcacatagccacgtcaacggcccctctctgtcccgtgctcccggctcggcccatctgcatctggatacatatcagattttctcgaatgcgatgaccctcgtggctacttcaagggtgtgccgggcctcctgagccattcctcgccgggtccccctcccccagcgtggacccccttccgggtctccccctggatgaggggctatggctcagatggcgcggagcccacaccactcctccgcctgtccacggtggcttacttcatgggcagcagcatcctcgtgcagtacaccaccaaggtatgggcgggtggggagttggggcggctgcgggtgcccagcaggacggcccatgccatcaccctcctacaaagctggagcatgggcgacgcgctccccacaaaccaccacactgcccactccgcgctgcaggccatcttctcctcctacggcttccacttcccgctcacggtggccttcctccagatgctcttcatcgcccccgtctcctatgccatcgcccgcccggagctgagctggcagctggcccggggtctcagccccctggccctggtcaacgtgctgaacgtggtggcggggctggtgggcacccagggcctcaacgtgcccatgttcatcgccctccgccgcttcaccctgctcatcaccatcctgctggagcgcttctggctgcacaagtcccacgactggcccaccctggccgccatgagcatcatgatcgggggtgagaggggttggggaggggaggaaggtggatgaaagaggcacacatggaccgtctgggggctgggcagggtcatcccagcccctggcaagctggacgccgtggcgggcctcacgtttaaacccactggcagccagttgcgccctggggccgccaacccgcccgaaatacccccttcacccacactccacattcgcaggagcgcttgtggcggctttcacggacatgagcttcaacatgcgggggtatgccgcggtgctggccaacgacctgctcacctccctctacctcatcatggtgaagaataaccctgcatcgcacggcctgtcgaccacaggtggagaggaagggtttgagtagggtatatgggagcgtgtgacatggaggccgtaagcttcggacaagtgaggggggacagcaggttcgaaagtggagcagctccccctgcttgcggcggcatgaagctccgctgctgccggctccatgacctgatgagctccgagcgccgttccaggggcttttgagcgccttgttctggcccatcaccctgctctccacagctgcgttgtacggccccattcgcccgctgtccaccaccacacctctccccttccccctcccacccctccccccaatccactcaccaggcatgctgttctacaacagcgtgctgtcgctgccgctgctgggcggcgtcctactgctgcgctccgaggtgtggcgcgtgctggcctacccgctcctcctctccccccaattccagaccgcactcttcctggccagtgccatgggcctgaccatcaaccactccaccatggtatgcacccgtgtcaatgagccgctgatgaccagcgtggcaggtgcgcagtgtgtgtgtgtgtgtgcgtgtgggggtctgggcgggtgccaagggacatgctgggtagcatgagaccaggcatccgccagcaaaggggacgcagtcgaccgacctggccctgcagtcccctccccttcccacgnnnnnnnnnngagcatgagaccatgcatccgccggcaaaggggacgcagtcgactgagctggccctgcagtcccctccccttcccacgtgcaaacacatcatgcacatcccttctctgcccccggccccccccccacccacacacacacataccaacaaaaaacatcatactccaggcaacctgaagaacgtgctgnnnnnnnnnnccccccacccacccacacataccaacaaaaaacaacatactccaggcaacctgaagaacgtgctgatgacggtggtgggcgcgctggcctttggcgacttcgtcttctcgccctggaacgcggcggggctgggcgcctccatggccggtgcggtgtggtacgcgactcgcagcgcctttaaggcgcgccagcgcgcgctgaagaccagcctgctgtcacaggtccccgtcatcggccgcgaccggctgcgcgcgcgtcccggcgccgacggaggcgcgggggcgcacagccgcgcggtgcattcgcgcacgggcagcagcaacaacgtcggcgccttcctgcacctggcgggcggggggcggccgccgccgcc

SEQ ID NO: 39187 - DNA, 105 bp, Chlorella protothecoides
gcatccctcaaatcacacgcagcaagcgcttcctctcccaatcctcagcatcacctccccgacacatcctctgcgtcccaacctcgatgtccttgagcagtatgt

SEQ ID NO: 39188 - DNA, 61 bp, Chlorella protothecoides
ctgggcgggtccctgtcccgaccgcccatcgccaggtccgaaagctttacaacgtggaaca

SEQ ID NO: 39189 - DNA, 142 bp, Chlorella protothecoides
ggctcgctggggtggggcaccggcgtgcgttggggcgccgccaagctcgccgccgccgcccgcccagacaccggcgccgccgctcgtgggggctgtgccctggtgccccgcggccccgctgccaaagccaaccatcctgctg

SEQ ID NO: 39190 - DNA, 61 bp, Chlorella protothecoides
aactgttaggtgttcttttaatggctgctggtccggcaggtttaattacagtgccttttat

SEQ ID NO: 39191 - DNA, 66 bp, Chlorella protothecoides
gccctccgagccgcaccgtcctcccccagccggccttctcatgaacactacatggaccccgacctc

SEQ ID NO: 39192 - DNA, 61 bp, Chlorella protothecoides
tggcttccggagtggttggttggtatgcatatagcttcgaaggttgatctgaagaccatga

SEQ ID NO: 39193 - DNA, 61 bp, Chlorella protothecoides
ctccggcggcatggtcatccgaccttcattcacagtcggggccgtgtatgtcatcaacaac

SEQ ID NO: 39194 - DNA, 77 bp, Chlorella protothecoides
agccgatgtggacaaaccagtccgtcttctcctcctcctccctctcgtccgtcttcttcctcccccgcttcccctct

SEQ ID NO: 39195 - DNA, 73 bp, Chlorella protothecoides
agaggggaggatcgtcgtcctgcgccccggccgcacacccagcgccctgtcctccccagtggtgttgcttgcc

SEQ ID NO: 39196 - DNA, 3139 bp, Chlorella protothecoides
  modified_base (333)..(434): a, c, t, g, unknown or other
  modified_base (665)..(674): a, c, t, g, unknown or other
  modified_base (1017)..(1026): a, c, t, g, unknown or other
  modified_base (1635)..(1644): a, c, t, g, unknown or other
  modified_base (2115)..(2124): a, c, t, g, unknown or other
  modified_base (2577)..(2586): a, c, t, g, unknown or other
gccctgtcctccccagtggtgttgcttgcctgggtttcacgtgcagcaccacctccgcccttgccacgcaggttctgcgcggtcatcgggcggggcctgcgcaccctgcgcctggaagccatgctgagcacgctgcgcacgctgcagcagggaggtgggccggcggagctcgagcaccaggccgccgcgctgagcgggtgggtgtagttttgcgacgtgagggtgggaggtatggaaacgtgcagggcggactggatggtgctcggggacagccccacggcaccggtgaggccctgcgggtacctggcgccccttcccgcccctgcctacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaccctgcgcacctttgcggaggtctgcgaacgctacctcgatccgcccctcgcggcgtacgtgctggagggcgtgcctggcgccgcggtggtcgcgctgcgcgccgtggtgctggccgcctggacccaggcggccgggtcgttgagccccggcgcagcctcagacctggagtcggggatcgcggctgtggaggtgggtttttggtgaggggcagcggggggcggggggnnnnnnnnnntccggcgccgcggtggtcgcgctgcgtgccgtgacgctggccgcctggacccaggcgggcgggttgctgagccccggcgcagcctcagacctggagttggggatcgcggctgtggaggtgggtttgtggtaatgggcagcggggggcggggggggggttggaaatgcagacaggtcttgctctactgatgatcgccgggcatgaccggatggccctcctccgggatcagcgcacctcactgcggcctcgtctgagcttgcgggcggtctggaattgtggccccgccagtcctcggctgcatgtgttccggtctcttgaaaccaaccaaaccctccgcgacacnnnnnnnnnnggcttgcgggcggcctggaattgtggccccgccagtacttggctgcatgtgttccggggtcttgaaaccaaccaaaccctccgcgacacgatcccgtgcaggcggccctggttggcgctccgggggggagcggcggccggcacggccaggcactgagggccgccgcctccctgcgccccgtccacgagctgctgcgcctgctgcgcggtgtggaaggcgcggaggacctgctggaggcggcggggcgcgagcccagcctcctggagcgggaccagtggctggacctgctgctgagcatgcggggcggggaggacgctgacctggcggagcaactggacgacaggctggcggcgcgcccggcggggatccggccggaggctccggggggtcagatggccgcctcgagctcgcagcgagcgatggggaggggacgatacccggccatggactgaggcacatgcagtggtcgggagtgcaccacctgggatgctgaaggggcagcgcgccaggctgccaccagcacgcaggaaaaggggggaccacctgttgaaccccttcttggaatggtgcccaggcgaggctgcagtcagagctgctttgcacacagcnnnnnnnnnnccccggaatggtgcccaggcggggctgcagtcagagctgctttgcacacagctgcctgcgctgaccggtgagggacatgaggagcggtggcttgggcacatgcctcgtgtgggatgtgactggccctgcgcatgcatgccggctcctcaccgggatgatatgaacccgaaaagccgatgctcgaggtcctgtgcctgccagtgcaggtcgcaaacaggtgaagagcacctgtgaccggacgcaggtgtgatgggcaggtgcggagtagggtcagccgccaaagctcagagctcctcagtgatatcttggattctaggtttcacttctgacagcagagcatatggcccgacatctcagacctcacaaacacagcggccgtgcctgctctcaatgccgtgacgtgaccatgacaacccactccctgcgagtgtgccctcttcaaaataggactgacttgacagaatggtccannnnnnnnnntgtgcctgctctcaatgccgtcacgtgaccatgacaacccactgcctgcgagtgtgccctcttaaaaataggactgacttgacagaatggtccacttgccgggaaatgagcagggtggaacctgagccatgacctttgctgtgtggacgagcctctcgcatagatctctttattggcttggatgattcaatggtgctctgcagtatgtgactgagcaaatcgctgtcgcctttacccatgctgagcaagctcctcgaggtttcgcagcaccccttcacaccttggtctgaggtccacacacaacatcacgaatcattccttcaagtaggaaggaaaacagtcaatgggaggaggtacaccctcatgagagcgaggaagcacgtgagcaaatgtacaagggagatctgttccacagagctgaagagctagcttgcagcagcggcagacttcccnnnnnnnnnngagtaggatggaaaacagtcaatgggagaaggtacaccctcgtgagagcgaggaagcacgtgagcaaatttacaagggagatctgttccacagagctgaggagctagcttgcagcagcggcagacttcccaggggtggccgacgaagcgcagcctgtcaacaagagcatgaattccacgacgcctgagctcagccggcgccactgaattcgggcttgagcacccacagcttggcgccatccctcctcctcagggtggccacggatttcaggaccccccggaacaaggggagctgtgcggcaggcaacgtctcctggaaatgctccaccagggccgcagacggtgcggatcccccaagcccttccaggaactggaccaccgccgaggcgaggcgctgcggaccggaggctagtgtcgctggatttgactgcccggtactcgttggtgtccccggccgtcccgcgcccggcccgccgcctcgtgccgtgcctgccgccccttccgctgccgctcccgcacccagacctgccgccgccccggcgccctcgccgcgg

SEQ ID NO: 39197 - DNA, 75 bp, Chlorella protothecoides
cccgccgcgccttgaatgaaaggggcaggtggaaatttgggttccatgcaagggccaaggaagcaggagttgtgg

SEQ ID NO: 39198 - DNA, 63 bp, Chlorella protothecoides
tccctgcccaccctcaccacatctctaatgactacccgatcaccaacgctcaacaggtggaga

SEQ ID NO: 39199 - DNA, 66 bp, Chlorella protothecoides
cccagaacactcaggagtttgctggcaacatggaaaagtatctggccaccgtgtacgccagcccga

SEQ ID NO: 39200 - DNA, 873 bp, Chlorella protothecoides
  modified_base (94)..(103): a, c, t, g, unknown or other
  modified_base (658)..(667): a, c, t, g, unknown or other
  modified_base (760)..(769): a, c, t, g, unknown or other
gagtgcgtctgacttttctgggagtctactatggtgctgatggtttttgtggaccacacgcttcatgccctcgggcgtgccatgtgccggctgnnnnnnnnnncgtgcgcggcgggtgcctggctcgggaggcctgcggccggctgcagggcggcgacgccgaggccgcgctgctcgaggccctgcaggcgcccgccgtgccggcggggcggccgggagggggcggcagggcgtcccaggccctggcctcagagtgcgtctgacttttctgggagtctactgtggtgctgatggtattctgtggaccacacgctgcatgccctcgggcgtgccatgtgccggctgccagggggtccatctggtctgaggtggcacctcgagcagtgcaggtcgcccgtgcagagcagcgccccgtgtcgcaaggattgcggctgccatcctgcctgggtaccagatcgcgagcccacaagctctcccccccccattcccaaaccccaccacccccgcaggctggtgcagtcccaggtgatgctggtgcggggggccaaggaccccgtgatcccggcgtcgcgcgggccgccccggacccccgcctccgcgacgtcgccggggtcgggcgccggcgatgcggagcgcgtgctgtgggacgcggtgggcnnnnnnnnnntgtcgcgcgggccgccccggccccccggctccgcgacgccgccggggtcgggcgccggcgacgcggagcgcgtgctgtgggacgcggtgggcnnnnnnnnnnccccggctggcgggccagccagttccacctcagcgccgcgcacgtgcccgactgggtcattcccctgggcgccgcgccgcacggctggggcgcctgggtcgcgg

SEQ ID NO: 39201 - DNA, 67 bp, Chlorella protothecoides
catcggcagcctgccctccgtcatcaccacaatttttcccctggcgggcagcgcacgcggctcccct

SEQ ID NO: 39202 - DNA, 70 bp, Chlorella protothecoides
aaacctcagggcatcggtgccgcactcctcaatgccgtcagggaagttctggacctggccctcccgcgcg

SEQ ID NO: 39203 - DNA, 90 bp, Chlorella protothecoides
tcgtacgggaagaggagcgtggagggtgttgggaccgacgggggcggggggtggaatgtgtgactggccctgcgctcatgcgcgcaatgc

SEQ ID NO: 39204 - DNA, 110 bp, Chlorella protothecoides
aagtccttggcccccctgccctctggccattcaccccccccctcctttttcctatctcccagacgcactggtagatgacacggccgtcggtaaggaggatgacgtcgtca

SEQ ID NO: 39205 - DNA, 6081 bp, Chlorella protothecoides
  modified_base (1131)..(1140): a, c, t, g, unknown or other
  modified_base (2350)..(2552): a, c, t, g, unknown or other
  modified_base (2843)..(2852): a, c, t, g, unknown or other
  modified_base (3723)..(3732): a, c, t, g, unknown or other
  modified_base (4249)..(4258): a, c, t, g, unknown or other
  modified_base (4993)..(5002): a, c, t, g, unknown or other
  modified_base (5862)..(6019): a, c, t, g, unknown or other
ccctcgctgccactggtataggagcataacactttctcagcggtccaaatccgccccccacccccttgtcccctgcagcgcctcgtccctccaccgaccttgctcgccgtcaggacccaactgctgctctgatagcaggcggaacacctcccgggcgttgtgggagagcgacgccagtaccaccagcgctcccttcttggcctcttcctctctcctgcccaccagcaggggggctatggccgcatgcaccacctcttgcaggtaaggggcgtaggtgggcacgtggtgccacacccaggcaaaccggtcccgagtctggcaggtgaatgtgggtggaaagcgtgattgtgtgaggtccctgggttcctggagctcacgagggtcctgagcaggctctggagattgctgtgcacaggcccaaggctatagatgtcattgacgataattccacttgggtccctccagacccccacctacctggagatcccagaggagggcagcattcacatggtcgacactggcggccaggtggacgtttggcacggcagcgaggagtgccagctggtgctgggatgtaggatccctcaatcctgacagcagcgtgtgtatgaagggaaggggcaggttggtagcgtaggacggtgtgtcacaaaggctcggcatccaagccactccacgtccctggtagctgccctggcgcgacgcaagacccctggcaataaccacctggcccatcgatgttgttaatgatgacatacacccgctttcctccgggggaggtcagtagttccatcaggtcagccggcttgtaggcacgatacagggcaggcttggacccttttgcagccgctgtggcccatgcgaggatgtgctgagaggtcaggccaggctgcaggccgtttacattgaagcatgcgccgtccagggtccacttggctgcaaattcggccagtaaacctgctttggagccgaacccatggaacaagaggctatgaccagccctgtgtgttgtcggaggtagctttggatggggtaattggtctggtggattgatgggacctgacaaactgcgagggatgtaagagaaagtgcagcaccctgttcatacctccattgttgccacatggaggnnnnnnnnnncgatgggacctgacaaactgcgagggatgtaggagaacgtgcagcaccccgttcatacctccattgttgccacatggaggggaacacggccttgtgacgcttaagcagagtctccttttcttcagcatgcaatactggtagctgcacggtgcatttgggttgatgaagtgataactttatttcagctccagtaattgcctggtttccctatgcgacccaccgcccaaagtcctctatgacctgtgctaagacgtcatggagtgtcttgtctcctaggccctccagattaagattggcaatggtcttgctgctcccactggctgcattggccccaaagaatgtggcgcgttcgttgcctgtagaggagccccgaatgacgaagggaaggggttcctgttccgagagcgaatgcacgatggggcttgaatctcgatcagttccgcgagcttcacgtgcatacgggagcatacatcccagataccggacctacgtcgtcattactgctcgttgcctctgcttcttgaaggggagccttcacggcctgctttggccgcttccgtggtggcatcgtcgagggacccaaccagaccagcagctgtttctgtttgccttatggattgccgtattagtatgttgacttttgtactacccttgtacacgcagcgaagcattatgctcgcatgccctgcaccacagtctttgcttaaatttttgaaaccattctcggacccccgccaatctggtgggcgcctcgacgaatcccggcgcggccatcctggtcacaatactcaacgcccaaaccagtccatcagagcccaatcaagtttcaacaatgagcactaatgcgaaaatattatgattaaactccgagagtaccccgttaggtgggacccatctcgccccttcgagaggccctgccgtggccattaggggacgcgaacgcattgcgaggcagattctttttacataacatgatagaataactaaggttgcgagtgatcggccgatggtgtgcactcggaacacgttgatcgtgccttgtgttccacgttcgaggggttggcggccatgaggactccccccaccccaccctcagctcttgtaagggcccagatgcccccttcgacatactgcctgccttatgctggtcgatttgttaggtctcacgacttactcagcaggtacaaggccaccctggccttcatttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtattacacaggtgagccgtgccagaaaacttttgtgctacttctcgacctcttatgtttgtctgggaggggggccccgggttgcccgggatgctcagcaatggtggtgcgctgcgactgtccacaaggtgtagggtggtggcactgtctggtccttgggtgtacagcctccacaatggtcaaaccttcattaggggaggcatctggcaggtctgacactggccccggctcccttccctgactcctgaaagtgcccgtcgtggatgccgcaatgagccctgtgtcggnnnnnnnnnnctccctcacaagatggaagcagagttcgacagttctgtctttgatatgccactcgatggggacggtctgagccgatcaagcgggcagcacgggtagcacagcttccgtcgcgagcttgtaggatgtgtggtgctccctctgcatcacctcctgtattacatgggggagccatgccagaaaccttttgtgctactcctcgaactcttattgttgtctgggaggggggtcccgggttgcccggatgctcagcaatggtggtggtgcgctgcgattgcccacaaggtgtagggtggtggaagtgtctggtccttgggtgttcagcctccacaatggtcaaaccttcgtcaggggaggcatcaagtggcaggtctgatactggccccggcccccttccctgactcctgaaagtgcccctcgtggatgccgcaatgagccctgtgtcggtgtacaagtagttgggtccatcaacagcttggcataggtgaaagcaatggattgccggtgtgacacccagatgaagagacattcgacagtctagggaaaccaatgcacaagccataggacacttctgcttgctgcagcctcctcctctttccgcacagctagccgcatgcggtcatggcattcctcagtccagctcaaatcactgtccaggtaacaagtgagatggtggcacgtttcgggcatgtagcgtgcgataccttgatgctatgcttgcagggcgtgtccatgcaagaatcaggacaggacaggagtagtcacccaacatactggggttcaccctgtacgactcaaatccagggttgggtctggaacctgatccatccaggagtgagggaggggggggcggcggagggtgacaaggatggannnnnnnnnncatctagggttgggtctggaacctgatccatcaaggagtgagggagggggggcggcggagggtgacaaggatggacatgtccttgttggggatcaaagccgccgatttgcagagggaacgttttggtcggctactctccaactgggtagtgatgctcaattctgaagcatggagtacgtcgaggctcgaagacgaagattaactctttgttgccgaaccgattggacggcgcgcgagccggctaatcattctcgtgttcaccaaagtcatttccactttcaatctagaagacagggatcaagaccgtggtcaatccccaactgacaaggccggcatggattcttggtctaaccaggtagctgttgagaggtcactggggagcacatactggccagcagtgctatcattgttgctacatccgagtccgactcgaccttcgtgcgtctgactttcacggtgcttttgagtatcacggtgcgcttcatgtagcagcgataagtgatctgctggcaatgcnnnnnnnnnnctgaggatcacggtgcgcttcctttagcagcgataagtgatctgctggcaatgcagggatcggcgacactggggcatcccgggtctgacttatcttgcgtggcctactcctttcaaagggcaacttatcctacatattgtcctgggtaaggtccttacaatgacactccatggcatcttgaactagatccgccaagagggcatgacctggctctgacagcgatggggagtgtgctgtgcatgatgggcaatctaccatttaaaagtccatgcacagcttgtctcgagtgcctgaggggcccttgcccccatcgaaactcattcctctgaccgatcttcgactcgttcttgttgctgggggcagcctgactctcgtacaaatcttatggtcaagagtgttggcgtgaggttcagagaaggtgttgaggtagcggttcagaggatcgaactgagccttgggagtcgcgttcctgcttgaataacaatgctcacttataaggccacctcgttacaaacatgaactggcaacacatgtggagtaatgcaggaacagacgggctaatatgtgtaggcaagggcgtggacagctctacaaacatgaaggaagagcagggtaagattcttcacaggagtcccctgtgaagacatgtcagacgttcatgatgctctaggtaggcctgagctagccagggattccttcccgtggtctcatagccctaccaattcaaggtgagannnnnnnnnnctgctagggattctttcccgtagtctcatagccctaccaattcaaggtgagagcatttgaagtgccgccagcgaatttgaacgcgacaacttgggcgtaggacgcaagagcggtctcacttgactccagagtggtggtccaactcattggtgtgctgtatacttctctggaagcccgaatcaggccaccagctgcagtgaaaaaagcccatctaacacggtctggtgtaacgtctacaatgttcaccgaaaatgagaagtcattgacattcttggtaacagtcccgctgatggacccaaatgctggtggtgggggatagggttccggaggtgagggtgaaggattgagcagagtcagcggtagaacttcctcgagttcattgttagcaccatagacccttgcagagccaaaggagtaatttcctgctatctcttattctcggaatctgttgcgaagagtggtgacagcagagtgaggtatggtagatgtaccatcaatttcggctaaacctgatgagatattggtgcaaacaatggcggagggtatagaacccactgtggtgactacaaaagtgatgtcaaccaaacctttactaggagcactgaactcgattgtggcagacgcttgtggcggtggtgatggtggggagggaatcggtggaggcgatggaggtggtgaaggtggtgaagaaggggggctaggaggaggagaggggctggggggaggtggtggaggtggtgagggcggggggttgggaggaggagggctctggattgagggcggtggcggcgacctctcggcgggcggggggggggaattcttggcgggtggcggaggtgacttcctggcgggtgtcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatttcttgaccggcgggggtggagacttcttggtaggtgggggtggagacttcttggcgg

SEQ ID NO: 39206 - DNA, 61 bp, Chlorella protothecoides
taggtgggggtggagacttcttggcggaggttggaggagattgcttggcagtcggcggagg

SEQ ID NO: 39207 - DNA, 146 bp, Chlorella protothecoides
ctgcaagtgtctccaaagctgggtgcaagtacatttaggtgggactgcttgtccatacagcagcatatcaccccagcgcctgccagtcattgacatgaacaaccacatcgaccccccggctgctcctccggaggcttacagaagca

SEQ ID NO: 39208 - DNA, 61 bp, Chlorella protothecoides
acagggagatggcccgtgtcgagaggggggtgctgaatcagatgctgagcatggagcggca

SEQ ID NO: 39209 - DNA, 79 bp, Chlorella protothecoides
atgggaggggtcacggaaggggcaggtgagggagcactccatcacggctgtgtccacaacacccagcagccagctgaca

SEQ ID NO: 39210 - DNA, 146 bp, Chlorella protothecoides
tgccctcctcctgaaaaggggatggagagccctgggttgatgatttacaccaccccagtcactccctctggaaattgccattgcaggcaccaggggcttcgtggggtgtgccttactacacaaagataccaacactgaatcacgag

SEQ ID NO: 39211 - DNA, 1564 bp, Chlorella protothecoides
  modified_base (432)..(441): a, c, t, g, unknown or other
  modified_base (808)..(817): a, c, t, g, unknown or other
  modified_base (1097)..(1106): a, c, t, g, unknown or other
ccagaccccagcgccgccgccgccgcgttgccgcgtgccaccagcacctccagctcgccgtccgcagccgcgtcgccggtgcgggccgcggcgtccgacacgcgccggcacagcacgtccagggccgccgcgaagcgcccgcagaacatgtacagctccaccgcctcctccgcctggagcaggagggtggtttggggcggggtggaaagcgggtggggggggatggcggggcgtgctggcatctggaatggagcaccgcaccctgtgcatgcctcgcaagacttcctcgcctacgccgcgccagaccccccggccttgggacatcgccatgcgaccccgggaaccccatgggcgctcgtcatgagcatcgccgagtcatgcccggccccgcccgccacccgcgcgcctggccattggcggcgcactggtccnnnnnnnnnngatcccatgggcgctcgtcacgagcatcgccgagttacgctcggcccccgccgccacccacgcgcctggccattggcggcgcactggtccgcgactgcctcgagcaccgcgccgcgcgccgcggcgtccgggaagaacgcggcgagggcgccggttcccgtgccgccgtcccccgagccgagcagcaggcctgtgggaggaggggagaagggggggtcgcaaggcaagcagggtcacgcgctcggggtacaggggtccaaggggcaggtcaggccgacgacacaggcgtggtggcgtgcgcacgtgcccggcaccctccacgaggctcgcgagcggggagcccaggcgtggcgggcggcccatgctnnnnnnnnnngggggagaaggggggttcgcaagaaaagcagggtcaagcgctgggggtacaggggtcccaggggcaggtcacgccggcgacacaggcgtggtggcatgcgcacgtgcccggcaccctccatgaggctcgcgagcgtggagcccaggcgtggcgggcggcccatgctgcgccccggcagggcgcgctgccttttcacgtgggctctggatgcacacatgcctgggctccacccatgcctcctggcacactcccaggaatgaaaccagcccccaaccccacnnnnnnnnnntggcagggcgcgctgccttttcacgtgggccctggatccacgcatgcctgggctccacccatgtctcctcacacacacccaggaatgaaaccagcccccaaccccactcaccaaacgcgcgagactcgaccaggagctcgcgcagcaggcggccacgcacctccagcgacccgcccatggcatcggcggccagcatgtagtgctccagcgccagctgggcgcgtggaaggggagcggcgatggggatgccaagcaagtcaccttgccaggccgaccacaaggcggtcgctcccggcacatggaccggccggcctgtgctgatcctgctcgatcctcactgcgcccagcggctcccccccccacactcccccaaccaccattctgacccatgcactgccaggccaggcccgcaacccctgccatgcccctgccctgcccccttaccccccccccccccc

SEQ ID NO: 39212 - DNA, 77 bp, Chlorella protothecoides
cgcacatgcccttgccacccacaatagatacaggggagaacctggcggactttgcacccggtttcttgttataccct

SEQ ID NO: 39213 - DNA, 61 bp, Chlorella protothecoides
tgagatattggagcggcgccggaagcattacggccccaacctggccctgttcttccccgag

SEQ ID NO: 39214 - DNA, 97 bp, Chlorella protothecoides
gatcctggaaggcgcgagggcgcgctccgccgccgtgcgggagggccacgtcacgctgttcaagtacctgcccggctgcatgcccgccgccttccgc

SEQ ID NO: 39215 - DNA, 69 bp, Chlorella protothecoides
acccggcctccgccgggcgcagggacctgcgaccccgatcccgtgcacgtcgtcttctccaacccggat

SEQ ID NO: 39216 - DNA, 93 bp, Chlorella protothecoides
gtgtagcctggtccggggtgggtgggtgaggttgagagggaatgcaggtgaggggccctgcagctgatgccaggccgacacatggcgcggcac

SEQ ID NO: 39217 - DNA, 61 bp, Chlorella protothecoides
gaggggggcttgcggcagagcggggcattgacattagcacagcgcaggttggccggccctg

SEQ ID NO: 39218 - DNA, 61 bp, Chlorella protothecoides
ggtctctgcaccccaggggtcccccaacccaccctaccgcttgcgctccgccttccactta

SEQ ID NO: 39219 - DNA, 61 bp, Chlorella protothecoides
cagatcgagtgcatgggctcggcgcctctgaaccgcttggccgtgatgcagcgcgaccgcg

SEQ ID NO: 39220 - DNA, 130 bp, Chlorella protothecoides
gggcagctgccgtgtgtgagatgcccgcgtacgacaaggactatgaggtgggtggctgtggaggtgatcagaccaaggttttgttacggggatgtacaccttatttccaccccgctgtgtatggtccgga

SEQ ID NO: 39221 - DNA, 94 bp, Chlorella protothecoides
gggggggggtgcaaggatgggatccgaagggtatgcctcaaagggtaccgagactcctcctcttcctagccggctctccgcttgcgcttgtcag

SEQ ID NO: 39222 - DNA, 74 bp, Chlorella protothecoides
aaagggacgcacgcctccagactctgctcagttgggggcgacagtgaggaagagggatctgaatggcgttccaa

SEQ ID NO: 39223 - DNA, 61 bp, Chlorella protothecoides
gatgccggccggtgaaggtgccggaacccgcctgacccttccctgcacgtcctccacagat

SEQ ID NO: 39224 - DNA, 66 bp, Chlorella protothecoides
ggcggcgtcttggggctggggctggggttgtacggggttggaggaggtggcacgctggttggtggc

SEQ ID NO: 39225 - DNA, 125 bp, Chlorella protothecoides
accgcgctcctcccaccttatccccaccacaattctcaatcacgtcgcctgtccgcacaacctcgaccctctcacctcccccccccgccttcaatcgccaggatccggcaagaccacgctgctgg

SEQ ID NO: 39226 - DNA, 99 bp, Chlorella protothecoides
ccgtgtcgcgaatcgacgggtgaatctcttaagcaattatactttctactcacttgtggaatctgctgtcgatcagcagtgccggcagatgccttttgt

SEQ ID NO: 39227 - DNA, 80 bp, Chlorella protothecoides
aagaacagcctgccctgcctgcacaggagggggaccgtgcgagtggcaatcacatgcccccagcagggcagcaccagcct

SEQ ID NO: 39228 - DNA, 95 bp, Chlorella protothecoides
cacttctggtatcgaacgccattatcagcacctcccgaagtagagcactccagcaccatattatatatccaagacatctactaaatacacgcgca

SEQ ID NO: 39229 - DNA, 1663 bp, Chlorella protothecoides
cccaagcccgcccccgccctctcctcccccctcgtcgccgccgccatcccctcctccacctccgccagccttacccgctccaaccctgcaagttcaggcaaatcctaccggccaagcagcttacactgtgaccacgaccacctattttcctgccacaatctacctctacaaagacgatgatctagcgtatacctggcatagtcctgataacaaatacttctacaaaacccccaccgatatcacctataattctggagaacattattgctttacttgcaaagctgttgacagcaacggtctggagtcccaaatgtcggagaaggtttgtgtcacattctgacgcactcgattgcactcctgaaccaccttggaggcgtcctggagatgcaagggatcaattcgtgccctttagattgcagaagagagtcgttgagccaagatcgatgatcctgcacaggtctttacgaccttgcactggagttttaggaacacacgcccccctaagcaatatgcgagagggaacagaagagcaacgcgggcaccaagttgtgcctgctgtgagctgggcgttgtctgggagatccattgttgtgggggctgacaagcccccgcaacggtgcaccgctgcatatgaccgtatttaggaatgttacagacaagaccccgaatgcggtgtgatggtcggatttcatagacgtcgcaaggcggagtggactctgtgcagagcgggaacaggtggaaggtggggaaagggcccggtcaaggggaaccctcacaatagcctaagacatcagctaccccttgagcaggtgagaggtcacgatttctgccagtgtgcacagacttctcagcaccttgatgcggaggcaggagattcatgaagctcgaggctcaacggcatcgaccccttctctgcgatggtgcgcaaaactgataaaagccattcagtgtccgagtgatgccgaccagaggtggatgattagtgatcagtgttcctcccaccagcggggttcgtggcggcaccctcggaggcgcggggaaatggcctcgagattgggtcacgcgaagcgtccctatcattccagtagtaattcagtagatgttggtagaatgggatgggattgcgtcctgggcacgatgttaagctcgcagtcaagatcgatctgagtcagggcgcgacgacgtccgggcaccgcccaggatggctgcttgatcgtcgatgtgacccagcatccaatcagggtcaagaagccattctgacttttggtttctgccttatcatagtactctatctgtgtagggtgtcgagtccgatttggcaaatggtcggaggcatgcccatccctttgtggaggcacaccgcgttcctgcgcgggcaggatcgtggctgctcctatcataagctcacttcgcttcaccatgcttgtacatgctctgtgcacgggccgcattgagcatcccgcttgctgccggagggtgatgtgagcccactgcctctgagcaggtgctggagcacctgacaccgaccagcaagaggatttgagcagctgatggcgacgctttttgccctgagggatgctgcagtcgcgcacaatatgcccgcttgcaccgtgtgatcaccgcgcatggcgaactctgcagcgtggcgcaaggtgcagcaatg

SEQ ID NO: 39230 - DNA, 72 bp, Chlorella protothecoides
accgcgatcgtgtggcgcaaaggcatcgtgcggtgggagggtgtgagtcgggaactgcacagcaaacagcct

SEQ ID NO: 39231 - DNA, 61 bp, Chlorella protothecoides
agacctatgaggcatgtctgcaccccccccacacacccccaccccaccctcgtgttgacct

SEQ ID NO: 39232 - DNA, 80 bp, Chlorella protothecoides
tgcccaggctgacgctggtcttgatgttcaggctggccccggcgttaaacttgtcggcatagatgtaggtagtggagggg

SEQ ID NO: 39233 - DNA, 61 bp, Chlorella protothecoides
tcgcgtatccttcgtgagtgcttgacccagtggctggcctttgttgaggtctgggctccgt

SEQ ID NO: 39234 - DNA, 89 bp, Chlorella protothecoides
ggctcccagggaccctacccaccttggctacagtctgaccaggcataggcattacctcctggatgacgtcctttgccaggaacagctcc

SEQ ID NO: 39235 - DNA, 119 bp, Chlorella protothecoides
gggggggggcagcgtggggggcagcgctatgtgcttcaggatccctgcaactgccctgcaaggggactgtgtggatacctggccgggcatcttccccccttcaccagtacctgtgcacg

SEQ ID NO: 39236 - DNA, 76 bp, Chlorella protothecoides
aggctgaaaaggggggcctagggtcctggctgggggcagagggatcgtgttttgggaggggagtagcctcttttgc

SEQ ID NO: 39237 - DNA, 62 bp, Chlorella protothecoides
ctcgtgaagttgctgtgtacaggtagttccaggagcgaagcagcaaggaggttctgggagga

SEQ ID NO: 39238 - DNA, 76 bp, Chlorella protothecoides
ctcggccgcatctgcccgggcctcggccgcgcttgcccgagcctcggccgcgctcgcccgagcctcggccgaggta

SEQ ID NO: 39239 - DNA, 84 bp, Chlorella protothecoides
atgcctgcacacagagaaatttgcctccgtcaccaacggcatccctgtctgccaagccttgccgtggcaatcacatcttcaccg

SEQ ID NO: 39240 - DNA, 128 bp, Chlorella protothecoides
gagatcaatgaccgcctgcgtcgatgacccaaagatcttccctccacccccccgcgatggccattacgcagtcattcgccagcgcaatccggtgcaaattaggggcattagaatggaatatccagtag

SEQ ID NO: 39241 - DNA, 113 bp, Chlorella protothecoides
gccacgagtatacggcgacgatgcaaagtcatttcataaaagataccgacctttggacataaagtgcacgagagcgacaacctccggcacctcatatgcttgccttggctttg

SEQ ID NO: 39242 - DNA, 127 bp, Chlorella protothecoides
cgtgcagatgggcaacgtgcgccgcgccaatgacatggtggcccaggccggcgccgagatcctgcgcgtgcatgagggcctgcccacactgccatatgtggagccagccctggtcaagtcgtgcacc

SEQ ID NO: 39243 - DNA, 104 bp, Chlorella protothecoides
gtacagattcatcctggggggtgcaggttcaagtggagggccagtgatgggcaaaggggaaacatcaagtgttccccaggcactccccagccccaagcaggccc

SEQ ID NO: 39244 - DNA, 61 bp, Chlorella protothecoides
ggcacgcagaatgagggtcccatcctcctcacccgccacgcggccaacgccacgctgctgg

SEQ ID NO: 39245 - DNA, 61 bp, Chlorella protothecoides
tgaaccctgcggtgggtgtgttgttgtgaaaccagggggcagagggagagagagctggatg

SEQ ID NO: 39246 - DNA, 101 bp, Chlorella protothecoides
gtcaagaggtccgtggcatcgcttcaacaggccccttcaccctggggcagcaggcatgattgcggtccacccacacaccagtatattggtgagcaatgcct

SEQ ID NO: 39247 - DNA, 73 bp, Chlorella protothecoides
gatattacatccatatagttgccagtggacaggtcaaggtcctttatgctcctccgccgggccctggccgtgt

SEQ ID NO: 39248 - DNA, 67 bp, Chlorella protothecoides
tgctcacgccggtctgggacactctgccccgcggaatccgcgcagacatgccgcgtgcgaccttctt

SEQ ID NO: 39249 - DNA, 61 bp, Chlorella protothecoides
ccacgggcagcgtaggcctgctgcggctggggtggggccgacggcagggctccccgctgcc

SEQ ID NO: 39250 - DNA, 61 bp, Chlorella protothecoides
cctcatgcgagtgccattagaaaaggagggacctgctgaccaagcctggccccggacggtg

SEQ ID NO: 39251 - DNA, 148 bp, Chlorella protothecoides
ctcacccactccaaggaagagggcccctcaggcctgctccggggcggacgccgccccggtcccgcggtgggcgctgcaacccctgcaaccccgctcacctgggagatcgggcaaccgagtcggtgagcaaggtcttcaggaccctcag

SEQ ID NO: 39252 - DNA, 61 bp, Chlorella protothecoides
tgggcaccccgaataacacaaatgacctccgcccctacatgctgctcccagatcccaagca

SEQ ID NO: 39253 - DNA, 106 bp, Chlorella protothecoides
agcgggacgcggtgagtcctgccggggtcaaagggggagtgggatggggataccaatctggggccatcgtgggtgatggaaccgccgggcaaacgtcagacttgtg

SEQ ID NO: 39254 - DNA, 76 bp, Chlorella protothecoides
gattgtttgtggatgacaagcacaatgccactgcttccaaggcttggcccctactaaaacgatcgccgtccctgcc

SEQ ID NO: 39255 - DNA, 116 bp, Chlorella protothecoides
caggcactgcacacataggtgaatggtgggagatttgcatcgggtgtcctggccacattgtcccttctcatcctacgcccatatcgagcgccgacgcacaccgacgccgtgagcgt

SEQ ID NO: 39256 - DNA, 79 bp, Chlorella protothecoides
ccctggcaagagatccccagtcgccacgtgaaggctgacctgaggcctcgctgaccttctctgttgctcaccaatcccc

SEQ ID NO: 39257 - DNA, 78 bp, Chlorella protothecoides
gtaggtggtgtcggggcggcgcacctcccacgggttgccctcgtccagccagtagtcggggacctcgatctgataccc

SEQ ID NO: 39258 - DNA, 87 bp, Chlorella protothecoides
aatcgagactgggaaaggtaaacactcaaagtagcagtgatcaaaggaaaactggaaaatggtgggtgtctgctcagggtcgaaccc

SEQ ID NO: 39259 - DNA, 582 bp, Chlorella protothecoides
  modified_base (121)..(130): a, c, t, g, unknown or other
  modified_base (221)..(359): a, c, t, g, unknown or other
cctacaaggtgaacgcatggttgtggagatcagcacggagggcgagagatgagcgcaacagtcgttacatggcatcaagcatccagtcggatgctgattctcaataacagttgcccggccnnnnnnnnnntagtacggagggcgagggatgagcgcagaagttgttacatggcatcaagcatccagtcgaatgctgattctcaataacagttgcccggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcagcaccttggttgacctgcaggaacaggtggcatggagacagcctgagagttggcctcagagtcggacaggagtcatcatttgcatttcaatggtgacctcctcgtacctgagacactgcgatggctgccgccttgtcatagttgccgtccacgatcgccttcttgtagatagacgacccagcaacattgcaccgctctccaatgttcaaaaaggtgct

SEQ ID NO: 39260 - DNA, 68 bp, Chlorella protothecoides
agtcatgtcagtctaccaaccgccgccgccaccaaagtcgccgccgccgccaaagtcgccaccgccac

SEQ ID NO: 39261 - DNA, 355 bp, Chlorella protothecoides
  modified_base (112)..(303): a, c, t, g, unknown or other
agcaagcagggcgggggacctacgcctgcctggaggggaaggatgcctccgcgtcctttgaggagccaccctgtgtttctccccgccattgccccgcggctgcagctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccactccctgcccaacatcagctcaacgctcccttgcctgcgtcctcccc

SEQ ID NO: 39262 - DNA, 79 bp, Chlorella protothecoides
tcaatatttatgcatgtgacggaggagcctgacgaagcgcccgtaatctttcaacaagggattcctctagttttgcaag

SEQ ID NO: 39263 - DNA, 106 bp, Chlorella protothecoides
gccggcagagaagggaaagaccattcccaatgctggcgagctggccaagccgctgaacaacaagtgggcgaccatggggttcagcaccacaatcccggaccaggtg

SEQ ID NO: 39264 - DNA, 61 bp, Chlorella protothecoides
catgggatggccttgcagcagggcggcgccctccgagaaggggcgacgggacgacagcagg

SEQ ID NO: 39265 - DNA, 63 bp, Chlorella protothecoides
ctgaggagcgcccagaggggtggctcctgcggcgggggggggccggggggggggggggggggg

SEQ ID NO: 39266 - DNA, 61 bp, Chlorella protothecoides
gcggcgccggcgcggtcgcccgcgccgccgacaccgccgccctgcgccgcggcctggaagc

SEQ ID NO: 39267 - DNA, 71 bp, Chlorella protothecoides
atcccctcatccattacatcaccccccccccaaatacaacaacaacaacaacaacaacaggctcggcagta

SEQ ID NO: 39268 - DNA, 96 bp, Chlorella protothecoides
cacagcgctgctcactgcggaagaagggagcggcggaggggggcggagcaggagtgggcaaggggcgaagggggcgagtgggctagggcgagagca

SEQ ID NO: 39269 - DNA, 79 bp, Chlorella protothecoides
cgctggctggcgacgcccttttcgtcagctactttggctttatgggaccaggggcgcacctgtattacttgactgacaa

SEQ ID NO: 39270 - DNA, 145 bp, Chlorella protothecoides
gcgcagaactggtcgtgtcagagagggatcagtgccgctgccgcccggcatacatgaccttgcacgatctacgtgcatccctgctcttcagcaccgcgcattggtgctgaccttcgttgtccagtggtccagtgccagatgctca

SEQ ID NO: 39271 - DNA, 462 bp, Chlorella protothecoides
  modified_base (174)..(400): a, c, t, g, unknown or other
cacgtctcccacgccgcgtcctttgacgagtgagttcctgctcggcccagcgcttgcatggctgctgcagtcacagggacttgctgcagagggattcccacccgcaaccccccccgctgaccgtcatccgcaggctgctggcagagctgccgcggagcgcgtcgcaggtcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcgggtcttccggtccctgcgagctcagccacagcgggccaccctgccgggcttgccggc

SEQ ID NO: 39272 - DNA, 79 bp, Chlorella protothecoides
gatggtccactcctgcgcagggtgaagcatttgctcgaggctttattttacgagatgcgcaggtcaggggtggtggcgc

SEQ ID NO: 39273 - DNA, 97 bp, Chlorella protothecoides
cataggcgtccaaggacggagggctgcgctgccaccccggccatggattgcacgacgcattcgcaggcatggaccagcccccagccacctccagcag

SEQ ID NO: 39274 - DNA, 81 bp, Chlorella protothecoides
agcccacccccgcgcccactcctgcccagcacacccccgcgcccactccatcccagcctgtgcccgcgccgactcctgccc
